United States Patent 7,750,207 (ZEA MAYS RIBULOSE BISPHOSPHATE CARBOXYLASE ACTIVASE PROMOTER) - sequence listing, part 6

SEQ ID NO: 7365 - DNA, 3192 bp, Zea mays
gccggcagcgacgtcatcgtcctcggcacctcccgcggctggctcgtccgccacgacttctccttcgaggacgcccacgatctcgacctcgggagcggccgttctggcgaccactcggtgcaccgagtgttcctggatcccggcggcaagcactgcgtcgccacggtagtccaccccggcggcgcagagacgtactaccaccacgcaaggtggccgcgacccaagctcctcccccgcctccggggcctccttgtcaatgcggtcgcctggaaccgccggcccgtcgcggaagcatcaaccaaggaggttatcctgggtactgagagcggccaaatctttgagatggccgtggacgaggctgacaaaagggagaagtatgtgaagccactcttcgagctcactgagcaaagagaaggcatcaaggacctgcagatggagactgctgtggttggaaattccacaagatactatgtgatggccgtcactccgacacgactttactcttttactggcattggttcactagaaactgtttttgctagttattctgatcgggccatacactttatggagctcccaggagagatacctaatagtgaactacatttctttatcaaacaaagaagggctaaacactttggatggctttctggatctggaatctatcatggtgaactgaattttggagcacaacacagctctaccagtggagatgagaactttgtggagaacaagggtttttttgactattcaaaattgggggattccggaattaaaccaaggtcatttgcattgtctgaattccattttctgcttctgattggggacaagattaaggtagtgaacagaataagtcagcagatggtggaggaacttgtaggtgatgatacacccggaacttcaagaggaataattggcctctgtagtgatccatctacaggacttttctatgcatatgatgaaagttctatattccaggtttccacttcagacgagggttgtgacatgtggcaagtttacttggatatgaatcattatgctgctgctttatcccattgccgtaatccgctccggcggccccccccccccccagttcaggctgatgctgcatttgctgcaaaagagtattacatagcagcatccttctatgcaaagataaattacatcctgtcgtttgaggagatcagcctgaaatttatatcaataggtgagcaggatgctctcagaactttcttattgagaaggctcgataacctcaccaaagaggacaagatgcagattacgatgatctcaacttgggctactgagctgtacttagacaagattaatcgtctcctattggaggataccactgtcaccattataaattcagtagcagagcctaatagctctgaatatcgttcgatagtaaatgaattccgtgcttttcttagtgacagcaaagatgtattagatgaagcaacaacaatgaaactactggaaagttacggaagagtggatgagcttgtgtactttgccggtttgaaggagcagtatgaaattgtagttcatcattacattcagcaaggagaagcaagaaaagcattggaagtgcttcaacggcgcaatgttcctgtagaccttgtgtataaatttgctccagatttgatcatgttagatgcttatgagactgttgaatcatggatgatggcgagaaacaggttgaatccagggaaactcataccagcaatgatgcgttatgtgagcgaaccacatgcaaagaatgaaacacatgaagttatcaaatacttggaattttgtgtgaaagatttgaacaatgtggaccctggagtgcataatctgttgctatctctatatgccaagaaggaggatgaatcccagcttttgcaatttctcgacacaaaatttggtaaaggacaaacaaatggccctgacttcttttacgatccaaagtatgctctccgcctatgtcttcaagagaagagaatgcgtgcttgtgttcgtatttatagcatgatgtccatgcatgcggaagctgtggcacttgctttgaaggtggatttggaacttgcaaaggcagaagctgacaaagtagaagacgatgaagagcttaggaagaagctgtggcttaaggttgctaaacatgtcatcgagcaagagaaaggtgtcaagagagagaatataaagaaagcaatagaattcctttcggagaccaataacttgttaaagattgaggatatcttaccattcttcccagacttcgtattgattgacgatttcaaagaggaaatatgcaaatctctgaaggactacaacagccagattgagcagctcaagcaggagatggatgatgccacacgtggggcagataatatcagaagtgatattggtgccctcgctcagagatatacagtaattgaccgtgagcaggattgtggggtttgccggcgcaaaatattgactgttggagggttgcaccaggtagggagaagctatacatctgttggacacatggcccccttttatgtgtttccctgtggacatgccttccatgcaaattgcttgattggacatgtgactcgttgcagtaaccaggtgcaagctgagagaatattggaccttcagaaacggcttagcttgatggacaggaaagcagcaaaagacaatggggcaagtgttaatggcgaacctattacgagcacaaccccagttgataagctgagatcacagttggatgatgctgtagcaagcgagtgccccttctgcggtgatttgatgatcaaggagatttcacagccgttcattctcccccaagagtcggatgaaaaggcatcatgggaaatcaaacctcaaccaacgcctcaaaagattctcccgatgaccatgtctatttgatgctacggacagtacagcctaagatggatttggttttaaatttttatattgtttttgacttttgacactccttttgaccatgttttaatcctttttatgttgtggtatatggtattcaatatcctactgctgttgggttatcttgttttatatttacccaacttgtaaccctagaacaatgtagtcatcaatcgcttaccttgtggttgtggttcttgtattggatgcatcgtgttggaacatctcggtacacttgttatttgggattgtttttttttccgaagtcttgctccggaa

SEQ ID NO: 7366 - DNA, 1316 bp, Zea mays
aaaccgaaacaaacagtcactcatcctctttctgtctttcacccccgcgttcacgccggcccaaaccccaaatcgcacgcgtcatcccaatcccaacccaattagtcaattacgacacgcctgccgccgccacgccgcccgaaatccggaggggaagctcctcgacgacgtagcggccagtggcagctcggacgatggcctcgtccaactccgccgccccggctcccgccgacgggggcgacgacctcgaccagctcctcgacagcgcgctcgacgacttcaccaacctcgatctctctgcctctgccgcccccaaaagctccggcgaggcatcggggtcaggatcgggaggcaaggggccagtgaaggggctggggctggggcttccggaccccaaggcgccgaagcggcgcgcggggaagcagccgccgccgaggggcgcgtgcgccaaagaggcgctcgaggagctgacgcgcgagacgcgggaggctgtgcgcggtctcgagacggccactgggagtgtcccgtcactggacgatgacgccatgatggaggagtttgtcaagcagttccaggagttcgcaggggcacaggatatggactccattgttgaaacaatgatgcagcaacttctgtccaaggagattcttcatgagcccatgaaggacattgtagaaaagtatccaaaatggctggaagataataaagataagataagcaaagaagaatatgggcgttataataatcagcttgaactcatggtgaagcttattgaggtctatgaaaatgatcctgagaacatgactaggatttttgacatcatgcaaaacatgcaagaatgtggtcaaccccccagtgatcttgtccaagatattgtacctgatctggatctaagcaagttgggacaactgtctcctgagatgcttgaatcagctccaaattgttgcgtaatgtgaggaccaaaagcattccatttgggattcgaattccatgaagttttctttacctgtacgaacccccctttctggctttagtagattgaagataatttccatctggataatctgtaaagccttgcaaatatataatgagttcaatgttctttctggttcttgaatggaatctatattctttctgttgatgtactgtaacactcccttccctcttatacaatgagtacatgcattgcctttcaaaaaaaaaaaaaaaaaaaaaaaaaaaaaaaaaaaaaaaaaaaaaaaccctccatcaaaaaaaaaaaaaaaaaagcggccgttttaaaggatccaagtttacgtccccccccatgcaacgta

SEQ ID NO: 7367 - DNA, 1107 bp, Zea mays
cctcgaggccggccggggcgcctccagcccgccacatctgtcacaccgcccaaagttcggagggaagtcctcaacgacgtcgcggccatttgcagctcggacgatggcgtccaattccgcggccccggctgccgccgacgggggcgacgacctcgaccagctcctcgacagcgcgctcgacgacttcaccagcctcgacctctccgcatctgccgcccccaaaagcgccggtgaggcatcggggtcaggatcgggaggcaaggggccggtgaaggggctggggctggggcttccggaccccaaggtgccgaagcggcgcgcggggaagcagccaccgccgaggggcgcgtgcgccaaagaggcgcttgaggagctgacgcgcgagacgcgggaggctgtgcgcgagctcgagacggccactgggggtgttccgtcactggacgatgacgccatgatggaggagttcgtcaaacagttcgaggagttcgcaggggcacaggatatggactccattgttgaaacaatgatgcggcagcttttgtccaaggagattcttcatgagcccatgaaggacattgtggagaaatatccaaaatggctggaggataataaaaacaagataagcaaagaagaatatgagcgttataataatcagctagaactcatggtgaagcttattgaggtctatgaaaatgatcctgagaacatgactaagatttttgacatcatgcaaaacatgcaagaatgtggtcagccccccagtgatcttgtccaagatactgtacctgatctggatctgagcaagttgggacagctgtctcctgagatgcttgaatcagcaccaaattgttgcgtaatgtgaagacaaaaaacattccacttgggattcaattccatgaagtttcttagcctgtacgaaccccctcccccctttctggcttgagtagattcaagataatttccatctggataatctgtaaagccttgcaaatatataatgggctcaatgttctttctggttctttctgttatttttctgtaacactcccgtcgttcctatatacataccttacgtgtcgaaaccccttacgttttgaactcgagggg

SEQ ID NO: 7368 - DNA, 2058 bp, Zea mays
  misc_feature (681)..(681): n is a, c, g, or t
aacaccacagtggtggaaggaaaggaaacgggagggagagaaaaacccaggccccccgatctcctcctcccactccgatcgcccgaccgatcgccgagcttccccgttccctccccgccccccgcgacgccgcgacgccatggagctgccgcacgccgagcaggccgtcgccgctgtagcagcaggaggagagggcggcaccgcaagcccgggcaccgtcctcgaagggccggtgcttaggcgggggctggacggcggtggggaaggggaggacggggagctgggggcggggcaggaggcggacgcacggctaccggagcggcctggcgaggcggactgtggctactacctccgcacgggcgcctgcggcttcggggagcgttgccgctacaaccatccccgcgatcgtggtggcactgagtttggtggaggtaccaagaatggtgcagcacaagactttccagaacgacagggccaacctgtatgcgagtattatctgaagactggaacttgtaaatttggctccaattgcaaatatcaccatcctaagcaagatggatctgtgcagtctgttatattaaacaacaatggattccctctacgcctgggtgagaaagaatgctcctactatatgaagactgggcaatgcaagtttggttctacatgtaaatttcatcatcncagaatttggtgggtattccggtgacccctggaatatatccaccattacaatcaccttctgtgccctcccctcatacatatgctccaaattggcaaatgggaagatcacctgcagttcctggatcatatataccaggttcatacactccaatgatgatctcatctgcggtgcggccgtcgcaaggatggagcccttatccggcatcggtaaatcctgtggcatcaggggagcacaacaaactgttcaagctggaccgttatatggtataggacaccatggatcttccaccgcaattgcttatggtggtacatacttgccatattcttcctcagctggacaatcgagcaataatcatcaagaacatggatttcctgagcgaccagggcagcctgagtgtcaatattatatgaggactggcgattgcaaatttggaactacgtgtaaatataaccatcctcgagattggagcactcctaagtccaattacatgttcagccatctatgccttccacttcgtccgggtgctcagccttgtgcgtactatgcccaaaatggatattgcagatatggagttgcatgcaaatatgatcactcaatgggtacactaggctacagttcatctgctttgccactatctgacatgccaattgctccctatcctattagcttctccgttgccacgttggctccatcttcgtcttccccagaatatatttcaactaaagatccatctatcaaccaagtagcatcaccagtggcggcacctgaacctgttggagcaatcttgccaaaaggggtattccctccggataccattatgcgaactcagacttctacaagtgttggcagttcaagccctggtggtggtcgctgatttttctgagctggtgggagtgatcctatcagcacaatttttttctgtcacttgacacaggcctttacaatgtgaataagaagctgtggcctctgtagagaagccgtggcgagggtggttttctctaccatcagaataagagagcattgatcggttacaagcaagctcgattcacctgcaattttttgcgttgttccgttcgtgtccaaaacgggaaaaggaaggtttttttttttttggatgtcaggttctatagcatgttgggcgcggttgtgaggctccaggtccattccctcggtaaataattatggggcaagaaagttttcgttgttatcaagaaaattttcacacgcagagttactgggttcctccgcctttcaattttttttgttctatgtatattgttatatatatagtacacacatatatatcttcatcagacttgagacatgtaattacgtatatatagatgtttatattgggagcaaaaaaaaaaaaaaaa

SEQ ID NO: 7369 - DNA, 2630 bp, Zea mays
accagaggaaacgagagagagaaaaacagcccgatctcctcctcccactccgatcgccctaccgatcgccgcctcgtgaagcttccctgttccctccccgccgcccgcgacgccatggagccgccgcacaccgaggaggccgccgctgctgcagcaggaggagcagagggcggcagcgcaagcccgggcaccggcctcgaagggccgatgctgaggctggggctggacggcggcggggagggggaggacggggagctgggggctggggaggaggcggacacgtggcttccagagcggcctggcgaggcggactgtggctactacctccgcacgggcgcctgcggcttcggggagcgctgccgctacaaccaccctcgcgatcgtggcggcactgagtttggtggaggtgccaagaatggagcagcacaatactttccagaacgacaagggcaacctgtatgtgagtattatttgaagactgggacttgtaaatttggttccaattgcaaatatcaccatcctaagcaagatggatctgtgcaatctgttatattaaacaacaatggattccctctacgcccgggtgagaaagaatgctcctactatatgaagactgggcaatgcaagtttggttctacatgtaaatttcatcatccagaatttggtggtattccggtaacccctggcatatatccagcattacaatcagcatctgtgccctccccccttacatatgcttcaaattggcaaatgggaaggtcacccgcagttcctggatcatatatagcaggctcatacactccaatggtgctcccatctggaatggttccattgcaaggatggagcccttatccggcaccggtaaatcatgtagcatcaggtggagcacaacaaactattcaagctggaccattatatggtataggacaccatggatcttccactgcaattgcttatggtggtacatacttgccatactcttcctcaactggacaatcgagcaataatcatcaagaacatggatttcctgagagaccagggcagcctgagtgtcaatattatatgaggactggagattgcaaattcggaactacatgtaaatataaccatcctcaagattggagcacttctaagtccaattacatgttcagtcatctctgccttccgcttcgtccgggtgctcagccttgcacgtactatgcccaaaatggatattgcagatatggaattgcatgcaaatatgatcacccaatgggtacactaggctacagttcatctgctttacccctatctgacatgccaattgctccctaccctatgggcttctctgttgcgacgttggctccatctccatcttccccagaatatatctcaaccaaagatccatctatcaaccaagtagcatcaccagtggcggcacctgaacctgttggagcaatcttgccaaaaggggtattccctccggataccattatgcgaactcagacttctacaagtgttggcagttcaagccctggtggtggtcgctgatttttctgagctggtgggagtgatcctatcagcacaatttttttctgtcacttgacacaggtacctttagcctccgattgtatttttcatcatctcgttaaaacatactgctgccgacaaatgattattatcttgctttattgatatcagttctgacaaaaaaaaacaatgtgaataagaagctgtggcctctgtagagaagccgtggcgagggtggttttctctaccatcagaataagagagcattgatcggttacaagcaagctcgattcacctgcaattttttgcgttgttccgttcgtgtccaaaacgggaaaaggaaggttttttttttggatgtcaggttctatagcatgttgggcgcggttgtgaggctccaggtccattccctcggtaaataattctggggcaagaaagttttcgttgttatcaagaaaattttcacacgcagagttactgggttcctccgcctttcaattttttttgttctatgtatattgttatatatatagtacacacatatatatcttcatcagacttgagacatgtaattacgtatatatagatgtttatattgggagcaaggcgcattgtaatggaccgaaaaatgctgaattgaagagatcttgctgtcgatactgaaagaaaacagccaagaacccaacttgacactttatggtggggtcctctttaatagtaccgttgtttcataagtacaccgtttcatagagtggttttgtcctaagccaaagtgtctttttttaatcaaatttaatagagaagattatcaatatttacaatgttattaaaatatcgtttaaaacaaaacgctgtttaaatgaagtttaaaagctaaaacgctatcaggagtctaaaacgttgtaacgtttaaagaaacaacgtaaaagatgtttttttttggcacttgtgttttagacctcgtgcccaacagcgaatttggtccagtccatttacgttttagggggtgtttgaatgcactaaaactaatagttagtcactaaaattagttgagacatccaaacacccctagctaatagttcaactattagctatttttagtaaattagttaatagttagg

SEQ ID NO: 7370 - DNA, 1613 bp, Zea mays
gcacgagaccattacctagaacatcctaatcgaaaaattcagagtgctatgctttctgtcaagactaattagcacgcccaaagttttctatcgttaattggttgtactacacgtgccagcagcagcagcagcccagcccaccgtggtgatgcagcccagcccactgcggtgatgcagcccagcccatacaacggcccggggcacctgacctctgacagctaggtttttgcgaagggtttagccccgccggcactcggcaacaattccacctgtctgcctccctccctccctccctccctccgcactgcttctcctctcctcgcggcgcgcatccatggcggcctcgtccgcctccctcctcgcccgtcgcctcatcatgtcccgccgcttcctgtcatccccactcggctccctctctaccaccaccgcgacgcgcagtttctcgatctcttctcccgggtttaaaagcttcgttgtggagtccgaccttgagaacgagcaggaccagccccccgcggaccagaaccgccagcagacgtcgaacagcccgcgcccgcccgacaccacccgccctctcgagaacggcctcgaccccggcatctacaaggcgatactggtggggaaggtcgggcaggagccgatgcagaagcggctgcggagcgggaagaccgtcgtgctcttctcgctcggcaccggtggcatccgcaacaaccgccgcccgctggatcgcgaggagccgcaccagtacgccgacaggtgctccgtgcagtggcaccgcgtctgcgtctacccagatcgcctcggcaccgtcgcgctcaacaacgtcaagactggcactattctctatttggaaggaaatcttgagaccaaagtgttctgtgatccaattactgggctagttagacgcataagagaaatagctgtgcgttcaagtggtcgtctcttgtttctgggcaatgacgccaatgctccaaagttaggcgaagtcaagggcgtcggctacttctgatattggtttatgtttaactgagcataccagttgcagggacagagtcatcataacggtgttactttactggaatctgagtggaccaacaaatcctggcggcgattcgagtcttttgccgtgttgaattttaccagattcctgttttgtcaagctctcagcaccactgtagataccttgtaatcgttgtaacagcaacatgtaggatgtgtgatcagtaatctgtactatccttaaagtactagtttcaacggtcgttctgcgtcatatttttacaaataatcactcacatctatttcaaattaaccttgtatcccttcatacacataacctccacgtctggcccgctaaccagtcggtggataaattaaatatggtgcaggaggtggggtttgaacctgaacctgatgaaagaagggcgggagacactaagtgaagtcgtctgttttttttaatattgaatataaattttacatatgtttatacgagttttgtaaaataaaatatatatatataaaatcatgttgaaccggatcagcactacgggtcgaggctacggtccaatcacgacacgatgatcgtgtcggtctggtctaggcactattaa

SEQ ID NO: 7371 - DNA, 1051 bp, Zea mays
tgggtacctcgaggccgggttttagccccgccggcactcggcaataatcccacctgtctgcctccctccgcactgcttctcctctcctcgcggcgcgcatccatggcggcctcgtccgcctccctcctcgcccgtcgcctcatcatgtcccgccgcttcctgtcatccccactcggctccctctctaccacaaccgcgacgcgcagtttctcgatctcttctcccgggtttaaaagcttcgttgtggagtccgaccttgagaacgagcacgaccagccccccgcggaccagaaccgccagcagacgtcgaacagcccgcgcccgcccgacaccacccgccctctcgagaacggcctcgaccccggcatctacaaggcgatactggtggggaaggtcgggcaggagccgatgcagaagcggctgcggagcgggaagaccgtcgtgcttttctcgctcggcaccggtggcatccgcaacaaccgccgcccgctggatcgcgaggagccgcaccagtacgccgacaggtgctccgtgcagtggcaccgcgtctgcgtctatccagatcgcctcggcaccgtcgcgctcaacaacgtcaagactggcactattctctatttggaaggaaatcttgagaccaaagtgttctgtgatccaattactgggctagttagacgcataagagaaatagctgtgcgttcaagtggtcgtctcttgtttctgggcaatgacgccaatgctccaaagttaggcgaagtcaagggcgtcggctacttctgatattggtttatgtttaactgagcataccagttgcagggacagagtcatcataacggtgttactttactgggatctgagtggaccaacaaatcctggcggcgattcgagtcttttgccgtgttgaattttaccagattcctgttttgtcaagctctcagcaccactgtagataccttgtaatcgttgtaacagcaacatgtaggatgtgtgatcagtaatctgtactatccttaaagtactagtttcaacggccgttctgcaaaaaaaaaaaaaa

SEQ ID NO: 7372 - DNA, 1473 bp, Zea mays
agaaaaatagtgacagaagttcacactgtgcaagagcaccaactatgaccacaagtcttaacacatcactgtctgctttgttctggcatataatcacgtttcttatggattagagataattacttttgacgtacagactatactagctgcatgccgttcttaatatctctttctcccagagaacaattagatccatactaacatcatactatgcaagtcacatttgatttgcagtcaatcccattgtacctgtccgaaatggcgccaccccgataccgcggggcaatcaacaacggcttcgagctctgcatcagccttggcatcctgttcgcgaacgttctcaactatttcgtcataaaaatcacagcaggatggggatggaggatatccctgtccatggccgcactgcccgccgcattcctaaccatcggcgcgatcttcctccccgagacgccaagcttcataatccaacgtgacggcaacaacacggacaaggcaagggtgctgctccagaagctgcgcggaacggcctcggtccagaaagagctcgacgacctggtccgtgctagcgacctctcacgagcaacccggtacccattcaggagcatactcgagaggaagtacaggccgcagcttgtggtggcgctgctggtccctttcttcaaccaggttagcgggatcaacgtggtgaacttctacgcgccggtcatgttcaggacgatcggtctcaaggagagcgcgtccctcctgtcctcggtggtgacacgcctgtgcgcgacgtctgccaacgtcgtggcgatggtggtggtcgacagggttgggcgcaggaagctcttccttgccggcggcgtgcagatgatactttcgcagttcaccgtcggcgcgatcctggctgcgaagttcagggactacgaggagatgggtgatgggtacgcgtacctggtgctgaccacactgtgtgtgttcgttgcaggctttgcgtggtcgtggggccctctcaccttcttggtccctgccgaggtctgcccgctggagatcaggtccgcggggcagagcatcgtggtcgctgtggttttcttgatgacgtttgtgattagccagacgtttcttgaggtcctctgccgcgtcaagtcggcgacgttcttcgtcttcggtggatggatctgcctgatgacgttgttcgtttatctgttcctgcctgagaccaagaagctgcccatggagcagatggagcaggtatggaagacgcactggttctggaagaaggttgtgggggaggaagcggataggaaagaaacaggagcagggaagatagctttgtcgggcttgtcttagtcattttctgagtcgggtgtgtgtatttgatcaaaactgcaaagaaaaacatagtatacgatcgcgacaagctgatgtaaatgtacatttgtatgtaaatcgagttaacttatcagtctggcgttgttgccagttcct

SEQ ID NO: 7373 - DNA, 3834 bp, Zea mays
  misc_feature (285)..(285): n is a, c, g, or t
gatttttgaaaaccctagatctcgcctactgggagggaccccgttagggaggagagttccaggaggtgcccttggatcggcaggccaccggcgacgtcactagacgatgtagagtcgaaaagggatgaagatccaaggttaagaaagctaaactaggtctaaattacacctactcctaatgtgacgaagaatgaagtaaataaagtagatttaattgtttagtttgattgttggtgcgcgcaatcgaccgtacaccttcatatatataggggaagtctggatttnttcgaccgttcctagacattttccaatagaatccgtagatttagatgaataaacacgcacgaaaaaggagattaaaccatctaatttgatgttatcgcggatcgtccgtgcctagatacggaccgtctgcggcccggactgtccggcctcacctggtggtatatatggtgctaatacaattgttatatgaatctataaaaaaactaaaaggaattttaatttagaacaaagggagttttttttttttttttcggcactaaaaattactttagtcatctatctcgtctataaatagacatcttgtgcaccacacctacacccacacctacacctacacattacagccagtactgctgtcacctcacttagcaaagctaatacgtatgtcatagcagcttgccaccatggcgagcatcaccgtgacaaggaaatcccaatccttcgtcgtgccatcgtccacgccaactccgacgaccgagacgctcgagttgtcggccatcgaccgcgttccaggcctgcgccacacggtgcgatccctgcacgtgttccgccgcaaggacgccgccgcctccgccgcccactacgatgctgctgccgccggcaggccggccgaggtgatccgcgcggcgctgtcccgcgcgctggtggactaccgcccgttcgccggccgtttcgtcggctcactgtacgccggggaggcgagcgttgagtgcaccgacgacggtgcgtggttcgtggacgctgtcacagattgcagcctcgaggacgtgaacggcctcgactacccgcttatggtctccgaggaagagctgctgccggctccagaggaaggtgttgacccagccagtattccgattatgatgcaggtatacactttcgtcctaatgaaaccagaaaacttgcagcatgtatatatgacagttgtttctattattccatatgcatggataatgactataatatgcacatgcttttgttatgacaaacaattcatgcatataaagaatggccgaattggagaaacacttcatgcatgtcacccaaagcaactgtcatatttttttaggggctaatttttagcctctccattttattatattttagtctctaaattaataattaagaaaaaataaaactctattttagttttcgtatttaacaatttaaaaactaaaataaaataataaagaggaaccaaaaattagtttctagaaaacaaacacttataaacacagcatgagcaattatacttgcctagttgtggtagctagaaagtcatgagtgcagtcgtgcagaacgccacgtacctagccccatgtttccaccaaaagaagtataaagtcactcctttaggtatatatattgtctactcatacatatccccactactgcttttagtcaaaatccacacaactactacatctaaacaatgatgaagcgccttgtccatatatataataaacaagcaataagtcacaagcttccaattacacaaaaagtgttgcatacttctttaatctcatatatattcattagttattaatattttataattgctacatagtgcttaattttctattctcaattatttaaaacaccttgtcgccaaaatttattaatgaaacttaattgtgtgccaggtcacggaatttgcttgtggaggatttgtggtggggctagtcgcagtgcacacccttgctgacgggctcggtgcagctcaattcatcaatgcaatttctgagtttgcccgtggagtagttaaacctacaatagcacctatatgggcacgggagttaataccaaacccacctaaaatgcctcctgggccaccaccatccttcgagtgcttcgggttcaaacattttgttatggatgtggcagttaacaatattgcacatgtcaagagtgaatactttcaaaccaatggacactattgctctacatttgatgttgccattgccaaggtttggcaagctaggacaagggcaatcaagtacgaaccaaatttcaaggtgcatgtttgcttctttgccaacactcgccacctcctcacacatgtgctacccaaggttggtggcttctatggaaattgcttctatccagtgactgtcacagcaactgctgaggtagttgctagttcaagattgcttgatgtgattaggatgataagggatgggaaggctaggcttcctttagagttttccagatggtccacgggcaatgtgaaagtagacccatatcaactaacattcaagcacaatgttctatttgtgtccgattggacacggcttggattctttgaagttgactatgggtggggtgtaccaaaccatatcctccctttcacttatgcagactacatggctgtagcagttcttggagctccaccgtctatgaagaaggggactcgaataatgacacaatgtgtcgaggaggagcatctcgtggacttcaaggccgagatgaaagccttcttttaggtcctcggattttacttgaaagttcaaacattatgcatttatgtgttcaattcaaataaaaatggtgttgacttgtacccttattagccatataaaacataacatttatattttcatagattttccacgaaatatatatgtagaaaccagtgacccatggaaaccatgtacaatagttatgttttagttttttatcgtgtttatggtatgaaagtacatgtagtctattagtgtatttcttagatgcatgtgtactaatgtctgtccaagctatcaactacgacaagaaatctttcatcaataagtttttatatcaaaaagcaatatcctacaaacaaaaccaaaaccattatcgaataatggtaggtcataaagatgatcagatatcgtagatgcgtagaacttgtcacaatgattatgatccactgttaacttattccatatggttttcgaatgaatttttagagtgcatgctggtccgatccaatgttaacttcctccgagcaacctcctccatggtcacaagtttgtcccatgcctcttctcccatgtcttctcttccacatgccctccggtcacatggtggctgcaccactcctttctcagtaacacctcaaatcataactttgggatttaggaaaaatctctagggattttgaattaaaatatcttctaacaaggattttcttacctctgaaaccatctctcatatatttaaaatgttttctaataagaagatgaataaaaaatccctatatgaatttagttatccctttgttaaagtaaaatataaaagattttatagactagagattattttcttaaaatgcctactttggagtgtatgaatttaatattaaaaaacttaaagaagcataaaaaatcaataaatcaataaaactatggacttgcattcatgctgagatttatttgaatgattgcattaggtttgaatttataatttgaataaactagaagatagaaataagaaaagaaacagaaatggaaaaaagtgactaccccactagtctgggccgattacccacacatcggcccaacaaaccggccc

SEQ ID NO: 7374 - DNA, 1607 bp, Zea mays
ctacgccaagcccgcaattaaccctcactaaagggaacaaaagctggagctccaccgcggtggcggccgctctagaactagtggatcccccgggctgcaggaattcgcacgagaccattacctagaacatcctaatcgaaaaacccacacctacacctacacattacagccagtactgctgtcacctcacttagcaaagctaatacgtatgtcatagcagcttgccaccatggcgagcatcaccgtgacaaggaaatcccaatccttcgtcgtgccatcgtccacgccaactccgacgaccgagacgctcgagttgtcggccatcgaccgcgttccaggcctgcgccacacggtgcgatccctgcacgtgttccgccgcaaggacgccgccgcctccgccgcccactacgatgctgcggccgccgccaggccggccgaggtgatccgcgcggcgctgtcccgcgcgctggtggactaccgcccgttcgccggccgtttcgtcggctcactgtacgccggggaggcgagcgttgagtgcaccgacgacggtgcgtggttcgtggacgctgtcacagattgcagcctcgaggacgtgaacggcctcgactacccgcttatggtctccgaggaagagctgctgccggctccagaggaaggtgttgacccaaccagtattccgattatgatgcaggtcacggaatttgcttgtggaggatttgtggtggggctagtcgcagtgcacacccttgctgacgggctcggtgcagctcaattcatcaatgcaatttctgagtttgcccgtggagtagttaaacctacaatagcacctatatgggcacgggagttaataccaaacccacctaaaatgcctcctgggccaccaccatccttcgagtgcttcgggttcaaacattttgttatggatgtggcagttaacaatattgcacatgtcaagagtgaatactttcaaaccaatggacactattgctctacatttgatgttgccattgccaaggtttggcaagctaggacaagggcaatcaagtacgaaccaaatttcaaggtgcatgtttgcttctttgccaacactcgccacctcctcacacatgtgctacccaaggttggtggcttctatggaaattgcttctatccagtgactgtcacagcaactgctgaggtagttgctagttcaagattgcttgatgtgattaggatgataagggatgggaaggctaggcttcctttagagttttccagatggtccacgggcaatgtgaaagtagacccatatcaactaacattcaagcacaatgttctatttgtgtccgattggacacggcttggattctttgaagttgactatgggtggggtgtaccaaaccatatcctccctttcacttatgcagactacatggctgtagcagttcttggggctccaccgtctatgaagaaggggactcgaataatgacacaatgtgtcgaggaggagcatctcgtggacttcaaggccgagatgaaagccttcttttaggtcctcggattttacttgaaagttcaaacattatgcatttatgtgttcaattcaaataaaaatggtgttgacttgt

SEQ ID NO: 7375 - DNA, 2463 bp, Zea mays
tgtactgatgtagatagctctaacaggaagtctaatttactgggaaagaagcccacgggaagttggtgctaagagaaaaagaggacatcacaatggagagcaaaatgatgatttatctgactcctcagtggaatgcatacctgggggggagatctctccaggatgaaattgttgctgctattggtccaaagcatttctggaaagcaagaagagctattcagaagtaagtatatggtgcttgagtagctgttttgtagttttgtaccaagtatttgtagcattctttagacaatactattcatatgtttcactctgcttatttcctttttcttttagttttcagttaattgtcatatggaagacaaaagtatgaagatgataagtctgttgtttggttttcagtacctaactattctgttgtactattaaatataaactgtggataataatgaatgccttcaattttgattcttttaagtagaaaacatgggtagtttcatccaaaagaatagtatgttgcttgtaagactgatattgtggaatatttctttcttgcttcctggattgctgcataatgccttttttttatgttttacactctgtcctgttaaaatctacagtcagcagagggtttttgctgtccaagtgttcgagctgcataagctgataaaagtaagtctccaggaaatcgatacatctttcttcctttttccgttcataagtaggttatcttatgtgatacaattttgtgcacaatgctattataaccccgtttgtaattgacttccaaacaggtgcagaaattaatcgcggcatctccacatctgcttattgaaggtgatcctgtccttggcaatgcattaacaggaaaaaggaacaagcttcctaaaggaaattcgaaagttcagaccctgtcaatcacaaacaaagatgatatccagccaaccctagagcaaccagagttatcaaaacaagacacagaaggaaacttattggcccattctcatgatggtggacttggtgacaaccatcataatcaagctgcaacaaatgaaatctttacaagtaaccctccagctatgcctgttgctcctgacaacaaacagaataactggtgcatgaatccaccgcagaatcaatggcttgtcccagttatgtcgccttctgaaggtcttgtctataagccttttgccggcccttgtcccccagttggaaatctgctgacaccattttacgccaactgtactcctcaaggctgccttctacaccatatggcgttcctattcctcaccagccacagcacatggtccctcctggtgcccctgccatgcatatgaactacttcccgcctttcagtatgccagtgatgaatccaggaacaccagcatctgcagtggaacaagggagccatgctgctgcgccacagcctcatgggcacatggaccagcagtcgctgatctcctgtaacatgtcacacccgagtggcgtttggaggtttcttgcatcaagggacagcgagccacaggccagcagcgccaccagccctttcgacaggctccaagtccaaggtgatggaagtgctccgttgtcattgttgtcattctttcccacggcttcagctccgaatgtccagcctccgccctcatctggaggctgggaccgggaccagcagaaccatgtaatcagggttgttccgcgtaacgcccagactgcttcagtcccgaaagcccaacctcagccgtcatccggaggccgggaccaaaagaaccatgtaatcagggttgttccgcataacgcgcagactgcttcggagtcagcagcgtggatcttccggtcaatacaaatggagaggaaccaaaatgattcgtagctggttaccatatactttcgtgtcatccgatggcagcttagtgcagtattgcagtttacagggctacccgagctgcagattatggtggctcctgtattctgaccactgattgcgctttacccgatcgtcatagatattggatgatatgatcttgtgttctatgcagagtcgtaagccaaagttgtgcccctgaagactgaagtgacagccctgaagttgggagtccttcctgattgtgctatgactggaattggtatatatataggatacttgaacggtttcactgtgttgagctcatcacacggccgcgcttctgtaacatacaatacaatagactatgggtggtacagtaggaagcagcagtcagaaaatgactgctggtaccatgctacggggtcgctagagattgatgtgtaccggtactctggttctggatgtcgatgacctgaatcagatcggttatgtttactttccttgtatgtcggtgcttggttgcttttgcgactggtacgtacggttgtatttctgttatgcaaataatagaaatggaggttctctggtcaaaaaaaaaaaaaattaaaaaaaaaaaaaaa

SEQ ID NO: 7376 - DNA, 1986 bp, Zea mays
acgaaaggccatgctccatcatcatcgccccttcgtgggccccacgcccgcttcggttggagacggcccatacggtccaccgagaaccgtgtccacgccactccacgccatcttcctcctcctccctactctgacctctcgtcgtcgacgaaggaaggaaggattccgcccccgcccccgccccggccgccttcgccctcgccgctgcattttccggtggcctctccacgtgcggccgcgagacgcctcgccgcgtctgcctagttgtctccccgtggggggtgttcctgggacttgtgaggaagccttacacctgttctgttcaagacggcaggtgttggtgtttcggttgcaatagagtgattggggaaactgatcagccagaattgttggtcaaccgatgggaagcaatgaccctaacacaccctcgaaggcttcaaaggcgtcagaacaagatcaacctccagctaccaccacatccagtggaacagcttcagtgtaccctgaatggcccagctttcaggcctactcagcaattccaccgcatgcgttcttcccccctaccgttgctgcaaatccacaggcccatccatacatgtggggggctcagcccatagtgccaccttacgggacaccgccgccaccaccttatgtgatgtatccacctggaacagtatatgcccatccctctacacctcctgccatgcatccatttggccattatcctatgccaacaaatgggcatgttgaaactcatggagctgcgccaagcgctccggcaatttcagggaaaagcgagcctggccgaacgtctgctccatccgccaacgggattacctcgcacagtgagagtggaagcgagagtgagagcgaaggaagtgacgacaattctcaaaacgattcacactcaaaggacaatgatgggaaggaagatggcaattctcagaacggcatgtcttattcaggatcgcaaggagtggtaaaccaaaccatggcgatgcttccaatgcaaccgggtgcaatggtcggaggagttcctagctccacggcagctaacctgaatatcggagtggactactgggcagctccgggttctgcggctgtccccgcagcgcacggcaaagcgccagctggttcagctcgaggagaccaatgggatgaaagggagctcaagaagcagaagcggaagcaatccaacagagagtccgctcgcagatcccggctgcgcaaacaggctgagtgcgaggagcttgggcaacgtgctgaggctctgaggtcggagaactcctcgcttagggccgagctcgagcggatcagaaaggagtacgaacagctactttcacagaacgcttccctaaaggaaaagctgggggctgccagtagtgattcgcttcctgatatgaacgaacagaacgaccagaacgacggcgacggcggctacaggaagcagcctgattccgatggccaccagcctgggagcgagtcctgacccgtttttagctcaggattcttttggaatgcacattgcttatatattcattctcttgaacgttgtggaacgcagcataggaaggaaatccaactttaattagaatcgattcgctgtcatccctcatgcatggcgggagaggtcaggagagggttctcttcttccttggatgttggatacaccgacagtcacgtgcatggcaagagcagaagctagcagctgcggcgactcagggcagcgagcgtttgactggctggggtgcttgctgatatgctcaacacatgaagcagcagcagcctggagcgccagacattcctgactgagtgactgctcatcacgaccagagccaaatccaaatggaataaaaaaaacacacacacactacgtgcagcaatatcagctctccttttctttgtccatgaaaggaaaaacaacgtcacgggaacaattgcggtcagcttttctggaccgtccaccatgccttcatttcaaattcg

SEQ ID NO: 7377 - DNA, 3559 bp, Zea mays
cctgcagctgcatttgccacaggagaggtctgttcggctcatgctcgatcgggccattggccgggcatccagcgcgctgtctcctggccataggcatttccgggatttcccggcgcaggtatggctggctgactcatcggccgtttgccacctcctcagtttttgttttctccttcgtgggagttgctttgccgctaactcgcgcatctcacgtgacactcaggttagctgtagattgctcatttgcatatacagtgctctcgagtttgtctggattgggcatgcatggaaattcagctgtctaataaaatgacagctgtgaaaccaccggcatcgaaatccaggcatatatttttattttttctatttttgtttccactattgacagctagtttgtcaagcttgatgccagctcaaatacacagttgcccaagacaagggactatgcaagggctatccctcctactccatacacttcccctccgtttcaaattataacatgaatgattttattttttttgcgagagtaaagatattttagatttaatcaaagccatcaaaataaatcacaaagatttataatatcatcatcatcattattttattatataagtttggtcaaattcgagatgtatatcacactctccattatttccccaaccaagttagctaggatggcataatttggaatggaaagagtggcgttcttatcagagagatatataacgtataactgactataatgattgttgtattctttactcggtttctgaagactgatgactgttcttccctacagacaaaggagctgatagcggagatcgaattgctcgaggaggaaatcgccaaccgcgagcagcacgttcttactctctacaggagcatcttcgaccagtgcatgtctgggccaccgtctgggcagagctctggcatctcgtcccccgcgcacgccaaaactatcaccgctaggacacgaaggcagccgagcataatatcgagtgcattttgctcgtccaagaagctcccgctccagcccttccacatcacagagtcactctccgagtcgggaagaaccaagaacacgctcaaggctaagatcaagcacccatctttttcaagcgaaacattggatagcagccattctacttccttcccaccggacccaaaaaaggtaacacaacaattgcaagcaaataaagagttctcccaacaagctcagataacttgctgcaaacattctactgcaattcatataattttgacttctcttcttttgaaaaaagctaccttattctgggagtggcggctctcttgcccgcactctgaaagaccacctctaccaatgcccaagcaaaatatccgaagaaatggtcagatgcatggcatccatatactatcttctgcgcaccgaggcgccagcaggaaagcctgagaaggcccgctcgccattcttgtcaaggtcatcgacgaatgtcatccttcctcggcgggtgaacggagaggaaaacagcgcaccgaacaacaggtgcacggtggaaatagcttccatatcagttgacaagaaccagatgccagatgtctcttacgcgatcacccactacaggttggttccaaaagtaaatcactgcaaaaccatgccctgatcaaatggctctcctgaaaatcgcaagtaacagattccttctctcttgggtttttattaggttgcttgtggaacagcttgaaagagttgatctgagcgtgtcggagaacagcgttaagttggccttctggattaacgtttacaattcgcttatcatgcatgtaatgctggatatatatgttctacagcgacaagatttttttttatgctttatgcttttttttaaaaaaaaactttattaacctgtgtgttattcacttgcattgcaggcgtatctggcatatgggattccaaacagctctctgaaaagaatggcgctatttcacaaggtgagtagatttgtgattggccacaggaatatgtatcctgaaatgctctaatctgctctgacgtacacaccgtgctattaggacatcttctgtgttgatgttagtaacaagtaactcatccctattgttgcaggctgcctacaatattggagggcatgccattaccgccaatgctatcgagcacgccttgctgtgcttcaggtctccacggatcggtcgtgtacgtagatcagcaatttcatcccgaattacagtttttggttggttattgatgcaaagttggaaagttgagactacaattctaagcagggaaaaataaaataaaattacgttagcacctgaactactggatcacttaactacactggcaatttttgtgatggtaatcgactatcagttaactgaaacatccccttgttctctttcatcactccgagaaaaagatcgttttttaaatgacatgggatacatgaccacctgctaaactgagaacccaacgaatataatccatctgcagtggttcgagtccatcctctcgacggctatgcggaagaaatgcccggacgagaagcagctggtccagctcaagttcggcctgcaggagtgccagcctctggccctcttcgccctgtgcaccggcgcttcgtctgaccccatggtactcacatcctacgatgcctgttctatctctatctgatacacacaccatgatctgatctctaaccgttggtggccgtcgagcaacacgtttgcagctgcgggtgtacacggcgaagaacgtgatggaggagctggagcgcgccaagcgagagttcctgcaggcgacggtggtggtgcgcaagtccacgaagaagctgttcctgccgcgcctggtggagcggtacgcgagggaggcgtgcgttggccccgacagcgtcctcccgtgggcgcagcgcgagggggccgtcgccgtcgtcgacgaccggccgcagcaggaggccgcccagcggggcgtggggagccggcgcaaggccgtgcaggccgtagagtggctgccgtacgccaccagattccgctatgccttcgccaggagcatggtcgacaagccacactgctagctgcttcgcctcgcacagtcgcactcctcgcatcgcagctgttgccgtctggccccgtttccgctggagaaagacatctgatcgctgtggcgctgcctttcgcccggccggccgcgagggtctcgttgatgctgcgatgttgacggctagatagtactgctccgttccgtagtgaacaagtggcaaggatgggacgaagggtttgactaattttgcacaaggtgtacagaagctagttgatcgctattatttcaggtttcagcagcagtctgttggagaccatttgaattcattcgaattgtttatctacttggtcgtttgtatttccattggtgtgagcaacttgtccgatttgggacagcttcagctctagaaaatttggttggtgaagttggtggatagagcaggttattagatactccctctaggcctaaattttttgacgtttttggacagattctcacgtaccaaaaaaaccattaaggtctagt

SEQ ID NO: 7378 - DNA, 2147 bp, Zea mays
  misc_feature (1487)..(1487): n is a, c, g, or t
tttttatataaattgttttatacattgtttgctccctacaacaacaataaggtggaaattattcgaatttgtatcgaattttataactatcatttgagaagataatgaacatgagatttatcttttataaatatatataagcttaatgttaaaagtaaaaatataaatttgtgttatagatcctgtatcctatttattcacagtggggaaaaagataaaatatctaaataagtatccgttttcgtctcaatcaccacaaaagtaatgttgcggtaggtttacttgctccagaagtgctacccgacttttcgaacccctcctcgcaaagtgaagcaaatttccttccactctatccatccagaacccaacacacggtctccaaccccactgacaatttggtcccacatagtccatggccccagtagtcgtgggtatggaaatgaaaatggaattgaattgggaaacggaaacggaaaagggaaccgggaaagttacccgggccgggtgcagatttgcagaagcagaggcaaccactgcaccagtccatctccatgatgactcgctcgctccgcctgcagaggcaggcgaggcgagctcttcggctgcttgcttttgttgccttcctcccgctccaatttaatgccaccacaccagccaggagttggggccgcgcatcaatggcgtcacctctcgcatccagatctcacacctcgtcgtagctactaccttcgtctcactcctcctcgtccccttgctgtcgttcgttcgttccttctacctccatctccacttctccaccttggggttcttggcgcaccatccgagaaatgctgttctcctttttcggttttccattctacaagtgccagccttgccttgtctcggagtgttgacatctctacgtgctctggcccgccattaattccctcctccctcacactgctgctgctgctgctgaccgagggcgcctagccagtcacgcacgaaatcccagcgttccaattcaaacacacccttccttcttggctgctcctctcgacgacgcgaccggagcggagggagtcatggtggcggagccgctggtgcacaaggtgctctccatggcgacgtcgtcgtcctcctcctccaagaaggcgcggccggcggcggcgagcgccaacaagggcggcgcggctgcggcgggcgacggcaggctgggcatcctgtccctggaggtggccaacgccatgtcgcgcgcggcgaacctgtaccgctcgctctccgacgccgaggcggcgcgcctgctcgggccgctctgcctcggctcccgcgccgtgcgcgcgctggtcccgggcgacgacgcgcgcctcctggcgctcgcgctggccgagaagctcgacgcgctgaaccgcgtcgcggccgtggcctcgcgcctcggccgccgctgcacggcgccgccgctcgtgggcttcgaccacgtctacgctgacctcctcgccggccgctcnggcgccaccggcgcgctcttcgccgtggcctccgcgtccgacgccgcgtcgctcgtgcgcaggctcgaccgcctcgcggccgccaccgcggctctctacgccgcgctcgaggcgctcaccgagctggagcagtcggcgcggaagctgcccaccgacgaggcccgccgcgcgctggagcagcgggcgcggtggcgccgccacgacgtgcgccgcctcagggacgcctcgctctggaactggacctacgacaaggccgtgctcctgctcgcgcgcgccgcctgcgccatctacgcccgcatccgcctcgtgttcggcgaccccatgctggggctcgacctgctgctggccacgccgtccagcgagtcgtcgaggcaatgcgaccagagccggcggctctccggtccaataacagcaaactcaggccccgtccgaagcgatctcagtgattgcggcaactcagggccggtttccagagtcgatccggacatgtcgcggccagtgaatcttcggtcaggctgtggagcgagcccggggaagatgctcatggagtgcttgagcctgagcagctcggcgtcatggaacgatgggttcgaggacgagttcctggaagattccagccgcatcagcacgatcagatcagggatgctggtgccattcagc

SEQ ID NO: 7379 - DNA, 1458 bp, Zea mays
  misc_feature (1428)..(1428): n is a, c, g, or t
aggcctccctggctggctctcctctcgtcttcgccgcccctccatacttcccgctccgtccctctcccccgctttgaccacctcctccgccatatctctcctccccctcccttccgttccgcccaccacacgccccctcgcagcatcacaaatagagagagagaaaaacaaagaggggtcgacaggcactgacacgacccatgtcaatgtggcgcgtctcccgctccctcctccgcgccgcctcggcggccgggcgcggcgccgcgcccagccggtgggtcccgcagccgtgcgcgctgcagcgctgcggctacgcgttgctgccggaggcggcgaggagggacggggaggaggaggtgacggcggcagaggcgaggcgcctgatgcggctcgccaacgtagaggcgctcaagcggcgcctcgggaacggggaggtgatcccctacgcggacctgctgcgcgcgtgccaggactccggcgcggcccggacgcgcgccgaggccgcggcgctcgcggccgcgctcgacgaggccggcgtcgtcctgctcttccgcgacagggtctacctccaccccgacaagatcgtggatcttgtaaggaaagctatgccccttgcactgacacctgagaatgatccggggaaggaagagctcaagcagctccaggtgcagttggaagacatcaacaagcttgcacacaagcaggtccggcgcatcctctggtctggtctgggtttcttgatcacccagggtgggcctcttcttcaggctcacgttctgggagttctcctgggacgtcatggagcccatcacgttcttcacgaccacgacaggcctggttgtgggatacgcatacttcctcatcacatcaagggacccgacctaccgagacttcatggagaggatgtttgagtctcggcagaggaagctgatccagaggcagaacttcaacctggacaagtaccttgagctccagaggcgctgcaaggatcccctggagaaggcgtgcggcacgaccaaccctgacacggctcatcttcatgagctatccgttcacaaatgacaaaggattcaccattgcttcactactcattccattctatgggagaaatggtccctgctagcaatagtaagcggtgtttcagataccttttccacggtcttctcctatgcaaatgtgtaggtcagtataatttttttgggggtaaatttgtagcgatgctgaaacacaagctagttaaaagtcaagctcatccgcatggctggatgcttactcactacccagaaccgcgcgattctgtggtctctactaatatactgtttcattgtgcctaattagctttattatgaaaactcatttgttggtggctaatattgtcctaattagagacttgtatttgatcaaaaaaaaaaaaaaaaaaaaaaaganaaaaaaaaaaacctaaaaaaaaaaaaaaaa

SEQ ID NO: 7380 - DNA, 3619 bp, Zea mays
gcggccgcccgggcaggtactgcactccagttcaggtttaccaacttcatccatataccagcaatctgatgtcaagtatcagaaaaaatcagaataccagccaccggaaatcctggacagcagtgatttgcgcatacaactttctgctactaaaaggtttcttttaggaccagaagccagcattgactcaccatctttgaactctgtgctgagaaacagagtcaacagtgtaactgataccatttcagcttattacagtagatttgaaagctctctgaacccagattggcaaacaaaaacagcattaacatttcaaagcaattctcagggctctgaaataacggagttgtttgaccatgatcattttgaaccctactccagagaagatacaacaatttccttaggacagagacagacaaacaagtttaacattcgtgaggtctctccagaatgggcattttcctatgagatcaccaaggtcatcattacgggagattttctgtgtgatccatcgaatttgtgttgggctgtgatgtttggtgacaatgaggtacctcggccgcgaccacgctaaggtgttctccgctgccacacaccactgcacagcaatgggaatctcagaatctgcattacttcgggaaacagagaagtttgtagtgaattcaaagactttgagttccgctcaaaaccaacctcttctagtttcacagacattgcaccatcttctagacatctgaaatccagtgaagagttattacttcttgcaaaatttgctagaatgcttttgtctgggaatggaaaccgtgaagttccagatggtgatccccaatctggacagtgtccaaaacttaagacgaacgaagagctctgggataggttgattaacgaacttaaagtagggtgtgaaaatccattaagctcggttgattggattgtggagcaactgctgaaaagtaatctacaacagtggttatcagtgaagctcagaggattcaatggaacggattctttatccaagcatgaccagggtattatacacttaatctctgccctaggctatgagtgggcattgtctccagttctcagtgctggtgttggtctaaattttcgtgattcaaatggatggactgctcttcattgggctgcttattttggaaggtaaccgaagtttataagctagtacaattcttttttttcttgctgcattttctccatagaaattttcatggacagaacagaatagttgcgcagaaagacatccttttgttcactcaagaaatgattttcgtataccattgtgctgttaacttggtaaccaagcaattgccagttgaaaaaaaactagaggcaagtatgattcttaaattaaagagaaaaatataaattctaatcaacgagctgtttcattctggtaaaatcaagtattttgggctaccttgctagcttggtaattttgtaatggccaatcgaagaatctggaaacaataacagtaacaatggttacagtagataaaagatctacatggttgttcacattatgttttgtggcactggagtcaattgtgcaatgcatatataaatatagttcttttcttgtgaaaccattacagcttttctttcttttgtaattgccttttcaagtgttggtacatagtgctattgattggcttggaactagcaagctaacaatatgtcgattttattgcagggaaaagatggttgctgcacttcttgctgctggtgcatcggcaacagcagttactgatcccactgcacaagacccagtgggtaaaacagcagctttcctggcttctgaacgagggcatacgggacttgcaggttatctttctgaagtgtcgctaactagctatcttgcatcactcactatagaagaaagtgatgtctcaaaaggatcagctgaagttgaagcagagagagctgtggaaggcatatctcagaggaatgcccaacggcatggtggcacagaagatgagctatcaatgaaggattctttggcggcagtgaggaatgcagctcaagcagcagctcgcatccagaatgctttccgtgccttctctttcaggaagagacagcagaagactgctcgacttagggatgtgtatggaatgacccaagaggatatagatgaacttgcagctgcatcaaggttgtaccaccaagctcatgcttcaagtggtcagttttatgatagagcagctgtttcgattcagaagaaatacaaaggatggaaaggtcgcaaacattttctcaacatgagaagaaatgcagttaaaatacaggtaaggggaatgggtatctaggttttttttaaaaaaatctgatgtcctccttcaagttgaattcatgggtatataaatacatatatggtatctggcaagttgatttgtgctttgttcaatgactccctttgtacaggctcatgtaagaggccatcaagtgagaaagaaatacagaacaattgtaagcactgtcagtgtgctagagaaagtaatacttcggtggcgccggaaaggtcatggcctacgtggcttccgagctgagcagcaaccaatggtcgaagcaatagaggaagatgatgaggaagacgacgatttcgatgatgatgaagcagtcaaggtcttccgtcggcagaaggtcgatcaagctgtaaaagaggctgtgtcaagggtgctgtccatggtagactctaccgaagcgaggatgcaatatcgacgaatgcttgaggagtttcgccaggcaactgtaagaagtttttttcctcttaatgtgtaatttcattaaaggagggcagctataagttaccaataaactaaacaagcaaattaggacaaatttgctctagtcacaactgtagatgatcgaggcattattctcttttgaggggacatgtacagtaacgataggttaaacagttcaaatctcaatgtgatacacgtataaacataatttagagaatccagaacagccattaaggccttgttcggttatttcaattccatgtgtattggtgtgtattgggatggattgggatgtattttgacttgctatggaattaaaccgactcaataccacccaatccacatggattaacggcgaaacgaacaagccctaaagtgtgtctatttttgctctctttttatcaactcaaatctccatgttataactaatcaggtgcgtgttgtaaatgcaggcagaattggaaggatcaaatgaagtgacatcaatatttgacagtgacttagagttattagggatcaacaatttcatgtaaagagcatttcgggtttcaagatctgagcaatggcataaattaagtatctacgggatgggtttcacctgctactaactaggacctgataatggtcgtcagtttatacagtgtttacgaaatggaaagtagattattgctgctatgatgtattgccactctatatttaggtgtattttcccagtggcagttcaatgaacactacattgtggtgtttgtaacttgatataccccgtttggatgtagatattagagtacaaaattgaaaattaaaaaaaaaaaaaaaaaaaaagggcggctgctcgcgatctagaactacccacgcgtctg

SEQ ID NO: 7381 - DNA, 1865 bp, Zea mays
ctcgggccggccgggctcaaaaccaacctcttctagtttcacagacattgcaccatcttctagacatctgaaatccagtgaagagttattacttcttgcaaaatttgctagaatgcttttgtctgggaatggaaaccgtgaagttccagatggtgatccccaatctggacagtgtccaaaacttaagacgaacgaagagctctgggataggttgattaacgaacttaaagtagggtgtgaaaatccattaagctcggttgattggattgtggagcaactgctgaaaagtaatctacaacagtggttatcagtgaagctcagaggattcaatggaacggattttttatccaagcaagagcagggtattatacacttaatctctgccctaggctatgagtgggcattgtctccagttctcagtgctggtgttggtctaaattttcgtgattcaaatggatggactgctcttcattgggctgcttattttggaagggaaaagatggttgctgcacttcttgctgctggtgcatcggcaacagcagttactgatcccactgcacaagacccagtgggtaaaacagcagctttcctggcttctgaacgagggcatacgggacttgcaggttatctttctgaagtgtcgctaactagctatcttgcatcactcactatagaagaaagtgatgtctcaaaaggatcagctgaagttgaagcagagagagctgtggaaggcatatctcagaggaatgcccaacggcatggtggcacagaagatgagctatcaatgaaggattctttggcggcagtgaggaatgcagctcaagcagcagctcgcatccagaatgctttccgtgccttctctttcaggaagagacagcagaagactgctcgacttagggatgtgtatggaatgacccaagaggatatagatgaacttgcagctgcatcaaggttgtacctccgcccccaccccgctagtggtcagttttatgatagagcagctgtttcgattcagaagaaatacaaaggatggaaaggtcgcaaacattttctcaacatgagaagaaatgcagttaaaatacaggctcatgtaagaggccatcaagtgagaaagaaatacagaacaattgtaagcactgtcagtgtgctagagaaagtaatacttcggtggcgccggaaaggtcatggcctacgtggcttccgagctgagcagcaaccaatggtcgaagcaatagaggaagatgatgaggaagacgacgatttcgatgatgatgaagcagtcaaggtcttccgtcggcagaaggtcgatcaagctgtaaaagaggctgtgtcaagggtgctgtccatggtagactctaccgaagcgaggatgcaatatcgacgaatgcttgaggagtttcgccaggcaactgcagaattggaaggatcaaatgaagtgacatcaatatttgacagtgacttagagttattagggatcaacaatttcatgtaaagagcatttcggtttcaagatctgagcaatgacataaattaagtatctacggaatgggtttcacctgctactaactaggacctgataatggtcgtcagtttatacagtgtttacgaaatggaaagtagattattgctgctatgatgtattgccactctatatttaggtgtattttcccagtggcagttcaatgaacactacattgtggtgtttgtaacttttaataccccgtttggatgtagatattagagtacaaaattgaaaattagaatcagctttccaaaaaaaaaaaaaaaaaaaaaaaaaaaaaaaaaaaaaaaaaaaaaactcgaagaggggggtaaaaaaagggaaaaatttatgtaaaatcctt

SEQ ID NO: 7382 - DNA, 5710 bp, Zea mays
  misc_feature (5525)..(5525): n is a, c, g, or t
  misc_feature (5592)..(5592): n is a, c, g, or t
ggagaggtctggatccgtttcaaaactgatttctgagttaatcccgcggttttagataataaatccggcgagaaactaggaaccctaactgactctgcgcacgcgcggaccatccgcgccaccaccgcggggactgtccggaccgcggaccatccggcctcagggccggaccgtccgcgaggctttttttagccttcaacataagtcgttctaaatttattctatttaatagttattattgtatctatttcttaacaggtagatgaagtcccacttagaaatattatgcagagacatcaccattggaattacctccaaaaagtggttgcacataacagtaacaatattattctgctattgattgaattgacaacttccatcttcactaattttttacactcccccacttacattataggattaaaaaatagaggtcaaggcacaatgaagattagagcaatgtcagagactaaacatgtgcaaggctcataaaaactaggaaatatgcatagttagtactctctctgttcgttttaatatgacgtcacttcacaaagtaaaagtgtttttttaaataacaaccttttacaaactttatgtggttttccatatttacctctcctctttcgacacattgctttacttactgttagacgttttcatggacaaacaaagaagatataaaggtaatattgttaaatctatgttttcttaatttaaacgacatataaaaacgaatggagggagtagcttttaaaacttcctttataaagaacttatagttgtcttttattataatacaatgttttccatcatgttaaatgtacagacatgacatgatatgcctgaaatatgttcctaactttagttcacatagatcgttggcaacacttttttaaatgcaaggtatgaattagcattaaataaaatgcaaggcatcatgtttatgggactattgcatataaataatttttatatatgtatccaactgttattaagctatctattgttagtaagcattggcgacttgcacaacttataaattattcagattttaaatttgtagctaaaaattattctaaaattaaaatattctatgtgtctacttatttcagaacggttgttggggacagccttgccgcttttggtgacttccgacgtccgtgtccgttgcacggctgctttccacggaaaaaaaaaagaatacttttaccacggcaggacaccggtaaaacaagagctgggccggcagacggccaggggcggggacaggtgcccagacccacgggattctcacgcatcccgaacgcggccacgctcgccgcgggcacacgcggcgcgctgtgctcacccctgtctgcctgcgcgcccggcacgcccgcgcccactcacgcccggccctgccccgcgccctcatcgtctcctcccggcctcccctcaaagcccaccaccgctgcccccacgccacccaccccaccccacccccgcccctaccgcgcggtgcccgagacccagaggccagaccccggctacctttcttcacctccttcccatcgcaatcgcaagcccccggctccggcgctcggcggtcggccaggttcgggagatcacttcgtcgcggcgaggagggagggggtcgccgttagcgcgcggcacttggatgagaagggcagcggtggaggaggatgcggaaggcgtacagggactccatcaaggtgctcgaagctgacatccagcacgccaacaccctgtaagcccagctctcgcccgcctccctcctctctccccgtcctgattccagcgccgcctcacatcccctgtcgattctgctccagttcactagtacgggcccatgtccttctcgtttctctgtctgcctccgtgatcgagcgggtgcttgggggtttcggtggggctgcgtcgcgccgtcgccgactcctcggcctgctgccggggttgcgcaatgcggcggccagggagggtgatagattgactgaccgagcgccggttcgcccccctccattgggatccgttgtggtggttgccctatccgttcacgcacgagtggcgaagcggcagtagatcatgtgggaatcccatgtgtttaggatgtttaaacaaaccctgattcccatgtgttttagcgttctaaattatatataattttctgcttaagaagaaaagggtacgagatgagtccactagtgtggtctttaggtgagggttgcttcatcagcatgtgatctgccaagtgatgctagttgtttatttggatgagcagggcctccgagtttccccgggactatgatggtgcgtgcctgcagatgcggctgtcgtacagtcccgcagctcatatattcctcttcctggtgcagtggacggactgcagcctcgcaggggctcttggtctgctgagaatcctcatatacaaggtctgttgcgcgtttgttggtgccgtgctcacattgtggatgtgccctgctgaatctgtagctcattgagtcattgttcaggtttatgtggatggcacaacaaccatgtcgactcatgagaggaaatccagcatcaaagaattctatggtaggagggcatgatgttattacatctttgtctaactatgttattttttttttgtgctgcattgctgatcagaattactatatattcggcatgagcagctgtgatatttccttctttgctgcaactgcaaagggggatcactgatgtcgaggacaagaagcagaaggccgtatgcatggagaagtacagaaagaaagatgaggatggacgggacaccttatctgatattgatgttgagagggaagaggagtgtgggatttgcatggagatgaacagcaaagttgtgttgcccaactgcacccatgctatgtgtatcagatgttaccaggactggtatgtgcatgattcagtttctgcccatgtgttttctgtgactgcattgagtgttatattctcaaatctcaatcacccttcttttactgctgtgcaagtgcaaacttcttgcgtagacttatgttatcattatcgattaacaagctttttagctagatgactcatctatatcattcctccacatatctgtatcatagcaaggtatatatcctgctaaacattagttgctgtgaacagtagctacagataagcttaaactcatcttccttgttctttccagcaacttatatgcttgtaaacacgatggaagtggaaccccttacccctccgcacacaagctcaacagaacatagtgctctgtgaaacgtattcatttacatgctttcccattgtctgtatcgttctgaaaatgaagtgatactagctcaacagaatatagtgctctatgcaacagatctgtattcatttacatgctttcccattgtctgtcattctgaaaatgaagtgatattagatcaacaggacatagtgctctgtgaaacattgttctcattgattgccgtgggcggttgtgttgctgttttcaggtgtacattgtttttttgccgtgcggttgtgttgttgttttcatgtgtacattgtactttgacccttgaggtctttcctctctttagaggatgtttggtttctagggaactattttttagtctccccattttattccattttagttcataaattgctgaatatggaaactaaaatagagttttagtttctctatttggaaatttaggtactaaaatgggataaatggagggactaaaaattagtccctagaaaccaaacacccccttaatacaacaggcagatctcatgccggttctttaaaaaaaatagtgctctgtgaagcagatctgtattcatttacatgctttcccactgtctgtatcattctgaaaatgaagtggtcgttggaaagtggcattgtgatattcatctgattttgccggctcccgtgaggtcgcgtgccggggcgattcaccacctggattttttgaactatgttctgccattccttcagtgcaaagaggaatctgactggtgtgccgagtcaagtattgatttttcatttttgtccaatccacgcacataatcatccatcttcttgtatagaccgtgcactatgtttacggccaattggttctaggctatgaaggcacattattcctttgttcactgcagctaacaatttagctcattaaacttgtggccctgccgatcataattaatagtagctttgtatgttagcaagccctgatggtgggtgtctgcgatttattgatcttgtgtactaggtgttccaataatatttgtggtttgtctgtgttctttttgccagtgtaaccttttcattcagcttaacttcgactgaatttctgaatgtcttgtttcagggttcattgtattatatcagcattaagattgaatgctgtctatgttccagataccatactttgacgataacattggttttcctacaggagttcaagatcgcagtcctgcccattctgccgtgacaacctgaagaagacctgtcctagtgacctgtggatctatgttgaggaccaagatgtggtcgacatggagacggtgtcgagcgagaacctcagacggctgttcatgtacataagcaagctgcctctgattgtcccagacgtcatcttcagcgtgtatgattcccacatcaaatgacttccgacgcgaccttcccgacgaccttcagccagtgcccagctccagttaatcttatgcccccatgtcctccattttcatgctttgctcaagcttttggaagtgcctgaactgatttggaaccgcaagccttccggtggtgctttagaaacttgtttagtgcctgcatgcatctttaatcatatgcagccactctgtacatatctgacttggctcagttaataggggactgtgcttgccccaaatggaggcagggccgtttgtgtctttctcatgtttccattagcgaagcaacgcaaagttctgggcattggaaggtttaaaaaaaaatcccagcccgctctcctgcaatgttagaatgctctctatacttaattagtctggatctactagtaataaggtataaaagtatcagaattctccaaaaatgtccagcaagctgaactacttgactcttgctggagaaattgtgcgagtcaaaattagaactggattattaacacataaagcatctaagcaatttaagataaataaacaaggatccggtaggcaaactgcccgagtcgtcgtgctggcaaggggggtagggtccgttttgtcctctgcgccggctcctgtttatttttgattgagcgtctaagaagtgatgagatggagtcttgataaattttggactatctgccactgagggtatggacatactcgtacttgtctcgttgtccacgctagctgtccatatcatcaatctgtttagatgttgtatctcaccctctccaatcttatccatgcatacacattggataatgattaacctaacggaagaaaactatcactacaagttttttgtttctgcgtgagtncgtctttctcttgtatgtttttggagcctccgctcttttctctattaataatatatgtagctctctngcatattcgataaatatatatatatatatatatatatatatatatatatatatatatatatatatatatatatatatatatatatatatagccgctggtcactcaagtaagtccatat

SEQ ID NO: 7383 - DNA, 1364 bp, Zea mays
  misc_feature (1)..(2): n is a, c, g, or t
nncgccgccctgccccgcgccctcatcgtctcctcccgcctcctctcaagcccaccaagccccccaccgctgcccccacgccaccccaccccacccccgcccctaccgcgcggtgcccgagacccagaggccagacccctttcttcacctccttcccatcgcaatcgcaagcccccggctccggcgctcggcggtcggccaggttcgggagatcacttcgtcgcggcgaggagggagggggtcgccgttagcgcgcggcacttggatgagaagggcagcggtggaggaggatgcggaaggcgtacagggactccatcaaggtgctcgaagctgacatccagcacgccaacaccctggcctccgagtttccccgggactatgatggtgcgtgcctgcagatgcggctgtcgtacagtcccgcagctcatatattcctcttcctggtgcagtggacggactgcagcctcgcaggggctcttggtctgctgagaatcctcatatacaaggtttatgtggatggcacaacaaccatgtcgactcatgagaggaaagccagcatcaaagaattctatgctgtgatatttccttctttgctgcaactgcaaagggggatcactgatgtcgaggacaagaagcagaaggccgtatgcatggagaagtacagaaagaaagatgaggatggacgggacaccttatctgatattgatgttgagagggaagaggagtgtgggatttgcatggagatgaacagcaaagttgtgttgcccaactgcacccatgctatgtgtatcagatgttaccaggactggagttcaagatcgcagtcctgcccattctgccgtgacaacctgaagaagacctgtcctagtgacctgtggatctatgttgaggaccaagatgtggtcgacatggagacggtgtcgagcgagaacctcagacggctgttcatgtacataagcaagctgcctctgattgtcccagacgtcatcttcagcgtgtatgattcccacatcaaatgacttccgacgcgaccttcccgacgaccttcagccagtgcccagctccagttaatcttatgcccccatgtcctccattttcatgctttgctcaagcttttggaagtgcctgaactgatttggaaccgcaagccttccggtggtgctttagaaacttgtttagtgcctgcatgcatccttaatcatatgcagccactctgtacatatctgacttggctcagttaataggggactgtgcttgccccaaatggaggcagggccgtttgtgtctttctcatgtttccattagcgaagcaacgcaaagttctgggcattggaaggtttcaaaaaaaaaaaaaaaaactcgag

SEQ ID NO: 7384 - DNA, 2110 bp, Zea mays
  misc_feature (1897)..(1897): n is a, c, g, or t
ttcatattttctaaggtgattgacaccataacttatgttagaaaaatatgttaataattttacacatcattttatatttagttttatatcattaaagttattatttatctgatccctaacctatcaaaataattataacaaatcataatatatctttctaggctaaattatactattagctactaaccaacaaaatttgaactaaaaatttagtttgtacataaagaaatgaaaaaataaattttgttaaaggtaaattgaaccaactcaaatgagccaatgcataaaataaattttaaaaaattaatttatttggttgtgtaaatattgtccataggtaaagatgttaatagatcatgatccaaacgattcttcataattattttgagccttaattaattttagtacaaaaataaatagagatagatcccaatcttaggcggtgtttgaatgcattagaataataattagctgctaaaattagttgaggtatccaaacaatttagctaatagttagttagctatttattagctagctaattctactagcaaattttatctaactaactaatagatctagtacattcaaacacctcattaatctgaccttaaatttatagtataaaattttagagtctattaccactagggagtattccaaaacgatctaaacatagtttaggacgcagagggtgatatacacttgcactgtgatagttaatgtagaattcagttctaaaacgagatactgtaaaaatgcacgtgtctgaagacaagggtcccaaaatgggcagcctccgtgggacccgcgtagccagtgtcccaacgcatggccacggttggagtcaaacgtacccgccaaccccgcgctctggcgtgtcccgtcggagtcgtcggacgcctgacgccccctccatgctcgtcgtgctcccggaggggtttcgcgctcccgccgcacgccgccggggccgcctctcgcagctgcttcgcttcttcttctttctatatacatatatagacctaataagaacaaagacgtacgataacctgcttattttgcgacccatcccgttcccacgcaaaggcgccgagcgtgatctccgtccgtgccgccatggcctcgcaccgggcgctgctgctgctgctcctcgccgccgcgctcgtcgctgcgctggcctctgtcgcatccgccgacgacgccaacgccatgcccaccatcctgacccccgtggcgcataccccgctggggtccttcgacggcgacaagccggcctctgacgacgacgccgtcgacgacgacgaggacgccgcccctgtcggcgcgcccaacggggccaccatgactgagcccagggacgacgtccccgccccgcccggcgccgaagcaaccgcgggcggcgccgccgccagcaacgcgcccgtcgcactcgccagcgccgcggcgcgcgtctgcgccgccgccgctgtcgccgcgggagccttcgcctccttctgaggagcggagactggtttcgtttcgtgcaggggttgcaaaatctctgcgatattttatttatttatttaacatggtcgctttcctcggtttgatatttgtatgtaaacacacagctaaagctaatcgtccattcgtatgtgtaactactttccagtgagcatatccaggttgtttatgtttgttcttttacatcagcaacgtcaaagtttgaggttgcacgtgcttctcaagacaggcatcatcatccattccaaaattattgtcacgacaagtagtaaaatgtcgaattgccacctttgcatccatcccacccccaactgaacaacattacacgttatggacagaatccctttgatatctcagaatcctttcacctactactcttatatgcatcacataacntacagtacagcacaaattcgtgggggaaaagaaaaagggcttagacctagagcgtggtttctagttgaaacaaatttgcctcctgctgcatcttcgtgtgattcttgatagatgttcgtgaaactattgctcaatatgcctcacagctatacctcagcgtgatgaagcagacacgtctgagccactgattttcagtgaacgcatcaaagcagc

SEQ ID NO: 7385 - DNA, 2657 bp, Zea mays
  misc_feature (2571)..(2572): n is a, c, g, or t
cctcgaggccggccggccctcgcggccggccgtgagatccagatccagatccagcaaccagcatgggccgtggcgtggcgtgcttgcagctgcagtcctgcacgtcttgccgctttgattgccttctccttcccgcaactactcatcctttccatcaaaactgagcaaacccctcatcctattctcgcgcccggcgtctcccttctccaacctccgtttctaatccgcgctgctaatcccactcccagtcccagctcgtccgctgagatggacagtagcagcctcaaatccgcgcagctcctggagctgatgcgccagcacctggccaccgatgccggcaaggaggtcaccaagaaggtcggcctcgtctaccagctcaacatcgcccccaagaagatcggcgttgatgaggagatcttcgtggtcgacctcaagaagggcgaggtcaccaaagggccgtaccagggaaagccggatgccactttctccttcacggacaacgatttccttggaatcgccaccggcaagacgaatccgcagattgcattcatccgaggggcgattaaaatcaaggggagcatcagtgcggcgcagaagttcacccctgacatcttccccaagcctgccaagctgtagaaggttagattgtattacttggtcgaggtgaataataatgtttgcaagcttcaattactatgtacgagatacaatgagtggaacatgaaaagcacgttctcggtgggaatttggatatggttgaacttccacttaaatcaagctcaatgttcgtttctcgtgaaaaaaaaaaaaactaagaaatggactctgttgcatgtgcatccgaggggcgattaaaatcaaggggagcatcagtgcggcgcagaagtttacccctgacatcttccccaagcctgccaagctgtagaaggttagattgtattacttggtcgaggtgaataataatgtttgcaagcttcaattactatgtacgagatacaatgagtgaaacatgaaaagcacgttctcggtgggaattcggatatggttgaacttccacttaaatcaagctcaatgttcgtttctcatgattacgttatcttcttaaaataggatgagtggtataataatgcttgttgatgccccttgagtagttatatgttggcaatggtaaattggcgatgctcttactttgggcgggattatgcaaaggttttagctttattgtgccatgctgctttgcatctcactgctgagagtcaaataaacgggatgacataataacagagagtcaaaactgagagtggcaaaatagcaatttttcctcgtcctactaaagtaacatgtttctgttatggccctggtcgttgttgatagataggttagtacttcataacattcaggggtggatccataggttggggggaaggggcaaaggtggccatggccctcctttatacctaatgttcatttaatgttaagtatagataaaaaataaagttttaggtagattaaatcagccatgttctaatcttctcgtcagatctccttggtccagtcctcgcatctatctgtttagccctattctatctgacgtcgtccgaaccagtttgcctcgatgccgcccgccatttggggataggctgtatgctagcctgagtgttgtttagcaataaagtttgcatccatggtgcattagttaggatgatcagactagatgattgatgggtgtgcatctagtattaccatctgaatttaaataacagtgccgtctaaactgaatcctctgagtcatccggacctttttccttcaaaaaaaagatggcaggagctttgcctttcaattaagaggcaaaatgagttctaaatacaattaaaaccggggttaactacagaggccccacacggccacacatatggctcaaacagccacagagggtcccaactcaaaaggcaccaaactgaaagataaattacaccaaaatgagcacccttgttcttaacttgaagccttctttttcattctagccgcttgttgtgctgtcaggaagcggttataaaaaagatctctgattccgatctttccagggttccacatgatgtattgccagccattgaaacaccgctgttgctcttcttcaacctttcatgtgattcatctggagcagcttatatgatctgacgataattgatattttgcgatataagtccagtgcggtgatcgtgtatgtggtagaatatgactgaactgttgtatagtataaaaacacggaacttgttgtatagtataaaaacacgcccttgaatttctgagtatatatgtaacataagcttgtgtcgtttaagattaaaaccaaacctttcttgtgttgtttgtggagccagtccaattatttcttgttatttttttgggagctctagacctaactcaagtcctccaaaactagctccatctcatctttaccagttcagatcctgtttcaagctgcaaccaacaaccatgaactctcatccaaacgtgctattgaaccaaagaagacatactgtaggatataccacctgtatgaaaaaaanngtgatggtagcttttgcttgatttcgattgtatatcagttgatcttggaagccagattacgcatgccttttttttctcgaaaacg

SEQ ID NO: 7386 - DNA, 1923 bp, Zea mays
gaccctcgaggcggccgcactgccttctcttctcagcccccacgtcgcgtcttacatgaggcatcgcagcctccgattccccgagaggcggcacgtcggcacggcacgctcttctcctagcgcgggtggtgtgggtaaccgcggcgcgagaagctgctcgatcttgcagctcgtgccgggcgccgggggtgtgcggtgcgggtgctgcggacatgagctgcctgtgctggttcaagcggaggtccaggaaagggcgatcgtcgtcgtcggggaagcgaggggcgtcgtcgacggcgacggtgtcggtgtcgggccccgcgaccgcgaccgcgaccacgaccacgaccacgacggcgtcggcggagagcacgagccggtcggacgactcgggcgcggtgcggccggtgagcaagtcggcgggctcgtcgcagtcgcagcggagcatctcgtcgctctacgaggagcggggccacggccagctgcgcgtgttcgactacgacgagctccagggcgccacggccgagttcggccgcgcgcagaagctcggcgagggcggcttcggcagcgtctacaagggcttcatccgcgccgccgacggcaagggggaccgcgtccccgtcgccgtcaagaagctcaaccagcgtggcatgcagggacataagcagtggctggcagaagtacagttccttggtgttctggagcacccaaatcttgtaaagctacttggatattgtgctgttgatagcgaaagaggggcacagagattgttggtctacgagtttatgcccaataagagcttggaagaccacttgttcaggcgagctaatcctcctctaccgtggaacagaaggcttcaggttatcttgggagctgcagaaggattggcgtacctgcatgaaggggaagttcaggtgatctaccgggacttcaaaacgtccaacattttactggacaaggacttcagagcaaagctatcagacttcggcctagccagggaggggccaactggagcaaacactcacgtctcgactgcggtcgtcgggacgcaagggtacgccgcaccggagtacatggacacggggcacctgacgacgaagagcgacgtgtggagcttcggcgtggtgctttacgagatcctgacggggcggcggtcgctggaccggaacaggccggcggcggagcagaagctgctggagtgggtggcccagttcccgccggacagccgcaactttcggatgatcatggaccccaggctccgcggcgagtactcggtgaaggccgcccgggagatcgccaagctggccgacagctgcctgctcaagaacgccaaggagcgccccaccatgagcgaggtggtcgaggtcctcggccgggccgtgcaggcgcacgccgagcctgacagcggggctcccggccccggcgccaaggggaagaagaccgacgctgccacaccgtcccggcggcggcgtgactgactgctacatgtcgtcatcggtaaaggcgcttaccgagtccattggttagtctagtcgtgagctgtgacagcacaaaaggagtgagtgttgtgcttggggccctacatataattttttttggacatacagcattacttagacgtacgtagagacgagctggcggattgaactttgtgtagctttcgaaagtgagcattttgaaaagaaaaaaaagagtagaggtctcaagggtttcgaaagggggcatttcaaaagattttgcgctggctctacaaaaggatctgttttagcatagccgagtgaaatcagagtgtcagacgcgagcgcacagatttttcaggaagcagctggcaagagcttcgtcaagcatgtattaacagaaaacataatttataaaaaaaaaatagcgcacaaatttgattgtaaaaaaaaaaaaaaaaaacgctca

SEQ ID NO: 7387 - DNA, 855 bp, Zea mays
cccacgcgtccgcttcagatctcaagaagatggctcttcctccttgccacatgtgggcacaatttaatgtggagaacgggaagctatcctgccagatgtatcaacgttttgaaaacatggggctgggggttccattcaacatggaataatatcctcttttgacatatataatggctcaagtttgagatctttctccaggagattttgtccatgttataggggatgctcatgtctatagaaatcacgttcgagctctggaggaacagattcagaagatgcctaaaccatttccaattttgaagataaatccttcgaaaaaggatatagattctttcatggcgtcagacttcaagctggttggctatgatcctcaccagaagctagagatgaaaatggcagtgtaacggtggcttagctctggagcccccagccttggaacctcggtgggtgaaatcagtcgaacgaactggtactacataaaaaatgaaccggacatcgcactagcttgtttttggtgatggtgctgaatgttgtgcgggaggcgttttcccccgttattagtagcgatctgcgtgctatatatggtcgctgaagtcaaaattgtctctcttttattttttatctactactactactcaattgcgagtgagagatggtctgggcacaccattcaattgcaacggcctactggtgtgttgccccccctatgagggctgtgacgattgcgccactacctcgtgagaaacatgatgtgaccgaaattgctgtgtacctgcatggtagaacaacgcactctttggtatctggttgccttaatacgtgacctggttaattcagtttccagtttggatgggc

SEQ ID NO: 7388 - DNA, 735 bp, Zea mays
tgcagagtctggaaacaaaaatgcatataggcaccataattttcattttgtcatagttgcttcacgttttgctctgatcctcaccagaagctagagatgaaaatggcagtgtaacggtggcttagctctggagcccccagccttggaacctcggtgggtgaaatcagtcgaacgaactggtactacataaaaaatgaaccggacatcgcactagcttgtttttggtgatggtgctgaatgttgtgcgggaggcgttttcccccgttattagtagcgatctgcgtgctatatatggtcgctgaagtcaaaattggctctcttttattttttatctactactactactcatttgcgagtgagagatggtctgggcacaccattcaattgcaacggcctactggtgtgttgccccccatatgagggctgtgacgattgcgccactacctcgtgagaaacatgatgtgaccgaaattgctgtgtacctgcatggtagaacaacgcactctttggtatctggttgccttaatacgtgacctggttaattcagtttccagtttggatgggcacaagatagcgatttgctgtggcgttttagttgttgttgctgtgctgggggcagaaagtctagtgccgtgcttgacgaagacggggtcaaagcgcttgcagcgacgatgtacgatttggagccatgcaactagctcgtcagcattactctaaagtaatactgcaactgca

SEQ ID NO: 7389 - DNA, 1206 bp, Zea mays
ggccgggccgtctgagtaatcaaatccatcatcatccacgccctggcgaaaccgaaacaccacccaacaggtaccctgccgttcgtcaggcggttcacggccaaggaggtggaggccgccacgcgcggcttcaccgcggtgctcgacgccgccggcacggcctacagggcgcgcttcgccggcggcctcgtcgccaccgtcgtcaggcgccgccgcgacgccgacgacaacgacgaccaccatcgccagggagagggaggaggaggagggaccacggacgccttctacctggagctgcagctgctggcccgcctcaaccaccgccacgtcgtcaggctgcgcggcttcgcgctagcccaccacgcaaggttcctcgtcttcgatcacatggagaacaggagcctcaaggaatgcctccacgatccgctccggacgccgctggactggcggaccaggctgcaggtcgccattgacgtcgcggcagcactggaatacctctactaccactgcgaccccccggtgttccacgtgtccgtcaactccggcaccgtgctcatggacgccaacttcgtcgccaagctatcggatgtcggcgtggtcagccacgacgtgaggctcgccaccactgactccttccaagaccgggtcgagcggaggcgggcgggcctggcgttccagtacggcgtgctggtgctggagctggtgacggggcagtccccgggcgccgacggcgagctcgtgcgctgggcgcaggaccccggctccgccgcctccgtgcaccggatggtggacgccgacctcggcggcgtctacgacgcccgcgagctccgcgacctcgtcgccgtcgccaggctctgcaccagggacagggacgacagggacgagggcgctggcgtcgtcaccattccgcagatcgtcaggtacctccaggggaagctggagcggatcggatgccaggccaggttcggatgatgatgatgacggtgatggttcgcctgcgttgcgtgcgcgggcgatcagcgtatcatcatcgtctttgttcttctttaacagcctgtctgtaccatcaaatgtacaaaagcgcgtggctttttcttctgtggatgcccagaatctgttggtgtcgatcagtccatagaggaaccaaagtgagttgctgcctgcaattggaagcgacatttttttcgacaaaaaaaaaaaaaaaaa

SEQ ID NO: 7390 - DNA, 2008 bp, Zea mays
ttttactgcttctacatgttttgtctctatgaattgcagccgcagcagtccaaacaactagttttaatccgaagcgaacatgggaggtgcttcaggggctgccttacagggcatccctacttttgtcgctaccaattgtcaagctcgcgaacttgtacaaccataggataggagagagcgcaaatacaacaaccacaaagaaatagaccaaaagtacatgctttttttctcatgatgcctccgcatggcacgcgccaccccaccgcaggtggaggaggcccgtgcatgcaggatgacgagatgcgcagagggaccccaaacatagccaacgactccaccgcgtccctctcgccggtcagcacattcccccttcgcccactcctaagggcgattgggttcctcgagggccgggctcatgccgtgaccaccgcacaccagctgggaaaccgatcgagcgagcgaccatggcccgtgctctcaccctcaccgtcttcctcgtcgtcatcgcctccgctgtcgtgtcgttcgctgcggatgaggcaccggctgcctcgccaaagcattcggcctccacaccgtcaaaggcacccagcacgtcgcccgacaagtctgagaaggcccccacggcgtcgtctgaggatggtgcggctacccccgctaaggccccagcttccgcggcctccaactcagaggcgtcaccttccgaggcacctacctccgggtctgagtccggtgccgcctcacctaacgagagcgctgcgtcagaagaggcccctacaagtgcccccgaggactcatcatcggccagcccttccacgtccccgtcggaggctgaggctgcagtatcgcccgatagtagcagcggtggtggtgccacctcgaaagagccttccgccagcgaggctggtgccgcagaggagccgtcgacggccgaggccggcggcgcatcggccgacagcccgcctgagccgacccacacttcttcggactcgccagcggagtctcctggcccggccgctgaccacgagagcggcagcccgagcatgttgggtggcactggccttgccctggtcatgctggtcgcgaccgtcacgtcctccgccatgctttgtttctaaacgaccacgatcgctctgagtttaatatggtcatgcatgcatggttgtgggagccgatgactacgccttattacgagtctctgatctctccttagggttttttaggcttttcgattcatccttttcggggttaccttgtttctatgtttgttttttgggtattgttttgtaatttttaactacgataaatgaattgttgcatagctgtgttttatgtatccactcgtgtaatactatgtgttttaacagtcttctcttcaaaaaattggcggcctttggcgcggcctgaactttaactctggaagtgaggaaggtcgcggtggtggtgtcgcctcgacatttgtttggtaattagaatgatggaaaatgaaaatgaataccaagatgaaaaagtggatcctgatggctttatgctagttcaatctagaaagaagaaagaaaaattgaaaagcaaaataatgtctccttcctttaaggtagatgaaaattttgaccttagaaagaagaggaaaggtaatgggaaaatgcctactaatgaagacgactaaattttttgtttctccatgaatgacctttcctagaattgcagaggaccgaggaaaaagggatgtctatatatatcaagaatctgatgttacagtataatttttttcattagtttccaagaaactatgatagaggagcttagtgacaagatcagtatgaaggttgatccttttaatgactatatgtgggtttgttgccttccaaagggaagtcgggtgggatcttagtggggatcaagcatgatgatttagatgttggtgcttttgatcaaggtgatttcatgattaaggtgaagatctgggataaaaagattgtttaaatgggacttgatggtgtttagggcc

SEQ ID NO: 7391 - DNA, 2024 bp, Zea mays
attttaattataattttgaggcagggagtaattggtacaagcgtgcactgttttggaactgcataatttcaaatatggaaaactgcccacctctaaagttttgtctcctgatctcctcttccgccactgagtaatgatcagcgattcatgttgacgtcgaccagttggctacaattcccaacgtcttagaattttccgtaccgtatctcgggcagcggcagcggcagcggcagcgagtgcaggactgcaggcacgagaaaaagtgaaaaacaaaacaaaacaaaactttgtggcagacgaacagggaaagtgaaaaatcgctttcgcacaagtcgcggaacagaggcaagcgctgtgccacacagcgggagtcctccccgactccccgagagatttgctgcccagagccttcgaatcgggttcaatcccgtcgatctttctgcccgccgccgccacgggactccagaagttgccttcgattcggccggggccgtggaagcggggatggggctcggagaggcggcggggcggctcctggcggccgtggactgggagcgcgaggcctaccctgcgtacgacgacttcctcgcgctccccgccttcgttctcttcttccctaccgtccgcttcctcctcgaccgcttcgtcttcaagtgggttgcaatgaggcttatacatgggcagggacatcagagagctaataatgaaacagaagaggcaaggaagaagataagaaaattcaaggaatcagcttggaaatgtgtttatttcctgtctggagagcttttatctttgtctgtcacatataatgagccttggttcaccaataccagatatttttgggtaggaccaggagaacaggtctggcctgaccaaaagataaaattgaaacttaaggctgtatatatgtatgctgctggattctacacatattccatatttgcacttatgttttgggaaacaaggcgttcagactttggagtgtcaatgtctcatcatgttgctactgttgttctgattgttctatcttacgtgttcagatttgctagagttggctctatagtattggcaattcatgatgcaagtgacgttttcctggaagtagggaagatgtccaagtacagccattgtgattggcttgccaatgtttcgtttctgttttttgttatttcgtgggttcttctccgcctcacatattttccgttctggattctgagaagtacaagctatgaggtcttgttgactttggacaaaaagaagcacaattttgatggtcctatatactattatgtgttcaattcccttctattttcactacttgttctccacatatattggtgggttttaatatatcggatgcttgtgagacaaatcaagacaagaaatgttggagatgatgttcgatctgattctgaaggagaagacgaccatgaagattgattgggggcatcatcttactttctgtgttataacggtgcttatacattcttttacttgattccaacattgttcctcacgagattcaccgaagccgggctacgggttacctgtgtcttggctgccaatttctgtgcattagaaacaacgctgcaatgcattagaaaaaagctggatgtcgaatataacattcttttcagtgttcacacaaagtgcagcggtaaatgtagcgccaatttagtattccggaaacaaaaggactggttgtaaatcaaagcctttctgccgacataccatgtacattctgtttgccaggatgacaccgcttggagttttgtgaacggtagcgctggccgccggtgaaacgcttctcttgagctcctgttgttccatagctgcaagctcttttttttaggcattagctagccgaccgtgtgttttgtattgttttaccctgtagattatagtaaaaggtgagatagtaagactacctgtctcccgctatatcccttatattcctcttgtgtgtctatctttgcagacttattctttaactaggtgagtacccgtgcgttgcaacgggagca

SEQ ID NO: 7392 - DNA, 1595 bp, Zea mays
cagaggcagcgctgcgttgccacacagcgggaatcctgcccagagccgccgaatcgcgtcccttcccgtcgacctttcaggccgccgccgccacgggactccatccagaaattaccttcgattcggccggggccgtggcccgtgggagcggggatggggctcggtgaggcggcggggcggctcctggcggccgtggactgggagcgagaggcctacccggcgtacgacgacttcctcgcgctccccgctttcgtcctcttcttccccaccgtccgctacctcctcgaccgcttcgtcttcgagtgggttgcaaggaggcttataaatagaaatggacatcagagcgctaataatgaaacagaagaaggaaggaagaagataagaaaattcaaggaatcagcttggaaatgtgtttatttcctgtctggagagcttttagctttgtcggttacatataacgagccttggttcaccaataccagatatttttgggtaggaccaggagaacaggtctggcctgatcaaaagataaaattgaaacttaaggctgtatatatgtatgctgctggattctacacatattccatatttgcacttatgttttgggaaacaaggcgttcagactttggagtgtcaatgtcacatcatgttgctactgtcgtcctgattgttctctcttacgtgttcagatttgctagagttggctctatagtattggcaattcatgatgcaagtgatgtttttctggaagtagggaagatgtccaagtacagtcattgtgattggcttgccaatgtttcgtttctgttttttgttattacatgggttcttctccgcctcacttattttccattctggattctgagaagtacaagctatgaggtcttgttgactttggacaaaaagaagcacaattttgatggtcctatatactattatgtgttcaattcccttctattttcactacttgttctccacatatattggtgggtcttaatatatcggatgcttctgagacaaatcaagacaagaaatgttggagatgatgttcgatctgattctgaaggagaagacgaccatgaagactgattggcgtcaccatcttagtttgcatattatgtcggtgctagaagcatcacccccaataccgtccctgagcttatacattctttggctggattccaagaatacgtgcagattatgagaggacgagcatttgttcctcacgagaatcaccgaagccgggctacgatttcttctgtctcgactgctcatttgtgttgtactaagtatgcattagaaacagcgctgcaatgtgttaaaaaagttggatgtcggatataacattcttgtgagtgttcagacaaagtgcagcggtaaatgtagcattccagaaaaaggactggctgtaaactatatggcctttctttcgacaaaccattgtaaaaattgtgtatgccaggatagccttgcttgggatttaccacaatcccaatcagaaactgtcccttctgaagcatgtatttcaccattcagtgattcgcctgatgataatttgataaattcatttatccaacacaaaaaaaaaaaaaaaa

SEQ ID NO: 7393 - DNA, 712 bp, Zea mays
tcgagtcagcggcgcccgcccccccccatcagacggtggagagcaacaccagctcaaaaccctagcgtccaactcatatacctgctgctcgccccgacgcgcatcaactcccgccgccgccccttcctctccgtcgctcgcctcgcgcctacgccaccacctctgccatggccccgaagaaggataaggccccgccgccgtcgtccaagccggccaagtccggaggcgggaagcagaagaagaagaagtggagcaagggtaagcaaaaggagaaggtcaacaacgctgtgctcttcgaccaggccacctatgacaagttgctctccgaggtgcccaagtacaagcagatcaccccatccgtcctctccgagcgtctcaggattaatggatcattggcacggagggcaatcaaggatctgatggcaaggggattcataaggatgatctctgttcattccagccagcagatatacaccagggcaaccaacacatgagggctgttttgcatcttgtcggcgggtctctagacggcttaatgttgctattatatcatgtttatttcaatcatggctcagtcagccttactgttgtgtcggatgttggaatatttttagattactgtactgtttaagctcatgttgctatccaaatatccatcttgaggaaaaaaaaaaaaaaaaaacgcccgactagtctctctctctcctcgtgc

SEQ ID NO: 7394 - DNA, 737 bp, Zea mays
ccggccgggccgctgctggccccgacacgcatcgactcccgccgccgccgcttccgcttccgctccgtcgctcgcctcacgcctccggcgccacctccaccatggccccgaagaaggagaaggccccgccgccatcgtccaagccggccaagtccggaggcgggaagcagaagaagaagaagtggagcaagggtaagcagaaggagaaggtcaacaacgctgtgctcttcgaccaggccacctacgataagctgctctccgaggtgcccaagtacaagcagatcaccccatccatcctatctgagcgcctcagggttaatggatccttggcacggagggccatcaaggatctgatggcaaaggggctcataaggatggtctctgttcattctagccagcagatatacaccagggcaaccaacacatgaggggtgttttgcgtcttgcggacgttatctagtctagacgacttgatgttgctattatatcaagtttattttaatcgtggctcgatcaatcttactgtcgtgttgaatgtcgaatatttttgagattattgtactattttaatatcatgttttttttataacatttaagaccatgttgccatccaaattttaatcttggtgaggaatatcaaccaatctctgctctgcaattacaaaaaaaaaaaaaaaaaaaggcccctagggccgttcagtgttacttgacaaatttatttacagtgttaccctgag

SEQ ID NO: 7395 - DNA, 770 bp, Zea mays
gggtacctcgaggccggccgggccgggaacccctagcgtccactccctcaggtacctggggctcgcccggccggccgggaactcccgccgccgccccttcctctccgtcgctcgcctcgcgcctacgccaccacctctgccatggccccgaagaaggataaggccccgccgccgtcgtccaagccggccaagtccggaggcgggaagcagaagaagaagaagtggagcaagggtaagcaaaaggagaaggtcaacaacgctgtgctcttcgaccaggccacctatgacaagttgctctccgaggtgcccaagtacaagcagatcaccccatccgtcctctccgagcgtctcaggattaatggatcattggcacggagggcaatcaaggatctgatggcaaggggattcataaggatgatctctgttcattccagccagcagatatacaccagggcaaccaacacatgagggctgttttgcatcttgtcggcgggtctctagacggcttaatgttgctattatatcatgtttatttcaatcatggctcagtcagccttactgttgtgtcggatgttggaatatttttagattactgtactgtttaagctcatgttgctatccaaatattcatcttgaggaataccaatctgtctctgctctaatattacaacaattgttaaagttgcgcgtgttgtcatgaattcagtcctattgacatgcgctcaacgaaaaccagaggatgtttcctagggctaaaaaaacccgcggcc

SEQ ID NO: 7396 - DNA, 1511 bp, Zea mays
  misc_feature (5)..(5): n is a, c, g, or t
  misc_feature (8)..(8): n is a, c, g, or t
  misc_feature (19)..(19): n is a, c, g, or t
  misc_feature (32)..(32): n is a, c, g, or t
tcaancanggcaatctggnacacctgtcatgnaccggctccggtccgtccctcgaggccggctggggctggccccgacacgcatcgactcccgccgccgccgcttccgctccgtcgctcgcctcacgcctccggcgccacctccaccatggccccgaagaaggagaaggccccgccgccatcgtccaagccggccaagtccggaggcgggaagcagaagaagaagaagtggagcaagggtaagcagaaggagaaggtcaacaacgctgtgctcttcgatcaggccacctacgataagctgctctccgaggtgcccaagtacaagcagatcaccccatccatcctatctgagcgcctcagggttaatggatccttggcacggagggccatcaaggatctgatggcaaaggggctcataaggatggtctctgttcattctagccagcagatatacaccagggcaaccaacacatgaggggtgttttgcgtcttgcggacgttatctagtctagacgacttgatgttgctattatatcaagtttaatttaatcgtggctcgatcaatcttactgtcgtgttgaatgtcgaatatttttgagattattgtactattttaatatcatgttttttataacatttaagaccatgttgccatccaaattttaatcttggtgaggaatatcaaccaatctctgctctgcaattacaattgctgaagttgttgcgtgtgttattatgaattcagtgttacttgacaaatttatttacagtgttaccctgagccctatttgggtcatgcctatgtttatcaaggatgcggctttcgttgccatttatgctggattggtacttcggtacagcgggaatggcgcttgtgctagtcccaaatgtcggtgaggtgtatggcaccgtcctgtactcttcaatcatttgataaccaatgtctttctttgctaaagagaaatggtcattataatgcggactcactagaatcggatccattttaaatagcgagagctaggattcaaggcattctatgctaaagagaaatgatcgcttcaagtcattcttggctaaagagaaatgatcgccatgtgtcacactgactagaattgaatccattccaaatagccacaagtcgaatagactgaatagaaactttttccaagcagagggaggtgtgctggcgacgcgacggggagccacgctgatcatactcatacactgatacaccatgtttttacgaccgtcgtctggtacgcgtttgctagtctcagcctaatcgacctggctctgtgctcctaaggttgagcataacttacgttctaaattgctgcagcattgagaacttggtaacagagacagatatcattcatcaattttggtttttgatactcgggttgatttctattcactggctcagacgatacacacagatccagatcctccgattgcttacttccacatagtcaaatctttttacactctgtaatccgcaatgggaggcacatg

SEQ ID NO: 7397 - DNA, 762 bp, Zea mays
  misc_feature (744)..(744): n is a, c, g, or t
cgcctgctgccgccccggccgggatcgcaccccgccggccgcatcagacggtggagagcaacaccagctcaaaaccctagcctccaactcatatacctgctgctcgcccgacgcgcatcaactcccgccgccgccccttcctctacgtcgctcgcctcgcgcctgcgccaccacctctgccatggccccgaagaaggataaggccccgccgccgtcgtccaagccggccaagtccggaggcgggaagcagaagaagaagaagtggagcaagggtaagcaaaaggagaaggtcaacaacgctgtgctcttcgaccaggccacctatgacaagttgctctccgaggtgcccaagtacaagcagatcaccccatccgtcctctccgagcgtctcaggattaatggatcattggcacggagggcaatcaaggatctgatggcaaggggactcataaggatgatctctgttcattccagccagcagatatacaccagggcaaccaacacatgagggctgttttgcatcttgtcggcgggtctctagacggcttaatgttgctattatttcatgtttatttcgatcatggctcagccagccttactgttgtgtcgaatgttggaatgtttttagattactgtactgtttaagctcatgttgctatccaaatattcatcttgaggaataccaatctgtctctgctctaataaaaaaaaaaaaaaagccccccggggcctcaggaaaaaaanaaaaaaaaaaggccccta

SEQ ID NO: 7398 - DNA, 683 bp, Zea mays
gggagctcgccttgtgacggtacccgggattcggccttatggccggggcccgccgccgccgcttccgctccgtcgctcgcctcacgcctccggcgccacctccaccatggccccgaagaaggagaaggccccgccgccatcgtccaagccggccaagtccggaggcgggaagcagaagaagaagaagtggagcaagggtaagcagaaggagaaggtcaacaacgctgtgctcttcgaccaggccacctacgataagctgctctccgaggtgcccaagtacaagcagatcaccccatccatcctatctgagcgcctcagggttaatggatccttggcacggagggccattaaggatggtctctgttcattctagccagcagatatacaccagggcaaccaacacatgaggggtgttttgcgtcttgcggacgttatctagtctagacgacttgatgttgctattatatcaagtttattttaatcgtggctcgatcaatcttactgtcgtgttgaatgtcgaatatttttgagattattgtactattttaatatcatgttttttttataacatttaagaccatgttgccatccaaattttaatcttggtgaggaatatcaaccaatctctgctctgcaattacaattgctgaagttgttgcgtgtgttatcatgaattcagtgtt

SEQ ID NO: 7399 - DNA, 1037 bp, Zea mays
cctcgaggccggccgggacgtttcttcgaattcaaaagccgcgggcccctcgaggccggccggcagctccaccaatcgcagctccgctgccctgctctccacctcctccagacctccaccatggacgagccgccgctccatccaccgcccctcccccatgccctcaccaccgccgagtaacacctcctcgccgccgcccttgccttgacggattcgaataattcgtggaagagaagttcttattcccttgccttcagccgtactgcggcggcggaatctctctctggacttctccccgatgtccgtggcggccgagcaggaggtggcgccggccgtcgtggccgtggccgtggccgaggcggaggagtgggaggtgtgcgcctgctgcgggctcagggaggagtgcacgccggcgtacgcggccggcgtgcgcgcgcggtacggcgggcgctggctgtgcgggctctgcggcgacgccgtgggcgaggaggtcgccgccgggggcggctcggtgctggagctcgaggcagcgatcgcggggcacgccgccttctgccacgcgctcggcgggcgccggacgccggccgcggccgagcggctcatcgccgcggtgcggcggctgctccgcggcgccgacgcgggcggcaaggaggaaaaagccgtggtggtggtggagttccaggaagcctcttgaccgcctgcctgaatttgaatgggacggatcgaagatttgttcttgcaggcggcgctagctagctactctgctagtcctcttttcgtaatttgcattttgattagttctcactatttgtatgcttaaattcggacatgaacgctgaaatttctccagcccttgtacacgccctaggagatgtggaacatcagaaattttggagaaagagggttgtgagagatttgaagtatatataaaagctacaagatgggagaatcccatctttcatgtcatttaggccccgtttcaaattcatccaatctgtacattttatgatttaagaaagctagtggtggtcgattct

SEQ ID NO: 7400 - DNA, 1115 bp, Zea mays
  misc_feature (26)..(26): n is a, c, g, or t
gggtaccctcggagccggcccccagnaggtagtgcgcttccggccttcacgaacaggttcgtctcttcggctcctccttggcttcgcaagagtggtgccgccagtagctcctccgcgctccgccgggaccgacttgccgctggccgccaggggctccctcgcccaggaccggctccgccgtccaaccgtcctatcccctccggcctccgcccaggtgattcatatcaaagatctgattcacataattaccaagttcagcagttttgcctctgacgatatgggttcttgggagggccaagctaggcagcttttgttggatgaggaagaagacgatgaagagtttttctttcttcttctccctgctatactttcattcctctctgaagagcaaagcgaaactggagcagctattgaaagtttcgtggaattcaagaggagcaccgcagccaaaacgctcgaagctcttgaagaaaagaagaagcatgatgaagatttctctattaaaaagtgtctagaggagttggatacaattgatgggctgacagatgaggatagatcatatgcaatggaagtctttgaatctgggttcaacagagaagtgtttatgagttcaaaaaaccacaatgttaggttgttttggctcaagagagaaattaaagcgcttgctgctatcatgtgatgtgaagtgaatgtggttgtgaagagataggcttacagaaaccgaagaaatccaactgctagtaccgttccagcgagaagacttcagccctgctttctgagtgcttggtgaacgatggaaggcctaggatgctgtttttgtttatgttgcttagagacggatattggaacgaggatataccttgtttgtacggtatcgtgctgccaaaattaatgcgttttaagcaatattttgctaggctaaccacggtttcttttaacggaacttgcctgacgtgatggagcctgctctgtctctagccagaaccccgcgtgttgtcaaggcgaactgtcatactgatcctaaatttagaagcgtcaatgttgagttatcagaacttgaaacaagacagcgtacatatactctacatggataaaaaagaaaaaaaaaaaaaaaa

SEQ ID NO: 7401 - DNA, 2172 bp, Zea mays
aaactgctgtaatgactgagcacgagcatcaagcactcagctgacggacagagcccacgtcgggttgacaaaaggaagacgcacgacgcgcgacgaggggagcaggcgatgcccggcgttggggcagggccgagcggtcaagcgccagcagagggaatcgccatggcgaacgcaggggcgagccaggagaaatcagggagcaggggctcgcggctagcaggagaagcagagatcaagctgggcgagatccaagcaggaagattggcggccggcagagggaggcgccatgggagggagacccgagcagaggagctgaagggggcgctggccatgggggaggcaagggaggaagaagcttggggagatggggaggagagaggtccgcgcgtagccatgaagttgggcagagccgagcagggacagggtagaaggaaccgctcggcaggggagaggagaggataaagccaagcgcctgaaggagaacgtcggcgagatttttctccgtgcggccaggaaactccacggcggggaaaaatccacagagatggctgaacaaaaaatcagacgagaacagcggttcaaaaaatcggagggaggacggctgcagagggcgctcggccaactaggagctggagagagcgtcacgaggaagataggagcagagacacgtatgcgaggggattttagagataaggaagatggcgattgcgaggactagaggagaatcataaaagagacaatactgcagtcagccctccggaggaacaacgtccaaagaaagcaaggattcagatgttttcccctgcggagggggtgccagataatgtaacagtctctgttgagtatgcgaagtctggtcgctctacctgcaagggctgcagtgagaatattgccaaaggtgccctccgccttggtgcctcttttcctgatccccgtggctacgaaaatactaagtggtaccatgttgtgtgcttccctacatcatcatacccattatttccaatgtcaaatctgaaggggtttgattcaattgaggatcatgaccgtgacaagttgcacaaattggtggagaatcacaagagcgatggaaaagcggctgatgtattgaatgagtcaaatctgaagagagaaatggctcacagcatggatgactcgaatgaaggtgctgaaaaggatctggaaggaataaagattcactgcatgggggagtttgaagaaggtgctgaaaagaacctggaagaagcaaagttacctgcagggaacaaaatgattggtccatcgatatccttttcactttctgatataaaaaaagaatacaagaatgctacccttcctgctcattggaaggtttttgatacagttatcttccgtgagaaggaagatggccttcatgcttcatctaagattgctgcatttgattttgatgggtgccttgccaataccagtatgaagagggttggtgcagaccagtggtctttacagcataaatcaattccagaaaaattgcaaagactgtacgatgatggttacaagctggtcatattcaccaatgagtcaaacattgagcgctggaagaacaagcgacaacaagctgttgactccaaagttggccgccttgataactttattgaatgtgttaaagcccctattcaggttttcattgcttgtggtttagggaaaggaaaaggtattccagatgatccataccgcaaaccaaatcctggaatgtggtggttgatggctcagcatttcaattctggaatcaaaattgacatggatcaatctttctatgtcggtgatgctgctgggagagagaacgatcatagtgacgcagatatagaatttgctaaggccatcggtctcaagttccatgttcccgaggagtacttcggtttctaattacctgtgaccagctagtaagatggttacactacgtcgtttagtgtttggatattatcaatactgtggctattctggtatggtgatctacatgtctgtttaaaccgtcaaataatatcccagttattcacttaggtcctgtttgtttccttccagaattatgtaatccatatggattatataagtacttaataacctgcttatggattatcataatctaggtatctagattatataatccacctaaaaaaaaaaaaaaaatgtttgtctctt

SEQ ID NO: 7402 - DNA, 2688 bp, Zea mays
  misc_feature (2668)..(2670): n is a, c, g, or t
  misc_feature (2675)..(2678): n is a, c, g, or t
  misc_feature (2683)..(2685): n is a, c, g, or t
tacaagtcaatgctcactcttgttctttgacaatgcatgcagtcgtttcgtccatgggggaactgactcatcgttcgtagtattattcatagtaaactgcacaaacaataagctaaatgggtgctcggctatagtcagtttagtgtggaagaagatacaggagcttaccagagtcggtggtgcgggaaccgcacgacacgggaatgtccctcgacgcaggatccgatgaagggcagggcaagcagccagggaagtaaatcagcaaggaagggcgcaggatccgggaatggccctgcgcggaactaaatcagcaaggaagggcgagatccggtgaatggcaggacagacaggcaccacagtgcgcggagacggcgaacagagtcgatggaggaagacgacgaccagagaaagaaggaagagagaatgaaatacgctagaaggagacgacgactagggaagtaacggagcgagggcacgacgggcacacgagaaacggtaatgatcattaatccagcgcgatgctaaatctttaaaacgggcaagattataatgccatatattcaattgcgatgatcatcgtgccaatagtctgaatcccctccgagcgagcgacatgttgcaaaattctcatctttcttcccgccggattgacgaaatcgatcgctccgctcccaccggccaccaccagtccaccacacctcgatccccgcaccgcccagccggccgcccgcatccaccgcacaaaaccctaggcatggccccaccctaaaccccttgctccccacctcgtatggtcgtcgtccccttctccctccgcattgcgcgaaaccccatccgcctccgccttcttccggtctccgctgctcgcttcacccgtctcgccatgtcgaccacgccgccggcggcggctaccatatccgtcgagtatgccaagtccgggcgctcaatctgcaaggggtgcagcggggtcatcgcctccggggcgctccgcctcggcgcctctgcgcgcgacccccgtggcttcggcgccaccaagtggtaccacgtctcctgcttaccctcctcgtcgtacccgctcggccccatcgggagtatcaaggggttcgactccattaaggaccatgatcgtgcggaattgcgagaactagagaagaatcataaaagagacaatactgcagtcagccctccggaggaacaacgtccaaagaaagcaaggattcagatgttttcccctgcggagggggtgccagataatgtaacagtctctgttgagtatgcgaagtctggtcgctctacctgcaagggctgcagtgagaatattgccaaaggtgccctccgccttggtgcctcttttcctgatccccgtggctacgaaaatactaagtggtaccatgttgtgtgcttccctacatcatcatacccattatttccaatgtcaaatctgaaggggtttgattcaattgaggatcatgaccgtgacaagttgcacaaattggtggagaatcacaagagcgatggaaaagcggctgatgtattgaatgagtcaaatctgaagagagaaatggctcacagcatggatgactcgaatgaaggtgctgaaaaggatctggaaggaataaagattcactgcatgggggagtttgaagaaggtgctgaaaagaacctggaagaagcaaagttacctgcagggaacaaaatgattggtccatcgatatccttttcactttctgatataaaaaaagaatacaagaatgctacccttcctgctcattggaaggtttttgatacagttatcttccgtgagaaggaagatggccttcatgcttcatctaagattgctgcatttgattttgatgggtgccttgccaataccagtatgaagagggttggtgcagaccagtggtctttacagcataaatcaattccagaaaaattgcaaagactgtacgatgatggttacaagctggtcatattcaccaatgagtcaaacattgagcgctggaagaacaagcgacaacaagctgttgactccaaagttggccgccttgataactttattgaatgtgttaaagcccctattcaggttttcattgcttgtggtttagggaaaggaaaaggtattccagatgatccataccgcaaaccaaatcctggaatgtggtggttgatggctcagcatttcaattctggaatcaaaattgacatggatcaatctttctatgtcggtgatgctgctgggagagagaacgatcatagtgacgcagatatagaatttgctaaggccatcggtctcaagttccatgttcccgaggagtacttcggtttctaattacctgtgaccagctagtaagatggttacactacgtcgtttagtgtttggatattatcaatactgtggctattctggtatggtgatctacatgtctgtttaaaccgtcaaataatatcccagttattcacttaggtcctgtttgtttccttccagaattatgtaatccatatggattatataagtacttaataacctgcttatggattatcataatctaggtatctagattatataatccacctaataatctgtgttgtttgtttgtctcttaacttatttaagttggattatataaaaaaaaaaaaaaaaaaaaaaaaaaaaaaaaaaaaaaaacannnggaannnnaaaannnaaa

SEQ ID NO: 7403 - DNA, 2450 bp, Zea mays
gtgggagatcgcacggggagttttcatccctgggttctgccacccttttgtgtccctgtgccctgcttacgattcatcacggcgtgtttcaaatgaatggagctacagcgcaacacaaagggtcccccggggccggctccgcaattcaattgcaatttagaacgcatatatttatttaaatccatgtatgcacagctgcctgaagttactgaaatcatcatcaatcgttaaaaccgtacacgcctacactgctccttccatgctttttcattcacccaacgttgctctcccaaaggccataaaccactgacacatgagggaggtgttctctatagagtatcgacgacgataacgctgaactgcataaatttggttatatcatctgaaatatagaaatcgggtgcaaatgaaattagttactatttgttcattcaaactatgatgtctgaaaattcaggcaattacagattctcacacgagattatgaggttgtgatccaaatcgacaattatctgttgatttgttcaatgtcttatggctgatcctgttggagtttattgggtttggtccatttactcaacaacttttaaaggtcccctctgtttctgaccttaccttgtgcgttgagttcataattgaatccatgaaatcgtggataccgtaaccgaactaaatccatggataccgtgactgagttagtttcagttttctatcttttgtgtctggttattatgagtaatttttctgtgtaaagacgattctctcctcgaaagatatgagaaataaccaacctgctatgtggtatggttttaggcaaaaggagcattcggtgttgtgtgattttaggctcctgtcaacactagtgtgacgacgaaaacagtctttgaaatcttactctgctgaagaacctgaagggttattgcttgtcgagttgtgatttgatgatctgtagtgttacgtcaatggacttgaacaatatcgtgaactcatatttgattgtttggagcaatctctgttgtgagtaataatgattttatcgcttttggttttgttagatacatttaagatagattttactcttatttgctatgcgtggtttatccattgtttatatagtggttgtcttagaaattactttaatccttaaaaaggtgtgcaatcttccaacacatcatgtggactcaaaattactctctagttgatttgtctaaatatactgcagctgttcttgttggtttgtcagctatcatcattcttccattattaattattatcaattaaggtttcacaaggtattatgaaagattgttctttcttagtttgtactctatccattctaaattataagtcattctaatattgtttgagccacaagtttgattaaagctatagagaaaattatgaagattcatatcaaatgtaaaatctaaattaataagaatctagtgacatttagtatcataaatgttattattttaatgtacaacttaggttagacttaatatttctttgactcctcaagaaagttggactgacttaccatttaggatggagtatgatttattattgtcttataaaagcctggatcggtatactctgaatatctgagtacctacatgatgagtatttgtaagatgtgtgaaggtcgactgctaggtatacattgtcagtatgaaatggctatcgtcttcagctttctttcctggtcagtggacagtgaaatatttatacgatgtgttaatgtggactgctctgtataaatcgttggtacaaaatggctatggtcttcagcttcatttcctggtcactggacagtgaactgctcaagcacacttagtagatactaggcacaatcagagcttatccaacttgtgcgatatagttcgtttcagtactcaatggttatgatgttattgatcactattgagctgaagcactacaatctgtgacaaaaaaatttgatacagcagcaaccaccgctgaagcttggcagaagggatgaaattaggaatacgaaacccattaggcctgtttggttgttcggtcgattatgtgtttatgttgattttgaatggattttaccaggtcaattcttatagaagcaagctcagaagctgaaaaaagctgaggcccaatatgccatagatgggagatctgttttctttttgttcccgggcaaatatgctttgctctaggttcagcttcttgtcttctatattccaaatttttttgtataataattctctttgggtttaaccatttactctgaagcttctgtttatatatatgcgagtctattcttgagcagtttttttttcaaaaaaaaaaaaaaaaaaaactcgagggggggcccggtacccaatcgggcctataggccggccccccccctcctctcgggcgcggggggggcggcaaggggggggggtggttttttttttttggtgggggtt

SEQ ID NO: 7404 - DNA, 1939 bp, Zea mays
  misc_feature (1921)..(1921): n is a, c, g, or t
aactcatttcccccctccagttccaactttattgtgtttaaacaatgggggggtaccgggccccccctcgagttttttttttttttttttttaagtaatttttcctttttttttattgacaacagtacatgaaactttaaacaacataagtactaaaaaaccatggtccaaatattacaattccaaaccaaacacactacataatcatacaaataccacatacgcttattatcaaccacgagcacattattaccatacttaaaaagccataaggtttttctccttgataaaattaattagctaattaaccaaaatatgtagtttgattaattaactaattaacctcaactaaataaaacactcaaacaaacccattgccatttccattgacatagccattaccattaccattgacatggccattaccattggtgagcttctttccatcatcttcttcttcctcctcactaagtaaaaactctttgctcttcacaagcttctccataacagaagcttcaagagttatctccacatcaatacttatgcctcctgctttaccttggtacaaatacatcatcccattaaaccggttatttgacccgctcctaaccgtttccggttttccaaacccgaaatccacctcgtaaacacgaaacctcggtgagcttcccaccgcaacacaattcactccggcgtctttgaattgaaaaatcttcggtgatttctcccactcgtcgttacgcgcgtcgataacactcgcgtcgtgtgccgcgatcgctttctggatcactgaagctccgaactccggtccgtgcgctgctagtagccccgccgctgttccggtgaagatggcttgaatcaagtttccgaaatattcctccggcattggaggatcaacgcggcggcgacagtcggcgaagacggtgaaaatagttatgtcctccggtttgagtccacgcgctaaggtgacgtggcgccagatgtgtgatgtgagtgattggaaagtggagaatggttttgaaccgtccgatgggattactgaattagctcttgacttgatcgtgtggacagcaaagtccgagaacctgaagatcttctctactagctgcggcggctccaccgtcggattggcggcatcttcgccgttggaggtctcgttggggtccttgggagcagtgagatcgagcttcacgcgcgtgtcacgcgccttcgatcggtcaaggaaaggttgggtcgagatggattgggctccacgacagatctcggcccatgagctcatgaaatgccacgtggatgtcccgtctaagactgcgtgattgaaagctaggcccattgcaagcccatcttttagcttggtcacctggacagcaaggagtggtctgctaagttcttccaagttcaagatcccattgtaaggaaccaactccttgaacttagccgtcccgtcctcagccgttagatcatcgacggttacgtgagcagcatgagcgacggagaactctacgccgttgatctctgagtcttcagcgtcgtactcaacacggaagactccttcatcgtccttggccagcttaccggcgagttgatagaagtcttcaagaaccaaacccaaaccatctttgagattctccacgacctcgttttggaatgtgggttcctcgagatctagaaggttctggaacttgtagagtagaaacttctggttgtagtagaaagcaaggtaaggaagatcaaatgtggtgaggtggaattgtttcttccctagtactggttttgttggtttcacatgtgttttgctcataatctttatcttcatggtgaaagagattttaactggcctgggggggggggggggagagataactacctgactaattcctagcatgccgaggttatccactatattctatgagcagccgancaccgcgagcgcagctcc

SEQ ID NO: 7405 - DNA, 985 bp, Zea mays
ggtccaggaactaggtgggatctccgcgggttccccggagattaagagagagtgcgctcctccccccccccccccccccccccccccgtgggagatcgcacggggagttttcatccctgggttctgccacccttttgtgtccctgtgccctgcttacgattcatcacggcgtgtttcaaatgaatggagctacagcgcaacacaaaggtacaactggatctaaattttcaattcaattgcaatttagaacgcatatatttatttaaatccatgtatgcacagctgcctgaagttactgaaatcatcatcaatcgttaaaaccgtacacgcctacactgctccttccatgctttttcattcacccaacgttgctctcccaaaggccataaaccactgacacatgagggaggtgttctctatagagtatcgacgacgataacgctgaactgcataaatttggttatatcatctgaaatatagaaatcgggtgcaaatgaaattagttactatttgttcattcaaactatgatgtctgaaaattcaggcaattacagattctcacacgagattatgaggttgtgatccaaatcgacaattatctgttgatttgttcaatgtcttatggctgatcctgttggagtttattgggtttggtccatttactcaacaacttttaaaggtcccctctgtttctgaccttaccttgtgcgttgagttcataattgaatccatgaaatcgtggataccgtaaccgaactaaatccatggataccgtgactgagttagtttcagttttctatcttttgtgtctggttattatgagtaatttttctgtgtaaagacgattctctcctcgaaagatatgagaaataaccaacctgctatgtggtatggttttaggcaaaaggagcattcggtgttgtgtgattttaggctcctgttgtttaaacacaataaagttggaacgggaggggggaaaggagtt

SEQ ID NO: 7406 - DNA, 3432 bp, Zea mays
  misc_feature (2894)..(2894): n is a, c, g, or t
cccggatcagcgctgctgcagcagcaggatagagcgagcaggagcgccgccgccgccgccgcacgctgcagcacgttggcccggcgatgacgatggccgcgcggggacgccattgttgttgcgcggcggagcagctagcggagtgctcgtgcttgtttgtacggtggcaagccgcgcgcggctgtgctcgatctgcagactgctgctgccggcgttgtctggcgagtggtgggtgcgctcattaaatagaggcggcggcggggctggcgagcgagcgggtacaaaaactacaaactaaccagtggtgctttcaaagttacgtcaagcgacgcatgatgggacacttttgttagatcctgcgccgctccgaaaaggaaaagtttcatcaaggacaaagctagttgctgaatctataactatataggtatgtcgatcttcaggccttgtatacaaataacaaaaaaatgagattgaggaaaactccgttgcgtttattttattttttgtgggactaataaattaacaaaattagcgaggccgttcatccgtttctcccacgaaacgagggccaccatccacaaattggcaagagcgcacattggattggagacgcgcctcctcaacctctccccatagggccggtgggtgcccccccgcccgccgcgaacgccgctcctgcgcgccatcactccactcgatcgaccgcctccgtgtccgtgccctacagctggtcatgagcgcccgcccaaccatggcggcggcggcgcccgtgcgcgcctgggtggtggcgctggcgctggtgctggcgtgcgcgctgctccagccgcggccgtccgacgccgcggcgcagcccgccccgcagtcgccggcgacggcggtgtcgtcgggcgccgccaagcccaagtgcgtggccggcgccaggaacgaccacgcgtgccgcgtcggcgccgtgcacgacccggacagccaggaggaggagggctccagcgtcaccatcgacgcgcccgccgccgcgcccgacgacgtcggccacgacgacggcagcgactacaacgaccccgacgtgcccaacaacgaccagctcgtcgtcgtcggccactgaaagctgccgcgcgcgcgcgcgcgccgacccgtggaccatgcgtgcatgaagaagaatgcagggggtgggcctgggcctgtaacctgttaatggatcggattctcggtgccaattcgtgatcttgaccggtctaagaagatggggacttgcgtctttgtttcattggttattatttctactagtgtgtatatggtaaagtcgtgtgctgtgaacctgcgatcatttatcctctgttcattgaattgaagcaatcccctctcccgtcacaaaataggattccgtcaaatttaaaactatacgaacatcaacgactgttatatttgtttagtttgaaaatatgcgagttccaaaatctcataaaactctctctaataatctcaatggttggctcccgtagaggggacagtacgtggaggataaagggaaggagacactacatgtctgtctgttagtttagtttgggctatatttggatctatgagctaataactagcagtagctaattttagtctcagatctagacttgagtgctaaaaatgactgatttttaactaaagatctagacttgagggctaataactgactaatatttggatctaactaaataaagggaaggagtactagttatcagccaattagttgacaagacttaggctctgcttgggagcaaagttttaaaaaatcatagttttttaaataatacaatatactttagtcataacaatattgtagtttaaatactacagttaactaagggggccagacctaagtttagaataccttaaaacaactacagtattactgtattagcaatacttcaattttgaaaacggagattttaactaactttccaaacatcattctatatatagtactgtagtatttgagaatactgcagcattctttcgaaactgtgaaaaaacttcacttctaaacaccccctaaggccctgttctaaacctataaaactaataattagcagctaaaattagttgataggtttaaaacgggtcaggtaatagaccaactaattattagttatgcctctcaaatagctatcagtttttagctgctccaacccagctataactagctaataacttattagctgactaacaattaactgtagtggtttagaacagggccttagttaatagaaaccaaatgcaggtaacatagagaaatgacagaaagatttcttcacacccattgtgtcccaccatctatgtggcacacgcttctctccatgcccgcccactcactagtgaagaaaagggccagatctgcccactcgtcgacgaaggaaagggggcatggccgagaggaccaccaccattgtgttgtccctagctacctgccctctgttgtctcaacctattcacaactctaaatatttttgccagtcgactttttggctcaccacataatcatgcacaaatctagggttgcacagcattgccttgccgagtagagacggggtatccgatattccgttagattaatgataactttcaactcggtagaacctaacatattgattcaacttttgaccaaaagatccaaaccctgcaacattaacatcatgattttcagtggttatcaaatgcgccactaatcgagttaacattaccaagaagaccaatccctacctacgaaacaaagaatacaaacaaaaactcgaaagtatgcagctcaataagagcaacaatgtatggttaagatagcgaaagtgtatttcacaaccagatactatgattattcaatgacaaattaatctaaaaaactaaacccnaatgtaggtggcaactatgaattttatagtctaagaatcgtcacacctcctcgacatgcccctaacatgttctaagacaatacattgcccaatagaccagaagacggtgacacaacacttgacaaattcttgatgctaacttgatttgacgatccatgatgattccaatggaatttagatctcaaactaaagccattaattagctttaaaattagtaatctgtgcatgtgcatgcatgagcgtgtgtgtattgttaaatgcagagtttgtatgcatctatttcattgttggttggtcctaaaggacaatgtagtctcgaactcgagttggactaggccatcgactggtattgtatatcgtcctaggtcttctccatgtccacacctttcaccaagtactttatgactacttccaatgttcctaatcaagatacggtgtagagatctattctctaaaatacgaaaaagactgtttaagaacgagcttacctctaaatttaactctagcattcgaggtcgggttatggacctgcataata

SEQ ID NO: 7407 - DNA, 1060 bp, Zea mays
  misc_feature (4)..(4): n is a, c, g, or t
cggncgcgtggatgttccattacatttttgcaaactcgcagaacaaggcgaaacaaggccacaccaccagctgaccgccgaacggaacgagcccggcgggcggagagaagggagagagcgcgccagagcggcgccgaacaaccctcgtccaccgcactctcctggaccgtggccatggccatggccgccgcgtcccggtcccgggcgctgtgggcgtcccgcgccgccgcctacctcaggatctccaccttccccagggccttctccaccgtgctgaaggatctgaaatatgctgacactcatgaatgggtgaaggttgagggcgattcagcaaccgtggggattactgaccatgcccaggatcatttgggtgatgttgtctacgtggagctgccagaagttggcgtcagtgtatcccaggggaagaacttcggtgctgtcgagagcgtgaaggcgaccagcgatatcaattcgccagtgtccggagaggtggttgaggtgaaccggaagctaagcgaggagcctggattggtgaacgcaagcccgtacgagaaggggtggattttcaaggtcaagctcagcgattcaggcgagctcagttcgctcatggatggtgacaagtactcgaaattttgcgaggaagaagacggtcattgaagaaatcagagggttttttgaacaccaaggacctgtgtttcaagctctatcactgcttctggtctggacacctgctgtgacaaatttaaattggcaaggttcattgcatggaataaattagttaggatttgccctattctaccagggcttgggaaatctgagcttgtgttgtgagtggcgtggtcaagtttgattatctctttttagttggaatctcgtgatttcctcttttttttaaaaaaatatttatccttttgaatccgtgctagtatgcaaaattttggtccttttggaccgagaattcctataaccttattgtcgatagttcagcactcgtaggaatttgcgccctaatatttcattcacttataagccatagcagaaaaggcttaatgataatatg

SEQ ID NO: 7408 - DNA, 959 bp, Zea mays
cattgggtacctcgaggccggccgggaaacaaggccacaccaccagctgaccgccgaacggaacgagcccggcgggcggaagggagagagcgcgccagagcggcgccgaacaaccctcgtccaccgcactctcctggaccgtggccatggccatggccgccgcgtcccgatcccgggcgctgtgggcgtcccgcgccgccgcctacctcaggatctccaccttccccagggccttctccaccgtgctgaaggatctgaaatatgctgacactcatgaatgggtgaaggttgagggcgattcagcaaccgtggggattactgaccatgcccaggatcatctgggtgatgttgtctacgtggagctgccagaagttggcgtcagtgtatcccaggggaagaacttcggtgctgtcgagagcgtgaaggcgaccagtgatatcaattcaccagtgtccggagaggtggttgaggtgaaccggaagctaagcgaggagcctgggttggtgaacgcaagcccgtacgagaaggggtggattatcaaggtcaagctcagcgattcaggcgagctcagttcgctcatggatggtgacaagtactcgaaattctgcgaggaagaagacggtcattgaagaaatcagagggtcttctgaacaccaaggacctgtgtctcaagctctatcactgctttctggtctggagacctgctgtgacaaatttaaattggcaaggttcattgcatggaataaattagttaggatttgccctattctaccagggcttgggaaatccgagcttgtgttgtgagtggcgtggtcaagtttgattatctctttttagttgtaatctcgtgatttccttcttttttttaaaaaaaaatatttatctttttgattccgtgctagtatgcaaatttcttggtccttttgcgaatggttcggcgttcattactgtgcgcggcc

SEQ ID NO: 7409 - DNA, 971 bp, Zea mays
cattgggtacctcgaggccggccgggactacatttactgggtccctcgaggccggcccggggaacaaggccacaccaccagctgaccgccgaacggaacgagcccggcgagcggaagggagagagcgcgccagagcggcgccgaacaaccagtccctctcctcgtccaccgcactctcctggaccgtggccatggccatggccgccgcgtcccggtcccgggcgctgtgggcgtcccgcgccgccgcctacctcaggatctccaccttccccagggccttctccaccgtgctgaaggatctgaaatatgctgacactcatgaatgggtgaaggttgagggcgattcagcaaccgtggggattactgaccatgctcaggaccatttgggtgatgttgtctacgtggagctgccagaagttggcgtcagtgtatcccaggggaagaacttcggtgctgtcgagagcgtgaaggcgaccagcgatatcaattcgccagtgtccggagaggtggttgaggtgaaccggaagctaagcgaggagcctggattggtgaacgcaagcccgtacgagaaggggtggattatcaaggtcaagctcagcgattcaggcgagctcagttcgctcatggatggtgacaagtactcgaaattctgcgaggaagaagacggtcattgaagaaatcagagggtcttctgaacaccaaggacctgtgtctcaagctctatcactgcttctggtctggacacctgctgtgacaaatttaaattggcaaggttcattgcatggaataaattagttaggatttgccctattctaccagggcttgggaaatctgagcttgtgttgtgagtggcgtggtcaagtttgattatgtctttttagttgtaatctcgtgatttccttctttttttaaaaaaaaatatttatcttttaaaaaaaaaaaaggggccaaaagaaagaccagcaaaaacc

SEQ ID NO: 7410 - DNA, 984 bp, Zea mays
gcgtatcactcctatgggcgattgggaccctcgaggccggccggggatcgactaaaaaaaccagcagctagctagcgatggctggagcctgggcactgctcatcgtcctcgcggctgccgtcgcggtcctggccgcgcggccggcgtctgcaggcgggggagccgcggcggtggcggagatctgcatgaagactccgtcccccgacctgtgcaccaggacggcggggaagcacgccaacaagtacaaggtggtggacgcggtgacggtgctagagatgcaggtggacgcgttcaagaagcgcgtgaaggcggcgcggaggctcgccaaggaggaggtcaagacggccgcgacgcccgaggcgcggagggcgctgaacctctgcaagacctactacctggacgccgccgacaacctcggcgcctgcaagcgcgccatcggcttccgcgacgccgtcaccatccgcgccacgatgagcatggtggcgcaggacacgcagaactgcgacgaggagttcaggaaggccgtctccaagaaccccatggaggaccacaacaggtcgctcatcgagatgtccgagatctgccgcacgctctccaacatgatcccttacgaacatgtccattgatttgtttgtttctttttcccgaccccctactacgttcggtaacgtcgtcgtcgtcgtcgtcgtcgtcgtccggcctaaaacatatgtaatttgatgctggtcgcgtgtgtctgtcagtcgatagactggacgcatgccgacttcatgcggacctagcgcgtgtccttcttttcggtgttgcctcttgcggcgtggcacatgtcttgagaccgtgggatgaaacggctcgttgagaggcacgcgtgtagggcagcctatatatatgattctataacatgctaatttgtgcttctttattactatatatatagccattcatcaatcaaaacaactagaaacattcctcagttatatttgc

SEQ ID NO: 7411 - DNA, 986 bp, Zea mays
cactcctatgggcgattgggtccctcgaggccggccggggatcgactaaaaaaaccagcagctagctagcgatggctggagcctgggcactgctcatcgtcctcgcggctgccgtcgcggtcctggccgcgcggccggcgtctgcaggcgggggagccgcggcggtggcggagatctgcatgaagactccgtcccccgacctgtgcaccaggacggcggggaagcacgccaacaagtacaaggtggtggacgcggtgacggtgctagagatgcaggtggacgcgttcaagaagcgcgtgaaggcggcgcggaggctcgccaaggaggaggtcaagacggccgcgacgcccgaggcgcggagggcgctgaacctctgcaagacctactacctggacgccgccgacaacctcggcgcctgcaagcgcgccatcggcttccgcgacgccgtcaccatccgcgccacgatgagcatggtggcgcaggacacgcagaactgcgacgaggagttcaggaaggccgtctccaagaaccccatggaggaccacaacaggtcgctcatcgagatgtccgagatctgccgcacgctctccaacatgatcccttacgaacatgtccattgatttgtttgtttctttttcccgaccccctactacgttcggtaacgtcgtcgtcgtcgtcgtcgtccggcctaaaacatatgtaatttgatgctggtcgcgtgtgtctgtcagtcgatagactggacgcatgccgacttcatgcggacctagcgcgtgtccttcttttcggtgttgcctcttgcggcgtggcacatgtcttgagaccgtgggatgaaacggctcgttgagacttgagaggcacgcgtgtagggcagcctatatatatgattctataacatgctaatttgtgcttctttattactatatatatagccattcagcaaccaaaaaaaaaaaaaaaatttgcggccctccgagctcagcttt

SEQ ID NO: 7412 - DNA, 1047 bp, Zea mays
  misc_feature (1010)..(1010): n is a, c, g, or t
  misc_feature (1013)..(1013): n is a, c, g, or t
  misc_feature (1038)..(1038): n is a, c, g, or t
actccatagggcgattgggttcctcgaggccggccggaatagaagaccggccggggacctaaaaaaaccagcagctagctagcgatggctggagcccgggcactgctcatcgtcctcgcggctgccgtcgcggtcctggccgcgcggccggcgtctgcaggcgggggagccgcggcggtggcggagatctgcatgaagactccgtcccccgacctgtgcaccaggacggcggggaagcacgccaacaagtacaaggtggtggacgcggtgcacggtgctagagatgcaggtggacgcgttcaagaagcgcgtgaaggcggcgcggaggctcgccaaggaggaggtcaagacggccgcgacgcccgaggcgcggagggcgctgaacctctgcaagacctactacctggacgccgccgacaacctcggcgcctgcaagcgcgccatcggcttccgcgacgccgtcaccatccgcgccacgatgagcatggtggcgcaggacacgcagaactgcgacgaggagttcaggaaggccgtctccaagaaccccatggaggaccacaacaggtcgctcatcgagatgtccgagatctgccgcacgctctccaacatgatcccttacgaacatgtccattgatttgtttgtttctttttcccgacccccctactacgttcagtaacgtggtcgtcgtcgtcgttaagtgcggcggcctaaaacatatgtaatttgatgctggtcgggtgtgtctgtcagtcgatagactggacgcatgccgacttcatgcggacctagcgcgtgtccttcttttcggtgttgcctcatgcggcgtggcacatgtcttgagaccgtgggatgaaacggctcgttgagaggcacgcgtgtagggcagcctatatatatgattctataacatgctaatttgtgcttctttattactatatatatagccattcatcaatcaattcaactagaaacattcctcaaaaaaaaaaaaaaaaaacaaaaaaaaaantcnaaaaaaaaaaaatacacacaaaaanggggcggcc

SEQ ID NO: 7413 - DNA, 1459 bp, Zea mays
agagatgtcctcacgcctcttctatattcccttacttgccctatacttcccaaactcgaatcgtgtatctttgtatggtggtaccgtggtagctcctaaatccttcggcgagcagttaacccccaatcattgatccctcaccagcttgggggcggtttcgctccggttcttgcgcttcggctccaggccatggagcagcggaggtggctcgcggtagccgttttgatgtgcctgctggtgctttgctccgggagagaactgaagaccaaacatgtgcccatatatgacccagtgctggcccggacacttgctgaatatacttctgctgtctatactgctgaccttacccaactgtttacatggacatgtgagagatgttgtgacttaacagaggggttcgaggtgatagagctgattgttgatgtgaaaaattgcttacaggcatatgttggatttgctagagacatgaatgcagttatagttgtgttcaggggcactcaagaaaacagcattcagaactggatcgaagatttattctggaaacaacttgatctcgactacccaggcatgcctgaagcaaaggttcacagtggattttattctgcttaccacaacacaacaatgcgtgacagagttatgagaggtattaaaaatactaggaaactgtatggtgatattcccatcatggtcacaggacattccatgggaggagctatggcttcattttgtgcccttgatcttattgttaatgttgggttcaaggatgtgtcactcatgacatttgggcaacctcggattggcaatgctatatttgcatctaatttcaaaagatatttgccgaatgcaattcgattgatcaatgcacatgatattgtgcctcatttacccccatactatcactactttccacaaaagacataccaccattttccacgagaggtatggattcataatgttggcctaggaagcctcatatattcgattgaggaaatttgtgatgattctggagaagacccgacttgtagcaggtccgtgagtggaaacagcgtgcatgaccatgtacactatcttggcatcagcatgcatgccgagtcatggggacattgcagaattgttacggacaatagtaccctgccacagcagtataagatggatcctgatggcaatataatcttgtcgaagcagcctggattatcagtaaatgaactacacagtgcacagtgaaaaagtcaagatagcgttaataaatttcatttcttgtatgatcctctggtggactcgaaggggatatattaggacggacgaccttggctacaaaaaaaaggcagcaatcttcattccattggatgtatgtacatatgtctgtgatgttagttccaaaccttagcatctgctatctgtatatgatgtttcagtaaaatcaaacttctctttacacgaaaaaaaaaaaaaaactttc

SEQ ID NO: 7414 - DNA, 1444 bp, Zea mays
  misc_feature (9)..(9): n is a, c, g, or t
ggtaccctnccgagcctgcaatcattgatccctcaccaggttgaaccaattgcttcccgtacaatttttgccggtcctgtcttcggtaagacggattccgattccgttgttttcttgccaaatccttcgcagcttgggggcggtttcgctccggttcttgcgcttcggctccaggccatggagcagcggaggtggctcgcggtagccgttttgatgtgcctgctggtgctttgctccgggagagaactgaagaccaaacatgtgcccatatatgacccagtgctggcccggacacttgctgaatatacttctgctgtctatactgctgaccttacccaactgtttacatggacatgtgagagatgttgtgacttaacagaggggttcgaggtgatagagctgattgttgatgtgaaaaattgcttacaggcatatgttggatttgctagagacatgaatgcagttatagttgtgttcaggggcactcaagaaaacagcattcagaactggatcgaagatttattctggaaacaacttgatctcgactacccaggcatgcctgaagcaaaggttcacagtggattttattctgcttaccacaacacaacaatgcgtgacagagttatgagaggtgttaaaaatactaggaaactgtatggtgatattcccatcatggtcacaggacattccatgggaggagctatggcttcattttgtgcccttgatcttattgttaatgttgggttcaaggatgtgtcactcatgacatttgggcaacctcggattggcaatgctatatttgcatctaatttcaaaagatatttgccgaatgcaattcgattgatcaatgcacatgatattgtgcctcatttacccccatactatcactactttccacaaaagacataccaccattttccacgagaggtatggattcataatgttggcctaggaagcctcatatattcgattgaggaaatttgtgatgattctggagaagacccgacttgtagcaggtccgtgagtggaaacagcgtgcatgaccatgtacactatcttggcatcagcatgcatgccgagtcatggggacattgcagaattgttacggacaatagtaccctgccacagcagtataagatggatcctgatggcaatataatcttgtcgaagcagcctggattatcagtaaatgaactacacagtgcacagtgaaaaagtcaagatagcgttaataaatttcatttcttatatgatcctctggtggactcgaaggggatatattaggacggacgaccttggctacaaaaaaaaaggcagcaatcttcattccattggatgtatgtacatatgtctgtgatgttagttccaaaccttagcatctgctatctgtatatgatgtttcagtaaaatcaaacttctctttacacggaatactgttttggtc

SEQ ID NO: 7415 - DNA, 2040 bp, Zea mays
gaagcaaactcgaccagatgtttgaataattctactttacaacatgtgaaccctagttttaagttaagcccccttctctctcacctcgatgcggcttgccaaccgccgatctgcccggccaaggattgttgagctcgccgcgggctaggtttccttccgtccaccatgacggggccaggctcagctccgacccaaacaccccctccagaacccaagcataacgcccgccgccccgtcctcctcctggggccgccactcctagccgtcgccgttgccctcctcttgggcgtatccaacaacccgttgccccgccgcttcatccgccttctctttggaacaaggccctccattctccgctcctcgccacctcctgacgcagcttacgaagcaaccggcgcggtacgcacaccatgtgttctatggatggccccattcgcctccggcggcgggtactgctccgaggcatggtcctacgtctccgcgcttgacgcgcacgccgccgccgctggcgctgggaaaaataatttctcgctcgcaatagcgcaccacggcgatctcgactcgccggagttctggctcggcctccccgagcgatctaagcacctggcgtacagactcgcctctgcgcgttgcgagctctccagtgccgtggtcgtctgccacagcgagcctggtgcgtggtacccgccgatgtacgaggccctgccgtgccctcccaccgggtacgacgatcctgtgttcgtcattggccggacgatgttcgagaccgaccgcgtctcgcccgagcatgtcaagaggtgcaaccagatggatgctgtatgggtgcctaccgatttccatgtgtcaacctttgtgaagagcggtgtggatcgtaccaaagttgtcaaggtggtgcaggctgtggatgccaatttctttgatcctgccaagcatgtggctcttcctttgccgattggtgtgtccgtcatggagcctgaaggttcgagatttgaaaatggtgactccaaacgcagggactttgtgtttcttagtgtgttcaaatgggaacataggaagggctgggatgtgctgctgagagcattcttgcaggagttctctggagctgatgacgtcgtactctatcttctaatcaatgcctaccactctgacacaaacttcagtgggaaaatcagcaggtttgttgtagaatccagaattgagatgcccatggaaggatggggtgagatccgggtcatcaatgagcatgtccctcagtctgttcttccaagtctgtacaaagctgcaaatgcatttgtgctgccaacccgtggtgagggctggggcagaccggtggttgaagcaatggccatggaactgcctgtgattgtgactaattggtcaggtccaacagagtacctgactgaggagaatgggtatccattggatgtagacaggctgactgaggtgacggaagggccattcaagggccacctatgtgctgagccatcagttgctcggctgagggatttaatgagacatgtcgttgatgatagagatgaggcaaggaataaggggaagaaggcaagggaggacatgataaagaggttctctccagaagttgttgccaggattgttgctgaaaagatacaacaagtgcttatccacactcagttgacaaatgagtagatacaatgtgaaactagaaagttcatgcaccatggaattccacatatgacataagtcttgctgcgttgtggaggactgcaggtgtggaggatagcagctaggacatcaacaccttgtgctgtagtttttgactgcactatagcatctagaggacaacattgtgctttagtatgtagtatgacatttgagtagtgtgtgagaaataaacgaaaaattgtcccaactcgtagtatcatcctctcgatgagagtaggagtcttgttgcttacaacaacaatgttgattcttgttagagtacccatcaaggttttggggttagccccttgtaactaaaaaaaaaaaaaaaaaaaaaagggcggccgccaccgcggtgga

SEQ ID NO: 7416 - DNA, 2064 bp, Zea mays
ggggacggcaatgctcgtcactgctaatccaagtaagaatcttttcctcttcttccattggttccagctgaatcatcctggtgtgtttctgagcgatcttatggcaattgatcgcttcattacaggctctgggagctgtgtctttgcatcatcattgccatcgtcgtcaaggtgggaatctgatacctgcattgtgataactaacacggaacctttgtgtctcttgcaattgtgaatgtattcatatgtgaaactcatgttctgtatttgcagctctactgttggatatgatcccgcgtccacggctactccatcgtcaccgtcgtctggttccgactcgggagcacccgtgctgaatgccagtggggcaggttcttctgaatcatcagattttggctttgacatcccaggagctgtcaatttgggcagcggttggaggtcagtctcaccacccaactggccctgggcagccctggtctggattctagtagcattgtgtgtgcacaaagaagggatggtctgaaaacctgtgagagcatctgcagtattttggagacagattgcaaagtagccaggtggtgtagagaccagtagagagctacaaagctagagaatcggaccttagcatggctaagtttatcgatgtatgtatgaagtatggtgctccagttcgtagtagcaactgggaactgatgtagtcctgatggatggacttggactcaccctgatcggtcactcaggcactctgtagtgtagatgtaggcatgtagctgctgctagtagtagtagtaatgcaagtactgctttgcatcgtatgggtgagagagttgaacaactaatggaatgcaaatgtgccgttttgttttagctactggtttgcgacaccgtaacagtaagcctgtaaagtatagatcgcaaggaaggaagggaggggaaatctctaacccaaggcgctcgtaaaaatgttaaatatcatcaataaattaacatgtttgaatcaataaatgtttctgaacataatatacagcttattgtacacactagcatctgcaataacattttttgcataataaaaaaggaaaatgtcatttgctactcgagtttaaacagatacacaggatgccttatttaataccctactatcttgcaccctatgagtctgaatccagattagaagaaacatcccctggaaaatggcatgggaagaggactgagccaagtctgaagtcagtgttgcaacatggacaggcagcattgaacaaagtggaaacttgtatggatcgtagtcgtagccactcataaatcaagtggcactcgagttgaaatttattcatgctatgttggctgcaggagaccaaattgtcaaggcaggacctatctgcggatgtaattatggctgatggatatgaggcttttgtttcatgcaaccgctcttcaaaaggccgtggagcatactctggtatgtttttatggcgtcaaaatcggtaattacaatatgtggataggagattttcaccttatggatgcatggttgcttgcctagttggagatgttctctgggttcagcattactttgatcacaccacatactcagtcaattactgtatttgaatcctttgtaggtgttgcaacattctgccgagtaacatcatcattttccagccaggaggttgctttgccagtagcagctgaagaaggctttactggacttcaggtctatgcaaaaaatagtcaaattgttggggatttcagtattgcaatgcctcttgaggaggagggtcttggtgaactcacaagagaggacctcttaagggtggacaatgaggggcggtgcatcatcactgatcatggacattttggtaagtagcttgttctcttgataggaacataacataaccgcttgcatttttcatgctttttattgcatatttattttttgttttgtctgtagtaatgataatgcctcactacttgtttagttcttttcaacatatatggcccagctgttgacgaagatgataaagagcgcgttcgttttaagctactattttacaagatactgca

SEQ ID NO: 7417 - DNA, 3109 bp, Zea mays
  misc_feature (3108)..(3108): n is a, c, g, or t
atccctatagaattatgtgaaaaggcgtattcggaactcttatatattattactaaatttatgtagatgtagaatatatgtaaaattttaaagtcaaataatagcacaagttatgatttttactgattgtattttagattttaactgtaatcggtgtattttttttctataccaaactttcgctttcgatatttttgatatcgttttcgtttgcggagttattgtttttaaatttgtttatgagaaaaaaatataaaaaacgaaaatagctttaacgtttaccgaccatttttatagtatcaatgaggaatgcagagaattggagacgacggatggaacgatccgtggagagggacgttctacagcggtggacccaggagtggcacatggctcgaaggaacagggcatgaggacgacccgcgtttggatgggcgtacatgaacagtaacaaaggtcatcagccagagcccgccatcgctgtagttgtagacttgtagtcagctctaactaatcatccattcacgtttcctggaaaaaaacaataagggggtgtttggtttgtagagactaatgtttagttccatcattttattccattctagactataaattgccaaatttagaaactaaaatagagttttagtttccatatttagcaattttgcaactaaaatggaataaaatgtagggactaaaaattagtgcctagaaaccaaacaccccttaattcatgctcatctgggtctcgatcaatctcaacgtcgcagccttttttggctttccggtcttttggtggtgtactggtggctggctggctcctgaatcgtcgctgtctctctctctctctcgctttcggcagctcagctgcactccacagtctgcctccactccactctccaccttttgctgtcgccttcctccccttgccttccctgtgtcctcccctccctcgcaagagagagagagagagagagagagagagagagagagagagagagagagagagaaagagagggccaggctgagcttactggcggcgagctggagaagaaggaaggagcatggccatgccggcggcgctgctactcttcctcctagtcctctccgccttcgaggccggggagcttccacgctgctcggctgctgctgcaggtacctccgaatccgcatcctcccaggtagaggtagattcttgcttctgcattcggttcagtgacttctcgaatcccaacctacccgctccatcgcttggttggcctccaactggccagggaccttagagagttaagagtgagctacagcactcaggttcgccgctagcaaatctctctaccagttaggccacgcaagtcacgtgtttgctgaattgctgctgctagtgaagtaccaggtccagctgcaggcatttcagtgaatctatctaccatttcgtttcttgtttggaaacggggaacaggctgcaaattaccaccactcacacagtcacattaaagtgaagggaacgcagcacccattctcttccaacctttttctcagaaatggggtgccatgataaagggacttgctatatttcaggtacacaatcaactagtatagttggaaaattcacattttttcttctagcctatagccaaacaatgatacaatcacatgttgcccaaacaataacagagaatgaggcaccttgggatataggagagttgcatgataaatcacagatggacgcaagagttactactagttaagcttggcctaattaattggtgctcgtcagaccgaactaatgaactcaagcacaatcactgtgttgtgttgtgcaggtaaaccggcagtcctcgtccatgatgacttgagtccggttcaagacaccagccccatcgcaacagtcccctccacgaacccgtcgcccgccatcatcaccgtgccttccacgaatcccaccatcaccatcccttccttgaaccctctgcccacacccatcacagccccctcaacaaacatcccttctccttccaccatgctgccgccggttccggtcatatatccgctgccaacgccgtcaacatcctccccaccagctgtgccggtcaccaatcctgctgtcaccacgccttccacgtcccctccgtcgacaccaacaccattcaacaacccaccattgttgaacccaacgccgacccctgctcctacagtcacggccccagctgcttcaggccgggaggtctggtgcgtggccaaggctgctggctcaagtgaagccgcgcttcagaacgcgttggactacgcgtgcggcattggaggagtagattgttcggcgattcagccgtcagggagctgctactatccgaataccatccaagcccatgcatcctacgcgttcaacacttattaccagagaaaccctgtttcttccagctgcgactttggggggacggcaatgctcgtcactgctaatccaagctctgggagctgtgtctttgcatcatcattgccatcgtcgtcaagctctactgttggatatgatcccgcgtccacggctactccatcgtcaccgtcgtctggttccgactcgggagcacccgtgctgaatgccagtggggcaggttcttctgaatcatcagattttggctttgacatcccaggagctgtcaatttgggcagcggttggaggtcagtctcaccacccaactggccctgggcagccctggtctggattctagtagcattgtgtgtgcacaaagaagggatggtctgaaaacctgtgagagcatctgcagtattttggagacagattgcaaagtagccaggtggtgtagagaccagtagagagctacaaagctagagaatcggaccttagcatggctaagtttatcgatgtatgtatgaagtatggtgctccagttcgtagtagcaactgggaactgatgtagtcctgatggatggacttggactcaccctgatcggtcactcaggcactctgtagtgtagatgtaggcatgtagctgctgctagtagtagtagtaatgcaagtactgctttgcatcgtatgggtgagagagttgaacaactaatggaatgcaaatgtgccgttttgttttaaaaaaaaana

SEQ ID NO: 7418 - DNA, 1653 bp, Zea mays
cttttttggctttccggtcttttggtggtgtactggtggctggctggctcctgaatcgtcgctgtctctctctctcttcgctttcggcagctcagctgcactccacagtctgcctccactccactctccagtctccaccttttgctgtcgccttcctccccttgccttccctgtgccctcccctccctcgcgccgcaaaaaacgccgcagggaggaagagagagagagagggccaggctgagcttactggcggcgagctggagaagaaggaaggagcatggccatgccggcggcgctgcttctcttcctcctagtcctctccgccttcgaggccggggagcttccacgctgctcggctgctgctgcaggtaaaccggcagtcctcgtccatgatgacttgagtccggttcaagacaccagccccatcgcaacagtcccctccacgaacccgtcgcccgccatcatcaccgtgccttccacgaatcccaccatcaccatcccttccttgaaccctctgcctacacccatcacagccccctcaacaaacatcccttctccttccaccatgctgccgccggttccggtcatatatccgctgccaacgccgtctatgtcctccccaccagctgtgccggtcaccaatcctgctgtcaccacgccttccacgtcccctccgtcgacaccaacaccattcaacaacccaccattgttgaacccaacgccgacccctgctcctacagtcacggccccagctgcttcaggccgggaggtctggtgcgtggccaaggctgctggctcaagtgaagccgcgctccagaacgcgttggactacgcgtgcggcattggaggagtagattgttcggcgattcagccgtcagggagctgctactatccaaataccatccaagcccatgcatcctacgcgttcaacacttattaccagagaaaccctgtttcttccagctgcgactttggggggacggcaatgctcgtcactgctaatccaagctctgggagctgtgtctttgcatcatcattgccatcgtcgtcaagctctactgttggatatgatcccgcgtccacggctactccattgtcaccgtcgtctggttccgactcgggagcacccgtgctgaatgccagtggggcaggttcttctgaatcatcagattttggctttgacatcccaggagctgtcaatttcggcagcggttggaggtcagtctcaccacccaactggccctgggcagccctggtctggattctagtagcattgtgtgtgcacaaagaagggatggtctgaacctgtgagagcatctgcagtattttggagacagattgcaaagtagccaggtggtgtagagaccagtagagagctacaaagctagagaatcgggccttagcatggctaagtttgtcgatgtatgtgtgaagtatggtgctccagttcgtagtaggaactgatgtagtcctgatggatggacttggactcaccctgatcagtcactcaggtactctgaagtgtagatgtaggcatgtagctgctgctagtagtagtagtaatgcaagtactgctttgcctcgtatgggtgagtgagttgaacaactaatggaatgcaaatgtgctgttttgttttaaaaaaaaaaaaaaaa

SEQ ID NO: 7419 - DNA, 973 bp, Zea mays
  misc_feature (972)..(972): n is a, c, g, or t
tatcctacgccaagcccgcaattaaccctcactaaagggaacaaaagctggagctccaccgcggtggcggccgctctagaactagtggatcccccgggctgcaggaattcgcacgagaccattacctagaacatcctaatcgaaaaaaaagcaacgacaattacaaaagagagtaaaaataaagtaacctaaaactcggaggaaagcagaaggggaagagtcagcaatggaggcgagggttgcaggagtgcccgaagacgaagagtccggcctcctcccccgcccgtccgcagccggccgacggccgtcctcccgcggcccccgcttcccgcctccaccggcagcctgggcgacggtggacggccccctcgggcttccgctggaggacgcggagggccacgcccgccgcttcttcatgtggggtttcgcgtgcctccccttcctctgggccatcaactgctgctacttctggcccgtcctccgctcgtcggtcgcctcctcgcccgccgccttcgcccccatccgcccctatgttgtgcggtcggcaattggcttcaccatcttctccgttgttctggtcacctgggccacgaccttcgtcgtcggaggcgagcggttatttgggccagtgtggaatgatcttgtgatgtacaatgtcgccgacaagcttggcatctctggattcatgggatgagcctgcgatgtctccctcgcttcagctgggctcgcttcacccaagcgtggaacgatctattccatccatctccctagggattaccactgtctcatgtactttattgttgttattattattgacagactgactggtcagaacaatgtctagcatggctagctcatgttatagaaggaatatggatcgatgaaaacgatgataaatggaactcaatctgatggacaaatttgtgtgtgtgtgtgtgttgttaaaaaaaaaaaaaaaaaagcccctaaggnc

SEQ ID NO: 7420 - DNA, 4278 bp, Zea mays
ctttagcctcaagagttctcaattcttaagttgttaattatttttaaattatgataatttgatggtaaattcatcatttttgtaacttaaatcatttaaaatatatcacttgtacactagtgtgaactcaatgacggacaagtgatttcacagtgtggtttataagtaaaacgggctattgagagtacaaaacaactccaattttagggaccaaatagtgatatttagaatgttagcatatttagggatctcatttaataaatcgttggaatatgatttttggttgctaccattataaatttaatttatggtgttttttgaactagattcaatgaacttaattaaagcggagattcggagaaacaaaaccaaaagcaacgacaattacaaaagagagtaaaaataaagtaacctaaaactcggaggaaagcagaaggggaagagtcagcaatggaggcgagggttgcaggagtgcccgaagacgaagagtccggcctcctcccccgcccgtccgcagccggccgacggccgtcctctcgcggtgcccgcttcccgcctccaccggcagcctgggcgacggtggacggccccctcgggcttccgctggaggacgcggagggccacgcccgccgcttcttcatgtggggtttcgcgtgcctccccttcctctgggccatcaactgctgctacttctggcccgtcctccgctcgtcggtcgcctcctcgcccgccgccttcgcccccatccgcccctgtgagaccgctaccccttctccccgcttcctcgtctcctctcttccttctcgcgcctgagatctgatctttcgtgatgctagtatgtgacgcgttgtgtgtgtggtggggttgggggttcagctgcacttaacctgtatggatggatcgtaatctaggttcggattgtctcgtgctgcattgacactagcatcacttggtatgttggatgtggggtgctgccttgcaagcgtgtaacctggagaattggatcggtttgatatatttttcgttcaaaccaaaggctacagtcgaatttgagatgcttagttggaggaatgtctttataattcgggatgaatttattaggtcggcttgtgtataatgatcatgttgcaaaaacatactgctaattttgggaagatatgacacgcacattttcttgttctgaaaataatgttgaaggcaccgatatttcaaaccaatttgaggtttctcagtggtatgctgttatttgctacgagctgttattaagttcgctgggataactccctgtgcagataagagatagatccaagaactcttttaatctgaaaagggcttccacattcttagagcccctttggcatggctctttggacggcttcagctcgggctcattataaagctctaccaaccggtcacaaaaaaacggtttctggttgagagcccttcgagagcctgagccgttttattgctaggagccagagtataaaaaacatggcttctacagtctcctcctatgttctcatgcatcatttgaaagaatatagaagaagctgatttgccaaatgaattgcaaaacgactctggctcctctagagaagccaaggagccagagaagcctgagccgaaactgttttcagagaagctagagccctgccaaaggaggccttacacttcccgaggatatctgtctggttcaatagaaccccaatactcacatgagctaaacagtgcaactgatctctatttgcttgttgattggttacatcaattataagttttggatttctttgtaaacttagtattaccagtgaagaaatgttctaattagaggttgtttgggtttaattggtcttctgccttgtcatcagaaaaaagatctgctaccctcaccggtttaactgcattataaatgtaattatttcatcactaatctcacaaggccactgccattgcatcacgaggtagccattttcagcttcttacacatgtcagtatgttttgcagatgttgtgcggtcggcaattggcttcaccatcttctccgttgttctggtcacctgggccacgaccttcgtcgtcggaggcgagcggttatttgggccagtgtggaatgatcttgtgatgtacaatgtcgccgacaagcttggcatctctggattcatgggatgagcctgcgatgtctccctcgcttcagctgggctcgcttcacccaagcgtggaacgatctattccatccatctccctagggattaccactgtctcatgtactttattgttgttattattattgacagactgactggtcagaacaatgtctagcatggctagctcatgttatagaaggaatatggatcgatgaaaacgatgataaatggaactcaatctgatggacaaatttgtgtgtgtgtgtgtgtgttgctagacatcctgggatgcattttgacatagtatgacgttgcaccgagcagtgtgctgtgtccaattttgtggaggccatcaggcctttaaatccaattgaaaaaataggatagcacttctctgtatttcagccccaaattcgggcgcttattatattcagtccggtatcggatgtcaacacgaacatgctgaaacaagcctcggcaacttggcgtcctgtctcaagtccaagcgtcctgctgcttctcaaattttatctagctgctagctggctcagtgtgaaaaaaagagcagtgatggaacggattgctttggtgtaataaaggtgttatgagtatagagattaaataaatggaagaggtgagtataggaactctcaaatctgcccccatactgggctttcacttgggctcggctcggcccacatttactattatttgggcccagtcaaaaaaaccaaaatttgcggtgagcgtggatcgaacacgcgaccttcagatcttcagtctgacgctctcccaactgagctatccccgcttacatttttttcttttcatttactaaaatatactatctatgtcagtacttagttgcacctaaattgacttctgtttgatagaacgatcgtgtgcctgcaagaccaatcctaaacattcctgcgatatgaccaaacatgcagctgaatctttattgtcaatttcatatattagttcgtttttcactgttaccacgtagccctttttacctcatgattttctgtatctaaatcgactaaaaaattataggccacttattattctatctcgacatacagtctactcaaatccagataactactagttcgttagttgacaggcctcagcagggtctttaatttcttaagtttggtcagcctagttaataattttatacctgaatgccttgagcatccggctcagtggtaggtactattaggcggatttaagtagagatgacaacggatacaaaaaccacaggaagggttggtaaacctgcattgcaccggtgagtcaaatgtcaaactcatacctctgcatgttacccacgacagacatattatgccatccacacctattatccgcaggcactaccaacctgtagatgtacccatgtgcgcacaaacaaacagaataattatagatcaacttataatacaaaatcaatagttttctacaacaaactaattattcaacacataacaaactaaaaacattataaggtaaaataacaacattttaaagtggtacgctaacaagcaataacatataagataatataatacaaacaatcatacataatttaaatatatatatagagcgggtttatgagtatacgagcatgagtgagtctttttgtgcaaacgcgagtaaacccgttaaacacgtattcaaacccatccccacgctcatggacataaattcacacctaatctgtcaggtttttgtccctgcaaagataatctggtgaatgtagagtattaacggactctaaattttacactataaaatttaagtatcagattagattatgatcgtactatatttctatccaattttaaaccaaaattatttaagggctcaaataaattataaacagacaatcgtgattcattatcatccaaatatcatgaagtcagatggtgaaagagaagtcaataactatctctagacggcagccatccatgtcacacccacgacaccacacacctgctctacctgctctgtgcttaaatacatgcatgcagctggcttattaaatagatcacatatttttatgtatgtttctcaactatttgtgcattgtttagctttggtcttttcccccagtttgttttaaaattatg

SEQ ID NO: 7421 - DNA, 2168 bp, Zea mays
atgggtttcaacttccgataggtaagagaagatcaggtggcagggttcaaaaaaataagtgatacagattatatggattaaaatgtcggtcacatactcacatgatagcactaaagtattggatctacttaacgctgacgataaaaagaaaataaaaatcacctagtgcatcatataagcatgggtgttcagcaactcttgttttgtttgatcaggaggaaatagaccggctgcaaaagaaactgaaacagctgcaaggagaggagcgtaatcacgacgagaggagcttgtcacctagacaaatggctgcgtcactgaagcgaaagagtctatcagagcctagatatccagagctgcagattccagagaacattgaacaattctcgatgtcgcaaatcgaaaaggctaccgacaacttccactcaagaaatttcatcggaggaggaggttatggcccagtctacaagggaaaagtgggcagcacatcagtggccatcaagctgctgaagcctcgtggtagacaaggtttctcagagtatcagcaagaggtaattcctaaaatatatatattaataagaagtagagttaaaaggcgtaaatggcataccataatcgcactgggggtgctctgatcctcaggtggtggtgctgagcaaattggagcacccacacatcgtgaggctgattggcgtgtgcccggagtcgtgcggcctggtgtacgagcacctccccaacggcacgctcaaggacaggctctccaagggcctcctgtggaaggaccgcgtcaggatcctcggcgagctgcgctctgcgctggcgtacctccactccaggcggccccacgccatcatccacgccgacgtgaagctgaccaacatcctcctggacgccggcaacgcgagccggctgggagacttcgggacggcgcgggcggtgcacgtgaaaccgctggaggaggagaccatcggccgccgcacgaacccgatgggcacggcggggtacatggaccccgtgttcttcatgaccggcgagctcacaacggagtcggacgtgtacgcgttcggcatggtgattctgcagatgctcacggggctgctggatctcaacgtcgcggagcaggcgcgcgaggcggtgaagatggacgccgtgcacagcgtgctggacgcgtccgccgggccctggccggaggtgcaggccgagaagctcatgaagctggcgctcaggtgctgcagcctggagaggaggcggcgaccggcgatcacgtccgatgccgagtggagatcgctcgacatcctacgggctatggtaaacccagctagtaaatcctggaaatggaattcccatgccagctgaatttactgtatgtatgcacctcccagtacatgccttgctgtagcctgcagatgccatgaaacacagtaggggtagctagtgattcttcttgtgattagatatagataagcaaaaatctaagaattgatgtgcattactagaatataagtattcaggggtagtacagtagagaaacaagagatggagcagacagaaatcatgctacatatgaagcagcaattggttagccaagatgatgatggtgcacggttattttttgggaaatctgcacctactcatgttcagtgtcccttgcaggatgcagaaatattatgtgtatattggtagacggtaatataaatctgactatgcacgttttgttcaagatttattacacgaaacggtactgctgatgcatgttccttgaattaatggtgtgagaaagaagtgtcaatcatcagcgaagagtttttttttttcaaaagaaaaaaactgtgaaaatggacaaggtgaggtggatgaactggtattctctaaaaaattcttgcaataattaaatcttaaaaacaagctcaacctcactccaatgactaaagtgttcacaaagagcctagtataccaattcaaaccttatacatggcaatacttgatgtaaatattcaaagtaaattgcttaaatgtaatagcagaaagtaaagcaagggttcataagacatcttaagtttttgttgaggtattaaagagtcaacattctttactagttctcgttgcagtatccgcgcaaggtatcgttctcacttagttcgtgcaacactcaagttggggtcacccacaaa

SEQ ID NO: 7422 - DNA, 2213 bp, Zea mays
agggctatgaaaagttagtagcgctttagagaaactgttagaaacacctttttatgtttttttctaaaaaataaactagatttagatgattcttatgggaagatcttagatatgctttaatatgcacacataggacgtggtcccacacacatcttttcatctagaaaaatatatatccacgaacaatactattcacacaaaaaatatctttatatctgtctaggtagcacactagcactactattgattttccggcgacgtccaaatccagcgctgctccctccaccacacacctgttccggcgccgcggaaacgagggacccgggccgcgcgtggtgcaccgcacaggaagtgacggccagccgtctgcggtcgccgtcgccgtcgccgctgtgcgagtccgagcgagcgagtgggcggcacattaatttggcccaccgcttgcatttcctgtggataacatgatggattattgccagtaacatgatcaggaataagacttctcctgttcctggaggggccgaggagggagttggcaagccgcaaccgcaatgatggcagctgccgggtccaatggcgaaagcaacaggtgccgaagcaggcagtcatcaggcacactggtggagatgagtcagcagagtgagagaatctccgtctccatctccatcctcccgcggataagatcagttcagaggtggacgcgtaagcaccaccacagcccacaggcccctcgtcgccaccgccctataaatcccacggcgcacatcggagtccggcaccgtagcccccgaagacacactgtctccaagaaaccaagaacaccggccacacgcacgcgcgcgcgcaccgacgcacggcaggcgaggccgaggacgaacagacgataaaggaagcaatggctccgtcgctcgcgtcgacggcggggctcccgagctgcgcggcgcggcgcggcggccggtgcgtggcccgccgcgcgtccgcggttgcgactccggcgacggcgaggacgcactacgaggtgctcggggtcggggccggcgcgagccagtgcgagatcaaggcggcgtaccggcgcctggcgagggaggtgcacccggactgcggcggccgcggcgacgaggggttcatccgcctgcacgccgcgtacgccacgctcgcggaccccgacgagcgcgcgcgctacgaccgcgccgcggcggtccggagccggatcagggcggcgccgtcggggtccggggcggggttccggccgcgaaggtgggagacggaccagtgctggtagcaccgtagcagcagccacgtagacgtagctgcgccggcggtggagtggagtcgccggagcgcgctcggtggtctggtccgttcccagggccagttgcgaccatggggcccatattgaagacagcccacatgaaaaacggaccgcgatcctggcagcccacatgagttgggatcgtggactttatgggctgcaggcttcgtaggcctttcgcgccagacctggcgctggatattgttgtaggccatcttgtcttgggatcatagagctgcacgaagagacatttttaacatctcttttgcactgctgctactccttccactctaaattgtaaaatatttttatctttttattaacatattatgtttactagtatatgtttatatatcgtgtatataattaaaacattgtatctagcgtcttataatttacaatgaagagtataaatatatgtgattatattgatatttatacatatatctatgttgttgtttcgacgaattcataaaataactcgcttgttaggacttgtttagcaataatgtttctcaaaatcatagttttacaatattatactttacaattgttatgataataccgtagtattggcagttccaaaaaataccatggttttaagaaatattgtttgaatataacattgtaaactatggttaaacaaaagctagtcatgctttaaaactttaggttggactagagtttttaatactccaaaaatacgatggtatctataataccatggttttgaaaacatagctttcaggattgcaacaaaacactacgatattgctaaaaactatggtattgtctagaaactgtaaaaatacttcacttctaaacagtgcatatgtgtgtggagggtgtcttggacatataagacacgtttccagtgaccaaacaagcagtgatgagtgaa

SEQ ID NO: 7423 - DNA, 1665 bp, Zea mays
gcacgagaccattacctagaacatcctaatcgaaaaacaccctctccctctccctcttccagcgcacagcctcggcccctccatctctctttgctcgcccctgccgtatcctccctctcccataaggtacagggacctcaaggggtatggaagtggagaagtatactagggagcccaaggggagggaggagcaaccgcagcaggtcaggtctgcctatgacccaacaaagctcggtacaaaccactaggaaggaggaggtcgccagaaaccactagctaggaaggagtgagggaggactcaggagtctagctagtttgttcgtccctccctcccgcgtcagaagtcagaactagcctagcctaagccgaaagccgaaaggactcggtgcttgcgtgcggcggtggcgtggggtcgtaccaccaccaccggtcgcggtttggcgacacgacgctgaccaaggtgttcgttggcgggctggcgtgggagacgccgtccgaggggctgcgccagcacttcgacgtctacggagagatactcgaggcggtcgtcatcaccgatcgcgagaccggccgctccaagggctacggtttcgtgattttccgggacccggacgcggcggcgcgggcggtgcagaacccgaacccggtgatcgccggccggcgcgccaactgcaacattgcggcgttcggcccgccgcgggccgcgcagccgagagggagaggaggaggaggaggaggccgagggccgcacgtgcccgatcagccgccccaggggtcgccgtcgccctacagggtgccatcgcagatgaccccgcctcatcaggccgccacgttgttctacaacccccagttcgggtactggtacccacctgattatccataccaacaggcattgtacaattctcaagtgctacaacattactaccctcagatgtatggtccagcctctccttcaggaccagcctaccaatacatgggctatatgcctggtggcccaagtccaaggactggattctcgccgatgcagcaaccaatgcgacaacccttctttcagcagccaacgacacagatggatggttctttcccatcagtcccttcgcttccacctaatttcagactccagctgccccctcgtgcagtctcaagggaatctgatgatgcatctggctcccagtcagcccagccagtttcttcaactccagctacagtcacaaacaacgaggaagattcgaggcctgtagtgtctgattcagatccaaacacaccaaattgacttagtgagaatcctggcaacacgatgtgacttcaatctggtgcaggctattggtagtctgtaacagagtcttcatgatactctcacatcttgactgaaaaagttcccaaagatttgttctttcattatttctgattcttttttttttgaattcttgcattgcatttcttcaccgaatccattgtacggacgactgaatttcaagttcaaacttcaggaattcgctagcatataagttccgtggcatgttagcgttcaaagtactgcagtgctgttagttcgtatctcaaatatgcagtacagtttttcattgaggaaccacccagttttattgcaaccagaacaaatttttcccttcaaaaaaaaaaaaaaaaaaaactcgaggggggggc

SEQ ID NO: 7424 - DNA, 1068 bp, Zea mays
ttttgaaaatgcaaagcctaatagaatccggtgggcatcattaaattgggtgtcgtgtggaaaccagattcaaactggtgccatgcccggcgagaaaagatgctaggttgaagagacagccgttcagctttctcaactgctctggccggaagcaagagctgtcagattcagtcgtgactgatgaagacgaagctgcgagggggcctggagcaagagagacaccgcttaaaggctacacctctagccagcaggaatcaccatacaccatgcgacgtgtcgattcgaaaccaacaacggtccacggttgcgaggatgacgcccggagtaccttgacgtcaagcagatccacggcagatgacctgacaaggacgtgcaggtcggagactggctacccaaagggcgcgcgtgagcagggccgctctgatggcacgcagcaggagcctgacctacagccgaactgcttttcgcgaacgctcaagcttcagaagaagctgctgtcttctggcgcagcgcacaccatctgtctgagggtccagccacataacaagatggatttcctgcctaagaaagagttcgatacgtacttctgcgcgtatgagccctacgagcagtgtccaagatcagattcaagagctacttacagttcaagagacgatgacttgtggagcaagaattcacgctttggctcgaatctactctgctggagagccccaaaacagtccatgtaatggaggaaagaacgagtgaactgggtggaacaaatcgattctgctacgagattttaccaattttgcccgaagctggagacatggacaccacccgcagctgcggggacaaattttgaagggaagtctgggaggggtctgtgctattcttgatcttggtaggcagctgaggattgaggaactatttagtgatgttttcttggaaatgcagatcctttataatgctagtgggcagttgtacagcgcgccagcgacgaaaccctgtgaattgttctgttattctgaattttgtaggacgatttgatgctctctctctgaatttacatgatctttttattagctg

SEQ ID NO: 7425 - DNA, 980 bp, Zea mays
  misc_feature (29)..(29): n is a, c, g, or t
  misc_feature (43)..(43): n is a, c, g, or t
gggaacaaaagctggagctccaccgcggnggcggccgctctanaactagtggatcccccgggctgcaggaattcgcacgagaccattacctagaacatcctaatcgaaaaagtgaggagccccaaatccacttcaacgatggaggaaagcctgtgcgccgtggagaagcgcgggcgggtgcacgtcatcaccctcaccggcgcgggggagcaccgcctcagcccggccctgctctccgccctccgctccgcggtcgcagccgcccgccgcgcctcccccggtgcgctcgtcctggccggcgagggcaagttcttcagcaacggctacgacctcgcgtgggcgcgcgcggggccggccccggcgccggagcaccgcctctccacgatgcgcgccgcgttccgcggcctcgtcgccgacctgctcgcgctccccgtgccaacggtcgcggccgtcacgggccacgcagcgggcgctggctgcgcgctcgcgctggcgcacgacgccgtcgccatgcgcgcctcccgcgggttcctctacattagcgaggtcgacgccgggatcaagatcgtcgattttgtcggcgagctggttcggcagaaggtccccgacgcggccgctaggagggacctggtgatgaagggggagaagatgacggccgcgcaggccgcgcgccgaggcatcgtggatgcggccgtggacggcggcgtggaggacgtcgtggccgcggcggtcgccatggctgaggagctcgctgccagagactgggacggagagaacctggccgccatcaggaaggacgcatggccggttttgtggagcaaggtcaaggactacggctgcgatgtgccggccaggccgcgtctgtaacggcctgcttgcgaatttcggtcgtttctgtgacttgccatttggtcgttatcaacaatctgaaagcaatgatccttggccttgggaatgtgcagacaaaaaaaaaaaaaaaa

SEQ ID NO: 7426 - DNA, 1800 bp, Zea mays
  misc_feature (191)..(191): n is a, c, g, or t
tttgtctcgatcgtcctgcgtacgtcctcctcctgcagccaaactctgattcgctccgtgtatatatgccgtgtcctgatcgtcctgcagcgaacgttgggaagacgaagccattgatggaccttcccggagcaacggagcgcctgtccatatggaaagccgacctggcggaggaaggcagcttccacgangccatcaggggctgcaccggcgtcttccacgtcgccacgcccatggacttcctgtccaaagaccctgaggtagatcagtctctagctctggctgcacaattaattagtctctcgatctctacgtcttcactgcacatgcactgcacacatatactacatacgtatggtttccattgcagaatgaggtaatcaagccgacggtggaagggatgataagcatcatgcgggcatgcaaggaggccggcaccgtgcggcgcatcgtcttcacttcctccgccgggacggtcaacctggaggagcggcagaggcccgtctacgacgaggaaagctggaccgacgtcgacttctgccgtcgcgtcaagatgaccggatgggtacgtacgcagccacttgtcagccctgcgcctcatcaattcaactgaacttcgacgacgacagtgtttggtcaccatcagccctgcctgcggctgcggcacatggcgaccgcgctgacgacaccttttatttatgtccacccccctgcagatgtacttcgtgtctaaaaccctggcggagaaggcggccctggcgtacgcggcggagcacggcctggacctggtcaccatcatcccgacgctcgtggtcggcccgttcatcagcgcgtccatgccgcccagcctcatcaccgcgctggcgctcatcacggggaacgcgccccactactcgatcctcaagcaggtgcagctcatccacctcgacgacctctgcgacgccgagatcttcctcttcgagaacccggccgcggccgggcgctacgtctgctcctcgcacgacgtcaccatccacggcctcgccgccatgctcagggataggtaccccgagtacgacgtcccgcagaggttccccgggatccaggacgacctccagccggtgcgcttctcgtccaagaagctccaggacctcgggttcaccttcaggtacaagacgctggaggacatgttcgacgccgccatccggacttgccaggagaagggcctcatccccctcgccactgccgccggaggggacggctttgcctcggtgcgcgcacccggcgagacggaggcgacgattggcgcttaagcaacaatcacccggctctccccgtcgatgatgctatcagctatctatctcttcgagctccgctgccaatacggaacttacttccatgttcaacgaattgttttatcccctggattacgtattgtttttatgttttatacccaaacaacgaatgtttctcagtattttactacagctagcccctatagtagagattctattatatgaataagctatctgtagaggctctggtgcaatatatatttcgagttatttggattactagcataattcaatttttaaaaactattattattattcacttattcgggaggctactattataattatttttctgcaactagaaggtcccagatttgagtcatagcctctctgcatattatgtggggaagacgcttaaacatagctttctccagacctcgcacagtcttgctcccatcccgtccatgtgacgcaccccttttttttttcttttttttggtgctgcacaactcgcatgtgcatttag

SEQ ID NO: 7427 - DNA, 1541 bp, Zea mays
cctcgagccggccgggacacggggaaacttaccaggtccagacatagcaaggattgacagaccgcggccattattgggtacctcgaggccggccgggagcagctaaagaagcaaagcaagtgtctgctcactcagtcctgcgcaagagctcgctctcggagaaaaaaacgcgggaggcgataatggagggaggtgccggtgcgagcgagaaagggacggtgctggtcacgggggcgtcgggcttcgtcggctcctggctcgtcatgaagctcctccaggccggctacaccgtccgggcgaccgtgcgcgatcccgcgaacgttgggaagacgaagccattgatggaccttcccggagcaacggagcgcctgtccatatggaaagccgacctggcggaggaaggcagcttccacgacgccatcaggggctgcaccggcgtcttccacgtcgccacgcccatggacttcctgtccaaagaccctgagaatgaggtaatcaagccgacggtggaagggatgataagcatcatgcgggcatgcaaggaggccggcaccgtgcggcgcatcgtcttcacttcctccgccgggacggtcaacctggaggagcggcagaggcccgtctacgacgaggaaagctggaccgacgtcgacttctgccgtcgcgtcaagatgaccggatggatgtacttcgtgtctaaaaccctggcggagaaggcggccctggcgtacgcggcggagcacggcctggacctggtcaccatcatcccgacgctcgtggtcggcccgttcatcagcgcgtccatgccgcccagcctcatcaccgcgctggcgctcatcacggggaacgcgccgcactactcgatcctcaagcaggtgcagctcatccacctcgacgacctctgcgacgccgagatcttcctcttcgagaacccggccgcggccgggcgctacgtctgctcctcgcacgacgtcaccatccacggcctcgccgccatgctcagggataggtaccccgagtacgacgtcccgcagaggttccccgggatccaggacgacctccagccggtgcgcttctcgtccaagaagctccaggacctcgggttcaccttcaggtacaagacgctggaggacatgttcgacgccgccatccggacttgccaggagaagggcctcatccccctcgccactgccgccggaggggacggctttgcctcggtgcgcgcacccggcgagacggaggcgacgattggcgcttaagcaacaatcacccggctctccccgtcgatgatgctatcagctatctatctcttcgagctccgctgccaatacggaacttacttccatgttcaacgaattgttttatcccctggattacgtattgtttttatgttttatacccaaacaacgaatgtttctcagtattttactacagctagcccctatagtagagattctattatatgaataagctatctgtagaggctctggtgcaatatatatttcgagttatttggattactaaaaaaaaaaaaaaaaaaaaaa

SEQ ID NO: 7428 - DNA, 1392 bp, Zea mays
agcagctaaagaagaagtgtctgctcactcagtcctgcgcaagagctcgctctcggagaaaaaaacgcgggaggcgataatggagggaggtgccggtgcgagcgagaaagggacggtgctggtcacgggggcgtcgggcttcgtcggttcctggctcgtcatgaagctcctccaggccggctacaccgtccgggcgaccgtgcgcgatcccgcgaacgttgggaagacgaagccattgatggaccttcccggagcaacggagcgcctgtccatatggaaagccgccgggacggtcaacctggaggaacggcagaggcccgtctacgacgaggaaagctggaccgacgtcgacttctgccgtcgcgtcaagatgaccggatggatgtacttcgtgtctaaaaccctggcggagaaggcggccctggcgtacgcggcggagcacggcctggacctggtcaccatcatcccgacgctcgtggtcggcccgtttcatcagcgcgtccatgccgcccagcctcatcaccgcgctggcgctcatcacggggaacgcgccgcactactcgatcctcaagcaggtgcagctcatccacctcgacgacctctgcgacgccgagatcttccctcttcgagaacccggccgcggccgggcgctacgtttgctcctcgcacgacgtcaccatccacggcctcgccgccatgctcagggataggtaccccgagtacgacgtcccgcagaggttccccgggatccaggacgacctccagccggtgcgcttctcgtccaagaagctccaggacctcgggttcaccttcaggtacaagacgctggaggacatgttcgacgccgccatccggacttgccaggagaagggcctcatccccctcgccactgccgccggaggggacggctttgcctcggtgcgcgcacccggcgagacggaggcgacgattggcgcttaggcaacgatcccccggctctccccgtcgatatgatgcaatcagctatctatctcttgtttgccaaaaaaaataagggaggtcttggcatactcgatctagagcgctttgcaagagcgttaaggcttagatgactatggctacgatggacgaatagagacaaagcatggactgggttgcaattaccttgtgataaagcagatgtcgatctatttaatgcatctacgattgtaacaattggtgatggcaaaatggctgatttctggagatcaaactggattcagggtcaggccccgaaaaaaaaaaaaaaaaccttattcatgaaagcaaagaggaaaaatatctcagtgtgccaagcccttacaaacaatcgctggatgcacttttgcgccccttacacacatgaggatgagataaaagaaattcatttccctc

SEQ ID NO: 7429 - DNA, 1009 bp, Zea mays
attgggtacctcgaggccggccgggagcagctaaagaagcaaagcaagtgtctgctcactcagtcctgcgcaagagctcgctctcggagaaaaaaacgcgggaggcgataatggagggaggtgccggtgcgagcgagaaagggacggtgctggtcacgggggcgtcgggcttcgtcggctcctggctcgtcatgaagctcctccaggccggctacaccgtccgggcgaccgtgcgcgatcccgcgaacgttgggaagacgaagccattgatggaccttcccggagcaacggagcgcctgtccatatggaaagccgacctggcggaggaaggcagcttccacgacgccatcaggggctgcaccggcgtcttccacgtcgccacgcccatggacttcctgtccaaagaccctgaggtagatcagtcttggctgcacaattaattagtctctcgatctctacgtcttcacactgcacatgcactgcacacgtatactacatacgtatggtttccattgcagaatgaggtaatcaagccgacggtggaagggatgataagcatcatgcgggcatgcaaggaggccggcaccgtgcggcgcatcgtcttcacttcctccgccgggacggtcaacctggaggagcggcagaggcccgtctacgacgaggaaagctggaccgacgtcgacttctgccgtcgcgtcaagatgaccggatggatgtacttcgtgtctaaaaccctggcggagaaggcggccctggcgtacgcggcggagcacggcctggacctggtcaccatcatcccgacgctcgtggtcggcccgttcatcagcgcgtccatgccggccagcctcatcaccgtgctggcgctcatcacggggaacgcgccccactactcgatcctcaagcaggtgcagctcatccacctcgacgacctctgcgacgccgagatcttcctcttcgagaacctcgccgcggccgggcgctacgtctgctcctcgcacgacgtcaccat

SEQ ID NO: 7430 - DNA, 1354 bp, Zea mays
  misc_feature (710)..(710): n is a, c, g, or t
gggtacctcgaggccggccgggccggggagcaaggtcaactcaggcctccgcaagctagctcaaagaaaaacgaaataatgagggatgcggtggcaaagcgggaggcgatgaagggaggcgcgagctcgaaagggccggtggtggtcacgggagcgtcgggcttcgtcggctcctggctcgtcatgaagcttctccaggccggctacaccgtccgggcgaccgtgcgcgaccccgagaacgttgggaagacgaagccattgctggaccttccaggagcaacggaacgcctgtccatatggaaagccgacatggcagacgaagacagcttcgacgaagccatcaggggctgcaccggcgtcttccacgtcgccacacccaccgacttcgagtccaaagaccctgagaatgaggtgatcaagccgacggtggaagggatgatccgcatcttgagagcctgcaaggaggccggcaccgtgcgccgcatcgtcttcacttcctccgctgggacggtctgcgtcgaggagcggcggcggcccgtctacgaccacgacaactggagcgacgtcgacttctgccgccgcgtcaagatgaccggatggatgtacttcgtgtctaaatccctgggcggagaaggcggccatggcgtacgcggcggagcacggcctggacctcgtcagcgtcatcccgacaacttcgtgggtgggcccgnttcctcagcgcggccatgccacccagcctcgtcaccgcgctggcgctcgtcacggggaacgaggcccactactcgatcctgaagcaggtgcagttcgtccacctcgacgacctctgcgacgccgagatcttcctcttcgagcacccggccgccgccggacgctacgtctgctcctcgcacgacgccaccatccacggcctcgccgccatgctcagggataggtaccccgagtatgacatcccgcagaagctccgcgggatcgaggacgacctgcagcccgtgcacttctcgtccaagaagctcctagaccatggcttcactttcaggtacacggtggaggacatgttcgacgccggcatccggacgtgccgggagaagggcctcatcccgctcgccacggccggaggggtcggctctgcctcactgcgcacacccggcgagacggatgtgacgaatggcgcttagacaacaatagcttgtttcaagaaaaattactacaacttgcctctacacagtagaaatcctacgaataagctatatgtagaggctgtgatgtaatattattgttttcctgcaacaactcaaaacacatctgttcccaaatcaaacagaacttcttatatatatgacaactatttatgcgt

SEQ ID NO: 7431 - DNA, 892 bp, Zea mays
  misc_feature (56)..(56): n is a, c, g, or t
tggattttatttataaagctacacgaggtggttgtgtaaaggtttaagtgttacancatatggttggatctaaatctcacggattttcatgcttgccctcctacatgggtttgaataccacaccgtatacgtatctgccatggcatatttaacatctttcagagttcagacacgtggtgtggcactagaaacactagctgcaaacaaccgctctttcctctagccaagtgataatgtccgcatacacacgctcaacgtcgtcagggagttcggctgtcagcgcatgccacatcccagggtacagcttgaaggttttgtccttgctcggtgccttctcgaatagcagcttgctgactgaagggtcggtcacgacgtcatccccgccgtgcaggaccaggaacggcatcgtcacctgatccaagttcttctcgatatcaaggctgaccatcaggagctcatggcaagttttcagggggagctttcctctgtatatatacggattggaacgaacctcctttctcatctctggatctttgcagactttgtcaatgatatcaggtgtgggtatgaccttccaaccaggcgcaacagcacaaaccatcgtcagagcgctgaccacgatcgggtgaggcctcatgtcatcagagatcttgcacatcggagcgagcaagatggcgccgtcccagtagcccggtgccttccggtggaggagaagggccacgcttccgcccatggagatgccgtacaggaacctcctcttccctctgttctgtggtttctctgaaaccaggtcccgtccggcccgggctccccaattgttcttccaccattgctaacttcagaagaacgaaagtaattttaatcatcatcggagttcccggccggcctcgag

SEQ ID NO: 7432 - DNA, 2874 bp, Zea mays
gccggccgtgttccggtaccatcccctaccctatgtcgcgagctcggccggcattagccatggcgacggcggaggcggcgctgctgctgctcctgtgcgcgtcggcgttcgtggagcgcggcgcggcgctgcacctctgcacggaccggctgttcaacgacacgaaggggcggcacgacgacggcctgccgcacctgaccccgacggaggaggccacgtggatgtccctcctcccgcgcaggctccgcggcggcggccgggccgagttcgactggctggcgctgtaccgcagcctgacgcgcggcgacgggccggacggtggagccggcaagccgggccccgaggggctgctgtcgccggcgtccctgcacgacgtccgcctccacggcgacgggagcctctcctccatgtactggcgggcgcagcagaccaacctcgagtacctgctctacctcgaccccgaccgcctcacctggaccttccgccagcaggcgggcctgcccaccgtcggggacccctacggcggctgggaggcgccggacgggcagctccgcggccatttcgtagggcactacctgagcgcgagcgcgcacgcgtgggcggccacgcacaacggcaccctgaggaagaggatggcgagggtggtggacattctccacgcctgccagaagaagatgggcacggggtacctctcggcgtaccccgagaccatgttcgacctgtacgagcagctggacgaggcgtggtcgccatactacaccacccacaagatcatgcagggactcctcgaccagtacacgctggccagcaacgagaaaggccttgacgtggtgctgcggatggccgactacttcagcaaccgcgtgaagaacctggtgcagatccacactatccagaggcactgggaggcgatgaacgaggagaccggcggcttcaacgacgtcatgtatcagctgtacactataacgagagatcagaaacacctgacgatggctcatcttttcgacaagccatgcttcctcggaccacttggtctccataaagacgacatctcgggcttgcatgtgaacacgcatctccccgtcctcgttggtgcgcagaagagatacgaggtcgttggcgatcgtctctacaaggacatctcgacttacttgtttgatgtggtgaattcttctcacactttcgcaaccggaggcacatctaccatggaacactggcatgacccaaagaggctggtggacgagatcaagatcagctcgaacgaggagacctgcgccacctacaacttcctcaaggtgtcgcggaacctgttccggtggacgaaggaggccaagtacgcggaccactacgagaggctgctcatcaacgggatcatgggcaaccagaggggaacacagcccggtgtcatgctctacttccttcccatggggccggggcggtccaagagcgtcagtggccagtcaccgtctggccttccgcccaagaacccaggggggtgggggaggtcccaacgacacgttctggtgctgctatggcacggggatagagtcgttctcaaagctaggggactccatatacttcctcgaggaaggtgagagtgagaccactgggctctacatcatccagtacataccgagcaccttcgactggaaagccacgggcctcactgtcaaccagcgggcgaaacctctgctgtcaacggaccccttcttcaaagtttcgctcaccatttctgcaaagcgaggtgcccgacaagcgaaggtgagtgtccggatcccatcgtggacgacaactgttggcgcaacggcgatcctgaacggccagaagctcaacctgacacccactggcaactcgactaatggtggtttcctgacgattaccaagctctgggccaatgacaccttgaccctccatttccccattacccttagaactgaggcaattaaggatgaccggccggagtacgcgtccatccaagcggtgctgttcggaccgcacctcctcgccggcctgacacacggcaagctgccagtgacagacagcagccactccaacgacggcctgaccgcaggcatctgggaagtggacgccacaggcgccgcctccgtcgccggctgggtcaccccgctccactccgagacgctcaactcacagctcgtcaccctgaaacagagcattggcgggcgcaccctcgtcttgtcggtgtccatcgctgacgcgaagctggagatgcagcagcagcccgcccccgggaccgacgcgtgcgtgcacgccacgttccgcgcctacggccaggcgggcggcagcagcagcagcagccagctgctgcgagggcccaacgtgacgatcgagccgttcgacagaccgggcatggcggtcaccaacggcctcgccgtcggctgccgtggaggccgcgacacgctcttcaacgccgtgccggggctggacggcgcgccgggctccgtggccctggagcttgccaccaggccggggtgctttcgtggcgacggcccccgcagcggggcgcgcgaacgccaccacgcagggtcgtctgccgagccaacaagggcggcgcggcgttccggcgagcggcgagcttcgcgcgcgcgccgccgctgaggcgttaccacccgctgagcttcgcggcgcgcgggacggcgcggaacttcctgctggagccgctgcggagcctgcaggatgagttctacaccgtctattttagcctcgtctccgacggcgagagctgattgatcggtgtgctcctgaacgaacgctccgctagtttcgctgtgcaatgagccattgacgctctgtatcccccatgaactatgtgcaatttggagtggagtaaaaatgtatggcgctagttccatg

SEQ ID NO: 7433 - DNA, 5414 bp, Zea mays
  misc_feature (5402)..(5402): n is a, c, g, or t
  misc_feature (5406)..(5406): n is a, c, g, or t
gtccctctgataccatattgttagcaccacagaaggtagaagaaaggagatcagagattggagctaggaagacggaaggaagacgagagctagacggggtctcagtgaattggtatttgtattctgttgtttgatgccttttacaaatgactcaagcctatatttatatcttctcaagcccacataacccatagctcatctactacacatgaccatagctcatagcccacctaatatatctaacaacctcccttcgtcagggctctggattctcgagaactaggtgacgttcatgtgtatctgaaacctgcgcaagaagacgaaggagaactgttacgaaggacccatcggagccaccctatctcgtttaagtagcttgtgaggaggtgacgcgagagaaccggctgacctgatttgctcagcacctgatctttaacctttacgaccagtcgcttctcccctggggcctagctggccgctttccggctttggcgcactcgcgtcgaaggggacaaaacggcggcgaaacaacggctgcactgctggaaccgcagccggagtccaccgattcgtcctgtccaacgccggtcagcggcggtcgccttttaccgaccggacacctaacccagacaccatctgccgcccataagagaacgacgaaaagaactcaccgtctcgtcgtcagagcatctgaggtgctgctccaaagcgaagaagccagctgcttgttgttaggtgcgcagtctatcgcgcatgcagtgagtgccgtcgtggcggcgctgcgactgtgccccatcgcctcgtcaacaccgccacctaaaccttgagaacaacgtgtgtgcctttctttattttagcttttcgttctgcaagtagtgctactgctacaggcgtacgtgcattggagatgctgctggtccggcggcgggcgcctgacggattgcatcggcaaacttcccaccgaatgtctttgtgctaatcgatgagctagacgacgacttcaacggtgacctgcgtcccactcggaatgatttcttctctgcggttatctggaagcttgggatggataccttctttctctagagttcagacactgtaaactaaaatatacttgtagcgtccaacttgagggcttgtttgggtacttccattcccgccatctcagcctgcttgcttacctatggctcagcagaactgcagaacctaccactgatggctactagtaatatttatatttaatcatgggttcagttcagctttctttcagaatcacggcggcactggtgcgttgatgttatccaaaacataggttctccggagaagcattatatatgtgaaacagatgatgcttcggctaacaagattatagtcctctctcctttcgatttgattgctacttgtaactgctcagctgtcgttttgccgttgcttcgctcgctttccacgttttcagtgtgactgaggcctgtttggatcgcaacagctagatgaaagaaaaccaatttggtgtctgacttattctcaagggtcaatataatctttgtatattgatatatcagttttacactttgtataaattatatacatctttactcacaagtcgtattacctatttatcagagctgtcattcacatgcaattcttctgatgaaatatggcagggttcaatacaaggtctttataaagacccgcaacaactcatgtggtggtttcttttttttcctttgtagttttatgtttccattttccaaatttcaattccgattaaaaaaataagttttaaattcaaatttgaatcaatcaaaaccatggttcagcatgcagtgcacacacagaaaatatttattttaagaaaaatactcttttaaatgtgtagtcaattaaaggcactagctcaaataaatattttaaagaactttattcatttcttgaaatagaaaatttggatgttacatcccatcttatgcttgttgtgttaaggtaatctagtacctagggttaagatcctagcccaaaacctggctctgataacatagtgttctaagatctaagctcgaaactctagacactaaaattgtagacagagggagctataccttcgaaactgagaggagcgactatatgagtcagagtttaatgagatgggagtgatggacataacgacgatgaccttcctttaactatgttagtagagattagcaggtccgttcctggcttttcagaggcccagtgtgaaattcgatatagaggtctcatctacacacaaatatatataattatacatatatcaccgaatatttaacgtataaaaaatattatgcactgttttaaagtttataagataagatataaaatataacaaaaaacattactcgcttatatcatcgagatcaatctcatccaacaacttttttcgatatatagaatcgtcaagccatttaacctctcttgagttattgttgaccataaatagttcgataagtaattgagacattagtttaacaatataaacgagactagtcgataacttgatagcgcatcgtttttttgtgtatttgcgtgtagaatagattgatttaataaaaaaatgctaacgttcagtggctaggaggccctctatttttgggggcccggtgcggccacacccacggcaccccctcagtgccggccctggagattagatcgaatctgatggggcgggaatgtatggccaaagagatacaacaaatgttggttcacgtgcctacctcttgcctatttatctaggaggtgtgggaaaagaccacaaccgatatatactattacatcccgatcatagcgtgaaaagaccacaacctatatatactattacatcccgatcatagcgtgaaaagaccacaaccgatatatactattacatcccgatcatagcgtggtgtggtgtctaactcgatccctcaaataaaaaacagacacgttgtaactaaactatttagctattttactccctcttaatgaaaaaaaacgtgtcaacggacacattctcgccaaaaaaaacatatgttaatttggtgctgacattcaagaaagaagctagaaataactaaaaagggcaatgcgcgttacatgatataatcgagataaattcacattttacaaaaaaaacacacacacacacatggagttaagccgtctcaccgtatgccatatttgccggcgcagaaacattttgttgtcgtggcggcaagcctacggcagaaacatgccgtccgtcgggctcggtcgacaccggcagcacgtcggctgcaattccaatctcccatatgggacgacgaggcaggcagagaggcagcctaggcgtttcagtttcaacgccgatgctctctaccgtactgacaaaccactagaaactctcttctctctattcgagagatgcgggaagacttgaggattattagcatatgttaaacgcttattaaaatcgtgcggccgttgcattgcacgtcatccgcagcacagctagcatcccgatctttcatgcacctgcacagaaacagagctgcccgcgtcgtgcatttttttttctggtatatataagcggaaccgaaaaacatgttgggtcgttagggtgttcacgttgtcagcagattgcgtccgttgcgttgttcagatcacccggccattgagaccgggaactttagaatgaaccagaggcgaggcgaggcgatgattgagctgctcagccggccggggagatagatgcttgtcaaacttgcctagcaacgtcatattggctggtgcgaatctggcggacacgcctgcctcaaatgtaatgtacccgtattaaagcctctagaaaagaaagaaaaaaaacctgatcaccccgtttgagctgacttgtcgacactatccgatctatctaccgcgcatcaagactgacttaagaagcaacaagacacagactcgttttcagccagcagcttcagagagctacatttaccttgcactagcggtcgagaacgctgtcaggctcatgcacaagcaaccggagcaaaaaacgcaaacggcacagcaggaggcgatccaccaccacacgcaataaacgagacacagccgccggccgggtcaagcgacgtctctgaaccccgtgtgcggagggaggctgagagcgacggaaacgcgtagaaaaaccagcgcatgttgggcacccccgcgggccgcgcccgcctataaaaacgagagcgagagcccgttcctccctacaggctacagcggaaaaaaaaacaaaatggaggggctcatcccgttcatctacaaggccatcaaggagcggcgggcccggagctacagctactactactcgcggtgcaactccaccggctcgtcgcgcggccggctcggggcccgcgtggaggacagctcgtgggacctgcagcagaagcagtgggagtccgccgccggtggcaaggcgccggcgggggcggcggcggagcgggagattgcgcaggcgcaccgccgccaccgctccctcgacgagctggcgggggaggtgggcgcctcgcccgggtggcgccgccgccacccgggcgcgccgctcagggcccgcagcgtcaggatcttctcctgcatcggcggcgtgtgatgtgcggatgcaccggccgcgtggcctgcacggaactggatggcggagggtttgtttggacgcgtcgtgctcgtgctcgtcgagcatgcgcgcagggggtggtttgctcgtgtttttttttttttttttttgcttcgatccgaggtgggcagcgaaggagtagtaattctgcagtggatgtaaatcctgctaatgtaatccaacaaaaagtgtacatattcatgtggatttgtgaacatgcaaattatatttgcaaatcatggtttgcattgcatgccccctgcttctgcttccgagacggtgcaggagactgtcaaataaaccaagtctccagctgcagaaaattcgaaacgaacatcgtgtttgtagtcagaggcggcacgtaacgagttaacgttctaatgtatgcttagcgggcgtaactagatggaatttaaatttgggatatttaaattcatatctttagttttgtcatgttcctcgtttttatccttagttatactttttgctcagttttgttcttctcttctatagcactacaaaagtagaacactgtttaaaaaacagtgaagttggtatcctgacgaaggtgatagggttaatcgtaaacgtgttactgcgttggaacatgatcgttttgtaaagataaattttattattattagaaaaaacatcttcaacaaattatgtaaatgcatcttcaattttagcacctcttctttcctacacattcgctctctatttctggatagcatgttttacttatcatacaacacgttcnaaanttaaagag

SEQ ID NO: 7434 - DNA, 1076 bp, Zea mays
ccggccgggatctcatctctctccccgacctcccagctctagagtctagacagccacaggcaggagctccacgagtccacgtgacctcagacctcacacattcacagtgtcacgctgcctcaacgtcatgtctctcctcgcctcccccacgccgttcggcgtgaccgccatccgccgccgcgtcgccccgcttcctctcctccctgctggcggtcgcgccgccctgcacgtggccctcgcgcgccgcggcggggtctcgtcccggacgcagcggcgcctcgaggaacgaggaggcaagaagcgccgcggtggggtcgtggcgcccgacgtggacgaggacgcggcggaggcgggggtggctgagtgggaaggggagccgctggggttcgaggtgtcgacggagcccatgccgcggctgccagacccggagacgcccgacttctgggagggacctcagtgggaggccctcggcttcttcgtgcagtacatgtgggcgttcggcgtcgtcttcggcctcattgcttgcggtgtcgctgtggccacttacaacgatggtgcaacagatttcaaagacacgcctgcttacaaggagtcccaatcacaggagttccctgaggagtcagaatcatcaagcgctgatgtgtttgaaggcaatccgactgaggtagcaccagctctcgagtaggactatcaaggaggcacgggagaaaagttgtctctcgattcaagctatagcctatagggcttcgccttcgcaatatagatgcaaaggtttggttgatgatgctaagaaaattggctggtaattattttgtactgaattttcccttagaattaaatatagatggctagtgtctagtggtgatatgatgggattcgtctgtattattcttccaaacagtggggggcaaaagaaagagagcaagcattgctgtctatcctgtattttgcattcatcatgcccctatgatggcttttggcacttagtccaggggaaatgtataattcaacacaaatacattctgtaccggcacaatccataattaaggaacatgtagcattatcagattaaggcc

SEQ ID NO: 7435 - DNA, 2261 bp, Zea mays
ttgggtacctcgaggccggccgggtcgactctgcggttgcggcctgcggggcgatgccaaaatcgaaacacgcctccccctcctcgtctggctccccgtgaccgatctcgtaatctcatccgcacccgcctggccgccttgcctagccttgcctgctctcctcatgccctggccgccgcctataaaagagcgaggcggaggggcaggcgccggccgttcttctctctcctccttcctcggtcctctcctctccgcatttcgggcggccacttgtggcggcgtagctagcgtactacagctccctgcatggtgatggaggggcgcacgggctcactctacggccgcctcaacaagagcagcacgcgggggttcctcgcctacaccgccgccggggctgcctgcgcggctgtcctcgcctgcttcgtgctctccgccgcggactcgccggcatctgcggcgcgcaacgatggcgagcgcctccgcctgtcctcgcgctcaccgcgcgtctggcccgacctcgcgttcaactggcgggtggtggtcgccaccgtcgtcgggttcctcggttccgcgtttggcaccgtcggcggcgtcggcggaggcgggatcttcgtgcccatgctcaacctcgtcgtcggcttcgacaccaaatccgccgccgcgctctccaaatgcatgatcatgggggcctcggcgtcatcggtttggtacaacctccaggtgtcgcacccgaccaaggaggcgcccgtcatcgactacaagctcgcgttgctcttccagcccatgcttatgctcggcataaccatcggcgtagagctcagcgtcatcttcccatactggctaatcactgtcctcattataatcctcttcgtaggcacctcgtcgagatccttctacaagggaattctgatgtggagggaggagaccaggattctgacggagacacgcgggcgagaagagcaatccaagtctacctgcgctgcaagtgatgtggtcattgatcccagttatggggagcccctcctgactcaacctcagcccaagaagtctgcatgggagactttcatgttcaatctgaggtggaagaatatccttgtgttaatgtctgtctggtcattgttcttggtgctgcaagttctcaagaataattcaaaatcatgcagctctttctactgggtgataaacgttctgcaggttccagttgcggtaagtgtgttcttgtgggaggccatgcagttatgtagggagagtcatgcacgacgtatgaatgggaacctggaatgtgtgtgtgaggcctctattgagtggtcaccagcacaactgatcttttgtgccttttgtggccttctcggtgggactgttggtggccttcttggatctggtggtgggttcatccttggcccacttcttcttgagcttgggtgcataccgcaggtggcaagtgcaacagcaacattcgtgatgatgttctcctcctccctctctgtggtggagttttacttcctgcacagattccccctgccttttgctggctacctcatcttcatttccatattggctggattctggggccagtgtttggttaggaagatcgtgcatgtgctcaagagagcatcgcttattgtcttcatcctctcctctgttatcttcgtcagtgctcttacgatgggtgtcgttggaacccagaagagcatttcgatgatcaacaatcacgaatatatggggttcctcaacttctgcgagtaactcaaacaccatcagactgtcgatccgtccgggagaatccaggccaatgcctaattgacctcatctccctcaaaatctagaagaataaagtcgccaagtatgtgcacaggttagctcctcgctaacatgtgcgcatttaggccgacagagtcgctgtagtgaattcagctcgtgttagctcctggctaacgagctgaccatacggctttagttttgtggaagtgggcgcgatttcgtcatgtcatgcatgtgttagctcctggctaacctgcaaatgcgtgtgttggtgcaggtttttgtcacgtctgcgtcagctcctggctgaccagcagttgtttgtcgttcattctctgcgtcagctcctggctgaccagcagttatttgttgttcattcttgcgctagcaccaggctaggctgcaaaactgcaaatatttgttgcatggaacattgtaaatatcagtcaattcccattctgtttgtgcaaaaaaaaaaaaaaataagcggcccctcgtgc

SEQ ID NO: 7436 - DNA, 3729 bp, Zea mays
  misc_feature (641)..(641): n is a, c, g, or t
gcagcgtgagatttaatttgtctacgaccggagataggagctcggcgccatgaatcatggcgccggactcggccacataagcgacagtggagcaggagagtccaacgcacgaggcacttggcgccataagctatgccgccgagcaaaaggttcacaaatgacatttaatttttctagggtctaaacttgattttttttcttcgaaaaaggaccaaaatgctaaaaatttggtcttcacaaagagcgtgtctttggaattttttaattaacccctcaagagaccacataataaatgtagttgtacccgccctaaaccgaaacataaaaaaacgacacttcaaatttgattcgttgtccgcgagatccctagcaatttgatcttgacgtcgcttgcctattgactttgcacaattttagaaagaactcaaaccgaatcgcgctggaacatgctgggctcaagggatgcgcatgtgatctggatctgacactcgacttgttataacgaaacatgcggctgtgatggaagcacgaagttacgcagttaccctcttggcggaaaggatgatggcaattacacgtgcgaaatcaccgtgctgtgatttttttacagaccccacatgcgaatggctactgacaggttnattagctgcaaccagacaagcgggcgagcggggccagtaggcagtagccattacggcgccggggccagtaggcagtcggagtcggctgccaacccttctcatcattcactaaaaaaccccgttcggtcccacattacatgactcgcttcgctcgactctgcggttgcggcctgcggggcgatgccaaaatcgaaacacgcctccccctcctcgtctggctccccgtgaccgatctcgtaatctcatccgcacccgcctggccgccttgcctagccttgcctgctctcctcatgccctggccgccgcctataaaagagcgaccccccgaggcggccgccggccgttcttctctctcctccttcctcggtcctctcctctccgcatttcgggcggccacttgtggcggcgtagctagcgtactacagctccctgcatggtgatggaggggcgcacgggctcactctacggccgcctcaacaagagcagcacgcgggggttcctcgcctacaccgccgccggggctgcctgcgcggctgtcctcgcctgcttcgtgctctccgccgcggactcgccggcatctgcggcgcgcaacgatggcgcgcgcctccgcctgtcctcgcgctcaccgcgcgtctggcccgacctcgcgttcaactggcgggtggtggtcgccaccgtcgtcgggttcctcggttccgcgtttggcaccgtcggcggcgtcggcggaggcgggatcttcgtgcccatgctcaacctcgtcgtcggcttcgacaccaaatccgctcgctctccctctcccaggacctcgcgttcaactggcgggtggtggtcgccaccgtcgtcgggttcctcggttccgcgtttggcaccgtcggcggcgtcggcggaggcgggatcttcgtgcccatgctcaacctcgtcgtcggcttcgacaccaaatccgccgccgcgctctccaaatgtaagttactggcctttgccggtgcatgcatctgctgatttgctccctgacacgcgtgcgtgctcgcctggttcggtttgggcgcaggcatgatcatgggggcctcggcgtcatcagtttggtacaacctccaggtgtcgcacccgaccaaggaggcgcccgtcatcgactacaagctcgcgttgctcttccagcccatgcttatgctcggcataaccatcggcgtagagctcagcgtcatcttcccatactggctaatcactgtcctcattataatcctcttcgtaggtaatcatcgcttgcctttagcttttggtgcctactgttctgtgcgcccgtcccgtgtactgtgtagtcactgagatgaaaacctgtgctgtattcgtgtggacccattcattgcaggcacctcgtcgagatccttctacaagggcattctgatgtggagggaggagtccaggattctggttggttcctgtcacattcgaaatgtttgctgttgaattattgtatactgacatctgtttttgtttactctatgttgaatgattgcagatggagacacgcgggcgagaagagcaatccaagtctacctgcgctgcaagtgatggtgagaactattacagcactcactgcatgatactttggcatgctttgttcatagcgactagcattagttgcttgtactttgagctgatattcatattatggactaacatgttgtgatcaaatatgaacttgttgcagtggtcattgatcccagttatggggagcccctcctgactcaacctcagcccaagaagtctgcatgggtaagctacaaccactacaagttcctagcattggcatttgtgacttcctaagcaattctggttcttcacgtaatcatatgttatgaatgtgctttcagatccattcataattggttgacaggtcttattcagatccattcagtgattcttcttgtatatattaacatggttagggcctagggtgatactgatagatgctctgaacatgcaagaaagcaataagaaacaaaagagtcacatgtcacctattcacaggattttgtacccttttttatttcaggagactttcatgttcaatctgaggtggaagaatatccttgtgttaatgtctgtctggtcattgttcttggtgctgcaagttctcaaggtctaccttctacactgaactattttttataactcctattttaatatagccaatcttcatagcaatgattgatgcctctgaaagataatgacctcatttctcccatacaagtacaatcactttggaatcagttacttctgttgactgttcaaacctaagttattctagcccgcatgtgcatacaatactttcagtggtcttttgactcctttatctcttttagatggaatttgttattaactgcagcaagtttttgaatacttgcagaataattcaaaatcatgcagctctttctactgggtgataaacgttctacaggtaatgaaaagctcaattttgtgcttctatgttctttaaactgacattatgcctgcctgtcaggctgtctttccagttgtaatagtaaccatttgttctattgcatttgggcaatcattttttttaaaaacataaaccacactagcatatccttcagccacattttaagcatatctcaactcttcatttaacattagcccttattttgttgcaaactgaaagcggggtgttgattctgttatacatcacattcatcagaattgagatccttatcattgataccttttaacattctgctaaattcttttaggttccagttgcggtaagtgtgttcttgtgggaggccatgcagttatgtagggagagtcatgcacgacgtatgaatgggaacctggaatgtgtgtgtgaggcctctattgagtggtcaccagcacaactgatcttttgtgccttttgtggccttctcggtgggactgttggtggccttcttggatctggtggtgggttcatccttggcccacttcttcttgagcttgggtgcataccgcaggtatttaagttgccttgattccatgctattcttgccagtcattttcaaaagctatcaagcagaattatatgttttcatat

SEQ ID NO: 7437 - DNA, 3805 bp, Zea mays
tccttcatattctgaagcagaattttaagctcacatgctcttaccgatatactctctgttcttacactgtgttataatacactgatgaatccattcgtctaactagtaatgaccatgtgtgagattgagcaagttgtttactcattttagtttttgttctcatcaagattaacctcatccaatagttagtgttcagacccagttttgataatttctatgttccttatgtctggatccctcgccttgtgttgttttgtccattaagatcgatcattttgttggtctgttatcatccgcagcttgttctgtttggcctttggcatagacttttcatgacgctctatcaaagctatccatgttcagaactgtatatacaactgtagtcgaaatttcttttcttgatcatttaatgggtccacatttcctcaagtctttttaagagaatgagcttcaaattcatatgtagatatatgcattatcttttcaagtctatattgagtggcaggacgccttcctaatttctgctgaaaaaattgttagcatgatcactctttcgcatagtccataacatctggtgctggaatgtatgtctgtgaaaatagcaattttcttgcaaataatattattactatctaccacttcaaaattaccttgctacttaaatcttagaaggaagtattactcttatcaatcagatttaatgatagtagatgggaagtttatcagctctcaaatctcattcagcacatttggtggatgtctcacaagtgcgctttgtcatggttcactttgctgttttgctgcttttagagtttcatttctgcacaatagtactcatcatttgcttgacctaccaatgtccgattccgcgagtctcctagtattatcaacaacaccaaaaaatgcatgacacgctcagctgattgctacattcaatcattacaatgatgcatttggccaccgaatcaacaaggatctgaaggctgacccccaggacgagtacctcagaacgctgcgggcgatcatccggtgcttcagttgccctgacaggtactttgagaaggtggctaggcaggccatagcggggctaggcacagatgagaactccctgaccagggtcatcaccacccgcgctgaggtggacctcaaactgattaaggaggcgtaccagaagaggaacagcgtgccgctggagcgggccgtcgcgggggacacctccggcgactacgagagcatgctcctcgcgctcctggggcaggagtgatgagccgtactggtgcgctggtgcctttctgaccggcgccgtggtgtttgttcgtgatcgtaataaacctgattgcctagctgtacgtgaggctgtttcttcggtcctggtactgtcgctgcagcatgcatagcagtggaccagtggtgataaataagttactgtgctttcgacgaatgaaccctttttttgtgtctaagttgtggaacctcgagaaagtttttgtgtctaaggctgtctttagtagattgcataagtttaaaatacgagataagataagagatgtgctaatagcttacatgctgcatatgatggcagagtcaccatatgatggcagaggctggcaaatcgcatatggtctctaaattttatactaaaattaaggatcggactaggatcaagttatatttctattaaactaaaattaattaagggcttaaataaattgtaaagaaatatttagatcgtaatcaattactacccctagaggtcctagaggtagccgaagcttaaggtcaacatgaaagatctacgaaagcatgcactaaggttttggatggaaataatgaataccttgttgctaccaggtgacgggggagtacaaatttattggtaattctttggaccaaacatctatatgcagttacaactaggagtgataatagatcatgatccaaatgattcttcacaaaatattagggtcttaaataaaatttaatttaaaaatgaatagaaataggatacgatcctaacccgattcgatctttaaatcttatagtgtaaaatttagagcttattgtcacccttagttacaacttattttaatagaattgatataatacatgctcatgctttgaaaattcttgatttgatgtatatcaagtaattgcctacgacaagcacagagtggcactatagaagacgaatggtagaattgtaattgaaaacctaaagtttgatgcaatgcaccactacagatacttctctcaaaagcttctcaatttggcatatcgagcagcctacgatccagagtgcaccttattgatggacaacgtgtttgatcttcttgatcaacagattgaagataaaattagaggatgtttggtttgaggaatgaaatgatccatcttctcactcctcacttttttatttggtttgtggaatagaatgggttgatacatcaccactccattccttataagctaataattagtatatacatgaggagtggattgattccaccaaaattgatggaatgaacttatgatgcatcacctcatgaagaatagagtgactccacaaaccaaacacatcattagtacattcaccggtccttctaatgctggaaagagggcaacccagattgatgttgttgtaccaaatgacacattaagtaatgcacagttaaagaaaaaagaggtccacataagaagttcaaaggggcaaacatttgggtgggaaggaaagcataagggaaaaaaaggacaaagcaaaaatctgttgcaggtacaagtaccgaaggtatgtcaaaatcctgaacacgagcatgccattcaatattcagttccatgtatatctgatttttttattttgtttcttgcaaggcccgagaggtaggggaagcaagcaatcaagccggcattgccattcattttcataaagaatataacaccatcaattcctccactcaacttgtgattggagcaaaaaaaactgaaaaaatatttttgttctgaagcaagtcagtgttattttgttgtttatggttgtttttttgttattgctaattgcaaggcagatggaatattcagtgaaaacaatctcaaatggatgaatacttgtattctctttctttcaaatccagcttaacaatctcaattagcatgagattttgcttctctgcactctgtttggttgaacaatgtcaggctgtgtactgctggatagggcgtcggcttggctcaactacgacccctcgtcggcggcttggagagctggggcctgcaggcgcatggcgcgggtgaacgtggcgtcgtttggtcttggcgacatcgttgtctcagcgacaacatcattggcttgacggcattgggcgggcatcattactcattggtttggccggatgaaagaaatgagggaagtggactgggagattgctcggcagggccgctccatacaccgctgaagggggaggattgtgaagatcaacgagtgcaccgcacgatgcagtaatgcagcggatctggttcctactctgcacgtccacaaccaagtaccattgtcaacataagtttgttgattctcgacaacgctctacagtagacagccagtatagtcctcatcatcaggctgtctgaacattgggagacaatgactcaagccaatctaaatttacctaatgatgactatgcatacataaggttgatttgtctcttgtggtttagatcgtgatgagtgattgtcaatgagtagcgtctcgggttaagtcatgtggactaaccggggcgggagtaagtgttgtgcaaccaaactcttggcttc

SEQ ID NO: 7438 - DNA, 1418 bp, Zea mays
ctcgaggccggccggggtttatccgtgggtcccccgcggccggccgggatctccgcgcattttatatgcaggcttgcgcctgtcacttctcccctgtccttgctccccctcgatcccgcatcagtgcgtcacattcaccgggaatggcaacgctcaaggtcccagccactgttcctcccgtcgccgatgactgcgaccagctgcgcaaagcattccaagggtggggcacgaacgaggcgctcatcatctccatcctcggccaccgcgacgccgcgcagcgccgcgccatccgccgcgcttacgccgaggcctacggcgaggagctcctccgctccatcacggacgagatctccggcgacttcgagagggccgtgatcctgtggacgctcgacccagcggagcgcgacgcggtgctggccaacgaggcggcgcggaagtggaagcccgggaaccgtgtgctcgtcgagatcgcctgcacgcgcacctccgcgcagatcttcgcgaccaggcaggcttatcacgagcggttcaagcgctcgcttgaggaagacatcgctgcgcacgtcactggggacttccgcaagctattggtgccacttgtaagtacttaccgctatgatggaccagaggtcaacacaaggttggcacactcagaagccaaactacttcatgagaagatccatcacaaggcttacagtgatgatgagatcatcagaatcctcaccactaggagcaaacctcagctgattgctacattcaatcattacaatgatgcatttggccaccgaatcaacaaggatctgaaggctgacccccaggacgagtacctcagaacgctgcgggcgatcatccggtgcttcagttgccctgacaggtactttgagaaggtggctaggcaggccatagcggggctaggcacagatgagaactccctgaccagggtcatcaccacccgcgctgaggtggacctcaaactgattaaggaggcgtaccagaagaggaacagcgtgccgctggagcgggccgtcgcgggggacacctccggcgactacgagagcatgctcctcgcgctcctggggcaggagtgatgagccgtactggtgcgctggtgcctttctgaccggcgccgtggtgtttgttcgtgatcgtaataaacctgattgcctagctgtacgtgaggctgtttcttcggtcctggtactgtcgctgcagcatgcatagcagtggaccagtggtgataaataagttactgtgctttcgacgaatgaaccctttttttgtgtctaagttgtggaacctcgagaaagtttttgtgtctaaggctgtctttagtagattgcataagtttaaaataagagtagagagataagagatctgctaagcgcccacgtactgcataaaaaaaaaaaaaaaaaaaa

SEQ ID NO: 7439 - DNA, 2985 bp, Zea mays
tgcctgcagcttggaaatgttggaatcttgtgtctgaaaccttgacccaaaagaaaaggacagatgctgagactgagggcttgatgcttcaaatagaattgacttgatgaaatttatcatgttattaggttccaccttccagtagttggaaattctttaatgttactgatctagaaccgtgctctctttaccacttcccaggtgtggtgttgtgcagaagtttgagaaccatgttggctattatttgtagacttaaccgatgtgctcctaaatcttaagacgcaccaaacggctcttttgagtttcctttttttgttttttttttgtcattttattagattaaatttcagctttgctgttatgcctcaattttaaatgtcctggcaaacgttttcagggtttgctagcggagtccatccaactttcatgaattacggcacccagatacgtaataggcaacgagaagtcaaacaaacttatttttcatggtcacaaggagagtcaactgaacgggatggtcctcaagtaagtttttatgatacattagtcatttatctttgtcaatttgtttatgctatgtgaaggtagcttatttgaaaaagagagagaggataaatacaatcttgttctcaacaactattactgctagtagtctcaccacccttttctgttgcatttctttacttttgctagggagtatctgtatcccagacacttgatcatggttccatttccttcggaagatttgaattagagtcactatcatgggagaagtggtccgtatttactaatgacaggcgcaatgaagaatttggaaaattcaatggtttagtcgctcagaaaaaggcttattttgaagagtattacaagaagatcagggaactaaaggcttcacagcagcaaaaccagcaaactgaacttattctggaatacagcggtgatggtagtgactccagccaaacagcagaagaggagcagggtgctgatcttgaaacccccactggatctggagcagctgttgatgtttatgtggaagaagttccatgtgaaaccacatcggagcatggactgcagtgctataatgaccaaggaaacgaaaattttgatacagaattttcctcatctaatctttcttcgtcaggtggatttctgcagcaaactgaccatgatgttagagttcctgttcgtggtgacaattctaccagtaaactgtatgcggcgccgcagaatgctagttctgttcacgatggtactagaaaaacatatgaagctgcaaggactcctagaaggattattgagaaagattccaggctcagacacagccccaagataataccaaaatccgtcaaagccctttcacaaagtgctatggattacacatttgctagtgaggtaatagcatggatttgttttctgcatttgtttttttatatataaaactttgcagccttctgcttccacacacataaccttctgagtaggcattacgtactagcagtacaaatgaattagttgtttatctactcactaatctgtattcagctaactagatgagtgcatgctttgctttgtatgcccaccaataataattgtttattaactcattacatattttacgtgaataatttcagaggcctggttcagtgaagcccaatacaactacgagccagaaggctaagccagtgcaaagaccaaatgcagcaagccagaagatgtctgcatctacagaaaggagcaagcttacaggtctcagaagaccttcctcagcaggtgcgcaacggccttctactggagagcgacatgctattgccagggagaattcacaattacctgtggtcgtttccaccccacggcgaccttccactgctgagagacgcccagtcacccgagatcgtgcagagaagcaagccaatgtcaccacaccacgccgaccttctacttctgaaagactccccatcaaaagagagactgcagcaaagcataatgatatttccgctgtacgtcgaccctctacaggagagagacgtgcttttactagagatggtgttctgagaactgatgtgaagacacctagtaaggcaagagcaactgtggctcatccgatgagtgaaatgactacagtggtatgctccagatccttgttatcatatcaacatttgcagcatacagtaaatgaagcacctaatgtggcaaatgcagtttgaagcatcttttctttgaggcaatcatttgttcaaagcatcttgatttggactgatgcttactgacatgctcggttatcatgtgaaagttcaattgcagcaaaacttaacattttacttgttcatgcagggcaatacgagaaaggctatcactccaaatgcagctagaagtagcaagctggaaacaaaaaggttgctcttacacaccgatcgacagattcttgaaagtgttagttttacatgtcggattttgattgtgttgtttcttttccccgcttcattgaacagcaataactacagactgaagggaccttcagcattggatagccactctactaggtcaaacagaatggacttgcaagtgtctggcaagcagaaatcgaggtgctaatctgcattaatgttggaatatcttatgatgcttatagaatatggctgtaaaagttgtcttagccatatttcctgattataacttctggttttgtagttctgttaaccttcctccaaggaaaattttcagttctactgctggagaaccatcagttggaaccatttctaggtcaaaaaagaaagaggtaattgctcatgatttagttatgattcttgcctcttttttatgcatgtgttgcacaaaattgacagtttcaacattcaactttcaactagatggttgccctgttcacgtaagtagttatagcagtcgccattactttgaacaactagtttctggtaatatagtgaactatttcttgttggaatctgcgccggagagacaaccctgcag

SEQ ID NO: 7440 - DNA, 1499 bp, Zea mays
gcacgcggtactcctagaaggattattgagaaagattccaggctcatacacagccccaagatacctccaggcccccccggccccctttcacaaagtgctatggattacacatttgctagtgagaggcctggttcagtgaagcccaatacaactacgagccagaaggctaagccagtgcaaaggccaaatgcagcaagccagaagacgtctgcctctacagaaaggagcaagcttataggtctcagaagaccttcctcagcaggtgcgcaacggccttctactggagagcgacatgctattgccagggagaattcacaattacctgtggtcgtttccaccccacggcgaccttccactgctgagagacgcccagtcacccgagatcgtgcagagaagcaagccaatgtcaccacaccacgccgaccttctacttctgaaagactccccatcaaaagagagactgcagcaaagcataatgatatttccgctgtacgtcgaccctctacaggagagaggcgtgcttttactagagatggtgttctgagaactgatgtgaagacacctagtaaggcaagagcaactgtggctcatccgaagagtgaaatgactacagtgggcaatacgagaaaggctatcactccaaatgcagctagaagtagcaagctggaaacaaaaagcaataactacagactgaagggaccttcagcattggatagccactctactaggtcaaacagaatggacttgcaagtgtctggcaagcagaaatcgagttctgttaaccttcctccaaggaaaattttcagttctactgctggagaaccatcagttggaaccatttctaggtcaaaaaagaaagagggcgttcaggcgacagtgcaatctcgagcatccacttcaaagagaacaactcctttgcagactggaaacttaaaggcgaggggtccaaatccaccagcaccgccacctccaccacgtcggccatcacgaacgactaccaaaccaagtgccggtgcctcatcgattggcggaagaaagccaaaggcttcagcaccacaatggcactgatgcagtggaggagagcggaaagcgcttcagtacagtggcccgcagagcatggtggatctgagggacgtcagtaccggccttcctttgtatggtgtgtactcccgttggcccgtgcagagcagctcccaagtgtagtctcagtacaacccccgttggcccgtcccttcctttgcagagcagcagtctagtgtatgtagtcgcgcgtatcatatcccaccggtgcctagtttcgtcgtccacaaggaacttagaacattgtaaatacctggaaataaatttgcagcttagctctaaagtaaatccagcccaagatttgtgaacatccatgtatgtcattagcaatggaagcccttgtttatcagctaaaaaaaaaaaaaaaaaaaaaaaaaaaaattgtcagatttgattcttcggaaaaaaaaaaaaaaaaa

SEQ ID NO: 7441 - DNA, 1315 bp, Zea mays
  misc_feature (1249)..(1251): n is a, c, g, or t
  misc_feature (1254)..(1255): n is a, c, g, or t
  misc_feature (1265)..(1265): n is a, c, g, or t
  misc_feature (1274)..(1274): n is a, c, g, or t
  misc_feature (1279)..(1279): n is a, c, g, or t
  misc_feature (1289)..(1290): n is a, c, g, or t
  misc_feature (1299)..(1299): n is a, c, g, or t
  misc_feature (1301)..(1302): n is a, c, g, or t
  misc_feature (1312)..(1312): n is a, c, g, or t
  misc_feature (1315)..(1315): n is a, c, g, or t
cgggagccctttcctttccctcccgcgagcacgctacgaatcgccgtggtaaatgctcggccgcggcggccattagaagcccctggccgcccccgccggtaaagagcccccctctccgtcttggcctcggctcgcgcacctgcctgcctcactgcctgcctacctacctgcgttgttgccttcttcgcctcctccccctgtggccgcaccgcagctgctgcggcggcggcagaggtgaacagcttcccgcggccttgtcctgtccggactccggggccgggaccggcagcgcagcgggctcgcgggatctcccgacccccatgcgtcggcctcggtgacagggtttgctagcggagtccatccaactataatgaattaggcacccagtacgtaatggcaacggaagtcaaacaaacttatttttcatggtcacaaggagagtcaactgaacgggatggtcctcaaggagtatctgtatcccagacacttgatcatggttccatttccttcggaagatttgaattagagtcactatcatgggagaagtggtccgtatttactaatgacaggcgcaatgaagaatttggaaaattcaatggtttagtcgctcagaaaaaggcttattttgaagagtattacaagaagatcagggaactaaaggcttcacagcagcaaaaccagcaaactgaacttattctggaatacagcggtgatggtagtgactccagccaaacagcagaagaggagcagggtgctgatcttgaaacccccactggatctggagcagctgttgatgtttatgtggaagaagttccatgtgaaaccacatcggagcatggactgcagtgctataatgaccaaggaaacgaaaattttgatacagaattttcctcatctaatctttcttcgtcaggtggatttctgcagcaaactgaccatgatgttagagttcctgttcgtggtgacaattctaccagtaaactgtatgcggcgccgcagaatgctagttctgttcacgatggtactagaaaaacatatgaagctgcaaggactcctagaaggattattgagaaagattccaggcttagacacagccccaagataataccaaaatccgtcaaagccctttcacaaagtgctatggattacacatttgctagtggagaggcctggttcagtgaagcccaatacaactacgagccagaaggctaagccagtgcaaaggccaaatgcagcaaggccagaaaannnttnnccccctacanaaaaggaancaagntttataaggnncccaaaaananncttccccccnccn

SEQ ID NO: 7442 - DNA, 1613 bp, Zea mays
  misc_feature (1590)..(1590): n is a, c, g, or t
cccacgcgcccgcccccacgccgtccgctcccgcgagcacgctacgaatcgccgtggtaaatgctcggccgcggcggccattagaaggcgctaatcacgcccaggattaaagagcccccctctccgccttggcctcggctcgcgcacctgcctgcctcactgcctgcctacctacctgcgttgttgccttcttcgcctcctccccctgtggccgcaccgcagcagctgcggcggcggcagaggtgaacagcttcccgcggccttgtcctgtccggactccggggccgggaccggcagcgcagcgggctcgcaggatctcccgagtcccgacccccatgcgtcggcctcggtgacagggtttgctaccggagtccatccaactataatgaattagacaaccagtacgtaatggcaacggaagtcaagcaaacttatttttcatggtcacaaggagagtcgactgaacgggatggtcctcaaggagtatctgtatcccagacacttgatcatggttccatttccttcggaagatttgaattagagtcactatcatgggagaagtggtccgtatttactaatgacaggcgcaatgaagaatttggaaaattcaatggtttagtcgctcagaaaaaggcttattttgaagagtattacaagaagatcagggaactaaaggcttcacagcagcaaaaccagcaaactgaacttattctggaatacagcggtgatggtagtgactccagccaaacagcagaagaggagcagggtggctgatcttgaaacccccactggatctggagctgctgttgatgtttatgtggaagaagttccatgtgaaaccacatcggagcatggactgcagtgctataatgaccaaggaaacgaaaactttgatacagaattttcctcatctaatcttttttcgtcaggtggattcctgctcactagtcccccccccccccccgttcctgttcgtggtgacaattctaccagtaaactgtatgcggcgccgcagaatgctagttctgttcacgatggtactagaaaaacatatgaagctgcaaggactcctagaaggattattgagaaagattccaggctcagacacagccccaagataataccaaaatccgtcaaagccctttcacaaagtgctatggattacacatttgctagtgagaggcctggttcagtgaagcccaatacaactacgagccagaaggctaagccagtgcaaaggccaaatgcagcaagccagaagacgtctgcctctacagaaaggagcaagcttataggtctcagaagaccttcctcagcaggtgcgcaagggccttctactggagagcgacatgctattgccagggagaattcacaattacctgtggtcgtttccaccccacggcgaccttccactgctgagagacgcccagtcacccgagattgtgcacagaaagcaagccaatgtcaccacaccacgccgaccttctacttctgaaagactccccatcaaaagagagactgcagcaaagcataatgatatttccactgtacgtcgaccctctacaggagagagacgtgcttttactgagnatgtgttctgagaactgatgtga

SEQ ID NO: 7443 - DNA, 1403 bp, Zea mays
gccggccgggttccggctaatcacgcccaggattaaagattcccgggccccctctcggccggggcctcggctcgcgcacctgcctgcctacctacctgcgttgttgtcttcttcgcctccttccctgtggccgcaccgcagctgcggcgccggcggcagaggtgaacagcgaccggcggcgagtgcgcttcccgcggccttgtcttgtccggtctccggggccgggaccgacagcgcagcgcctctcgggatctcccccgagtccccgacccccatgcgtcggcctcggtgacagggtttgctagcggagtccatccaactataatgaattaggcacccagtacgtaatggcaacggaagtcaaacaaacttatttttcatggtcacaaggagagtcaactgaacgggatggtcctcaaagagtatctgtatcccagacacttgatcatggttccatttccttcggaagatttgaattagagtcactatcatgggagaagtggtccgtatttactaatgacaggcgcaatgaagaatttggaaaattcaatggtttagtcgctcagaaaaaggcttattttgaagagtattacaagaagatcagggaactaaaggcttcacagcagcaaaaccagcaaactgaacttattctggaatacagcggtgatggtagtgactccagccaaacagcagaagaggagcagggtgctgatcttgaaacccccactggatctggagcagctgttgatgtttatgtggaagaagttccatgtgaaaccacatcggagcatggactgcagtgctataatgaccaaggaaacgaaaattttgatacagaattttcctcatctaatctttcttcgtcaggtggatttctgcagcaaactgaccatgatgttagagttcttgttcatggtgacaattctaccagtaaactgtatgcggcgccgcagaatgctagttctgttcacgatggtactagaaaaacatatgaagctgcaaggactcctagaaggattattgagaaagattccaggctcagacacagccccaagataataccaaaatccgtcaaagccctttcacaaagtgctatggattacacatttgctagtgagaggcctggttcagtgaagcccaatacaactacgagccagaaggctaagccagtgcaaagaccaaatgcagcaagccagaagacgtctgcatctacagaagggagcaagcttacaggtctcagaagaccttcctcagcaggtgcgcaacggccttctactggagagcgacatgctattgccagggagaattcacaattacctgtggtcgtttccaccccacggcgaccttccactgctgagagacgcccagtcacccgagatcgtgcagagaagcaagccaatgtc

SEQ ID NO: 7444 - DNA, 4800 bp, Zea mays
  misc_feature (1002)..(1002): n is a, c, g, or t
  misc_feature (1039)..(1039): n is a, c, g, or t
  misc_feature (1597)..(1597): n is a, c, g, or t
  misc_feature (1821)..(1821): n is a, c, g, or t
agctcgcctcgcctccactcgactcttagccaaacactataaaattatggccgcacgctttcattcctcattgtacatccaaccaaacacactataaagtaaccaaacggcttaaggttgcagattttacctaaaaaactaatgattgcaggataattggatttacgagcaggcagaagatgcctcgaacaataatagaaatggacactactacagtgctagcattgcgttgcgtggtccactgcaaatcacaggacagtcaaacacacacccacatggacatgcgtcgcaagttttcaggcgctcgagaatcaaaccatacttgtcaatatcgtttcggacgatgttctggtttgctcactggaatgcaacgtttgggtactggatagtatcggcgcaccattccggaaaacaataaatataacaaaagtatatttacaattaacaataccatgtacctgatataagcatgggggctgcgtattgcatgcaacaagcctaaaacaaaaaaaactaatgaaactaataggaggttctggttgtagattgcagaaacacaccctacgtcctgcagtatagagcttggagcagtgacacagggagagaaaaagtaggtccttgttgcctttgctcattggagggagtttgttgcaggagtagaggatggctttcaggagtcactacacattacaagagatgctgtggcagactgccagggcaaaccaagaaccggaagattccacccagaacagctggaacaatcgggaaagtggccagagttctggccggtacaagatactgctttggccgtgtcagtctcttcactgttacgaagcattccagccatcctggctggtaccgaaacagtatttacatgcatggtccaaacaggctcttgtacaccgactgtaacttcttattgaagccttaaccatgcaatgctttgactgactgttgtgttttactttccgagaattacgaattgttgatgtgatcatttangtcagatatctcatgttattaagaatgagaataatcntattgttattgtttatatatcatctctgccgggattttgcaggttttgccaggatgatgggacatggagacgtgagctttataaggattctagaggaactcagacttcatgtaagggccattgttcgaataattctgaacatgcctttattcctgctttccttctgataatttaccattaggttgttgcttctactgtgtatgttttagctgaacttacttccagaaatctgcaatcaaacaaaaaatcccaagcgcagcaaaaggttgtgaagaaattaccagtttcagatcttcgtggaaagttatctggtgtcgcgagccagcgccctcaacttagcagtactgttcaggtcccaaaacctgtaaaagaggttattaagagcaacaaacctgttcaaaagagagaccccactccaactactacccctcctgacatcaagaaacccagtgcacctgcacccgtaccagcaccatctgcactaccaaagcaatcccagaacaaggtgagatggttgaggatctatgttgtgttttcttacaagattgtatcctgatnggttattgtggttccactatttgttcttctggaatgggaaacatcgtaccatcatttttcttattttctatttgctgtggtgctgtcctgtgaatataatggactacatgaccatttgatgttggagtccctttgatgtttgtacaacctttggttctaaatttgatctagtgcatggttaatcttctagacccttagcatgttcgaattccaaatgaaatttngatctaatgcatgattaatcttctagctctttagcattttttaattccaaagtttcatttgtctagtcccatgctggcactgtggtgtctaaattcctgaatggaatttggtcttcataaacattcaattcaatgttgtaataatttgtttcctttcttcgatatgtgcagattgatgcttcgcttgacagtttactgaagtctcttgatctagagaagtatttgataaatttccaggctgaagaggcacgttcgatatatgttgcaatttcgtattgggggtgtgactggtgagtggtgaccttaaatattggtaatggatattcatctttcaggttgatatgaaagcattggtgtacatgaatgaagaagatatgaagtctttaggaattccaatggtactgcaaggactttgcctttttctttccccaagttggttagcatgcttatcctctgcttaaacaagagacctctgggttgaagcaatatgtatatatttaaggtggtagaatttgatgattttattaatttcctgcttataggttggtagatccatattaaaagtgaaattgtagcaattgagttacaaacttatgagttatgaactataccaattacttctttttgaatgagtcgcacccatggtatagcctttgttatctgctttgtacttgttgagtatgtattcggttagttatgaactatgccaatgatttctttttgaatgagtcgcacccatggtatagcctttgttatgtgctttgttgagtacatatttggtcagaccaccacttatccatacttttagttccagtttgtctaacgagaagtaactttgattggcaaacgagattagaatgacctgattagttggcgttgtgtgttttctctgcagttatcataaatttaaaccagatgctctaaagagaaaacttgaaattattagttcactttggctttgagctaagtcaaacttatttaactttggccaagtttttttgaaaaatatattattacccacaagttcaaaattaatgcactatgataacatatttcatgaaggattgaatgaaactaccttggtgttgtagatattggtgcacttttttaaagccttgggtcaaagttagagaagtttatcttagaacaaaaccaaagtgagctataatttggaatgtaggaagtaggcactaaagatatgtccagtcagtgttttagcttagccccacattcatagtacattgagctattgccgcctcaatggaaaatattgatttctctttgtgatatgcatcccttatttgcacagctgaaaaatggaagcaatgtccattatgttctggttccatctctgattgcattattacccagcgatcatttgattccaatctacttaggattattgtggatattctttcatttgtttcatgtttacagcatctttcaggttgatatgaaagccttggtttacatgaatgaagaagatatgaagtctttaggaattccaatgggtcccaggaaaaagatactatcagcattggctcacagaaagaacaagtcttcgaagtcattgcctaccagtaccagttgaggcatctttaagcttgtgtggtagctagacaacttgttgatcttggatatgtgcaagtgcatcatcgacctgcagagttaactccactgacgagcaagattcctatccatcaaggctgatgcggtgtataagtagagaactccgtgatgttggtagttgaaggcaaccaactgattgttgatgtccctcctattctgtgatctccggaatatttgttgatcattgggtgttaattcatgatgatgccttggggattgtttccccttgtccggcaaaaaaaaaaaaaaaaaactcaagcccggcttcttgcgtctcaccgtctgcatatccatccaaaaagaattgagttcacagagaaatgcttgagtttaactaagttcacagaaaaataacaggcaacatttatgtctccaaacaggtttaatatgaaaatatagtatatgattattttcatcttctctttgttttattttataaaatgtatttgttgtcggctattttattgttgaactaaaacgtgataatgacaacgggatagagtcgtctccaaaagaggagataattttcctttgatttggggataactcgaggaaggcagctggtccatcgccggcggactggtcggcttcctgtgcggctgtgcctctctcgtccctgtttcttatgtctctctcacgttgtagtcacgtgcgtgcgtacgagcgagggtgtttcgttttggatcgttttgcagcggcccgtctcggacgccgacgcgcaacacggacagatccaccacatatatctctggcctgtgggccgccttttgacacctgcaggccgagcaccgcaccgccttccttccaccgttccgtccgtcccgtccttccccgttcctgtgcagcacaagcaccgaccctgccgtgcgcccaaccccgtgcgccgcgcatggctatggcggcggcgaccggcgcaggcgcggtgggcgaggggatgcgtcggctcacgcagctctcgcttgtctccaaggtctgctcggagctggagtcccacctcggcgtcgcagaccgcgtcctcgccgagttcgtcgtcgacctaggccgcgcctccgcctccgccgccgacttcgccgccgcgctcagggaccacggcgccgagctgccggactacctcgtccgctccctccacgccgtcatcaccgccatcccggacagcgcccccgctccccccgcctcacgtggcgctggtgcccgggggcgcgtggacaaggcggcgggagaggacgaggaccaggagccggggctgcaccaggggcgccgggggagggtcacccgggtggccaacgccggatgcttcgttcgcctcgacggcggacgcgaggggcttgtgcacgtcttccagatgccccg

SEQ ID NO: 7445 - DNA, 1332 bp, Zea mays
gccaagcgcgcaattaaccctcactaaagggaacaaaagctggagctccaccgcggtggcggccgctctagaactagtggatcccccgggctgcaggaattcgcacgagaccattacctagaacatcctaatcgctccaccgctcctctgtcctctccccaccacctccttgtatctctcctccccttctggccgacgaaaccctacgcgcgcgcgctgccaagccctcgccgccgacgcctactccgactccgacgccgcagtagtgatgtacgccgacaggtcctcgggcaggaaacactctgtaatggaccgcctcgggtcgggcggcggctcgcgctcgcggtccgacgacgcaaaaaggttttgccaggatgatgggacatggagacgtgagctttataaggattctagaggaactcagacttcatctgaacctacttccagaaatctggaatcgaacaaaaaatcccaagtgcagcaaaaggttgtgaagaaattaccagtttcagatcttcgtggaaagttatctggtgtcgcgagccagcgccctcaacttagcagtactgttcaggtcccaaaacctgtaaaagaggttattaagagcaacaaacctgttcaaaagagagaccccgctccaactactgcccctcctgacatcaagaaacccagtgcacctgcacctgtaccagcaccatctgcattaccaaagcaatcccagaacaagattgatgcttcgcttgacagtttactgaagtctcttgatctagagaagtatttgataaatttccaggctgaagaggttgatatgaaagcattggtttacatgaatgaagaagatatgaagtctttaggaattccaatgggtcccaggaaaaagatactatcagcattggctcacagaaagaacaagtcttcgaagtcattgcctaccagtaccagttgaggcatctttaagcttgtgtggtagctagacaacttgttgatcttggatatgtgcaagtgcatcatcgacctgcagagttaactccactgacgagcaagattcctatccatcaaggctgatgcggtgtataagtagagaactccgtgatgttggtagttgaaggcaaccaactgattgttgatgtccctcctattctgtgatctccggaatatttgttgatcattgggtgttaattcatgatgatgccttggggattgtttccccttgtccggcaaaaaacccaattcttgcttcttgcgtctcaccgtctgcatatccatccaaaaagaattgagttcacagagaaatgcttgagtttaactaagttcacaaaaaaaaaaaaaaaa

SEQ ID NO: 7446 - DNA, 1399 bp, Zea mays
ttgggtacctcgcggccccccgcagcatcgctccctctcagcttcctcattggccatccttcgtcttccatggagaggctccttgccggcctactactcggcttcctattattgatcgcgtcagtaggaagccatgcaactcgtgctccagatcagtactggaagtctgctcttcccgacactcccatgccgagctccctctcccaactcctcaacaccccagctggcaagggcggcgtcggtggaggcagcagcggcaagaagcccggcggcaccacggtgggagttgggaaagggggagtgggcgttaacgttaaccctaccaaacccggcggcgccggtacaaccgttggcgttggcaaaggtggcgtcggcgtcggcgtcaatcccgggtacggcaagccgggtggcaccacggtgggcgttggcaagggcagggttggcgtccacgtgaacccgggcaagaagcccgtccacgtccccgtcggccctttccagtacgagtacgccgcatcggagacgcagttgcacgacgaccccagcgtggcgctcttcttccgagaggaggacctgcagcccggtaagaagacgaccgtccagttcgccaacaccgcgatggccggcgccaagttcctcccgcgaagcgatgccgaggccatcccgttctcctccgagaaggtccccgagatcctcggccgcttctcggtggacccggactccgtggaggcggcggagatggcgcagacgctgcacgactgcgaggcgcccgcggccaggggcgagaggaaggcgtgcgccacgtcgctggaatccatggtggactttgccaccgccagcctcgggaccagccacgtgagggccgcgtcgacggtcgtggggagggagggctcgccgaggcaggagtacaccgtgacaggcgtgaagcgggcgggcggcgggcgcctggtggcctgccacgcggagccgtacgcgtacgccgtgttcgcgtgccacttgacgcagcagacgcgggcgtactcggtgtcgatgctgggcagggacggcacggccgtggacgctgtcgcggtgtgccacgccgacacgtccggctggaaccccaagcacgtcgcgttccaggtgctcagggtgaagcccggcacggtgccgatctgccacttcctgccgcaggaccacgtcgtctggacccgcggcggctgagagtggtcgccgtttgcatgcactggtcatgacgccgccgtttgcttagattatgtttgtatagtttcgaataatcagacatctctgttacttctgctagctctcaggctaagcaagcttctaattgatctccgacgacgcttgttggatctaataaaaaaaaaaaaaaaaaaaaaaaaaaaaaaaaaaaaaagaaaaaaaa

SEQ ID NO: 7447 - DNA, 1739 bp, Zea mays
gcacgagaccattacctagaccagccgcgccgcggaatcgtctgcaactgcatcgctcgctctctcctttcactgggaacatctatcagctcgcgctcattggccatctttggcttccatggagaggctcattgccggcctacttggcttcctattggttgcatcggtaggaagccatgcagctcgtgctccggatcagtactggaagtctgctcttcccaacactcccatgccgacctccctctcccaactcctcgacgccgctccagccggcggcggcacgaccgtcaacgtcggctggggcggtgttcacgtcgatgctgggcacggtaagcccgggggtacgacggttgacgtaggcaagggcggcgtcggcgtcaacgttaaccctggcaggagcggcaagcccggcggcacgacggttggcgtcgggaagggcggagtcggcgttaacgtcaacccgggctacggaaagcccggcggcaccaccgttggcgtcgggaagggtggcgttggcgttaacgtcaaccccggcaagcccggtggcacaacggtcggcgtcggcaagggcggagtgggcgtcaaagtcaatcccggcaaaccggccggtggtgccggtacaaccgttggcgttggcaaaggcggcgtgggcgtgggcgtcaatcccgggcacggcaagccgggcggcaccacggtcggcgttggcaagggcggggttggcgttcacgtgaacccgggaaagaagcccgtccacgtcaacgtctcccctttcatctacacgtacgccgcgtcggagacgcagctgcacgacgaccccagcgtggcgctcttcttccaggagacggacctccggcccggtaagaagatgaccgtccagttcgccagcaccgggacgaccggcaccaagttcctcccgcggagcgaggccgaggccatcccgttctcctcacagaaggtgcccgagatcctcgcccgcctctcggtggacccggactccgtcgaggcggcggagatggcgcagacgctgcgcgactgcgaggcgcccgcggccaagggcgagaagaaggcgtgcgccacgtcgctggagtccatggtggacttcgccaccgccagcctcgggaccaggcacgtgagggccgtgtcgaccgtcgtggcgaaggagggatcgccgaagcaggagtacacggtgaccggcgtggagcgcgctgccggcggcaccgacgacgacggccgggtcgtggcctgccacgcggagccgtacgcgtacgccgtgttcgcgtgccacctgacgccgcagacgcgggcgtactctgtgtcgatgctcggcagggacggcacggccgtggacgctgtcgcggtgtgccacgccgacacgtccggctggaaccccaagcacgtcgccttccaggtgctcaacgtgaagcccggcaccgtgccggtctgccacttcctgccgcaggaccacgtcgtctggacccgcagcggctgagtctgctggatggccgccgtttgctcgcgtcgcgccgcctggagtgatttgttatgttccagtggcctctaggcatactgtcatattattattataccgaggtatcacgagtttgcttatgtttccagtacttgatgcttgtatggatatggtgtagccagctcagcaagtatcaacccacctgcttaattctgttgtatagttttaaataaacagacaacctctttatgggcaaaaaaaaaaaaaaaaa

SEQ ID NO: 7448 - DNA, 1706 bp, Zea mays
ccggccgggagtactggaagtctgctcttcccaacactcccatgccgacctccctctcccaactcctcgacgccgctccaggtataacaacagacagctccagaccttcatcaaatcatcagtagataagatacttcgtataggcatgtgcctgtcccatcatacaaacatacgtgccaacgccacctcttcaattccctgcttgttcgcagccggcggcggcacgaccgtcaacgtcggctggggcggtgttcacgtcgatgctgggcacggtaagcccgggggtacgacggttgacgtaggcaagggcggcgtcggcgtcaacgttaaccctggcaggagcggcaagcccggcggcacgacggttggcgtcgggaagggcggagtcggcgttaacgtcggccccgggggcggacgcctcggcggcaccaccgttggcgtcgggaagggtgacgttggcgttaacgtcaaccccggcaagcccggtggcacaacggtcggcgtcggcaagggcggagtgggcgtcaaagtcaatcccggcaaaccggccggtggtgccggtacaaccgttggcgttggcaaaggcggcgtgggcgtgggcgtcaatcccgggcacggcaagccgggcggcaccacggtcggcgttggcaagggcggggttggcgttcacgtgaacccgggaaagaagcccgtccacgtcaacgtctcccctttcatctacacgtacgccgcgtcggagacgcagctgcacgacgaccccagcgtggcgctcttcttccaggagaaggccgtgcagcccggtaagaagatgaccgtccagttcgccagcaccgggacgaccggcgccaagttcctcccgcggagcgaggccgaggccatcccgttctcctcgcagaaggtgcccgagatcctcgcccgcctctcggtggacccggactccgtcgaggcggcggagatggcgcagacgctgcgcgactgcgaggcgcccgcggccaagggcgagaagaaggcgtgcgccacgtcgctggagtccatggtggacttcgccaccgccagcctcgggaccaggcacgtgagggccgtgtcgaccgtcgtggcgaaggagggatcgccgaagcaggagtacacggtgaccggcgtggagcgcgctgccggcggcaccgacgacgacggccgggccgtggcctgccacgcggagccgtacgcgtacgccgtgttcgcgtgccacctgacgcggcagacgcgggcgtactcggtgtcgatgctcggcagggacggcacggccgtggacgctgtcgcggtgtgccacgccgacacgtccggctggaaccccaagcacgtcgccttccaaatgctcaacgtgaagcccggcaccgtgccggtctgccacttcctgccgcaggaccacgtcgtctggacccccagcggctgagtctgctggatgaccgccgtttgctcgcgtcgcgccgcctggagtgatttgttatgttccagtggcctctaggcatactgtcatattattattataccgaggtatcacgagtttgcttatgtttccagtacttgatgcttgtatggatatggtggtgtagccagctcagcatgtatcaacccacctgcttaattctgttgtatatagttttaaataaacagacaacctctatatggttactgccctcagcctaggacgaacatatctgttatgt

SEQ ID NO: 7449 - DNA, 2416 bp, Zea mays
ctccatggtttggaccactaactttggtttaacaaattttaaagtaggacctacaataaacagtgacgatggttgcatctgggaaaccattttcctcatgtataaccacgaagcaatcaaattagccggccgttacatcgtactattttggcaaatgtataaaactggtgggccatgccagaaaagtacgctgtcagacagcgagaagctgtcgggcccacgcgcagaggtccagggttcagatacgatcgaactcttctctcccacaaaagttaaaaactttcgcaatgcaccccctcccgaaataaaaaccggtgtaaaataaacggcagagcccagtgtccccgctagctgctagcgagctactactagtacagtgtcccccactccccagtccccctcagcctctctgccaaccgcttcgtcccctcctttctctccttggattccactactccctcgtcctcggagcagttgctgcagctgcaacccccctgcgcctctcttctcccggtcccacccgcccctccgccgcctagggcttccaaatcccctcagcttccccggattccgctttcccccgtcgctgcaaggttccgggaggttctaatcccctttgagcgccgcctgcccgccgtggctgtttctcggtgttcaccgcgttcctccgtgcaatgcggggcctaaacgcggctggggttagggttcctggcccgctgctcgcttcaatttgattttttggaggtttttatagggaggagaaagagtccggatttcgaggagtcagtggttgcgtgcttgtctcggcggaggggaatctcaagttcgtggccggggttttagctcgacgaggcggacaattttctacgagggattggaattctttgctcggtttttgaggtgcccgtgtggaaagcccggtaatttttgaatttttgggcggtaaaaacctgttggttaggctgtggtggtttctatggccggggcgccgagggcccggtccctgaacatcgcggttccggaggcagaggcgaggccggtgctggtgccaggaggcaacaaggccaggtcgggcccggcgaacgcccggaaaccgtcgccgaagcccgtgaggaaggcggagccggcgccggcggggacgccagcggagactgtgcccgccgcgaccaaggcggaagagggcgcaaagaggaatgcagtcggcgggggtggaggtggcgcgcccaagagtgcgtccccggtgccgtcgccgcggcgcacacctcctgggccgccgtcgaggaggaacgacgcgccgctgtcgcatccgggcttgccgctcagcgcgtcttgctcctcggatgcatccgcggagtcggtccgcgcccggcgggctttcaccgggaaagtagagaagggccggtcggtgccgacggctcaaccgaagcaaggcaaggctgtgggtaaggcggtggagagcaagcccatccgcgtggaggttgttgctccgatgacagtgacaccagaggctgtgcaagggaagaggaggtgcgcgtgggttactccaaccaccggtgagcatcttctctcctggaactggttctttcttagtcaaaaatcctagtttggtataagaattgttcttgtttcttctatacagacagaagaagaatgcaactcttgtgtttcttgatgttttagtcacttattactagtttaccgtgtttaatttatgcctgttcgaatcattggaatcagtccaatcatgtgctgcagttcattataacttgtatacattctagcatcctgaaccaggcaccttttatcacaatggttcatatggtgtaaatatgtagtaaagctacgcgaaactctcaagagcagcatgctactgagttgctaatcagaatggtgatattttttcctactgcgttaatagtttgttaaactctagctgttcttgtttgccatgggattggatattggaaccattcgagatcgtaattctgcctagattagataaagttagcattcctcctcctttaggttgcctgtaaagtgtaaagaacatattatccttttttttgtttcccttctgttcttatttccttcgtttcaaccgattggtttggttaatcccttgcaatttgacatcaacatctgtaattgactatagttttgcatatatggttaactgtagattttcatccaaacaactgccttgtcattggcacttccacgtagttaaatgtgtaattagctatacttttgactcaactgagagaaaggcctggtgcagcggtgagagccatctcactaagtcactaggccacgggttcaaatcatcctctccacatttacaggggaaagacttgtcttgatttaacccttttctagacccccactcgtgtggcagcctccaacactgggtctatcc

SEQ ID NO: 7450 - DNA, 7141 bp, Zea mays
  misc_feature (3378)..(3378): n is a, c, g, or t
atccaacagagcgtagtaatttaggcatatgtcaattaagttaattttgttttatgcaaaatatatttgtgtactattattagcaagatgttggagatatttatttgctacatttttacaatagagtgagccaaagaacatcctataagttgcagagtacaaaacatattctactgatagataaaatcatttccacatcctctaacccatgaatttaagataggcctgaactttcgaaagtggtgtaatgtcaaattccaagccaaataagttactttattaagtagattccaattcctccaaaatgaatgaatccaaacgccccgttatattattttgtaccatgtgccctttaattttgatactgttgcagcaacccactgtaattgcttgaaaccataaatttggcaaaaggaacgattactttaccaacctgaaaataacacactagtagttgtaatagctccatctatgctgtcaggaaaactgaacgctcaaagtgtgaggtacagtactggctttatttgacaccatcacatgctatgtttatcctatgccttttctacgccttattgatgaagtgtttcttaagctatgcatttttacgaacaaagctgacatgtcatgttttctactgacaagatccttgctatgtcactttccatgatgaggagtggggagttcccgtgcacaatgataggtatgcaaactgaaaattgcttcattcatctttgctatttatcttctgtgaaaacggaatcaaacagtccaaggatatttggccatggtcattcaacaggagattgttcgaactacttgtactatctggtgcattagctgagcttacgtggcctgaaattctcaagaagaggcaacttttcaggtatatgtcttgtaatgttgaaaaataaaattactatgcatggtttatttcgtaagatccatgctgcattttccagggaaattttcatggagtttgaccctgctgctgtctctgaaataaatgagaagaagcttgtggcacctggatgcgttgcccattctcttttatcagagcaaaagctccgagctgtacttgagaatgctcgccagatactaaaggtttgtagtgcctactcgatacaccaccaatttggctggcacttctgttggtatggcttttgcctgaaactacaggtttgtgcaatccgatgcagatcgctgacgaatttggatcctttgatcggtactgctggggttttctgaaccacaagcctatagtaagcaagttccgctatccaagacaagttcctgtgaagagccccaaggcagatataatcagcaaagacatgatgagaagggggttccgaggcgtgggcccgacggtcatatattccttcatgcaggctgcggggctaacaaatgatcacctagtcagttgcttccggttcgagcattgcagtgccgtgccaactctttgcgcatgcgacatcgacagggcaaacacgaaggcggatctgaaaaaagatgaggtgacagcgaagatctatcgcgaggaggtaatcgcaaacccagagatgctgaggacgatcgatgctcttaccgtttcgtagcaccatgtgggaatggaagagcaacgtggtcgctgaacttgtgtcatctcttatgtagacagtgtgctaggctatcctttgcattgaggtcaggaatcaaaaaaatgcttattatgtaaaaaatcgttctgttgctaatgcttactctgttgtacattgaatggttgggggaagctaaggatggtggccttttcttactgatccagaaactgtcgaattacttgctgtcaataattcagcagttttctcctgaccactgttgtttatcagaaagatttccttggtggcctattatggttgggggaagctaaggatattcgtttggttttaatccgtaccggtatctacaatatttttgtctctatggattgaagttgcagcagtgtaaacaaccgaacagccccgaggagtatctcacaaggctcggaggtcgatatgtatcatgcaaagatcaatggtatataggaaagattcactcatgcataattcagaagtaacaagctgaaattctggatagtttttctttttcttaaaaaatctggaacataggtcacaggctgagattctggactcatgaagatagctttgtttttttttaaagtagtaaataggtcacaagtggtctacagtgaaaactctgttcagattgcactcctacattgctctgtcgctctcagacgtccgattttttgagcgtccgggccaggatggctgcctattggatttcaggatttggcctcctgaaatccaatagtcagagtcagctagagatttgtgcaggtactacgctaggaagtctgcgtggaggagagataagaaaaaagaagacgtcgctagggtgcacttcatcgctctgtttgcaccatagtgaacttccttgatctatttccacagctcattaattttgttcttccttcgtttccccaccaccaggacattgtcagctagagatttgtgcaggctgttgaggacgacgccctaaatatatggagctagagcctacgtcagaacggctcaatgaggattgcagggcgcgtagtaccacttcagcagactttgtcaattgagatcataccaacgaaacagatcgatgaggaaggatgcttcaggttgccaggtccacagctcatgcatctatcccttcataaaaacagatcatgcatcatgtaggcattgcagggaccatctccatcagatttaggcagcaggccggagtggactcggcaatcatagtagtcgaggagatatgatgattcaaacatcggacacactgaaatgcaggtccctttcgtcaacaaaaagcaggatcagtagaaagcgtggctgggtcaaaagtgctcagagtgggtcccgtccagtaacaagttagatgtctggagcaggctaaccatttttttgccgtagtccagggttgctgagacaaaacaaacatgtcagtgtaaagcattacaaatactctgccagtcctaaaacaaatgcacatctcgcatttatataaatcaactaatttcaagtttggctagatttatagaaaataatattaaaatttgtgtatccaaacaggcttactaaaaaatgtatggtttgattaatttgatggtgtatatttgtatcatgaatattgatatttttgtgtgtcctgtatagaaaggacaggctcagtgctactgactcccactgccccacatgaacataagtctaaaagaaataaccgaggcatgttttatccttgcattttgtagaggatgcgtccgacctaaaaccttttctcaccactatgtcaagnctatcattttttctgtgtcattgtatattctaagaagataagatttcagaatggccgtacctccatcctgattgtcttttatatataatgactaaaacatcaactgtattttcgtcaggactgttctactagctcctacgacatactccgtatacaattgcctggctacaggtgatttcagattgaactgtattgttggcacttattccaggcaggctctgagcctatctccagcagatccactatttcaaactccaccctgtaagttccgcatctcctattttaccttatctactagagagtctgacatacatagcattattcaataatgcgttttttcaaaaactattattcaagcatggaattccaattattacaaggcaaagcttgtgctttaatttgttcctccaatacaatcgacggtctagagagtagaaactcagataccatcagcacagcagatccgtgttgggcactaggcttcacgggaaagacaaccaagtcttatcttaaaaacaaagggactcgtgtaccgttctgctgattttgctccttcaccagacagcacctaacctggtttcttaacaaggtggcaagccaaccaacaagtgatccagatctgactgggtgccaacacctaacacaaacaatatacacctaacatgcaggttgaggtcgatatcaccgaacgcaatataataggaacataacagcaaaaggggatagagtaagcagtacctgctcttttatgcttggaacagatgagagccaactcaatggttgtggacttgcggtggattatttccagggtcaacaaactgcagcatgttagtggaatacaagtgggcaactactttctcctgcgtgtcatagcagcttttgcagataaaaggcagacatgaatatgtagtttataagtaaatgcatttctggtattttggcatgacatatcatgaaatcaggtacaaaggtataccaagatgcagatcaacacaacattgagcccctttcagttggtaccaaacatggcccaatgcatcaggttggcatagatgccacaggtttggtattaagaaggcaaaacttagcacaaaggataactgtagcctacatataaaatgtggataactgattttagaaaatgtaggagcactgtggtttcgttggatggctgtttctagttccaagtcacataatttacatatacaacatatgacaaacaaataatgtcagctagtaccatatgtgaaaatgctcgagtcatgtgacatttaaagaaagaaaaaaactgtatcctcttttcagttatgaattatgataactataccaaaattgtacaggtatacatagattgttgctaagaagttaggagattaaagacgaggacctaagctccacaagacaaaagaaaaacctatctataccatgtggcatgatatacctctcgagcaagtcaaagatgagattctcactaatattccctttatatcaacaaaaaatgcgaaactgaaacttcttttatcctgagacgtatatgccgctcgttctatctataaagaattttagttaacatacttttatgtccatatgcatgctgagaattttatctcatcctttaagtggctcgagctgtacttccattggttcaggtgacaaattagactccattttactgactaccctgttagattgcaaaagttcgactgtatcatcttcctcagtgttgccaagcacccaatttcctgaaagaccatcaacacctgcagtccttcgcttaattgccatatactcaaagtaagctgttaacaaagtaacgcttataacccataagattagcccacatgtaagtcccttgatagtcttactgccatatcggtgcccaagatgctgcaagccagtaaagagcgccaaggtaccagcaagcgcagcagatctcccggtcaaaacatggagatattcccaaactactctgtttccaggcggggtctctccattctctgttttatgcggtcgaagatacgcatttactggctgcatagatgcgaatgtcagtgctactgcaccgattcgagcatgtctggatttgaaagagaaacctcggagctcagcaactgcaaatacaacacccaagaacatgacagctatgcttgaatactgcaggcaggcgtgagcctggaaccaggcctcgcctttcagatgtttcaggtatctcgcagccatgatcccccctggcagcagaatagcccatgccacaaacatcataaacccatgaacagcaagcaccgggcggaggtcctccactgcttcagccaagccgctcaacagaagaatcctgataggacgattgcttgtgtcggagtgcatgttcttcaaacttaaggggccgggtgaccattgagcacccatggcccagatgaccttcataggagtcgtcgggtcgattatgttcttgcactccacctttccactgcatgaaggtgttaatggacgagtgaactcaaacacgatcgcaccattttccaatcggcatcgcttatgagtaacattttcatgtgtctcgtgcacactcatcccgtcctttccgtcgatccaataagatttgacatgccccttgccattgccatcgacccacccgacataagcatagctatttaccattacgctaccaaatccaattgcaaggtacccactcttcttctcaccccgtgcagcaatgttaatagagtcaccagagagagtccagaagaatgtcacctgctgatcatccagtagcacgctgttgttgtacatgtcgctgaggccaccatcgacgacctgaattttccagcccatcttgggatcatacaaggattggtagtacactaggtccggcgtgttccgatcaggcaaccagacgagttctgttggtgtagccggcacgccctccgccatgcttccaccggcgtagatgatctctgacgagttcctgagagtggcattgcctccgacggggtccgacgtgatgtagactggtgcgtcgtgcccggcctcgatggagaaggtgactggcacgccgcgctccaccttgagcagaggcgcctccttcttgttgatgtagaacaccttgtcggggttgggcggattggggtaatggagcgccggcccaaccgtcacagccagcggcgtattgcgctccgtcgtgatcctggcctggtcctccttatcctcggcgtccaacggaccgacgcacccgctgctcgcgtccgacaggttgagcctggcgaaggtgaatgctgtccccggagacccgccgcggtgactcatcagcggcaggtagtacggccggagcgagtcaggcggccgcagcagcccgatcgcccagatcacagtcatgttcctggtggcgttcacggggacgtcgtacttattgtccgcggacaccagtgggcgcgagaagcgcacgaaggagacgccgtcgcggcggtggccgtagaccagccgcgtgttattgacgagcccggtggagttgtcgcggtcgtagatcgtgtccgggcagacgccctcgacgaggccgtccttgcgcagcaagcactcgctgtaattggtgacgtagaagtcctcggcgaaggggagcccgtcctcagtgaagccggcgacggcgaggtcggcgccgatcacggacggtttggccgtgccaggcttcgcccacccgagcgccatgtagtactctgatccaaccgccgcctcgagggcgatgtcgatggaattgttcgcctcgtggagc

SEQ ID NO: 7451 - DNA, 2049 bp, Zea mays
ctcagcctctctgccaaccgcttcgtcccctcctttctctccttggattccactacgcccgcgtcggcggacgcgtgggctcggagcagttgctgcagctgcaacccccctgcgcctctcttctcccggtcccacccgcccctccgccgcctagggcttccaaatcccctcagcttccccggattccgctttcccccgtcgctgcaaggttccgggaggttctaatctcctttgagcgccgcctgcccgccgtggctgtttctcggtgttcaccgcgttcctccgtgcaatgccgggcctaaacgcggctggggttagggttcctggcccgcagctcgcttcaatttgatttttttggaggtttttatagggaggagaaagagtccggatttcgaggagttagtggttgcgtgattgtctcggcggaggggaatctcaagtttcgtggccggggttttagcccgtgtggaatgaaaacccggtaaattttgaatttttgggcggtaaaaacctgctggttaggctgtggtggtttccatggccggggcgccgagggcccggtccctgaacatcgcggttccggaggcagaggcgaggccggtgctggtgccaggaggcaacaaggccaggtcgggcccggcgaacgcccggaaaccgtcgccgaagcccgtgaggaaggcggagccggcgccggcggggacgccagaggagaccgtgcccgccgcgaccaaggcggaggagggcgcaaagaggaatgcagtcggcgggggtggaggtggcgcgcccaagggtgcgtccccggtgccgtcgccgcggcgcacacctcctgggccgccgtcgaggaggaacgacgcgccgctgtcgcatccgggcttgccgctcagcgcgtcttgctcctcggatgcatccgcggagtcggtccgcgcccggcgggctttcaccgggaaagtagagaagggccggtcggtgccgacggctcaaccgaagcaaggcaaggctgtgggtaaagcggtggagagcaagcccatccgcgtggaggttgttgctccgatgacagtgacaccagaggctgtgcaagggaagaggaggtgcgcgtgggttactccaaccaccgatccttgctatgtcactttccatgatgaggagtggggagttcccgtgcacaatgataggagattgttcgaactacttgtactatctggtgcattagctgagcttacgtggcctgaaattctcaagaagaggcaacttttcagggaaattttcatggagtttgaccctgctgctgtctctaaaataaatgagaagaagcttgtcgcacctggaagcgttgcccattctcttttatcagagcaaaagctccgagctgtacttgagaatgctcgccagatactaaagatcgctgatgaatttggatcctttgatcggtactgctggggttttctgaaccacaagcctatagtaagcaagttccgctatccaagacaagttcctgtgaagagccccaaggcagatataatcagcaaagacatgatgagaagggggttccgaggtgtgggcccgacggtcatatattccttcatgcaggctgctgggctaacaaatgatcacctagtcagttgcttccggttcgagcattgcagtgccgttccaactctttgcgcatgtgacatcgacagggcaaacacgaaggcggatctgaaaaaagatgaggtgacagcgaagatctatcacgaggaggtaatcgcaaacccagagatgctgaggacgatcgatgctcttaccgtttcgtagcaccatgtgggaatggaagagcaacgtggtcgctgaacttgtgtcatctcttatgtagacagtgtgctaggctatcctttgcattgaggtcaggaatcaaaaaaatgcttattatgtaaaaaatcgttctgttgctaatgcttactctgttgtacattgaatggttgggggaagctaaggatggtggccttttcttactgatccagaaactgtcaaattacttgctgtcaataattcagcagttttttcctgacc

SEQ ID NO: 7452 - DNA, 3234 bp, Zea mays
cctctatagtcgacctgcaggatggactccagcccataaaaacccataaaaagggtatttcagtcttttcttgcacgagaccattacctagaacatcctaatccaaaaatccaattttctctctctctcccgcctcctgttcagtttcccactcgccggaaccgccgcctctccaatccccgctaaccctcgctccgttttatcgcccccctctgcttccaaatcgaatcgcgtcctctccattctgccgtctcctctcctactcctcccccctgccgccgcaagatccaccagggctctcgaccgcaatggagccgcagctgacgcccggcgcggtggcggcggtctccgcccacgccgacggcaacggcacgctgcagccggtgctgcaggtggtggacgtgcggatggtcaacaacgccaagaacccctccgccgagcgcttccggatggtgctctccgacggcgaacacaccatgcagtccatgctcgccaccgccgagaacgcgcgcgtccgggacggctccatccagaagggctccatcgtccacctcctggagtgcacctgcagcaccatccagtctcgcaggatcattatcgttatcaaacttgatgttctgcaaagtgagtgtgccataattggaaaccccaggccctatgaaatgagaaaccaacctaatgagcagggcaccaacataccggccaatgctgctcaagctaatactggaacgtattccagtggccctggtttgctgggatcacctgctgcttcaaggccagcacaagttgctaataatgtaccatacagtggatcctatggtggttatcatggtacggtggtccctccgattgcccctgcagtagaatctgttcccaatgtggcatcgggtgtcacttatggtacaacttcagcgcataatacaatgaatgcgggcatgacacagtcaaacttgcagcagcgttcactgaactctcacccgaaccaaaggtttgcagttccttccatggctggtggcagtggtgctcctgggaatacatatggacaacctgcacagtcgttttatcagcaaccgcctccagggcatatgaatagaactcctgtgtctaagaacgatgcatatcgtcttgtcccattggctcaattgaacccttatctagataaatggacaatcaaggtcagggtaactgcaaagactgatctcaggttctacaacaatgctagaggtgctggaaaagtcttttcctttgatctccttgatgaacagcgtggagaaatccgtgcaacatgcttcaatacgcaggctgatcagttttttaacctcattgaggttgataaggtgtacctgatatctaaagggtcgttgaaaccagcacagaagaagtttaactccttgaatcacgagtatgagataagtctggattccagaacatctattgaagtttgtgctgatgatgatagcaacatccctaggcagcagtataatttccggaagataagtgaaattgagaacattgagaaagatgctattttggacttgattggaattgtcacatcagttggcccttctgtcacgtttatccgaaaggatggcgtggaaacccagagaagaacacttgaactgaaagacatgtctggtcgaagtgtacaacttaccttatgggggaagttgtgtgttgctgaaggcaaccagctgcagtcgctgtgcgattctggtttgaatcctgttctagctttgaaaggtgcccgcgttactgactacagtggtagatctgtgtcctcagctggctcaactcagttaaaaatagacccagaaattcctgaggctgagagtctgcggcgctggtacgcaactggaggaaagacagctgcttgtgtttctctgtcagtggtaagtatgggtggtacttgtgtccggaaatcaatcgctcagatcaaggatgaaaatctggggcagttagagaagccagactttatcactgttaaagctgcaatttcacatctgatagcagataatttttgttatcctgcttgcaccattgacgtgaatggtaggatgtgcaacaaaaaggtaacagataatggtgatgggacatggcgttgtgacaaatgcgaccagagcttaccaaattgtgagtacagatacgtgctgaatggccagatccaggaccacagtggggtcaccaattttactgcattcgaagatgctgctaaggtgatgattggccacagtggccacgagctcaacaacattagtgtagaagactcggaacgatttgcagagatcttgcaggcggctcgttggcagcagtttctgttcacgctgaaagtcaaggaggagatctataatgatgcgccgcaagtcaagtgcaacattactaaagcagagaagctggatccggcaatagagagttcttaccttctaggggtaatcaatggcctgttgcaggatgacactggctcatcttctggggcgcaaggtgccatggcctacaatgctggtatcagcaacactggcgctggacgaagtgtgccaacctccaacagtgcctacaccaccaatttgagtggtccaaggtatggcgagtctgcaaaccagctcgcgcagcaggaaagcacgtacaccggggtgaccactccagtgtcggcggcacggaatgtgcagcagacctgcgtgtcctgcgggtcaagtgggcacaacgtgcagaactgccctgcaggaacgtacaggcagcaggcggctgcaagcgcagcaagctcctacggttcttcgcagcctcgcaatggactgtgcttcaaatgcaatcagcctggacactttgccaactcttgtccactactggctcctgctccccagcagcagcagcagtatcggagcggcggcgctccctcaggcggttatggtaggcagcagccctatgttggggctaccaactactgaaagtcattatctctgtcgagtcaggcgtgatgttggttttgcttagatgcctgtcctgaatggcatcgctgcgtccatgtgaagtagatgcaaaccattcctttttatgtttgtgtgtgaagttagaactatgtatcagtacttctttatgttttcgtcttataaatcctcgttgctgtgtcaaaaaaaaaaaaaaaaaaaaaaaaaagttctgttgaattcgtttcgtggtttgtctccctgaataactcactgtatggtgggtgtaaattaaatggaaatcacttatcaggag

SEQ ID NO: 7453 - DNA, 2317 bp, Zea mays
ctccttaagacagagccaggccgccagaccattcccgaccatttcctctctctctttctctctaactccgggtccctctctcctctctctattctctccatccttgcttctgggaagctcatcagccatggacgatgccactgcagaggaagaagcttccatgttcgagaccagccatgtcctcggcgccctgctggcctcctcgccgttgctggcgcgcgcctgggaccgctgcacagccgcctccgccgcagcgccgtggttcgttcacggcgaagacggcggcaaggtgtacgtggggttctctggggtgcaggctgcgcttacggcggcaggcgcggcggtggccggcggcggcgccgacatcttcgcgccggtgagtctcggcggggacgcggcggggcggatgttcgcgccgctggtcgccgccgagcccgacccggccgctaccggggagccggttgccgtgcaggcgctggcgctgcagtgcttcctgaaactctgctgcagtcctgattttcagatgcttctgaatcagatcaggggcaaggcagtcgtgttcacgggccactcccttggtggcgccgttgcggccctcacggcgctacactacctctgcatctcatcgtcaagctcgccacctgctcctcctgtcctgtgcgtcacctttggaagcccattacttggcaacgaggcgctgtccagggccatcctgcgtgagcactggggtggtaacttctgccacgtagtctcacagcacgatgtcgtcccaaggctcctcttctgctccccggacgccgtacccgcgcacatcattgttggaatgcaactgcagcaatggccggcgtggactcggcacacaggagctgtgagcacggtcaccgcgcacatggcggacactgacaaagacgtgctccggcagctgatacagacgcacgttggcgctgtggccgtggaacagaagcttgccgcttctgagacgacaggtgggagcccgtaccggccgtttgggacgtacgtgctgtgctccccagaaggcgcggcgtgcgtggacaacccgaccgccgcggtacagatgctgtacgccaccttcgcctctcagagctcagccggtgcagagtccccggaggccgcgcactcctgctacggcgagctcgtgctgaaaatgccgcaccacttgcttctcaagagatggctgcgtgtggacgacgacatgccggcgacgcccaactacgacgacggcgtctccctcgcgttggaggcctctggcatcgacgtcatggccatggaggcgtcgacggcgcggcattggctgaaaacatcaaagcgggcagggcggcggccgagcctgaactgcgctcgcctggcgacgcagctgggccgggtcacgccgtgccgtgcacagatagaatggtacaaggcgctgttcgacgcagagatggggtactacgacgcgttcaagcagcggcggtcgcccaggaagtacaccaaggtgaacttaaaccgcatcaagctgggccagttctgggaccgagtgctgagcatgctcgacgccggccagctcccccacgatttccaccgccgcgccaagtgggtcaacgcctcccgcttctaccagctcctcgtcgagcctcttgacattgccgactaccaccgccacggccaccacctgacgagcgggagctacatgactcacggccgggagaggaggtacgagctgttcgacaggtggtggcaggagaaaggatgcactggcgctggcggtggcatcacgtcctccatgtcggcagcgtcggcgagcagccggagacgcagcaaatacgccgggctaacgcaggacccgtgcttctgggcgagagtggaggaggcgagggagcagacggagagcgcacgccgcgagcgcgacgcggccgaactggcgatgaagctggaggagctgcaagagttcgagcgctacgcccgtgagctggtggcgaccaaggaggtgtccgtcgacgtgctcgcgccgcagtcgagctacacgctgtgggtggaggattggaaccagctcaagctcagggatgatgtgaggacaatgttgcttcggttttgagctgggctgcaaaaagctgatgagttcgtaggtagctggtgggcgttctacaaatagttcaggtatacatgaatcattggatcacggtgctagtatatgtgattgtaaatatatccaaacctagaagcgcagcagtggattacagtattgttgtggttcccgtcgaaattctgaaaaaacgataatatgacaataccaattagttttgaaaaaaaaaaaaaaaag

SEQ ID NO: 7454 - DNA, 5117 bp, Zea mays
  misc_feature (4544)..(4544): n is a, c, g, or t
cttaaaatactagcaattattatattaaatatatgtatcagatttatcatagaatatattattatttaccctaacccaaagcatttaaatatctactaggtataatcccaagatatataaagtaagcaaccaacttgtggaggttcttgatgcaaaatccaccataccatttgacctctgactagtgtgccccctgccccacccctcaccaagacacagcctggccgccaaattaaacttgaccacttcctctctctctcaactccaagtcttctctctctttctctctattctttccatccccgcttctcggaagctcatcagccatggacgacgccgcgggagaggaagaagcttcgatgtaagttccacctccaaatttccatcgcttttccccgcatcagcacttataaatacttgctgcatcagtcgagcacaaaaaagctagttgctttcggctacctttcgcgcccaattggaggcaccccgaaccacaaaaaaaaaaggatgagaatttgatgccacaaacaagctcaaatgcttggtccttttgaaggttcgagaccagccatgtccttggcgccctgctggcctcctcgccgctgctggcgtccgcctgggaccgctgtacgaccgccacagccgcggcgcccgggttcgtgcacggagaggacggcggcaaggtgtacgtggggttctccggggtgcaggccgcgctgtctgcggcaggcgcggcggtggccggtggtggcgccgacgtcttcgcgccggtggggctcggcggggacgcggcggggcggatgttcgcgccgctgctcgcggccgagcccgactcgtccgctgctggggagccggttgccgtgcaggcgctggcgctgcagtgcttcttgaaactctgcggtaaccctgatttccaggtaagtgattactactccaatgaaaaaaatatctgcctggttatcatttgttttatgcttagcgcgttgattggagcagtttgccttgcccactaataatctgactaaaaatgttatttttcaagttgcacgttcatgtgactatctgatatttttgcctttctggttggctggggcctagggatggacttattgtgatgttgatgtgcctgtctttggttgttgctgtgtccttgtgtgcagacgtatagtatgagacagatccactgagatatgagatattataaatccattgtcagtcattcatagagcaagaatttggtcagtgagaaatttaacaacattatgcgaggaaaacaaaacgaaattctctgggacaaattccatgctgctgggtctattttcttccctctagtgatttctcttctatatcagtttgccttctccgtcatagtaaaacttgtctgtgaagtcacttcggacctcagaactcaaattagagtattgtgtgtgtacatagaacaatcctcgtcaaatttgccggctaacatgagatgagatgctatgcatctgttttctattgtcccagtgcaaacaaaaagtacaatcacatgtcatagatcgcagtacccaacaaaagttgctgttgcgcctttattgtcgcttacagttgatgcatttcttagggcccatgatcaacagaacatgagatagtgacgaggcatttaaaatgcactgcaggctggctcgtgatcggacagctttataaaccaattgcatagatacagatatagatctgtagacatttcaaagtcttaaaatgcttcgactaagatatggagaatgactgatctgtaggaatataatctaaccatgatgaagagctctacttcagagtttactgtcattcagaattcacgctggtttgatcggacattatctatcttctggcctcctttaatttcagatgatcacacacacacacaaaaatgtgattcttttacttgtgattcatacatttgaactaaattccactattgtagagtaacaacctaaatgacgacagctttttgctccatcacaaattccagtctttgttgacggactataattaaatacttcaaatagctgaagagaattttgaggtttcgttgatcttttgatatacgtttcagaggaccacaccttgtctccatcttctatacctttatcacttttgactttttaatcgagtgacctaattattgttcataaaactatgcagatgatcatttttcatgattttttttgttctagcatgagtgctttgtgccactttatgcagctaatgatcccattctctccaatctttacttttcgacctgtctcactgaaactgtgctactaaaatttcacatttgtgtttcaccacactgaaactgtgacttactcatcagaattggttgacattgcagatgcttctgaatgagatcaggggtaaggcagtcatgttcacgggccactccctcggtggcgccattgccaccctcgcggcgctacactacctctgcatctcatcttcaagctcaccatggtcacctgctgctcctgtcctgtgcgtcacctttggaagcccgctactaggcaatgaggcactgtccagggcaatcctgcgtgagcgctggggtggtaacttctgccacgttgtctcacagcacgacgtcgtcccaaggctcctcttctgccccccggacgccgtccctgcgcatatcattgtcggaatgcaactggatcaatggccggcccggactcgccacacaggtgcggtgaacacggtcaccacacgcatggcggacactgacaagaacgcgctccagcagctgatacagacacacatggccgctgtggccatggagcagaagcttgctactcctgagacgacaggtgggagtccttaccggccgtttgggacgtacgtgctgtgctccccagaaggtgcggcgtgcgtggacaacgcgaccgcggcggcacagatgctgtacgccaccttcgcatctcggagttcgcccggtgcagagtccccggaggccgcgcactcctgctacggcgagctcgtgctgaaaatgccacagcacctgctcctcaagagatgcctgcgtgtggacgacacgcgtgccacgcccaactacgacgacggcgtctccctcgcactggaggcctccggcatcgacgccacggtgagggcacacgtacgtacatattagtctgcgtgtattaaactatggtacagtgcgtgttctttgtagtgtatatcttgtctgacatgctggcattaccatcggcggcaggccatggaggcatcgacagcgcggcagtggctgaagacatcgaagcgggcagggcggcggccgagcctgaactgcgcttgcctagcgacgcagcttggccggatcacgcctctccgtgcgcagatcgaatggtacaaggcggtgttcgacgcggagatggggtactacgacgcgtttaagcagcgcaggtcgcccaggaagtactccaaggtgaacttaaaccgcatgaagctgggccagttctgggacggcgtgctcactaagctcgacgccggtcagctcccccacgatttccaccgccgcgccaagtgggtcaatgctgcccgtttctaccagctcctggtcgagcctctcgacattgccgactaccaccaccaaggcctccatcggacgagcgggagctacatgacccacggccgggagaggaggtatgagctgttcgacaggtggtggcaggagaaggcatgtacgggcgctggcggcgacatcacgtcctccatgttggcagcgtcggcgagcagccggagacgcagcaaatacgccgggctcacgcaggacccgtgcttctgggcgagagtggaggaagcgagggaggagacggagagcgctcggggcgagcgcgacgtggcggagctggcgatgaagctggaggagctgcaagagttcgagcgctactcccgtgagctggtggcgaacaaggaggtgtctgttgacgtgctcgcgccgcagtcgagctacacgctctgggtggaggagtggaaccagctcaagctcagggatgaggtgaggacactgttgctccagttttgagctgagttgcaaacagctgatgaatttgtagatagctggtgggcattctccaaatggttcagaagtacatgaatcatttgatcattgtccatggatgctactatatagctgattgtaaatatatctaaacctagaaacattgcagtggattacaatatatttattctttcatgggtaccttgatggcccgatactgattcgaaaaagctttcgagcaaggaggcttgaaaacagctgaagttcagatatggatggatggatgctagtaagctccaagggcagagccagtatttcggtttgcgaacctgtgcagaagattccctctacatataaaatgcacaaaattaaatctggaccattcatatctaatcattcaatatctaacggcttaacggttgagtatgtgggttattttttttataaatatatagctagatgcgggagagaggaacaccaaatttttttttttaaaaaaaatatgtccatttgntggatgaatggtagatttaatttgtgtatggaagggatttcgtgcatagctttcggtttaaaggactagtctgtctctgtgtattatttttagtttgcctttgttaaaataataattaagttaaactcttgttttacaatagaaagacaaactaaatatgtaaaaataatatcataaattatataaaaggacaagaaaatttatactgagggctagtttgggagctaaaaaatagaggggattagagaggctaaaattatcttcttattcaattttgaataggaaggggattctagccctccaagccctagcttccaaactagcactaagtctttaacctctgcccgaccattttaatacatatgaaaaatttacaccactaacattaataaaaaaatggagagagtgtgtgaaaaaacaatcataaaacatataaccattctaattaaacaacaacaaccatcctgccattctaattcatataaaatatcacagtaatcaagtaaaaaaagtagaacgaagataagagaaacacacgcatacaacatatactagagattaatgggaaaaata

SEQ ID NO: 7455 - DNA, 1495 bp, Zea mays
ttgggaccctcgaggccggccgggaagccggccgggtccggaagttttcagaacgtctgtgtgccgttggttctgggcctattcacggcattcagggggaaatgggtgagttccaagctcttcctctcatcaacttcttcccgttccacgcagaccaaccagacattaagaattgagatcctgcaaccgcaacaatggcggccatggcgaacacctctcgtctccccaccccctgcagcctcccaaccatcagcatcggcgctaagagcaggaggctagctgtggcggccgtcagatgcggtcccggcggcagcaggagccaccggaggagccttggggtcttgctgtgtcgatcctcgtccacggccggagcccaagggagcacgaggatggaggactataacaccgccatgaagcggatgatgcgtaacccctacgagtaccatcacgatctcggcatgaactatgctgtcataagtgagagcttgattgttggctcacagcctcagaagcctgaagatatcaatcacttgaaaaatgaagagcgagtagcatatattctttgcttacagcaggacaaggacattgaatattggggcattgacttccaatccattgtcaataggtgcaaagaacttggcattcagcacatcaggagaccggccgtggattttgatccagactcactgaggtcgcaactgccgaaagcagtttcggcgctagaatgggctacgtcgcagcgcaaagggcgggtttatgtccactgcaccgctgggcttgggagagcacctgcggttgcaatcgcttacatgttttggtttgagaacatggatcttaacacggcttatcagaagctaacctccataaggccctgtggacccagcaagagagccatccgcgccgcaacctatgatctagctaagaacgatccatccaaagagccttttgagaaccttccggagcacgcttttgagggcgttgcagactgggagaggaagttgattcatgaccgggtgcgtgctcttcacgaagcatgagcagaagaaactttctccacgcgtcaagaaggggggaactaagcttcctaatgaggcaatggctgtgcttcggcaccagatcattagatgtcgaaacgataaagtttgttctcaataaagcttatacgacgccatatttgttgctgggtagtttgtaatagtcactaataggaaggaaataaagagggccttgcatgagattccagctggtgtcttcacctttgtggtgactgcaaatgagatgcccatccattaatggcatggcgcattgtaggtatattgtgtaaataaacctgtggatcttcatttgaggaacatcacttctgtaaaagtttatttgaagatacggccagctttgcaaatccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 7456 - DNA, 751 bp, Zea mays
tcgggaatctacgagcagcagcaccatccaactggctcatccgcaagcgaacccgatggatccaatcacaaggccggcagctccatcgttccatcggccagcagtcgcgaccgcgaagcatctccatcaggccgccgccaccttggctcggaggaatggagtcagcaggaggtgccttctgacgctgctgatgtccactgcggccatacctggcggcagcgaatcgaggaaggctctactgcaagagtatctgaagaaatcgaaggagaacaaggaaaagaacgacaaggagaggctggatgactacaacaagaggaactacagggactacttcgggctcatcgagggccaggtcagagagaagacggaagaggagcgcacggagtcggagaaacggatcctcgagtggctcgacaagaacaggtagtctaatgagcaggatcgaatggtcgatcatggagggccggccggtcgcacggggtgaaaattctcgcaggattcttcgtgttcccgctctagctatggcacgctttgtgtaaacaagtactccgtatatgattgactgagcgtactacgtcgtgtttgttttcctgttacagcgagagcgagcgaggaaacatgttatctcgttcgcaacataaacaaagattagaaaatttccaatacacgatgccctgactttctgttcacagacagaaaacaaaacacaacctgaagattcactacaagttaatctccacacggagaatcg

SEQ ID NO: 7457 - DNA, 1625 bp, Zea mays
  misc_feature (29)..(29): n is a, c, g, or t
aaaaaaaaaaaaaaaaaaaaaattttagnacggcgacgcggactatattgctcccatgaacctcgccgtcgcagccgcactgccgtccgtgacgccacgtaccggcgtcgtgctcccacggagcagtcgccgacactgcccccgcggggtcgtcccactcgcggcctcgagctccgtttcctcctttacctccccctcagcagcggcggcgcccatctacgcgcccacgccgcaggaccggtctctccggacgccgcatagcgggtaccactttgatggcacggctcgacctttctttgaaggatggtacttcaaggtgtcgattccagagtgcaggcagagtttctgctttatgtactctgttgagaaccctctcttccgtgatggtatgagtgatttggacaagttgttatatcgcccacgctttactggtgtgggagcacaaatccttggtgcggacgataagtacatatgccagttctctgagaaatcaaacaatttttggggaagtaggcatgaactaatgctgggaaacactttcatttccaataaagagtcaaccccaccgcaaggggaggtgccccctcaggatttctctaggcgtgttttggaagggttccaagtcaccccaatatggcatcaaggtttcatacgtgatgatggaaggtcaaactacgtgccaaatgtccaaacagctcgctgggagtacagcactcgtccagtttatgggtggggtgatgtcaaatctaagcagttgtccacagctggttggcttgcagcttttcctttctttgaacctcattggcaaatttgcatggctagaggcttgtccacaggatggatagaatgggatggagaacggtttgaatttgaaaatgctccatcttactcagaaaagaactggggcggaggttttccaagaaagtggtattggatccagtgcaatgtcttcccaggagcttctggtgaagtttctttaactgctgctggtggattgaggaaaattggacttggtgatacctatgaaagtccttcactgattggaatacattatgagggacagttttttgaatttgtaccttggactggaacagtaagctgggacattggactgtggggtctttggaaaatgtctggcgagaacaaaactcatctggtagaaatagaagcaaccactgcagaatcaggaactgctctgcgcgctcctactatcgaggctggactggtaccagcgtgcaaagacacctgctatggagatctaaggctacagttgtgggaaaagaaatacgatggtagcaagggagagatgatactcgacgccacaagcaacatggcagcactagaagttggcggaggcccctggttcaatgggtggaaagggacaactgttgtgaacgaggttgtaaataacattgtgggcacgccagtcgatgtagagagcctcctcccaatcccatttcttaagcccccaggcctataggatcaccaacgaatgtcacaatgaagaagtatcacggatatcaatgttgatcatacagtaaaactgtgcccagttcaataataattcatgatttttacttgttttttactacaaaaaaaaaaaaaaaaaaaaaaaaaaaaaaaaa

SEQ ID NO: 7458 - DNA, 1601 bp, Zea mays
cgttatattgcccgtcaagttcccgcagttcttcacgggcaagcggaggccttggagggcgtttcttttgtatggccccccaggaacaggaaagtcttatttggcaaaagctgttgcaaccgaggctgattcaacgtttttcagtatatcttcttcagatctggtttcaaagtggatgggtgaaagtgagaaattagttgcaaatctgttccaaatggctcgggaaaatgccccttccattatcttcattgatgaaattgattctttatgcggtcaacgtggagaaggcaatgaaagtgaagcatctaggagaattaagactgaacttcttgtgcaaatgcagggtgttggtcacaatgatgataaagttcttgttcttgctgccacgaatacgccatatgctctggaccaggttacaaaaaacttgccgaatactccgtcctgaagatgatgcaactacctagggtatctgtgcaagtcaaattagcccaagtttgaccaaatttcctcggggcccgccgggaatttacgtcttcaactaggtttactatgaaaatacattccagaattaatgatttatagtggtacttattttgtatcataaatgttaataccttttgtctaactttggttaagcttcaaaccgtttgactcgaaaagtgagaattgcattctttttgggatagagggagtacagttttgcaccgaatacaacttcgccaaaaaaaagtaacgtccccatggtcttgtgaaacactgtttggttctttgactcattcattgtcgcaggctgtgcggcgaagatttgacaagcgtatctacattccgctacctgacttgaaagcaaggcaacacatgtttaaggtccatctcggggatacaccacacagtttaactgaaagtgatttcgagagcttggcccgtcggacagacgggttttctggttctgacgttgctgtctgtgttaaggacgtgttatttgaacccgtgcgcaaaacgcaggacgccatgttcttcttcaaggcggacggtgacatgtggatgccatgtggaccgaagcaaccgggcgccgtgcagaccaccatgcaggagcttgcatccaaaggcctcgctgcgaagattcttccgccccctatttcgagggcggacttcgagaaggtcctgtcgaggcagaggccgacggttagcaagaaggacctggaggtgcacgagaggttcacgaaggagttcggcgaggagggctgacagacgcgcgcacccacccatgcacgggcggctgcaccacacaaatgtatattgcatcttatgacttggattgttctgcttcgaagtggaagttgcgttacattacaatttggtgtcccaactacggctaatcatgccagctggtttctcgtgttgggctaccaatgggcctctgttgtcagcctatttcatttttattgttgcacatggaatttttccacgggtgtattattatggaataataattgttagcgtggtggagtccttgtggttgcagactgtatgtatagctatttcactaacgttccttggtttttacgcccagtttcttttttttcaaaaaaaaaaaaaaaaaa

SEQ ID NO: 7459 - DNA, 1870 bp, Zea mays
ctcgaggccggccgggagccaaaacacgcttctcccttccgatcttttcctttcctatccctcgtctcgtctcgtcttcgttcccctttcctcctgcgcaccccgtcttctcctcaccgcgtcaaaccccagcacaaatcaaccgcccgccgcctccgctcccctcccgtcccgaatcagccgccgcggtgcccaatccggccgatcccccctcctatccgccgcagaggcggcgcctctgggcctaccccgatgtatagcaacttcaaggagcaggcgatcgagtacgtcaagcaggcggtccaggaggacaatgccggcaactacgtcaaggcgttccctctctacatgaacgcgctcgagtacttcaagacccatctcaagtacgagaagaaccccaagatcaaggaggccatcaccgccaagttcaccgagtacctccgccgcgccgaggagatccgggccgtcctcgacgagggcggcgcggggccgggggccaacggaggtgacgcagccgtcgccacgcgccccaagaccaagggcaaggacggcgacgggggcaacggaggggatgactccgagcagtccaagctcagggcggggctcaactctgccatcatcaccgagaagcccaacgtcaagtggaacgacgttgctggcctcgagagcgccaagcaagctctgcaggaggccgtcatattgccggtcaagttcccacagttcttcacgggcaagcggaggccttggagggcgtttcttttgtatggccctcctggaacaggaaagtcttacttggcaaaagccgtcgcaaccgaggctgattcaacatttttcagtatatcttcttcagatctggtttcaaagtggatgggtgaaagcgagaaattagtcgcaaatcttttccaaatggctcgtgaaaatgccccttccattatctttattgatgaaattgattctttatgcggtcaacgtggagaaggtaatgaaagtgaagcatctaggaggattaagactgaacttcttgtgcaaatgcagggtgttggtcataatgatgataaagttcttgttcttgctgccacgaatacgccatatgctctggaccaggctgtgcggcgaagatttgacaagcgtatctacattccgctacctgacacgaaagcaaggcagcatatgtttaaggtccatctcggggatacaccacacagcttaactgaaagcgatttcgagagcttggcccgtcgaacagatggattttctggttctgatgttgctgtttgtgttaaggatgtcttatttgaacctgtgcgcaaaacacaggatgccatgttcttcttcaaggcagacggtgacatgtggatgccatgtggaccaaaacaaccgggcgctgtacagaccacaatgcaggagcttgcatccaagggcctcgctgcaaagattcttccaccacctatctcaaggacggattttgagaaggtcttgtcgaggcagaggccgacagttagcaagaaggatctggaggtgcatgagaggttcactaaggagttcggcgaggagggctgatacaccgcgcgcggacacacacccatgcacagctgcaccacagaaatgtatattgtttatcacttcgattgttctgcttggaagttgcattcacaggattatacatttggtagcccaactatgagtaatcatggcagctgctttaccgtgttgggctaccgatgggcctctgttgtcaacttatttcaatttttatttatgcacatgaaaattttccgcaggtgtattattgaataataattcttaacgtcgagcccttgtggtgctagtttctttttctaaaaaaaaaaaaaaaaaaaactcgagaaaa

SEQ ID NO: 7460 - DNA, 1854 bp, Zea mays
aaaaaaaaataaaaatcgcagccacattgggcccctcgaggccgatcttttcctttcccctcctccctcctcggctcgtctctgttcccctttccctcctgcgcaccccgtcttctcctccccgcgtcaaaccccagcacaaaaagcaaccgcccgccgcctcctcgctcctctcccgaatcagccgtcgcggtgcctaatccggccgatcccccctccgatccgcgggtgcccgccgcagaggcggcgcctccgggcctcccccgatgtatagcaacttcaaggagcaggcgatcgagtacgtcaagcaggcggtccaggaggacaatgccggcaactacgtcaaggcgttccctctctacatgaacgcgctcgagtacttcaaaacccacctcaagtacgagaagaaccccaagatcaaggaggccatcaccgccaagttcaccgagtacctccgccgcgccgaggagatccgggcggtcctcgatgagggcggcgcagggcctggggccaacggtggcgacgcagctgtcgccacgcgccccaagaccaagggcaaggacggggacggaggcaacggaggggatgactccgagcagtccaagctgagggcggggctcaactccgccatcatcaccgagaagcccaacattaagtggaacgacgttgccggcctcgagagcgccaagcaggcactgcaggaggccgttatattgcccgtcaagttcccgcagttcttcacgggcaagcggaggccttggagggcgtttcttttgtatggccccccaggaacaggaaagtcttatttggcaaaagctgttgcaaccgaggctgattcaacgtttttcagtatatcttcttcagatctggtttcaaagtggatgggtgaaagtgagaaattagttgcaaatctgttccaaatggctcgggaaaatgccccttccattatcttcattgatgaaattgattctttatgcggtcaacgtggagaaggcaatgaaagtgaagcatctaggagaattaagactgaacttcttgtgcaaatgcagggtgttggtcacaatgatgataaagttcttgttcttgctgccacgaatacgccatatgctctggaccaggctgtgcggcgaagatttgacaagcgtatctacattccgctacctgacatgaaagcaaggcaacacatgtttaaggtccatctcggggatacaccgcacagtttaactgaaagtgatttcgagagcttggcccgtcggacagacgggttttctggttctgacgttgctgtctgcgttaaggacgtgttatttgaacccgtgcgcaaaacgcaggatgccatgttcttcttcaaggcggacggtgacatgtggatgccatgtggaccgaagcaaccgggcgccgtgcagaccaccatgcaggagcttgcatccaaaggcctcgctgcgaagattcttccgccccctatctcgagggcggacttcgagaaggtcctgtcgaggcagaggccgacggttagcaagaaggacctggaggtgcacgagaggttcacgaaggagttcggcgaggagggctgacagacgcgggcacccacccatgcacgggctgctgcaccacacaaatgtatattgcttcttatgacttggattgttctgcttggaagtggaagttgcgttacattacaatttggtgtcccaactacggctaatcatgccagctggtttctcgtgttgggctaccaatgggcctctgttgtcagcctatttcatttttattgttgcacatggaatttttccacgggtgtattattatggaataataattgttagcgtggtggagtccttgtggttgcaaaaa

SEQ ID NO: 7461 - DNA, 680 bp, Zea mays
acctttctcaccgtttctctcctagtctcctctcgtttcccgtcctcctcccgttgggagtataaaatttcctaatccgcaaacgaagcttccagaaggcttcttcttgcgtaccttccacttccacccaacgcgactcgctctttcccgcatctggaagtcgccggctcagatccagccgggctgcggcgctggccggatggccgagcagggcggcgcagccggggaggccgctggcagcgacccccctgcgcctgcgcctgcgactgccccggcgccagccccagcgcttgctgcggacgcggccgggcagaggtccctgccgacgccgttcctgaccaagacgtaccagctggtggacgacccggcggtggacgacgtgatctcgtggaacgaggacggctcgacgttcgtggtgtggcggccggcggagtttgcgcgcgacctcctccccaagtatttcaagcacaataacttctccagctttgtgcggcagctcaacacctacggatttaggaagatggtgcccgaccggtgggagttcgccaacgacttcttccgccgtggggagaagcgcctgctttgcgacatacaccgacggaaggtagcaccggctccggcggcggggctggccactgcggccgccgctgccgcgtccggggccgtaacggtggccgcgg

SEQ ID NO: 7462 - DNA, 1004 bp, Zea mays
gagcgccgctacggtcaccactcccgtgcactgttgcactgaccatcgtctcactctcatctcatcaccgctttccgtttcgctcgtccgatcctcatcaccagctcgggagggaggtcgggagagagcacggacgatgtggcacgccgcggcggcccccaacaaccttcacccggccgtcgccacaacatcgtcccctgcccttcgccgtgcgaggtggcccatcgctcgaccctcgtcgtcggtgaaggtccagtcctccaccaggaacggcaatggctccgctgacaacctggaccacctgcagagggcgtccaagggcaggcagcagcggcagggggcgagtgctccaggcccgagggctagaagggtcgtccgcaccacaccattcgggctgtggtgggacagcttcccggaagcgaggacgctggaccagatggtgcggaccatcatggacgccgacgacgctgacaccgacacccgcttcggcggcgtcgtgcctgcggcggcggcggcggcccccaccgccgtgccgcgcgccgaccacgggcggacgccgtgggaggtcagggagcgcgcgggggagtacctggtccggttcgacatgccagggatggcgcgggacgacgtgcgggtcagcgtgcacgaccggacgctcccccgggccgcagagaagaagcaacagcctgctgctgacggcggcggcgacgaggagggagataatgaggaggaggcgtggccgcccggcgagcttccggcggaacaggaagcgggtggagctgccggaaaacgtggaaccgaaaaggatacccgcaaaagtgaaggacggaatggttgtaccctcccccttcccccacctgcccggcggggggcccaaggtcctcaacattccaggcgtaatgatggttgtggggttataaatcttttagggaacattaaacccccttgttgcccgggggttttttcgcaactcttttataaaaattctgggaaggctttgggga

SEQ ID NO: 7463 - DNA, 2830 bp, Zea mays
  misc_feature (875)..(875): n is a, c, g, or t
  misc_feature (1497)..(1497): n is a, c, g, or t
atcatctaaaatgcgcactgctgtcaccgcggcggagggaaaaatcgggcgtaccccggtgcccgttcaccgccgttcacgccgcgtgtgcgctctggctctgccgctctctctctctcctgcgcgtggcgcagctgccgtcctataccaggcgcccaggtctagcctcgtcggtgccttcgccaggtctttctcgggcccttcgccaacgacgagcgcccgctaggttagaaggtatgcattcgtgttcataatattgtatttgactaaaaagactgggcctacgcatgggggctccaaaacagaggtggacttctgaggaagaggctgctcttagagctggagtagccagacatggagttggaaattggcgcatgatattgaatgatccagaacttagctccacattgcgctaccgctcgaatgttgacctaaaggttaaatctattcactcgtttttacgtaagattgatttagtgaagggactgccatatttgggtattccttgaaatcatgtgtcttttggttttcaaatttctagattcatcttcaatcttaatgctcatatgttccttttttattaatcactacttaggacaaatggcgcaacatgaatgtaattgtcacttcatcgagtactcgtgacagggggagaacttccacgaggagaacccgagctgctcctaagaatatatgaccaatggttggcaatgagcaccatcacttctgagggtgatgatgagattgttgatgtaaagcccatagtatcaatgtctgttgaaggatggaatacttcaaattcaaagaaatctcactcaaggtgattacatatgcatgtgtaataatacataattgtgccgtttagcttatctccntctctctcttcattatctcaatagaaaactagatagactgaagtcttcacttactattgctttaatgcaggctagacaatattataatggaggctataaagaacttgaatgagcctacagggtcccacagaactactattgctaattacatagaggtgtgcattcttctcttgtttttgtttctttgaatgagcctacagggtcccacagaactactattgctaattacatagaggtgtacattcttctcttgtttctgtttctttctagaacttatagacttacaatatgctttatttatggtctgtctacgttcccattttcctttacttttgaacgtcaacattatttgccttttctgtttgtaattagtcagccaaaaaaatttatactcatgatatcttgttaatagtaaatgtattgttcttatttttgacaaaagtgtatgataagtcaactacgtggctacccaaccgtcatgaacccatgattttgcccaaatcggaagggtaggcgtggtgtagtgatgagagctgtctcgctgagtcaccagatcacgggttcaaagcaggctctctacatttacagggaaaaaacttgcatcggtttatatatcataaanatctaaataatcagtgaacacttgtcatgccagaaacagaacttcagcacacctgatctggctgtataaaagttatatatcatagatatcaaatagtagaatccaataaaaaagcatgtctagttaattagattagatttcctcttgttgtccaaagcgttagctattgcactgtcttctcgcagagttctgatttcattttgaaatcatcatgttctttcttatttgctaataaaagttattggtgaactaggtcatggtcgtcttattttctatgtgcacaatcaggctcttaccttggttttatgtaggagcaatattggccacctagtgattttgatcacttattgtctgcaaaactgaagtatttagctaccagtgggaaattgttgaaggtaaatatgatttttagctccctacatcattttatgctatgagaaatgaagttaatttaaagatgaaactactaggtgatatcacgtgagtaaattcaattaatgtcatcagctcacctaaaaaaactcttcttggaggaaagatctcccccaaggcattgtattaaggagaaaccttaaccacagggtcaagaaggccagctgacttcccaggatgcaaccatgtatatctctgaaagcagttgcaacgtgaggggccttttgtgaaacccagggttcaaaccctgatcctacagcaccacaactgggtgcccaaccaccggccaccacactagtgcattctcatgacatcacctggtgttgtactccaagataagtaaaatttgtgcataatgttgaagtgtataagtggattgacaaccttctcccaccagagagaaagatgcaaacgtggaaataaatgggcgggggcacacataaagcctctaccaagattcgaactcgagatctctggctttgataccatgttagagtgaacgcactaaccagttcaacccaaaagtttaagctaatgaaagaaggtagccaatccacttatacacttcaacacataacaccatgagaagcctagttttcatcgaactgggacaactcatgtgccatgtttatgaattcaagtatatgaaggtttatcatgacccatatgtttgggcataagcatgtgctctagaagatgcacaaacgtagacttgatcaatcatgcaccatactctattctttctattattacagtgccaaacatgttaatcagtattagcaaacactgagtttttgttcagtaatgcacaacactccactgttagatacattgatttcttgttcaatttcatgtagaatcttttgttaggctgcaagtttcctgttgatcttactataaa

SEQ ID NO: 7464 - DNA, 1317 bp, Zea mays
atcatctaaaatgcgcactgctgtcaccgcggcggagggaaaaatcgggcgtaccccggtgcccgttcaccgccgttcacgccgcgtgtgcgctctggctctgccgctctctctctctcctgcgcgtggcgcagctgccgtcctataccaggcgcccaggtctagcctcgtcggtgccttcgccaggtctttctcgggcccttcgccaacgacgagcgcccgctaggttagaaggtatgcattcgtgttcataatattgtatttgactaaaaagactgggcctacgcatgggggctccaaaacagaggtggacttctgaggaagaggctgctcttagagctggagtagccagacatggagttggaaattggcgcatgatattgaatgatccagaacttagctccacattgcgctaccgctcgaatgttgacctaaaggacaaatggcgcaacatgaatgtaattgtcacttcatcgagtactcgtgacagggggagaacttccacgaggagaacccgagctgctcctaagaataatgaccaattgttggcaatgagcacaatcacttctgaggttgatgatgagattgttgatgtaaagcccatagtatcaatgtctgttgaaggatggaatacttcaaattcaaagaaatctcactcaaggctagacaatattataatggaggctataaagaacttgaatgagcctacagggtcccacagaactactattgctaattacatagaggagcaatattggccacctagtgattttgatcacttattgtctgcaaaactgaagtatttagctaccagtgggaaattgttgaaggtgaatcggaagtacaggatagcacctagtttgctggaagacgtgcaaagagaacccttgaaattagggagtgatgctagtagaacccttacaagatcccaagtcgatgctgaattggtccgtatggcaactatgactgttgaggcggcggcggcagctgctgctcatgcagttgcagaggcagaggctatcatggcagaagctgaagcagctgctagggaagcagaagctgcggaagcagaggcccgagctgcacaggcctttgctgaagcagcagttttgacactgaagaacagaaatgctgcgaaattggtatagctcgagtccatgaatcttagatatgccctcttgtccttccacacgtagaatccagttccgtagctctgtatgcaactaattggttactaaaagaacctgaaatcagaagttttcacaaacacaccgacttattcaccgaagattatggtttccaaaaaaaaaaaaaaaa

SEQ ID NO: 7465 - DNA, 1990 bp, Zea mays
taccggggccggccgagcgtgaactacccactttccaattcgacatcttcgccctcgaatcgagcttccctccaccgaatcgagttcctccatccaaatcgagctcattgccgccggatcgaggtctgcgtggatcgagctcgagctttggagaaggagaggaaacgggggacgggcacggggggagcaaggcaaccaaacgggtggagggaaacacgccaaacaggctcctcgatcgttccgggctcgggctgccacccgccattcggtgtcccctccttgacaggtgcccgagccgcgccgagctccagcctcatttccacggtccgcgccggcactcttccctctcccgatcgtcctcctcgtcgcctgccgcctcttccttcttcccactccactagcttcaggttggactgcacaacgtggagcggagatctatccgaacacgggattgattcatctggtggtgttacaacatagggtttttgatatagcaatgggattactcatgtataaatgaacaaagtttggagacagttggacctgacaattgccactttttacatgttttaactcattttttttctgggaaacaagtaattctgaagttaccttggaagtcctttgcgcttttgactggtcgggttgcataggccattgttgagaggtgatttggcctaagaatgggggctccaaaacaaaggtggacttctgaggaagaggctgctcttagagctggaatagcaaggcatggagttggaaaatggcgcacaatattgaaagatccagaatttagttccaccttatgctaccgctcaaatgttgatctcaaggacaagtggcgaaacatgaatgtgattgtcagtacatcgagttctcgtgacaaggcgaagtctgcattgaagagaatacgaactattcccaagaataatgagcacaccatggcaattaccagagttacttctgatattgatgatgagattgttgacgaaaagcctatagtatcattgcctagtgaagcaaagaacacatcaagttcgaagaaatctcacaggctagataatattataatggaggctataaagaacttaaatgagcctacgggatcacacagaactactattgctaattacatagaggagcaatattggccacctagtgattttgatcacttactatctgcaaaactgaaggacttgtccaccagtggcaaattgataaaggtgaaccggaagtacagaatagcacctagttcacccaattcagagcgccgaagccccaaaatgccactgttggaagatgtccaaagagagcctgtcaagatatggagtgatgatactaaaacccttaccagatctcaagttgatgctgaattggcacgtatggcaaccatgactgctgaggaagcttcagtggcagcggctcgagcagttgctgaagcagaggccatcatggcagaagctgaagctgcagcgaaagaggcagaggctgcagaagcagaagcccaagccgcacaagcatttgctgaagcagcgtttttgacattgaagaacagaaatgctggaaaattgatggcctaaggttgatcctacttggactctcggcctcgcggctgttctgaaacggcttttctgtgccatgtagatttgtacaacagtacgtgtttactacacttcggtttaaagcagctgccccggtgagtgtatcaccttatgttagtgggagccatgtgaaaactccagcctccagcgcactagtagcaacaatagcagcttgccacaacgccattcagaaaactgggtggcataaactcttccagtgtcaaatgtttcgctaacgatttgcagtattgcattgtgcatgaacagcctttgcattagtgcattattgcgctgcctgccaacagtcggcccgtttgctgaaaacgtttgtccggtggtgcactggcgctgataactacatattctcacaatattaaattaccagtttc

SEQ ID NO: 7466 - DNA, 1351 bp, Zea mays
ccggccgggaccacggccacggagcgtcgcacgattcgcggccccgcccgcgccggccccggctccctccttctccgctgggtcactcgctcgtcgctcccaagtcccaccaagctgtcccccgaccactccgccgcccgctccaatggcggcgccggccagctcctcatgcttccacccacgcgcgaccgccagcccgccgtcttctctcagcgtcggcaccaaggtcttcgtcgggctcagggcgcagaccaagctcggttcgtcggagtcgtcatgcccgaatgtcagcgctgggttccacactgcggtcaaccggagaatctctctcaggttgtccaaaaagaaggcgaccagagcccgcatctcgatgatgcctattggtactccacgtgtgccttaccgaacacctggtgaaggaacctggcaatggcttgacatatggaacgctctgtaccgtgagcggattatcttcattggggacaatatagatgaagaattcagcaaccaagtgttggcaagcatgctctatcttgacagcattgataattccaaaaagataatgctatacattaatggaccaggaggagatcttactccgtgtatggcactatatgataccatgctaagtctaaaaagtcctattggcactcactgcttgggctttgcattcaacctggcaggattcatccttgcagccggtgaaaagggttcacgcactggtatgcctctatgccggatttcactccaatcacctgccggagcagctcgaggacaggctgacgatatagaaaacgaagcaaacgagcttatccgcatcaagaactatctctatggcaagctcgcggggcacacaggccattctgtcgagaagatccatgaggacctgtctagggtgaagcgcttcgacgccgaaggggctctcgagtacgggatcatcgaccgtattgtcaggccgtctaggatcaagaaagagggctccactgctcaaaggagggacatgcggaatctgggacttggctaataatagacgatcgaaatcctgttgtatcagaattttttgtgcaagggatgcgcttattatgggagagcgagcgatgcactgttccaggctctacgccggcgtaggtgttttgttgtgtcagctgtgcttttgctaactgtcagcactactattataatatatttgctgggattgttgatgagcacggcaaagaaaaagaccagagatgcgagggcactggcctctaggcgtctcgtctcttggacaactcttgtaccaatcaatcaaccaggtgcccatgctctggatggggactacagttatatgcagggctaaaaaaaaaaaaaa

SEQ ID NO: 7467 - DNA, 1458 bp, Zea mays
gttgttgtggggaacatggcagccctcaagagagcaccaactcatacataaaagaaatgttgcaagtatccaagtttcttcgtgtcatcaatctacaaggcatcgatatcggtgagagcttaccaacagctattgggaatgtagcacaccttcagtacctcggtgtcactgcttgttccttgaaatatatcccatcgacaattgaaaaccttaaaaaacttcagacgttggatgttcgacacacgtttgtttataaacttccagaagcattttggagtataacgacactgcggcatgtatttggtgagggtcttttcttgcctaagcaggtgggtgacttgaaacacctgcagacacttgaaagcatagatcctgataaggataatggttgggacagcagcacttttgagaaaatggctcaccttcagtcccttcatgtttgggattctaagtacaatggagttaatgctgaggctctatctgctgttattgataaagccaatttcctcgaacacctagataccctcactcttgatgttcatgacatcccattgagtgtgttcaccagttcttccctgaggcgtctccgtaccctaatcttagacggcaagttggacatgttggtgctgcaatctaaagaaaaggagtcaaaatttcatttccccaacattagcttcctatcattggcaaaaacagaggtgtcgcagaacttcatcaacaagcttgggaagctgccttcgctcaccactctaatattggatgtaaaatcctacaaggatgatcaagatcaacttgccttccaagctggtggatttacaagccttacaaagctgatactttctgatctggaaattgtgaaactcgagataaagaaatatgcacttccagaactcacagatttggaggttgagttgtactacgacgaaatcgaaatcgaggtatatggcgagcatgagtttgtgaagaaaattgaacaagtggatgaatacctctatggccgtatcactcaagttccggttgctccaaagaaaattggtcagcttcctagcatgaagcaacgcgtggctagctgaagatcacaggtaaactaagacaccaatatagtaccacttgctgttatttcgatttgcctgttcagtatgtacaactctgtcatgagtcgtgagtttattagtgtggatgtggtggcagatcggcatgtctacataataattgctggccgcacctgtctacagtatgcgtgtatgtattatatattatggaacctgcgaaaaaaacgtatgtgtgcgcgtgtatcatggtgtgtactcctaaattgtaaaataagtgaaagaaaaaacaagtggatcattgaatgttgaaggatgtttttgtaaccagatgttctttggactctgttttttgtttagagaaatataatcccttatgtaggaaaaaaaaaaaaaaaaaaggccccta

SEQ ID NO: 7468 - DNA, 1841 bp, Zea mays
ccggaccgacagaatgcctatagtcctatacttacagctgaccaggcgatcaatcacgcacgccgctggtcagcagtcagcagcaagccgcctcgtcgcctcgtcgggagtcgggagtctggtgagcgagctggtgatcaggtaccttggaggcctggcttgcttggacgctccattgcttcgacttcgaggtcgtcgcgggtttggatcctgtgtggagggggtaacaccgtgtagctcaactgtcccctagcgccgccgcgcgaaactccctaccggtccattttgtttgtagccattaagctcttcggaggtggagatctgggctgtcgtttccaggaccctggccgcgtcggctgtgatgggtcgaagcgccttggcggttcggttggcttcccttcttgcgtttggtttggtgctcgtctccgtcgaggccagcctcggggatgttgatccgcgctacagaacttgcgtgagggagtgtcaagctacagggattgttggggagaatgtcatcagccattgtcagtccaaagagaactacacttctgttggagtctcttggtataaccaggagcaaatttacatccagtggaaggaactgaactgtaggacagactgtcgctatttttgcatgatgcagagagaaggggaacgacagtcacttggtctgagccctgttaaatatcatggaaagtggccattcttacgtgtttctgtgttccaggaacccctttcaactgcactatctgctgtcaacctactgatgcacttcactggctggctttcatttttccttctagtgaattacaaattgcctcttagaccccagaccaagagaacttattatgaatacactagcctgtggcatatctatgcaatcttatcaatgaacgcatggttttggagctcaattttccatactcgagacattgagttgactgagaaactggactattcttcagctgtggccttgcttggctactcgttgatcctttcattgctaagggctttcaatgtcaaggatgaggctagcagggtgatgtttgcagcccctattttggcattcgttacaacgcacatcttgtatcttaacttctacgagcttgactatggatggaacatgaaagtctgcgtggtgatggctgcggttcaacttctgacgtgggctgtttgggctggtgtaagccggcatccatcacggctgaaactctggacggttgtttttggaggagcactggtcatgcttcttgagctctacgacttccctccatacatggggtttgccgatgcccattcactgtggcatgcaagcaccattccactcacctatctctggtggagcttcatcaaggacgatgccaaattccgcacgtcaacactcagcaagaaggcaaagtagttaagcaaagcgcgacattcttagcatagggtcagagaggatcagattccgattccgtggtctgcacgggggacattttgggggcacacgtgttgtcggacatcatggaacctcggtacatttgccctccccaaaaaagacattcatcttcatccactcaggtttttggcccacaaaagtcaacatactctttagggcgcatgttctgcccttacgaattatctctttactgacctgaacgtgcatcctgtgattgaatcggcatcttatcattgtagtgttggtggggtttgggagattttgtcatcgccgaatcagttttgtgaaatcagacagaacaatgaacatcagtggtgtgtttcctaaaaaaagaaaaaaattgtaaactcctgaaagcccatttggggcgagttctccaacgttacgaaaattcctgaac

SEQ ID NO: 7469 - DNA, 1212 bp, Zea mays
gaatgggtttccagctacttctattcatggagatagaaaccagcaggaaagagaatatgctctgaggtccttcaagagtgggcaaactcctattttagttgcaactgatgtggcagctcggggcctcgacattcctcatgttgctcatgttgtcaactttgatctccccaatgatattgatgactacgtacacaggattggaagaactggaagagctgggaagagcggacttgccactgccttcttcaatgataataactcatcactggcaagatctcttgctgacctaatgcaagaatctaaccaagaggtacctgcatggctattgcgctatgcagctcgtccttcttatggtggtggtggtggtgggaggaaccggcgatcagggggagggagccgctttggtggccgtgacttccgcaatgattcttcgtcatttggcaaggggggatcccgtggtggtggtgactactatggtggaggcagcagtggtggttatggtggtggctcctcatatggtggtggcggacacggtggagctggggctccgagtgcctgggattgatgttacagttgctcccaagtagaggggtctgccaagtttaggtcactttttactctagttctatttaggtatacatttttggtaggagctgttatacagcaacaagtacaaggtgaatgtggtcatcccctttcttcttctggttgctactggctgcagtcttaatcttgcagatgttcattacgaagagggtcttgaggacattcaagcacacgagattcctagttaggtgaaattccttggtagggatagtagctaggctctgacaagtagtgcttggtgcgtaatttctgcctttgctctttttccctttgtcagcgtcgaattttggtggtcggttgtaaagcttgtgttgagggggcttttgcggcttgatttttgtcctggattcgagttttgacaccggaggttgaagaagcggtaggatgatggtagtcctttagatcctgttgtaatgtatttaactgtgaggtgaggctggacacaataaattctgtaggcgtgtttagaggaagaagggggaagttgtgtgtgatggtttcttcagagaagattcctgctactgtgtacttcgaatctgtttttggatggagttaaattgacattatcgatgtcgtcccaaaaaaaaaaaaaaaaaaggggcggcc

SEQ ID NO: 7470 - DNA, 1170 bp, Zea mays
  misc_feature (1)..(1): n is a, c, g, or t
  misc_feature (10)..(10): n is a, c, g, or t
  misc_feature (71)..(71): n is a, c, g, or t
  misc_feature (81)..(82): n is a, c, g, or t
  misc_feature (135)..(136): n is a, c, g, or t
  misc_feature (153)..(153): n is a, c, g, or t
  misc_feature (162)..(162): n is a, c, g, or t
  misc_feature (168)..(169): n is a, c, g, or t
  misc_feature (212)..(213): n is a, c, g, or t
  misc_feature (235)..(235): n is a, c, g, or t
naaaaaaagnatgaagccatatatatacccaaataacaggagagaaccttaacatgcttatggaggcacanttgtaccatnnactgaatttattgtctcatataagggatcttgcagccattaacccacatgttnntatttttcaaacatagnaaaactagngattgnnatagcaagcgttaaaaacaattgcattgtgcattattcccctnngactgtcatgcgagtatggtgnctggaccaaccactaaaatgaaggggaaaggttatgtgcaaacaaaatgaacaggggaaaacatgaggagggaacatgggatgagccctggttgcagtgaaaagcaaagcaggctaccatggtagaaaaagtgaacagacaatgcagcctttggtatattcagaaataataaaattcactctttcattagtagaaaaaccagacatggccaacataatcaatacagtcaagtcccaggttgaaatcttccttttcttaagaatcagtgaggttttagggtaatctcagtgagccatacgccatgttttcttatgatgattttgcatgtcgaaaacacaaaacaatttgaagttgtgtaatcttcacatgactaggtcgatatttatccccaaactggtacctattacgttggttaaagtttggttatgcttggatttaaaataacacgatgagatctgctcttgtagataggctacgatttgttactgacacattttttgctactggcttctaggaaacagcccacaagattggtgtggtgatagccaaatcttcaggcggtttcaaaccatggctgcgtaaaaagctattgttgattctgctagagagcaatacttgagttctgaattagtccaaatgcctgttcgtatatatctccaggatcacatgtaatcttctcctttttttcctttttcttttcctccatacgtcgagcaagattgtttttgtagttaatattcgtcttgttgtgaagggtgcggacgtggcaagactctttgatcttgtgttctgatgcttcgctacttgatacttactcatctctctcgtcatctatactttatggtgcacatcatcatcatatgttcatgtatgagagaataatacctttttgatgtggattctgattcctgagtacatacgagagttggaaacct

SEQ ID NO: 7471 - DNA, 1784 bp, Zea mays
ccggggcagattcatgaagaggcgaggaagttttcgtatcagactggtgttagggtagttgtcgcttatggaggagcgccaattactcagcagttaagagagcttgagagaggtgttgacattcttgtggctcacctggccgattggttgatttattggaaagggcaagagtatctttacagtcaattagataccgtgcgcttgcggcgccacatagaatgcttgatatgggttttgaaccacaagttagaagaattgttgagcaaatggacatgccacttccaggtgccaggcagacaatgctgtttagtgcgacgttcccaaaagagatccagaaaatggcatcggatttcctggataactacatcttcctggctgttggaagagttgggtcaagtactgatttgattgcccagcgagttgagtttgtgcaggaggcagataaaagaagccacctgatggatcttcttcatgcacaaagagatacaggaaagcaaactctcacgcttgtctttgtggaaaccaagaggggcgctgattcattggaaagctggttgtgcatgaatgggtttccagctacttctattcatggagatagaaaccagcaggaaagagaatatgctctgaggtccttcaagagtgggcaaactcctattttagttgcaactgatgtggcagctcggggcctcgacattcctcatgttgctcatgttgtcaactttgatctccccaatgatattgatgactacgtacacaggattggaagaactggaagagctgggaagagcggacttgccactgccttcttcaatgataataactcatcactggcaagatctcttgctgacctaatgcaagaatctaaccaagaggtacctgcatggctattgcgctatgcagctcgtccttcttatggtggtggtggtggtgggaggaaccggcgatcagggggagggagccgctttggtggccgtgacttccgcaatgattcttcgtcatttggcaaggggggatcccgtggtggtggtgactactatggtggaggcagcagtggtggttatggtggtggctcctcatatggtggtggcggacacggtggagctggggctccgagtgcctgggattgatgttacagttgctcccaagtagaggggtctgccaagtttaggtcactttttactctagttctatttaggtatacatttttggtaggagctgttatacagcaacaagtacaaggtgaatgtggtcatcccctttcttcttctggttgctactggctgcagtcttaatcttgcagatgttcattacgaagagggtcttgaggacattcaagcacacgagattcctagttaggtgaaattccttggtagggatagtagctaggctctgacaagtagtgcttggtgccctttgctctttttccctttgtcagcgtcgaattttggtggtcggttgtaaagcttgtgttgagggggcttttgcggcttgatttttgtcctggattcgagttttgacaccggaggttgaagaagcggtaggatgatggtagtcctttagatcctgttgtaatgtatttaactgtgaggtgaggctggacacaataaattctgtaggcgtgtttagaggaagaagggggaagttgtgtgtgatggtttcttcagagaagattcctgctactgtgtacttcgaatctgtttttggatggagttaaattgacattatcgatgtcgtccaaaaaaaaaaaaaaaacaaaagcccggctagagggggggcccggtacc

SEQ ID NO: 7472 - DNA, 1458 bp, Zea mays
gggtacctcgagccttggggacctcggagccggccgggccggggttgttcttcttcctaaataataaattctagggtttgcctcttccctctcggctctcgctcccaccaccaccaccaggcagacgcagatcggcggcgggataggctagcaatgatccccaattccgacttcctctagactgcctggcggtcgaattccgattcgattggagtagggaacgagaagggaacaaatacaccggcaccaccaccagaccagacagcacgtgcctccatactatggtttacgccccgtgccgctcatcgacgccgccgtcttcctcgccgatgctccacaagaacctccgcgccctcggacccggcttgaatcccttggctcccttcggcatgggcaactactcccgctagccgtttcctcctatccctctttctccgattccgatctctgagtgcttccgcctccgcccccggccgcttcctccatcggaaccgatccccgctattttactcccgttcgtttcattgttccgttgctttggatctgagtctcgagatcctcccctgtcctgctgctcgaggagccgccaaggataccaaaataccatggtgcaggtgcgcaggtcgctcagcatgagccgccttcggagctgccacgacgcggacgaccgtggctggaacccgctccatgttgctgctcgcaagggagacctcaaggaggtccgacgtctcctggatgagggggggatggatgtgaatgcacctgcatggggaccaaaatgtcctggtgctaccccactccatctggctgctcagggtgggcatgttaaaatcatggatgaactactggagcgtggtgccaatattgatgctcgaacaaaaggggcatgcggctggactcctctacacattgctgccaaggaaaggaacaagaaggctgtgagattcctgattgagaatggagcattccttcctcctgagatgaatgaccataggttcaatccccccctccattactgctctgggttagaatgggcgtatgagatgaagcgcatgcaggatgaaagcgattcgcctggcgaaacttcgttgagctcggataactagagagaaagcagcaggtgcatgcagcttgagaacgatgaagttaagtcaagtcattgagtacatttgcttgatgtctggatgatggagatgttctgttctgtgactttagaataattgttgagtggtacctgtaatatacgacgagtgatttgttgaataataatcatacactagtgtatagcgcgcacatgcgcgcatgccgttctgtggtgtaaaatcttgttataagcatgtataacttgatattgtatcgtgaacatgcatatatgcagagtagtcattattgagacaaaaaaaaaaaaaaagaaaaagcggccaaagaatgaaaattaaaaaaaaaaaataaaatcca

SEQ ID NO: 7473 - DNA, 1487 bp, Zea mays
aaatgcttcgaaaattgtgtcatcccacaccgtgttcacctcctcacacggtctagagtcaagtcaactcactctcctagtcttcgatccagatcccatcgggttggactgtgtacactcttaaaacttcatcagctcccgagcaatctcagcccgtacatcaggttcttggatctctcccgagctgggatccgtcaagttttctgctccagcggcgacaattcgtcaggaatggccaacaagccgagtcttctgagcactctgccgactaacccaccagcacagtttctgaaagatatcacggacggcttctctgaaactcaaatgcttggtgaaggtgcatttggaactgtttacaagggcattctgcaagatgggcagccaattgcggtgaagaagcttgcagagaatgcgccggtggcacctgagaagcagttcaagattggggttgggaaccttatggccatgcagcatccgaatatagtcaggatactcggctactgccgtgaaccgcaaaggaaagtgattgagcagagtggaagatacattattgtagacgtggttgagagcttactgtactatgaatacgttcctaatggaaaccttgaaaagtatatttccgatgcatcagcttctagacctgattggaagacatgcttcgagataatcaagggcatctgccagggcttacgttacctacataaggaaatggataggccaattgttcatttggatcttcatcctaccaacatattgttggatgagaacatggtgccgaaaatcacggatttcggcctgtccagactctttggtgaagaacaaaccagaataaacacaattaatgttgtgggaaagaaagggtacatggctccagaatatctatataggggtgaaatttcaacccggtcagatatatatagcttaggtctagtaatcatggagattataacaggcaagaacagttcttcaagcgacaaagatatgtctgcaagggactttgtagataaggtgcgtgagacgtggacagatgagcacatagcatccaagcactcagcactagatgcagtcagcctccaggaagtaagaacatgcattgaaattgggctaaaatgtgtggatattgatcagaacaagagaccttctatagttgaaattgttgacaagctcaatggaaggcatgctcactgaatgatgaactcctgcatactatacatgcaagtgaaaattatgttgcggacccatggagatttgctctagatggaatcatggacaaaataattgtatgtgttaccgattatgtacttttgaataatgtgttcctcgtgttgtgtcactttttcaggagttccttgatttgtcattgtgtttttctttcttttgacacaaatctgcatgcataacctgttgaaaaattgtgtgcatactagttatttgttttttctcatgttatgtgaatactatttttttacctaaaaaaaaaaaaaaaa

SEQ ID NO: 7474 - DNA, 2792 bp, Zea mays
ttaaccataaaaatcttctgatttctaaaaaaatcaacgcctcgcctaacacctagtattttgtctaggcatggtgcctacgtgctaagcagtgctacactgcctcgcctagcacctgagcattttgtctaggccttttccacatagacatgttttgggcttgatgtatgcatgaaaatggggcaaattgagatggaaggagtttttcccctcaaacacgcatgagtgtatagttatattaagaagaaaaaagggtataaagaaacctttacaacacatatccacacactcctaaggagcgcggtgagaaatacctctatttggaaaaaatgaactatggtgatattaatcatatactggtaacaacattttttttgttttgatatgctaaatttccttaatttagcatgtaatgaatctgactgtccataaaatgtataaattataaacgtttagcaattcctgggtgctagccagatcccgtctgcctgcctagggcctataacacttttttaaacactgagctgaacacttgtttgcgtttgacctgtgtcaatatcctgctttcatgcatatttacctatttttatgcatttttttggaatatacgactatcttcccttctattgctttagagttttatattggccaccaactcagttcattcctttttgttgtgttttttgtgtgtagattttcatatcctgctttgtaaagacatcacattttgaggagtatctcaatgtccaggtaatgtgcctttacattgatagatatttgttgtgcaagaaagccttggaacatattatgctggcattcgcctatggtgtctgctgaaaatatatggtctgtcactttggaccctagttttctagcttgtgttcttcaaataaattactcaggtcagtaggagtgcttatagagtagagcattttgacactttcacccattggatttcactatgtccagaactatgagtatttcagtttagagtttccttccattatggtgttactgttctgagcagttgccaggatgattgaaaaaaaagcaaattaaatctagccattcaaccgtacataattcctttcaaagaaaagaaaattttaaataaatgggcatagaactgtatgactactttagcatgtcccaaactcctaatatttgaatcttcgccccagtacatgtagttttacttgacgtctgccatcgaaccttcattatgtaacaagggtttctgaactaatctggttgcttttgacctgttgtgcattaatagcttgggacttgcatggtaaaactattcaaattttcattggaaaagcttagggtgccattttggcatgacatccatttaaatcgaagaattccagcttgattttaggctgcattttatataaactaggaagcatcacaccatgctaaaaaataattaacatgggttttctgtgttccaaattacacaggaagctgttatgttggaccttcttagaatagttgggcatcacaaagcaaggcttgctacccaaattcgaacagttcagaaatcatatggcaatgcagacttcgataacattccctttggggagggacatgtatagtcgagtccgtggccggccacttctgattgatacatctgcaaggatcagtgatgacaaacccaggcctcgacctgtatcatcacgtgaggagcagaaagtcaagacaaatggctcggtagatattaagtccagttcccctgaaaatgctagttcaagcaactctgaaaagcaggaaccgaaaaaaatggtgcctgaagatactcgggtgaagaacattaagggtgataatgtgatgccagtaacaccatctttagatcctgctacgtcaacttccaaggctggtaaagggaagacacgggaaccagagcccactgagcggcaaggagatgggtcagtctcggtggctaatccaaagaaagaatctagaccagtttttgaagataacattgttctgggcgtagcccttgagggttccaggaggacactgcctattgaagaaggaaatcctcatctatcactatctgagactgaggtggacaccgaagaggcggcttcatcaccgaaggataagataggccaaagcccaaaactttgaggtccagaaaaaaagccgttcagaggaatctcgataggtcatccgagttcaaactgtatccttgtgaagatttgtcaccaagcctaccttttttgtgcgcttgtgcaaatacaatgccaccacacatcagtgttgtatgcttaaggggtaaattcacactgacgattattcagggaacattacctgtcagtcgtattgctacaggcttgtaaagaagcaagtgcttcaataggcattttgtaaagattatattattgctcatttaagtggcttcttgcatatgcatcggcaattcagcatgcgccgttgcaactgtcaaaaaaaaaaaaaaaattggcttacgttagttttgtttccaatgccatctgctgcgagctgaaatatcatcgtctcttttcctttttttttttttacaaaagacacgctaagtcgtggagacggtgaattcttccggatggcgtctcatcttgcagacgactaaaacggaataccgcgattatcgaaaaggaaacggaataccgcgcggcgctgaatgtacctatcgttgcgatgagaataacatcaataaaaatgacgcaaaagcttataggtgagacgctcgtaggttttcatttatgcttaaatatagagtataaaatataaaggtacatacaaaa

SEQ ID NO: 7475 - DNA, 7058 bp, Zea mays
  misc_feature (6722)..(6722): n is a, c, g, or t
tcccactgcaaaactaaatgattttgttgttttatgcagataatgggctatgttaaatgtgtggttaagtttctgaaagacaagcagcttctccagccaccaattattgcatctgtatgtattgctgctgtagtgttctactagcattttttaaaccaatttctttgagtaattatttatatactaactctacgtctttttttcttttggccattgtttaacacaggcttttgcaattgcaatcggtgttatcccattcttgaagaattttgtacttacggatgatgctcctctgttctttttcacagacagctgcctcattcttgggtatctacatgtttcatttctattttgtttttgcgaaaacatctctcttgcccataaagttatcaaactgagatgaatgtatctatcacctaattctgtggcatacttttcagagaagctatgatcccatgcattttacttgctgttgggggcaatcttgtcgatggtaagtagctattttagttaaaactttggagaattgcatggggtgcgataatccttagaatgaccatctttattggtttagagatatttctaatgtttttgcctttacccatgtttttttatggaatcaggccctggtgaaggaagtaagaggcttggcgtgcgtaccactgttgctataatttttgcacggttggtcttggtccctcttgctggggttggcattaccatgttagttgataaacttggtttcattcccgaaggtgatagaatgttcaagtttgtcctgctactgcagcattctatgcccacatcagtgttgtcaggtatgtgaagccaacaagggatgtatcttatcagctatcacttgtcttcatgtgctcatgcgtacagattcttgttaacaattttgtgtgttgagatctgtaaggaaaccacattatggactctgacgataggattgtttgttgcaggtgctgttgcaaatctgagaggttgtggaaaagaatcagctgcaattttgttctgggttcacatttttgctgtgttctccatggcgggatggattatattctatctgagtttgctcttctaagtatgtcacgccctgctaccacaacaatctgcaatttgtgcccgcattccagcctgtcagatgtaactgcattttcttgctagataatgttacttgatctgatttcagtccgctggttcagatgccttactgcgcaggaatatctttgagatcaaatatggtccaaaatgttgaggaagaaaccagtatcatgaactgtacagatatatcgttgcagaggtacaagtgtatctgtacagatatatggatacggtccctcctataatcccatattaccgtggtctcctgctgctacaagccgtgagcgatgggaacactttccctttccctccacgtatcaacaggttcacacccaaccctagattgggatgctggccttcttagttctccataatattatttcatttgtacttcctgtatattgtaaaccttgagatggctgtgttcaaatagtttcttattgggcgagggctgaagtagtagtatagatgtattatactacctatttgagtgttcggttatgccgcaaatgatgctttattatgcagaacttgtgcccgctgctggcccgtcggtcgtactaactaaaattgccaatcgcggagacttgcatgttgcaagctcaggccggcgcccagcggtttgcagcaaatttttttttttgactcggctatctccaatagaatactcaactcaatatttatatttaaactctactctatctacagtagtatcatgcatatcagcatatatattggcatatgtattgttcgcgggagataaccttagacactgtttgtttaccctttagcctatataatttaacttaaataagttgagaggtaaacaaacaacaaagattattaaatggattatatagattatgataatccataagcgagttaataggtatttatataatttataaatgcttgttcgttttgatctcaatctatatgtattaggtgggattgagtgggtttcgaatccaaacaaaatcaaaaacttaaaattttctagtgccatctaatctatataatagaaataatcgaataaagtctaagctagattatataatcctggaagaggacacaaaaatgctgcctccaggccccgaatgcacatcttccttaagacaatattcgaatttttttagtcatctccaaatatgtttactataaaaccatattcaactattaatttaacgacgtttaggctatcctcatcggcgagggtctttcacactattttttttaaatttaaatctcactttatagtacatcttgctgaaatactctcaaattctactcagtctatggtgtatatggtgtcgaaacagttttgcacgctcactggtgggaacaaccttgccactccctttgtctaaaaatagttgtcactatgttatgttatttggggtggctaaagtttttaaagtttgactagatttataaaaaagtattaatatcatttatatctctaaatatgtttattatgaaatatattcaaagatccatctagtgatactaattatatactataaatattaacatttcacatatatttgattaaagttaaaaatggacgtctcttagaaaagtgttttctatcaaagttaaaaatagtccttaaaaagcgagagcgtcaactattttgagatggagaaagtacacattataaatattagttttttatatatctagttaaatgtttaaaatttagattcacaaaaaaaatgagaggcacattgtttgtaaggtactctatctccaaagtaatggagatcaaatattttgagtcatgaaaaacaagatattgttttcatatgtttgattaaaattcaacatagtagacttctaaaaaagttagattgtcaactattttaagacagaaaaagtgtacatcataaatattgggtttttgtgtccagttaagttttagaatttttgactcaccaaaaaagaagaggtacattatttggacggtacttcatctccaaggttatacagatctggtctctgatgtggtcgttctagatgtctgatgtctccatgtgcttatagatctgatgtctccatgtgcttatagatctgagcacctgcaggtctgaacaatacagataagcttcaccctatgatgagacgtttgaaggaaagaattcataattaagaaattaatataattcgtcgttttttattttctgttatttaaacgaataattcgtcaagtgtgttaaaaaacaaagatttgtgaagtttgttcggcttccctttcaacatcctggaagaagtgcccccctgtatggtgaaattatgtcattttataatctaatattatacgaagagcggagacaatcaataaaaaaatcttaaaagttttttggtagatagtttatatggatattattgtaagccgtcacaatgcacgagcaacccactaatttattatctattttaggctagatgttcaatggatacaagctattttatgtctgaaacaaattttttatagattctgaacctctgatacattattttagtctgtatctttgtaccttaacatgcatcaaagtcttcccagacgcggcggatgctcgccccaccttccctaatgcattcgccattcggcattcgcaaaaaaaaaatgggaatttggtcacacgattcggacgtctgtgcagcgcgacgaagggcttccaagcgtgtacatttgcaatggccaatgaccaatcgaagaatcacacaccctttttcagctatgcttttccctctcctagtgccgcagatttggaatcaatttcatggccagaagttaacagcaaagctaacacggaaaacaaagcgtggtaaagcagcacctatgaggcaacgaatctcacaccatcgttttcaccggcccacttcgccgtccggctgacctgctcacctttcctcttcatgcaaatggcgaaaacgtcggtggagttctgtgtgatctctgcccgcggcctgggccgcggatcgtcgctgctcaagccgcagtggttctccgtcgcatgggtcgatcccaacagcaagtactgcaccaaggtggatgcgtcagggagctccgacccaagctggggcatgaagttctcggtctcggttgacgagcatggtctgagcaacctgcagcagatggtgctgacggtggaagtgtacaggagagagcccatcttcctcagggagcacctccagggagctgctgttgtccagatgaaggagtatttcgacaaatttcagcacggcggggagcaacctggagtcgttgaggagactgcaagcttccagctaaggaggaagaagtcagacaaagctcatgggtttgtcgacatatccatttgtatctacaaggagaaagatgttcatactcagttttcaggtaaacagaaacttatatattttttctttcaagataatacaatataggtaagtttgcacagacaggaattcagtacaacacttgaaaagatagatcttactaggtaaatctgcacaaaaacaatacaaagctatgtttaaccaattgagcaagtgatttggaatggccttaacaaagattgaccttattgattataacacaatcagtatatgactgaattcatcttatctgcctctgttgtgaatgtgcaggatcacacgatggaccaaagcacccaaaccaggtcggtatcacactagctatagaagatggtccggtttataactatccaccattgtcctcaagccattatagggatcacagcaaaggtgatggtcgctacagcaacaccatgccaaaaagccctaccactcggccagatccatcaccatcaggaagtaatggatatagctatcaacccccactcatcccacaaaccctgccacctcccacttcaaaccccagttacttttccccaccgtatcctacgagagggcaagtgccacagagctacataaatatgccaccaagaaggtttgcaggtcagaacggttcatctaaccttggaatggggctcggagctggagcactggccgcaggaactctgatatttggcgaaaatttgttgccaggaccaaattttattgctggtcatgatggtgtgagcttaactttatcttcagatgcaccattctaacttatgggctactgccaatccatgtgcttgtgtaaccaattgtgtagcacaatttgaaaacttatgagaattctgccagatacattggatttaaattgctcagatggctgcatcccttcatccaacctattaacgtgtgcatcatttcataaatcatgtcagcctcagggtgtccccatccccattaacaaaagtatgcataattgtttcacttccattattctctcatccgacctcgacccagctgcaaccaactgccttctgcaccccttggcgtttcatctcctctctcacctcttcgagttcctcaaagtttccatccgaaccataagtgttggcgagcagaacccatcccccgctccctgattcctctgccatcatcaacatcctagctgcttgttgtgctctctccttatcaccatgcatccggcacgccgcaaggtatgtcctccatgcaccagcaccaacatcaccagcctcttctattacctttcttgcttcatccaacctccctgctcgtccaagcatgtcggtgacacaagcatagtgctctagctgtggctccaatccaaactcctctttcatcctctttagaaaacccttcccttcctcgacaagcccagagtggctacaagctgacaatgctcccagcagcgttatctcatctggaaccaggccttcttctatcatctggtggaacaacatcagtgcctcccggccacgcccatgcgacgcatacccatcgatcataatgttccatgatgccacatcccgtaggcgtgtccaatcaaacacacaacgagcctcatccagcccaccgctcttcgtgtacatgtccgccagcgcattgcaagcaaacacgtccagtgctccatcacaggccagtccactcgttacgatgtatccatgcaccaccctcccaaccttcagggctgcagtctgtgcacatgcggggagaacagcggcaacagtcactgaatcaggcaaaagtgtggtacgtctcatccttgcaaagagacacatcgtccccgcgtgatcagccgagtactgatgtgctgacagcatggagttccagctgaacagatccttatcagtatctggcagcccctcaaacaccatggttgcatcgtgcacctggtggcacttcccgtaaagatctatcaatgcattgcacacagatgcctccttgtcaaaccctgacctcaccgacaacccatgtactgcagccccgctccccaaatcggctgttgctgtacacacggacaagattccggtgactgtgaagctgctgatctccacctcgccctcctccctcatctttctgaagcactccgtagcgcggtcaaagcaaccgagtttgacgaacccattgaccatggagttccacacgacgacatcccggtgcctcaattcgtcgaacaggcggtgcgcgtggtcggcgaggccgaacctcaggcacccgcggagcagagcgctggcacagaacaggtcgtgtgcgangccgaagcggagggcgagggcatggagcgcgagcaggtgcggcgagctgggggccgaggagaagaggggagggaaggagaaggcgtcgggggagtgcgcgacgaggaggcggcggaagagcgggagcgcgaacgcgtgcggcagggagagcgcggcgttgaagcaggggagcggaggcggcgcggaggcggggaggagaagcgggatggaggagttcagcgcggccgggccgcgagcgtagagggaaacgagggacgtgattgcggcgggggacgcggcgaggcggcccgacacgacgagatgcgcgtggagcgggaggaggaggcccgcggacgg

SEQ ID NO: 7476 - DNA, 1128 bp, Zea mays
cctcgaggccggccgggccgggtactttgttatctgctggggaagtcaaaaggagcgtgccacttctgtaggaacaaagataatgggctatgttaaatgtgtggttaagtttctgaaagacaagcagcttctccagccaccaattattgcatctgcttttgcaattgcaatcggtgttatcccattcttgaagaattttgtacttacggatgatgctcctctgttctttttcacagacagctgcctcattcttggagaagctatgatcccatgcattttacttgctgttgggggcaatcttgtcgatggccctggtgaaggaagtaagaggcttggcgtgcgtaccactgttgctataatttttgcacggttggtcttggtccctcttgctggggttggcattaccatgttagttgataaacttggtttcattcccgaaggtgatagaatgttcaagtttgtcctgctactgcagcattctatgcccacatcagtgttgtcaggtgctgttgcaaatctgagaggttgtggaaaagaatcagctgcaattttgttctgggttcacatttttgctgtgttctccatggcgggatggattatattctatctgagtttgctcttctaagtatgtcacgccctgctaccacaacaatctgcaatttgtgcccgcattccagcctgtcagatgtaactgcattttcttgctagataatgttacttgatctgatttcagtccgctggttcagatgccttactgcgcaggaatatctttgagatcaaatatggtccaaaacgttgaggaagaaaccagtatcatgaactgtacagatatatcgttgcagaggtacaagtgtatctgtacagatatatggatacggtccctcctataatcccatattaccgtggtctcctgctgctacaagccgtgagcgatgggaacactttccctttccctccacgtatcaacaggttcacacccaaccctagattgggatgctggccttcttagttctccataatattatttcatttgtacttcctgtatattgtaaaccttgagatggctgtgttcaaatagtttcttattgggcgagggctgaagtagtagtatagatgtattatactgtt

SEQ ID NO: 7477 - DNA, 2322 bp, Zea mays
ccaaccgagcaattgttagtcacactcaaacggtcaaaccttctcagcaaccgcttcttctttcttctccttctgagcaattgtttcttctttcttctcctcgccggcggccggtagggtggaagcagcccgctggggcacggcctcttccttaatctctccatcggtcgctggatcccctcccttggctttcgcagtctcagcagcagcggcggcggcctcggcctcggcacgctcgttgacggcctcctcggccatgagcacgggcgcgtagtagtcggcgtgcgcgtccatgcacttcttgaggttggcagtggcctcgtggcaacgctcgaccatgtcggcgccttccttctgtgccgcctccacgcactcctcccatgccacgaaggtgtctctgcagccgccggccttcatgaagaggcagaacccgcactctccttcctcctcaacttcctcactctcccccttcgctgctggggcaggctcttgcggctgcggcggcccttcttgctccgccgcggacgagtgcgccgtggtgggtgtgggagtggtgggggtctcttgcgcgaggctgggatccacggcgggctcgggggacgccattgccgtctgtgcgaggtgaggtcgctcggaaggtagtatggggggagatgggatgcggcgcttggtggcggcggtacaggtacttcttggggaggaagaagaaatcccgccgccggccgaggagcacgtcaacctggtgttggtctggtctccaaaaggggttgacccctcgtgggccgtgggttcgtgtacgagtagtatggcttgaggctcataaaatcatagaccggttactcggcccagacccaatgccacacgattaatgaagcaacgcatataagccatcgattcggcccagcggccccatccggtagcggataagaagaggacaacttatttatcgacggcctcgggccccgctgccaccgccactggacgtgcgctccctccacgctccggcccttctcgcctctccggccatggccaccgccgccgccgccgtcacggccaccttccgcaccctgatccagcacgcagcggcttgtggcgcccccgtcccgctccccagcgtccggttccagagcctgcagcgccaccgcgtcggcctccgccgcttcgcgccaccgcgtgggcgccccgtcctacccccgcccttcgccgccgaggacttctcttcctacgtagatgatttctccggggacgacggcgaggagcacttcgatgaggaagagggctctgagccggaggaggaagccgaggccccgcgcgcgtactcgtcgccacgaagccgcccgccgcgcggcgacgaccccggccgtctcttcgtcggcaaccttccctacacctatacctccgaggagctcgcccaggtgttctctgaggccggcagggtcgacgacgcgcagataatctacgacaaggtcaccaacaggagccggggcttcgccttcgtcaccatggccaccgccgaggaggccgccaaggccatccagatgttcgatggcgccctgctgggagggaggacggctagggtgaactacccggaggtgccgcgtggcggggagaggagaacagtcaccatgagtggccgcaggcgtgacgatggcacttacaagatttatgccggcaacctggggtggggggtgcgtgccgacacgttgaggaacgtgttcgagggtagggccggcttgctcgacgccagggtcatctttgagcgtgagactggtcgctccagagggtttgggttcgtctccttcagcaccgcagaggatgcacaggctgcattggagtctttggatggagtggaactggaagggaggccgcttcgtcttagtctggcagaacagaacccgccacctggttccccgcctagcactgcgcaggcacagcaggaagaaacggattcaggcgcacctgctggtgggggtacggaggcagccagttcttcagaaccatctgaagcagaggtgggcgagagcaacttgcaaacagctgcaaattattgataagcaggagccacagggttataaatgtgttgcaacgacctctaaatcctgccattcgagtccaaggtgtgctgatagggaagtaaattttgacacgagtgatgctgtagcgaggattcagcatttgagctatacatatacactagaatggattaagtgttgttaggaatgtatttgtgtaatgaattctgcaaagtatgatctcaactgcagttgtgtagcctttctcttactgtaaactgattccttttcaatgttctgtttttcgttc

SEQ ID NO: 7478 - DNA, 1818 bp, Zea mays
ttttttttttttttttattttttttttttttttttttttttttttttttaaatgaacatctgaatctgatcatgggtgttggcaagttgtccgtctgtgattaacaacaaatacagaacatcaagtactatatatccatgatttattcgcacatacatgttttgcaacactcatcagtcatgcaaacgggagaaccaagagtgttttattcagtagcgagcttgaatctgaacattcacacggtcagactccacgcctgctccttctcttgagaaaccttgccgggctgaaaggctcgagatcaacgatcttggacttgccgtccaggatgagctcggcgagggctgcgccggtggccggaccattgaggataccccagcagctgtggcccgtggccacatagcaccccttcacgcctggtatctccccgatgaccggcagcccgtcggcggtgcacggcaggtagcacgcctgctccgcgaccacctcagcgccctcctccttcttcagctggctggacactttgcctgcgatcttatgcagcattgcaatcgagtctggctcgcctactatcgttgctgggtcatctggcgggttctcgtccttgctcatcccacatatgtacacctccccggtggccatacgagcgaatcgggcaattgaatcttagtagttctgctgcaagacgagaatctgagcaggtacgtggcaaagggggcaatggcgtaccggtgggccgcgggtacacctcggggtcgagcatcttggcgccgggctccggctggtagctgaggaagaggcagtgcggcgtgaccttctcgggctcgcgcggccggagcacgatgctgtgcgccttgagcccggacacgtcgaacacctcgctgaccacctcgaggcggccggaccacgggccgagcgcgagcacgacggcgtcggcgtccagcacgccgtcgcgccccttgaccacgacgccggcgacgcggccgtcccgggccacgacgacgcgctccacctcgccgatgacgacctcggctcccgacgcggcgaggacggccttggtgaagaggcccgggtggacctgcgcggtggtgtcgggggtcccgagctccctcggcggggcggcggacgcggaggggtcgacccagggcgggagcagcgggtgctgcggcgaggaggaggaggcggcggggtgcggggggagcaggatggagagggtgtggacggggcggaagccgtaggcgtcggcgccgccgagggcgtcggccaggcggcggtggagcgcgaaggaggcccgcgcgagcctggacagcgccggggtggagtcgcaccagtccagcgccaggaagccgccggctttccccgaggcggcgcacgccggggcgcacctctcgacgagcgtcgggacggtgggggacgcggcgtgggtggcgaggaagtaggccgtgcacgcgcccaccacgccgccgccgcagatgaccacgcggcggggcggggcggcggacatgggcggcggcagcggcagcgccagcgtcaggctaagggatgcggggcggcggcacgggtggggctcaagtgtgtgtggatcccaggtgtgtgtggatgcagaggaagagttgtgattgtgcacgctgtttgatagaatgtcacagaggaatacgacaaatgaaactcacgcgatgtgttgttgctagctttttggcttcttcttaaaaaaaattattcactcactgtctagatttctttaaaatagtatttaaacattttgtttcatcagtacgtattatagtctaattttatctattctcatttttctttaat

SEQ ID NO: 7479 - DNA, 4481 bp, Zea mays
  misc_feature (3571)..(3571): n is a, c, g, or t
agtttgagcgaaaggagcagcacattttttttttttttttgaccaaaatcacataacagtatcaaaattttctagtataaattgagcgtgacacccaacaattacgagcagaacagcattattaccccacccccacaaagggaaccaaaattaacctcacgaactaatatgaacctaataaccaaccgagcaattgttagttacactcaaacggtcaaaccttctcagaaaccgcttcttctttcttctccttctgagcaattgtttcttctttcttctcctcgccggcggccggctggggcacggcctcttccttaatctctccttcggtcgctggctcccatcccttggccttcgcagtctcagcagcagctgcagctgcagctgcagcggcctcggcctcggcgcgctcgttgacggcctcctcggccatgagcacgggcgcgtagtagtcggcgtgcgcgtccatgcacttcttgaggttggcagtggcctcgtggcaacgctcgaccatgtcggcgccttcctgctgtgccgcctccacgcactcctcccatgccacgaaggtgtctctgcaggccggccttcatgaagaggcagaacccgcactctccttcctcctcaacttcctcactctcccccttcgctgctggggcaggctctcgcggctgcggcggcccttcttgctccgccgcggacgagtgcgccgtggtgggtgtgggagtggtgggggtctcttgcgcgaggctgggatccacggcgggctcgggggacgccattgccgtctgtgcgaggtgaggtcgctcggaaggtagtatggggggagatgggatgcggcgcttggtggcggcggtacaggtacttcttggggaggaagaagaaatcccgccgccggccgaggagcacgtcaacctggtgttggtctggtctccaaaaggggttgacccctcgtgggccgtgggttcgtgtacgagtagtatggcttgaggctcataaaatcatagaccggttactcggcccatacccaatgccacacgattaatgaagcaacgcatataagcccatcgattcggcccagcggccccatccggtagcggataagaagaggacaacttatttatcgacggcgagaggctgcactgccaccgccactggacgtgcgctccctccacgctccggcccttctcgcctctccggccatggccaccgccgccgccgccgtcacggccaccttccgcaccctgatccagcacgcagcggcttgtggcgcccccgtcccgctccccagcgtccggttccagagcctgcagcgccaccgcgtcggcctccgccgcttcgcgccaccgcgtgggcgccccgtcctacccccgcccttcgccgccgaggacttctcttcctacgtagatgatttctccggggacgacggcgaggagcacttcgatgaggaagagggctctgagccggaggaggaagccgaggccccgcgcgcgtactcgtcgccacgaagccgcccgccgcgcggcgacgaccccggccgtctcttcgtcggcaaccttccctacacctatacctccgaggagctcgcccaggtgttctctgaggccggcagggtcgacgacgcgcaggtacccgtacgccgtatggaccccaatcaaaatcccttcttggtctgcctcctggaaggattgctgagcagtaatcatcattcatggctgacgtttccaattgctgaagataatctacgacaaggtcaccaacaggagccggggcttcgccttcgtcaccatggccaccgccgaggaggccgccaaggccatccagatgttcgatggcgccgtaagtaccgcaccggccaattggatcagcacttccacacctcacagaattgggatcctgctcttgcccatgaatgtgcaagcgtgtgttctgacttctgacagatctttggcacattcttctccaatgcagctgctgggagggaccacggctagggtgaactacccggaggtgccgcgtggcggggagaggagaactgtctccatgagtggccgcaggcgtgacgatggcacttacaagatttatgccggcaacctggggtggggggtgcgtgccgacacgttgaggaacgtgttcgagggtagggccggcttgctcgacgccagggtcatctttgagcgtgagactggtcgctccagagggtttgggttcgtctccttcagcaccgcagaggatgcacaggctgcattggagtctttggatggagtggtatgttctgtcttcttctagggtcatgttgttcagtgcctaactgcctattacatctcttattactagttagtagataaatatatggaaatgccaactgatccagtggcattgttatctgtggcctgtgggcacttcaaactgaatcaacaaattagagcacacaaggtagctaatatagatgctaattgcacttcgtcaatgtgaatacatgaattgcgatttacttgagtgtataccttcatagttcatatcacttgagtcccattgaccttactgttgcagtggctaacatggttatggaacggcaatgcaggagctggaagggaggtcgcttcgtcttagtctggcagaacagaacccgccacctggttccccgcctagcactgcgcaggcacagcaggaagaaacggattcaggcgcacctgctggtgggggtacggaggcagccagttcttcagaaccatctgaagcagaggtgggcgagagcaacttgcaaacagctgcaaattattgataagcaggagccacagggttataaatgtgttgcaacgacctctaaatcctgccattcgagtccaaggtgtgctgatagggaagtaaattttgacacgagtgatgctgtagcgaggattcagcatttgagctatacatatacactagaatggattaagtgttgttaggaatgtatttgtgtaatgaattctgcaaagtatgatctcaactgcagttgtgtagcctttctcttactgtaaactgatcctttttcaatgttctgttttcgttcagagtgtgtgctcaactcatagattttgtttgtcaggcaaattttcaaatgaactggagcgatatgggaggtataaactatttttcaattgacatttcaaagatgtaatcagttgtaagtcgtgcctctattttgtgtaaactcagtaaaaggaacagcagttcaaatggttttaggtcatagcctcagcagggcagtgcacagtcagaacgcgcctgagatgtcatcaggctcatgggacatggcgaaattggcagcgaggacaaaagtataccagaccaaaaatatttcgtaggcatattgaaagatgtaacatgaaagcatgcatgaccttatgccgaagcagaacttgctgaaggatggcatcttcttgctcgagtccgttaacactcaggctgagctactgtgtctggaagctggtagatgtcaccgagcagaagctgggaaaggaaggctgctgaacaggattcaggaagcagaaagcatggaggctgcatacttcctacgcacaagtgaagnaaaatacatagaccatacgcccacttaccactctaccacttcaattccatgacggacttctatgatacctagcttgagagagatcacaggcatgtggtgaaccatacggagagaaagagcactgaaatgaaccatatcgagcacaggtctcactctacaagtaaagttcgataagctcttagcggagttgtgcctgctatctactaagtttgtgctagggaaagaaaggaagcagagagttctcactttgtacttggactcaaacatccaggccaggaggactcaccatgacttaatgaaaactaccgtaactctagctagactgtgttgtcagaaacagtgcgacatttttttttgggtggaagcaaattaccttgcagacttgtacgggatcacaatcccatctactgaatttaacgaaggttgattgatccagcgtctgcactgcttgcagatctaatatttgtgcacactgtttcacttctcatgcttgattatgcctcacgaataagattattgttagcgttcttgggaaaggttttacataatgttttcaaccgtctgaatcatcctgattagaccttgttcggttatggatgggattgaaaaaaattatgaaagattttgacttatttgggattaaaacctactcaattccatcctaacccacatggattgagagcaaaacgaacaaggacttagactttgttcggttattccaattacatgtcgattagaatggattgagatggattttcactttatggatttaaattggctcaataccacccaatccacatgggttaaggatgatttgaacaagctttgaacaataatccatatggtatcctaatacattccaattcacatgtaattaaaatagtcaaacaaggccttacgtggaataggg

SEQ ID NO: 7480 - DNA, 1636 bp, Zea mays
caggcatgtggtgaaccatacggagagaaagagcactgaaatgaaccatatcgagcacaggtctcactcttttttataaggttacttgtgtcacttgaccacaaggaaacattgcgtagacatggtgtacgtagaatagctcagatgcaacagcttgtcgagctcaacctcagctaaatgaacatctgatcatgggtgctggcaagttgtgtccgtctgtgatgtacaacaaatacagaacatcaagtactatatatccatgatttattcgcacatacatgttttgcaacactcatcagtcatgcaaacgggagaaccaagagtgttttattcagtagcgagcttgaatctgaacattcacacggtcagactccacgcctgctccttctcttgagaaaccttgccgggctgaaaggctcgagatcaacgatcttggacttgccgtccaggatgagctcggcgagggctgcgccggtggccggaccattgaggataccccagcagctgtggcccgtggccacatagcaccctttcacgcctggtatctccccgatgaccggcagcccgtcggcggtgcacggcaggtagcacgcctgctccgcgaccacctcagcgccctcctccttcttcagctggctggacactttgcctgcgatcttatgcagcattgcaatcgagtctggctcgcctactatcgttgctgggtcatctggcgggttctcgtccttgctcatcccacatatgtacacctccccggtgggccgcgggtacacctcggggtcgagcatcttggcgccgggctccggctggtagctgaggaagaggcagtgcggcgtgaccttctcgggctcgcgcggccggagcacgatgctgtgcgccttgagcccggacacgtcgaacacctcgctgaccacctcgaggcggccggaccacgggccgagcgcgagcacgacggcgtcggcgtccagcacgccgtcgcgccccctgaccacgacgccggcgacgcggccgtcccgggccacgacgacgcgctccacctcgccgatgacgacctcggctcccgacgcggcgaggacggccttggtgaagaggcccgggtggacctgcgcggtggtgtcgggggtcccgagctccctcggcggggcggcggacgcggaggggtcgacccagggcgggagcagcgggtgctgcggcgaggaggaggaggcggcggggtgcggggggagcaggatggagagggtgtggacggggcggaagccgtaggcgtcggcgccgccgagggcgtcggccaggcggcggtggagcgcgaaggaggcccgcgcgagcctggacagcgccggggtggagtcgcaccagtccagcgccaggaagccgccggctttccccgaggcggcgcacgccggggcgcacctctcgacgagcgtcgggacggtgggggacgcggcgtgggtggcgaggaagtaggccgtgcacgcgcccaccacgccgccgccgcagatgaccacgcggcggggcggggcggcggacatgggcggctgcagcgccagcgtcaggctaagggatgcggggcgggagcggcacgggtggggctcaagtgtgtggagtggacgcccccggccggcctcgaggtacccaa

SEQ ID NO: 7481 - DNA, 1913 bp, Zea mays
ccggccgggagcccgtccgacgccgcgttagctactcgcctactcccgccattgggcccggcaagagcctccccctcgttccccaatctcctctccatcgaaaccctagcacgacgcaattcccgtcttcccacgccgtatcgccgttgctatgggcaagaagcggaagctcgagcccaaatcggcggcagggttcacgccggttaaggcctccccgaccaccaggtctgccaccgctaaggccgctggtctatccgaggtcctcgcccccgtcgaggctacgatggagaagctgccgcagggggcaggcggcgaggatgtagaggaaatcgaggaggtggaggtcgaggaggaagtggaagtggaagaggaagaagaaggcgagagcgaccaggcttcgatccaggcgctgctggattcgttccccaaggaccagctcgtcgagctgttacgcgacgctgccatcgctcacggcgacgtgctaaccaccatccggcgcgtggccgacgccgacccggctcagcggaagatcttcgtacacggcctcggctgggacaccacaaccgacaccctcaccgaggccttcggcccatacggcgagatagaggatctcaaggtcgtcaccgaccgcaacacgggcaagtgcaaggggtacgggttcatcctcttccgtcaccgctccggcgcccgagctgcactacgcgagccccagaagaagattggtaaccgcagcaccgcctgccagctcgcctctgttggccctgtccctggtggtgcgcccaacagcgctgcaccagccccggttcaattgcagttgccaccagtgtcagagtatacacaacgaaagatatttgtcagcaatgttggtgcagatatcgatccgcagaaattgcttcagttctttgcgaggtttggtgagatcgaggaaggcccgcttggtcttgacaaggtcactgggaaacccaagggatttgctctttttgtctacaagaccattgaaagtgccaagaaggctcttgaggagccacataagcattttgagggagtgatgctgcactgccagaaggcgattgatggaccaaagccgaacaaattaggaggagctggaggttttttcggtgctggagcttcaagtgggggcaaggggtttgctggttatggagctactagtcattctctgcccggaactgttggtattgtccagccaatgtcacctctggcacctggattggcttcattgcctggtggtatttctgctgccccaggtgtggatcctgctctggggcaggccttgacagctttgcttgccacccagcaggggggtgggctgagttttaatagcattctgggggtcggtgctaatggatcggggttgcctccgcaggggccaactggtgcattgggtggtagcagcgtgcaggggatgcaaggtggttatatgggtggctacggtggttctggtgggtatgggggtgcttcttcaggaggccctggaagacattacatgggtcattaggatgattataactattttactgtggccagaatgccagatgattctacatgttcctgcttggcacttataaacttgctgttttaagctgtttctggctactcaattatggctgtggtcaaagttttcataggaactttggttccctccacctatcatttcaaaacgaaattaccgtttagattttcaaaagggcatcttatggctgcaagactattgtagaagacttcatgtggatctaaagcattgtggtatttaatgatattactgtttttgtacggttttcaaaaggccaaattaaggcttgcaaaactattgtaaaagacttcctgtgggtttaaagcactgagctatttaatcacaacggttttgtttcaaaaaaaaaaaaaaaaaagcggcc

SEQ ID NO: 7482 - DNA, 822 bp, Zea mays
actggcatgtgggggcagacactaaacgtagccactggcatgtggggccaggcctttccattcctagtactcgaacccggtagagccatcacctaccagacagaggctggaagcgacggcgctgccggagatggagacggagacggaggcggcagcggcgaggcgggcgaaggagtctctggagctggctttccagatgtcccagatcctcgacaccggcctcgaccgccacaccctgtcgctgctcatggcgctctgcgaccgcggcgccaaccccgaggcattggccgccctcgtccgcgagctctcctctgcggctcccccaacctccgccgcggcttcctctaccgtgagcaacggcgccgcggggccggcctcggcaattgcgcccacgttctcctccggccttcgccgtccctagggtgctgctaaaaagtctgaatggaaccggtgtagtttttcaagcaagacaagatctcgctgctggaatcgctggatgaaaaggattgcctttacaattccatgtgcgcgctgctgtggtggtgtggttcgaccacaaaacatgtggctgggttcatagagccacagaaatacacgcgcggcgcatccgcacccctctcacgacttcttgggtttaaaacagctgtatgcctgtataatcttgtggattgaggagtcattgtctcttgacgcccatgattggacatttggacagttgcttgtatcagttccacgcctggtccttcgttaaattatcctcgctttgacgccacagccttttgcaaaaaaaaaaaaaaagcaaaaaaaaaaaaaaaaaagcgg

SEQ ID NO: 7483 - DNA, 807 bp, Zea mays
attcctagtactcgaacccggtagagccatcacctaccagacagaggctggaagcgacggcgctgccggagatggagacggagacggagacggaggcggcagcggcgaggcgggcgaaggagtctctggagctggctttccagatgtcccagatcctcgacaccggtctcgaccgccacaccctgtcgctgctcatggcgctctgcgaccgcggcgccaaccccgaggcattggccgccctcgtccgcgagctctcctctgcggctcccccaacctccgccgcggcttcctctaccgtgagcaacggcgccgcggggccggcctcggcaactgcgcccacgttctcctccggccttcgccgtccctagggtgctgctaaaaagtctgaatggaaccggtgtagtttttcaagcaagacaagatctcgctgctggaatcgctggatgaaaaggattgcctttacaattccatgtgcgcgctgctgtggtggtgtggttcgaccacaaaacatgtggctgggttcatagagccacagaaatacacgcgcggcgcatccgcacccctctcacgacttcttgggtttaaaacagctgtatgcctgtataatcttgtggattgaggagtcattgtctcttgacgcccatgattggacatttggatcagttccacgcctggtccttcgttaaattatcctcgctttgacgccacagccttttgcactggcatgtgcttatgctgtgagggaacgtgccatgtctacccttcctgcagtgacatctttattgtctctcaaaaaaaaaaaaaaaa

SEQ ID NO: 7484 - DNA, 1674 bp, Zea mays
tattgtttcaattttctcatatagcaatatattgcctttactcacatataattatatagttcaatgaattttttttcctgctagcctgctctactctatccgataatttttcgatgtcctggagatgagaaatggagaaaaggacaattataagaggagtgtcaagtgccaaagttgtatactcctttctaaatgatacactatcaccatcatcccattttcccaaaatagaacaagtggcgaatcatatgcttgatgtcccaattgaaaagacatcagtcaactataattcctcaaatagataatgcaaacaaccaaacctgaacatgtacacaaatttagcctaaagctagcctatgcataagaagcctgactcatcgcgtatgagccagactaccaccgtgtaacaacaaacatatggacattttgaatttctatgtatatgaatttgtttcttatacatagtccatcgccgtgccaatatcatttgatttttttgctttgatattgaaccgactttcatgttcaaaaacaaggaagagctggaacgaagccactggcacgtggggggcacccactaaacgaagccactggcatgtggggccaggcctttcaaattcctagtactcgaacccggtagagccatcacctaccagacagaggctggaagcgacggcgctgccggagatggagacggagacggaggaggcggcagcggcgaggcgggcgaaggagtctctggagctggctttccagatgtcccagatcctcgacaccggcctcgaccgccacaccctgtcgctgctcatggcgctctgcgaccgcggcgccaaccccgaggcattggccgccctcgtccgcgagctctcctctgctgctcccccaacctccgccgcggcttcctctaccgtgagcaacggcgccgcggggccggcctcggcaattgcgcccacgttctcctccggccttcgccgtccctagggtttgtaatatccctctgttcccacgatgagactgcttgtcggttagccaactagatcccgcactatgcacttagctgtttgtgaacgcctgagtgtagcatgctgccccttctgttgactaaatttgtgcctttggctttatgattcaccggcggactatggttcagacttcagacagaatgtgcatatatcacgtgactgcatagatgtgctgctggatgcatttggcatcaatattcaaattacgttgtacttatccgagtcacattattaatttgaaatctggcatcttacgaatagggaatgggcatgtgaactgtggatgtgttgccatgatatagatgtgaactgcaatagagtagtggtattgccatgatatagatgtgttgcggtatagtagattaatggggtgttttgttgaggaatggggtagtccgtcatattcccactcctaacttttttttgtttgatttgtggaatggaatagatcgatccaccaccaccatgtccctcataagctagaataatcagtataaccacatcagtacctcatgccagtgagattcatgggatgagcacatgatgggccaccccgtccatagggtttgtggcatccctccccagtgagattgcttatcaatagtcaaactacatcccacaatatgcatttagccgctgtgaatgactgaat

SEQ ID NO: 7485 - DNA, 770 bp, Zea mays
ggagatagtgtaccaaatggatttctccctttttggatttctggtctgttctgttattttgggattaggtatttttgaaacaacctccttggaacgctcaaagaaaggccctttggagacccatgaactatcgaatggggtgttccacaatcaattgccaattacagaacttccaagctgaagaatatatgacctggctgccacatggcgaatggccgcggttgcacacctcaaaatcagtggctcgattctttgtgcgaaggtttggaaccacagacagaaagcacggctatttttgacctgcaaatttgtctttgtgatcttccattcttgttggccacctgcatcctgtacatgccaactactcccagccccagtagatgtgtatcggtatcccccttggagatattgcaattgtcacagcatcctgtctcccgacttgggtagttgcgaaattttgcttttctcgcttggagacgcagatggttaaaaggcggctgttttgactgctgtagctgtggtgcaatccacaggaataaaatattgtagaagtagtagaagccggtatggattaaagttgtgaccgaagtgcattgatacatgtaagtatgtgacccgtccatgatatgattaacatgccgactttatctttgacctgtccgtgactgcaatcagcgagtctcctgcatgctcgacagaatgcacatgtaggcataccattatgggaaatggtttgaaccccttgattaataataaggtgtttgatttga

SEQ ID NO: 7486 - DNA, 1299 bp, Zea mays
gcacccccccggaggggctggcctcggcccccggggtcgctagctctcggctgatgagaaccgtggagcattactttaccctgaaacacaggcaacaagacgcccctgacccctgtggacggctccgttctttgtgacgtggtcgccagtccagtcggcgctctcagatggcccgcgggttatggctcctctcccgcgaggtggggaggctgcggccgctgcttgttcaggggcaggcgaggggcatctctgcctccgcacaggagcagctccatgtctgcgtcgttggcagcggccccgctgggttctacaccgccgacaggcatgttgaagggtcatgatggagcacaggttgatataattgataggctacccacaccatttggcctagttcgttctggagtagctccagatcatccagaaacaaagattgtggtgaatcaattttctcgtgtagctgcaaatgggcgctgttcattctttgggaatgtaactctgggaagggatatatctttgtcacagcttcgcaaaacatatcatgctgttgttcttgcttatggtgcagaaagtgataggtcacttggaattcctggagaggacctgaagggaattcattcagctcgagagtttgtctggtggtacaatggacatccagacatgtgcgacttctgtccagatttaaaaaacacagaatctgctgttgtccttggacagggaaatgttgctctggatgttgctcgtattcttttacgctgtaaagctgagttggctactacagacattactgattatgcattggatgctctacgtggcagcacgataaggaaggtatatttggttgggcgacggggtccagtacaggcagcttgcacagcaaaggagctgcgtgaaattttaggtttgaaaaatgtccgtatttgcatcaaggcagctgatctcgtgaccacacctgcggacgaggaggagatgaggaatagtagaatacaaagaagagtttatgaattgttgtcgaaaactgcgcatgggggcaacaattacaatggccaaaaggagcttcattttgtgtttttcaggaaacctatcaggttcatccctgcagaaaatggttccacggttggtgctgttcaacttgagaagacagtattaaaaggtgatgaagtaactgggaagcaggtcgctgctggaactggtgagtttgaagacctaaaatgtggtctggtcttgaaaagtattggttacaaatccttgcctgtacaaggtttgcctttcgacaaaaacagaggagttgtgccaaattta

SEQ ID NO: 7487 - DNA, 7382 bp, Zea mays
tgcgataaatgctggctttgcttgctcaggcctctttgtagtttgtaacaaaggattatttctaagtcctacgtttttcctgtgattttgaactaactcctataaaatccatataccatccctatgaaattactgtgtttcaaaggaggagccagtgtacagctgctgttggaatctggataacagtagcaaactagcaataacaaagttagctataaaaaaatattactagcaaaacaaggagatgcgacccactggcaaattactgatagcgctgctgctctttagattacaaacgtaaagaaaaaaaaacctgctgaggagcacgcacagttcgtaggagatggagcgaaatatctgtgcttagcttatccaagtggcgatgatgctctcccctggctggctggctggcttcttcaacctgtctacggttcgatctacagccccagttttctctcgaaactaaaccctaataaagggtgtgtgcagcgggcaccgttgcagtttgcgccggcgcggctgccaaagcctcgcctgtattcttgggagccacgttgcttgctcttgcagcaatgtgctcgctcgctcgccctgttccactgttcctgttcgtgagcagctcaaccacttccctgattccctccacgcagagcagagccaagggacaaagctagctacaacttggagcagtaaacacagcagagaaacaaggaacaatatgaaaacagcatccccagctgttcgtgctcgtagcacacagaaacaaagcatctttcttgtccgatgcaggccagctttctgtagtctgaagctggggaaacatggggagcgcgacatgcaatgcaatgcgccgcgctggcttgttcggctgcaattcatttcttagtttctccaagctattttccctgagaacaaagctcgtttctcagttttccggagccctcactggactgcatcatatgcatagaaatgttgcaagctaatgatggaaggaagattcatgtcccatgaaaaaggcactatgaaactcttgggccatttatacatcgtagcccattgttaccaaacacaccgctttgtggcccgttacgtggttcactcttgtgaagaaaccgagagcagagaggaagaaaaaacttatgataataaagtactcgaaatgattcaagcgaatacggcgcgtctcatctcttatctcaccttttattttaaatttcactctgtaaacagtgtcatatacagttctacgttcactattttacgctatgcaccggagagtcttgcgtcccctttatattaagtagcacaacggccatgcattgccaaggtgaatacagattttattactatttgtttttataagagttgaaggggaaaaaggaaatgatgaactaagtgcaatgaaaagaaaaagaactaccatctcgccaccaattgacatgaccagaagtataataacgctataaaaaaaagaaccggaccaggaatgaacgagatgtcatattgaccatccatctcatagtgcacgccatcctgaatctgaatggcacacagccacgacgcacaatctggatggccggtgacacagcagagtgaagagactgttccgacttgcaaaagctagcggccgagccaccggccggccgaggccgaccgacgcgaggggccagcgagaggaacgttcagatcggagcagggcgaaggccgcacatgccgcggatgaatccaacatcatgcatggtgtttcaaagcccctgccgtccagctaggacgccggtacgagacagtacgtccacgtcatgctcacacagcacagctgggcggggcggggcagggacttgaattgaacagggaggaccggggcccagccgtaccgcgcacaggtgcccagtccccgtcgcatagcagtagcaggtgacaaccaaaccagcacaggggtcgcaaatggaaacgagaacaagcgaaagcgtatcagtaacacagctgatagtaaattccaaggactcgagaagaagagagatgctccaggtcgtgttcagaggcgggcctggttgcctctgaagagagattagaaggctgaatcatgcgtccgtccggggacgacgatgcgtgcgtgaatgattgacacggactacgcgtacacttgcaataatgctgccgcatgcccccagcagcaccccgtcccctccccctattaataaaaaaaaagattctgacagccgaaagcgcgcacggtgcttgctgctgacctgccctgcccacgccatgttcgcgcccacccgcttcacgtggccggctccccgcggctgaccggatcgttgagcccggtcgtacgtacgtcgcccgctgccccctcgtcgtcgcaccccggcattccccattcccgttcccgttcccaggcaggtacgtgctcggtgctcgccgcggatcggtcacgattcacgcgctacgacgacgatgtcatgtgatatgatgtatgtacacggccggcgccgccatcgtacacgtactccgtgtagtgcgttgcttgcagttgcggtgggcggcggcggaggcgtcgacgaagcatggggaaggcggggcgctggctccggagcttcctgtcgggcaagaaggacaggcaggcggcgcctcccaaggacaagcggtggagcttcaggcgccccccgccggcggcgcaggaagggacggcggcggaccagcaccacggtcatgggccgccgctcggtctgccggcgccgggcgtcgacgagctcgacttcgaccagaagaagcacgccgtggcggtggccgtggcgaccgcggcagcggccgacgcggcggtggccgccgcgcacgccgccgccgcggtggcgcgcctgtcctcccgcgccgcgccgcgcttcgcaccgccgccgtgcctcgtcggggacgccgcggccgtcaggatccaggccaccttcagaggctatctggtactccgtccgcccgcccgcccgccctagcattcctgcatgcttgtttcaggggagaaaaaaaaagactttttctttctttttggataacgcgagtcgtcgtctcgtctggcgtggcactggcaggcgcggacggctctgtgcgcgctgaggggcatcgtgaagctgcaggctctggtgcgggggcagctggtgaggaggcaggccaacgccacgctccgctgcatgcaggcgctcctggcggcgcagtcccagctgcgggcacagcgcatgctggccctccagctccacgaccaccaccacccgacgcctcccagaccacgccagtcgccgcagcacccgaggcaccgccgctcctacgtaagcaaccaaccaactaacgaccatgatgcaactgcactgaatcgatccgttcgtcttcgttcccgtgtcctgaatgctgatgtcgacgacggatccggagcaggagatggaccggtcgtgcgaggacaacgccaagatcgtggaggtggacgtgggcgagcccgtgcggcggggcgcggcggggaaggacaggcagctctacgccggcggccggtcctccccggcgccgtcgttggcggcgacggagctgctgagcccgcgggcgtacagcgcccacttcgacgacctctcggtggccaacacggcgcagagcagcccgcggcaggcgccggaggcctgctgcccgggctacatggccaacacggagtcgtcccgcgccaaggcgcggtcccagagcgcgccccgccagcgcaccgacgcgctggagcggctgcccagccgcaggaagcaggggacgccgcccagggccgccgccaggatgcacttgcagcgctcgtcgtcgctggccggcaactactcctccccgtggtcgtcgtcggctgccaggctcgacgtctccgccgcgtcgctcaaggacagcgagtgcggctccaccagctccgtgctcaccgccgccaccctctacagccggacgcggtcgctcgtcggctccgaggtgagtgagtgacagagtacattcgtactgctggcttgctttgacatgatcgtgatagagtccttgccttgcttcctcctgttgctgctggctccaggtgcgccgtggcctgtactgagaggagctagctcgtgttcctggcgaccccatggatggatgctgatagcttctgttcttccaatggtccgtgattcttcgatgggagatgggagcttcaaattaatggaatgcttatgaccagttcgtgctacattaaataggcgcggttccaactggtcctttttgtagcccccttgtggccgtctgcacggtattgggtactagtatatagacgtgtacagctacacaaaatgtttgtacaacaaggtttgcgatcgcttgtaatgggtctgcttagctgccaagaagcaggggttgttaatgcgatcgcttgtaatgtgtctgcgatgacgaagatgggtaaatgatccttggcttcgtgctgaagcccccaagggctgctggcccgcatcccaactatatattgtgcacgtctagtttaatttatgtagttttttcgtgctactgtcgtgccaatctaacaagtgaaattatctgcaaatctatttgtgtagtcgttgagtgttttcttctgcactcgtggtgcctatctaaaatgtgaattgtctgtttagcctctactttggcttttccaatggatggcaatgcatcgttgatgtatctacttaattgcctcctgtttccgtcactgtgtggacaggtaggtatggtgtcccagtttctgcagtgttcttgaatcatatgatatgccacagttagttgtggttgccgattagggatgtagtacttcacaggtagctgtggttcccaagtagtgtttcatcatcggtattgatatccatgctgtttcgatcgattttatatcctggcaaatggttgatctgattctgaatctaccttttttttattcttcctctttttttattgaatattatgccaggattcttgctgccaatctgccatggcatactgatgttttaacgtatggttcatgctggcctctgcagattgtaaaggttctggtagcagctaatgttgtggtcgactggtcggcaaatgttcttgtcaagtcctgtatgctacaggttcaggtcatatactaggaactctgaaagtatgaataatgtgtgatacctgaaccttgccctgaattgctaggaacagacgttcgccaaactgaattggttctagtcatgaaagttagagcatgtttaggagggctttgactctagcttttctttgaaagaaagttagagccctacggaacgccttttttcaaaatggtttttattgcgaaaacacctaaaagcccaaaccgtttttgtactgcagaaatctctcacttacacaagattgctgattgctgcccctgtctgattgctgattgctgtgaaaggggaatctacatttacaatggccaattgattttgggtgctaccggttactagcataggttttatattcagcaatgtccatatgtttttctgtatcggtaggcatctggcaatttatcaaatactccttatgtttcaaattataattcctttaacattttcaacctcaactttgaccactccatgtattaaaaaaattaatgaaaaatggaaaaataagtaatatgtgaaatatatttgataataccactatattttttaacaattttttaataagacgagtggtcaaaataaaaaaaattaagcgaattataaattagaacagagggagtaagctttttgaggttgtgatggtttgggattattttttacatcttcaatgaacatggcaggctcacaaattgaagtggttggtttgtaccatgctgataccaacatgatttactattttattaagttccatgagagtatgagactacttgtgcattataagtgtggtatgccaatgttcatatagccattggtctattgtgaggcataatcagggaaaacaatctcagacgaaaaccgagggttttcgtgatttttttctcgttctcggtgaactacggaaataaatttggcgaataatttcgaaaattccgctcgtaaatttagagtttcaaaaaaaatcataaaaattcgggaaaaatatatttaaaactagatggtcccaggagtttagaaatatatttattgtccaaaaaaatatcttttattgttaaaaaaaagttggcggccggaggatgtggaccgagcactgtgtatgttcccctaattctatagaacatgttagtttttaaactaattctcatgaaaatagtttaaaaaatgcttctaacagcccccttaatctaatttaacttccctaattttggattctggattcgcccctatctgtgctcgccttggattctacggcaattggtcgtctacgggtgaaaactaaatatgtagctgtttatttaccattactatataaacctgcaacaggttcaccgttgtctacccataagtaataaggcacctgatcagcactaaactgcctctgcgcggccggatgtgctttcaaaactggagtcatgtgagaacgggaggaatccgtccaagacggggcatcagttttgacgtttgtgaatttctggttccatcatgaaaactagcgcaggataatggcatcccctccaccgtagtaaagtaagaagtaacgggtctacggcccagcttccttgttcggttcaggttacgggaacggttgactttcaaaataaaatacccttcttccctgttttgcaaattcacctagagctagcgaagcgagtctgtttccagcgatgaagagcttttttatttaatgaatattggtctacgccctcctttgatgtccagaggaagaaaagcgaaggaaagaatattatctataactataactataagggaagggaagagaaggatattgataaaaaaaaaatataaaatggaagtagatgagcgtctatcaggtgcttgttgacatttatattggaaaagagctttcggttctattcatttttagttttaagtaaaaccagatgtgaaaaaagcacttcccggtcaggatctaacgaaaaccgtccgagttcagcgaaaactgttttttccccaaatttaagattacaaaccactcgaaatttacgaaattcggcgaatttcgtgcggtttttcgttttcgcagacaaccaagaaatatgttcaaaatgagataataaaccctgagcataatgcagtaatttggacctggtttaggctggctttataaattgttctttgtactacagcattggctgtattcctctgtattacggcaatctggttggataaattgttctttctattatggcaacttagccggaattctttgtattacggtgatatgtc

SEQ ID NO: 7488 - DNA, 1446 bp, Zea mays
ctcggtacccctgttcagagtggcctagcaagctcacttgcaaacgctgctgacaagcttccaacaggcacacgctgtgccgatccatgtcttccttttatcaggtatgcttaagctcatcattattatcttattgttatatttgaaagaaaaagagaatgaatactgttgaaactacttttaagactggaagatgctcatggtaaaattagtctttactatcttctgggattttttaacttataattttttttcccaggttgcattctttcccgcttcacccttctcaaagggatatagtaaagcggaatccacataaaaaggagtggtgggctggtgcaggtccttcaggacctttcatttatactcctttcagcaaagcaggagcttctgggacttccaagcaagagcttagttggattgtgggggagccggttcaagtcatggttgagttagcaaacccttgcagcttcgacctagttgtggagagcatctatctctctgtccattctgggaattttgatgcctttccagttagcgttagtcttccacctaacacttcaagattagttttattatctggtattccaacaaaagtcggacaaatatcaattcctgggtgcattgttcattgctttggtgttattacagaacacctattcaaagaggtcgattgtttgctccttggagctgcacaagggcttgtcctttctgatcctttcagatgctgtggctctagcaagttcaagagtgtcaactttcctagcatttctgttgttcctcctctgccattgttaattgccaatgttgtgggtggagatggttctattcttctttatgaaggagaaattcgtgatgttctgataacactgacaaatgccggaaccgtaccagttgaagaagcaaatgttgcattgtcagggaagaatcaggattctgttatttcgattgctcatagcacatggaaatctgcgctccctattaaaccgggtggagaagtgacatttgcagtgactctaagagcctggcatctcagctcagcagatttggaagcagatggcagtagatctcctgtaaattcaaggagaatagcaagagaaggaaccaatccattcttggatattcactatgctggtccggctgcggttcctcagtcttttctactctgtcatcctttaatattcagctcctctcataatctatatttacattaatattgaaatctatggtgctgttaatgtacatattacggttagacatttgcaaatttgttaactcctgttgtgaataatgcctctatatcttttcatatttttattagtactccctccgtctcaagatataaggcgtaaccactttttattcttgtcccacaatataaggcgtgctctctctatgcatacgtatatcgatgcagtggtatagagacaattaatgcatttcttg

SEQ ID NO: 7489 - DNA, 3087 bp, Zea mays
atgttttctggcatgctggagcccttgagggtagtgtctgcgcattagtggtggataggatgggccaaagtgaccctattttggaggatgaagtcaaatatcgctattacaccattatccagctatacagaagagccactttacaagataatgctcaaagagtttcacctgtgagctttgagcttgaagctgccttgaagttggcaagatacttgtgcaggcgagaacttgccaaggaggtctcagatttgttaatgggagctgctgatggtgccaaggctcttattgatgccagtgatcggctcatactatatattgaaattgcaagactttttggtacacttggttataagcgcaaggcggcctttttttcaagacaagttgcacagttgtaccttcagcaagacaatgcatatgctgctatgagtgctatgcaggttctaactatgactacaaatgcataccatgtccaaagccgaaagactatgaaaatgaatcatgatccgtccaaggaacctcgtgctggcaatactgattctggaaaggtgcaccctcagtctatagtgtcattgtttgagtcacaatggagtaccctccaaatggtggttctaagagaaatattgatatcgtcgatccgggcggcagatccactctcatcatggagcgctgcagctcgtcttcttcgatcattttacccactcatcacaccagctggtcagagtggcctagcaagctcacttgcaaacgctgctgacaagcttccaacaggcacacgctgtgccgatccatgtcttccttttatcaggttgcattctttcccgcttcacccttctcaaagggatatagtaaagcggaatccacataaaaaggagtggtgggctggtgcaggtccttcaggacctttcatttatactcctttcagcaaagcaggagcttctgggacttccaagcaagaggttagttggattgtgggggagccggttcaagtcatggttgagttagcaaacccttgcagcttcgacatagttgtggagagcatctatctctctgtccattctgggaattttgatgcctttccagttagcgttagtcttccacctaacacttcaaaattagttttattatctggtattccaacaaaagtcggacaaatatcaattcctgggtgcattgttcattgctttggtgttattacagaacacctattcaaagaggttgattgtttgctccttggagctgcacaagggcttgtcctttctgatcctttcagatgctgtggctctagcaagttcaagagtgtcaactttcctagcatttctgttgttcctcctctgccattgttaattgccaatgttgtgggtggagatggttctattcttctttatgaaggagaaattcgtgatgttctgataacactgacaaatgccggaaccgtaccagttgaagaagcaaatgttgcattgtcagggaagaatcaggattctgttatttcgattgctcatagcacatggaaatctgcgctccctattaaaccgggtggagaagtgacatttgcagtgactctaagagcctggcatctcagctcagcagatttggaagcagatggcagtagatctcctgtaaattcaaggagaatagcaagagaaggaatcaatccattcttggatattcactatgctggtcctgctgcgaatcttgagaatggagatgtttctcttctacctggaagacgcctagttgttcccttgaatatctgtgttgtgcagggcatgcgtcttgtaagagcacgcctgttgtccgtggaaatacctgctcgatttactgaaacacacttaaaacctgtcagtggcaaagacatgaacttattgaaggttgatccctataaaggaagctgggggctccgccttctggaacttgagcttttcaatccttcgggtgccgcgtggccggccggggttgctgtgcatttggatgacacggatgtggaccaagaagtaatttcagacggggatgctgcttgtcacaaaactagaattgatcgggactactctgccagagttctcatacctcttgagaacttcaaattgcctgttcttgatgcttccttctttgtaaaggcaagtagtagtgatgaacctcttggatccagggccgccgccatagcagaaaggaatgccaaggcagagctaaatgcgtctatcaacaacttgatttcaaaaataaaagtgaaatggcactctgggagaaatagctcaggtgagctgaatattaaagatgctatccagacggcactacaagcatctataatggacatactgttgccagatcccctgatgtttagctttaagcttgttacgaatggaactgtggtcaatgtcgattctccaaaggattctggcaatgttctgaggtgcaaagatcctatatctgctcatgaaatgacccatatggaagttcagattcgcaacaacacaaaggaaattatccggatgaaccttagcatttcatgcaaagatgttgctggagagaattgcttcgatgaaaatagtgctactgtcctctgggctggtgttcttagcgatatacacctggaagttccaccgttgcaagaggtggtacatcctttctccatgtatttccttgtaccgggtgactactcgctccaagctgcttctgttataatcgatgccacagacgttcttcgtgctcgtgcaaaggcggagtcaccagatgaacctatactgtgtcgcggatccccattccatatccgggtagtcggtacagcataggcagttcttctgagttactcctagtctagaggcctcattttactgtgacaattgtaggtgtggaaaatcttgtacaagagtgatccctggcgccctgcccctcatgcgatatgttttttgtcctttttgtaggcttctttgtaagtcatgtcatgtacagtgtacaagcatagtgagtattgtttcaagcacagaaattgtatgtcgatgattccacaatcttaatttctggtcagcttatatgattttacttaactaaaaaaaaaaaaaactcgagactagttctcttctctcgtgc

SEQ ID NO: 7490 - DNA, 1310 bp, Zea mays
tcgaggccggccccacgacgactcagtggcctggtccacagagccagccgaactgcccgtccgcctcccgcgacggccgccacacgccgggtgccagtggtcacgctcacgccgactcccagctccagggcgccctcaaaccagcgctggctgccatgctgccgctcgcacactccgccggctgcagccatctccacctccctcccgctccgagtcgagcttaccttcccaatcgccgccgcgtccgatccctcgtccgagcgcgccctcccagcgcgggggcgtccggaactgaaaccacctctaccactagcggcagcgttatgtcgttcctgtgcccgctcctcaaactcctcgggggaggcgatccttcgcagcaacggaacgacgttgtggaggtcacgacatcttcaatttcaagtttatccagactgccatggggatcaaaagtggctactagcagcggggagaacatcgattcagcaataagcattccaactcttcaactgtatgagtttgaggcatgtcccttctgtaggagagttcgggaggccatgaccgagcttgacctttctgcagaggtttatccttgtccaaaagggtcgctaaggcacagggacatagtcaagaaaattggagggaaggagcagtttccactccttgttgacgccagtactggtatctcaatgtatgaaagtggagatattgtgaagtacctgttcaggaactatggacaaggaaggagtccttcacctggtctccttgagagtacgattttcacaggatgggtgcccactcttctcagagctggaagagggatgacactgtgggacaaagccggtgctgtacctgcagagaagctggagctcttctcgtacgagaataatccctgtgcaaggatagttcgagaggctctctgtgaactggagcttccttatgttctccagaacgtcggagagggatcgtcgaggacggatttgcttctaaggaagtcgggctctaagcaggtgccatatctgatcgaccctaacactggattccagtcgggcgaccataagaagatactaccttacttattccagcagtacccagttagtagtatctagcagaaaaagcagacgtccacaactttaactgtgtatggtttatgtgatcttacatatgtatctgcgggtacagtgttaccagacgtggtttgtacgtatactttggctgctgcacttgtgttcctcacatggcactacgtttcttcccagctaaaaagcgccaaaaaaaaactcgagggggggctctaatcttcaccagccctc

SEQ ID NO: 7491 - DNA, 1135 bp, Zea mays
tgcggtaccggtccggaattcccgggtcgacccacgcgtccgccagtgtgtcctgttctgatcttctgctgtgttccgtaacttccgtgattcctattcttttccaacgcgactacacgtctacgcctctcctctgctttcccctctggcccttccgatggactactcgagtggcgcgacggagtcggggagggtgcgagcacgttggtgctactgccgctgcttccgccgttggtgccgctgcttctgcggctgctactgctgcaactgcttccccgacgagccccacgacgaccgccgcgccgcagcgtacgcttaggctcctggactctccactcgcagtcgcagggagagtcgcatataggcatatgagcagtatgagggaactggatttctgtcctcatgtacactaggcaaatggctaccttgttcttcaaatagatgttgaagaagatattacagcttcagagaatcagagctctcttttttggtgcttgtaatgttacaaagaagccccgacgatgatgtgaatcagagtagcacttcgtgcattctaatctgtgtactgtggttcgcgaaactaagattgaatgtgtcgagtgtttctgtgtgggcggttgtttgcctcttctgtactctgctgttcttcttctctgtttaatgaaataattcacagctctcctgcaaaaaaaaaaaaatcgagagagagagaaagagaaaaaaaatgtttgcacatagctgtgttgtgctatcatcttccatatttctgcaattctgctcctaactgggaatggttttccctgcggtgaatatgaattggccatttgggtgtgcgtggaaatatctcttgacttgtgattgcaagtgttctactcatcgtgtcttcattcagttgcattgtagttgtagcaaaggagaagatgcagcctgaacggtttaccactttattttgtgcataacaaaacgtagcatgtggcttggtgggggtggggttccactattttagaaactgcacgatgaatatggaaaaacatgcagtatgagcgatggacactcacacgtatgcatcgtgcatactgtatgtttccctgttcgtcactttggacgtgcctgaactgtcagctgcaggtcgact

SEQ ID NO: 7492 - DNA, 1564 bp, Zea mays
aaatagtttacgtggttattattttgagccgtcgcagcatacggacaaccgactagtatgtgtagtacatactaagtagaagattttttttttttttttcggacacaaaattgtgctattactgcaaaagaaaaaaaatgaacgcacagaccaaaagttgcatctcaaaataaaagaaacatatggatttacacttgggagttgtttcagtttcagctccactcatcatcagtctacgccgccgggaagaagcttgcgagtagtcgctctggacgccgacgaggccgtcccaatgcgtgcagcggtcgtcccagtgcggcggcctgcaactgcggggatcactcgcgacggcgtgacgacttcgaccacggacaggttgtaggaatccgtcccgaggcggctctgcgcccaccctttccggcctgagaagccgccggccatgacccagcagttcttgaaccccacgctgtccagcgtcttcgccacagtcttggcgacgtcgctgtacgagtccatgatgatgacgttggagccctttccgatcttcttgaggtaagatatcttcagagcggcgatctccgcctcggctttcttcgcgttgcgcaccatgcccttcagcttgctcggaaggtcttccagcggcacagagacgagcttgttcttcgcgttcgatggcagctgcggcaatcctgccttggccttgtccttgtcgctccgcacgtcgatcaggacgtagccctgcgtggtcaccttgtccagtgcttgcgccggggtcagatcgcctttgtaaccgcggaggctggacgagaccagcgaccagaccggcggcacgaggaggtacgcgagaaacgccgctccggcggccacgacgtagtcctcggggcccagcgacgtgatggtctccacggccgccgaggccacgggcttcgcggcgtcgatcaccttcgtgctctgctccgctgcggtcttggcgacggacagaacgggggcggggtcgacgccggcgccctggagtgcctccgtggcctgcttggaggcggcggacaccacgggcgcggccagcttgagggcctcgtcgctggcgctcttcaggaccggaagcgccggcttgactgcctcgcccaacgccttgagcacggccgccacctgctcagcggccttgccgccgacgtcgatggcctggctcaccgtgtccacggccttggtaagcgagccggcgacgtcctccttggacaaggccgcggcgggcgcggccggcgtcagtgtcagcaacgcggccgagatggcgacggaagaggcggccgcgaacgcggcgtcagccggcgcacgccgttcccagctcctggatgttgcctttggcggcgccgccggcggcggcgcgagggtggccgacaccgacacggggacgggggccatgggtgggtggtggcttcggcagctctgctcggctggccggccctgcagtcttctacggtctacccacccgcgctgcgatttcggccacaaacgggcacgcgcgcggcttcctgcctccccctgtagcgctaatgactctgggaatgtt

SEQ ID NO: 7493 - DNA, 1626 bp, Zea mays
ctcaaccttcagaggagccccctaagaggttaattgagcaacacagatggccagccatgatagctgggcaggcgccgaagaatctcatgtcaagaagcattgacctttcggacaaagctaatataccagtcccaccatcaaatacatcaagaggtctttcaccaaggaagacgccttctgtcagacctgttgcatcatcaaatacatcaagaggcctttcaccaaggaagaccccttctgtcggaccagtcccatcatcaaatacatcaagatgcccttcaccaatgaagaccccttctgttgaagcttcagtgaaactgtcaaatcagtcattggatgaagtggcaaggagtttggctattcaatcaagcagaagagatgataaggtagattcacagacaatagagagatccaaatctttgagccgaccaaacagaacagttacttttcctgttccaattctacaacgctcatcatcaccaagcagaacattgccagctacgtcctcaacttccagggcctttcagagcccatctcgggcaaggccatcaacaccctgtcagtcccaaagtgctggagctatccaatcaagtgttccatcttctcttattaactacatggttgatgcgcggaaaggaaagaagaatgccagccaaatcgaaaatatccaccaagtgcgtttattgcacaatagacatttacagtggctctttataaatgcttatgcagaagatgctttatcttttcaaaaggctactgttgagaataccatgtataatgtttggaggaatactgtaaacctgcgggattctgttaatatgaaaagaataatggtgcaacacttccaacaagaactcaggctttacaacattctgaaagagcagattgcttaccttgaacaatggccaacgctagaaagggagaatagtatctctttactaggggcaactgaggctctgaaagcaagcaccctgcgcctgccagttacattgggagcaaaggctaacacaattgctctcaagaacgctgtaagctcagctgttgatgtcatgcaagttttgggctcatctgtttgctgcattcattcaaagatcacggacagcacatccttggtttcagaactctctgtcatagcaggacaagagaagatcatgcttgatgaatgccgagaactcttagctacagctgcaaaactgcaggtgcaggagtcgagcctacggacacatcttgtgcaacagagacaaaggcttcaggattgaaatggcaacctgaacaagatgcagaagccccaggccatgccattgaacaggtaaactgtgcaagttgaactgcaaacagaaaagtaatctgtagagtctaaacaataggaacaaaacaaatgttaaacatcccctggagattcatggtgtgatgccacaactaactacccgcagtgcatagatatgacaggtttactgaaaaaacctcatcatatgtaaatggttttcaccatataatgcactcccagccttttctagtattttttgtttctttgtatagagtggatccctccctctttgccattgtattttttgacattttgaaagaaatacatagataatggatgagctaaaaaacaaaaaaaaa

SEQ ID NO: 7494 - DNA, 2737 bp, Zea mays
atatcaactttgggaaatggtggaatatcaaattccaaactaaataagttaatttattgagtgaattctaatttctctaaaataaagggatccaaacggctgttagaagaatagctaggcttgatttgggccgaatcctttagaattgccaggcttgatttgggctgaaccggtcatctgagcaagcgtatgtggaccaggcatccatcctcgattttgaacgcccgagaccaagatacagttacatcagacagggcggctgtatccaaataggtctgctcactagtgccgtgagtccgtgacagacccacaccattgctctcgcaagccgcttgacgcttgtagttcacgtttactactactactactttcttgcaggaattcggttcctctgtcccggacaggagcgtcccctgacactgacagcgacgacctttgatctcgtggggattccctctgcattccaacgtcgtaagctgcaccaaccaatcatttgcgagcgcaaaatccttgttgccaagtccaacaacactaggatagtaaaacctctgaaaaagtctcaaaacacagaaaggcgaacggagacaccaccacatgaaaacagtagaatggtgagccagtgcggttaactgtctacgcatgcgccggcgccgcagaccgcgtcacgtttcgacagcaacgcgtgtcccacgtccaatagctgggcggcacctacccaggagatattttcgatcgccggaccccacgcgccccgccggcgccacacgtgtcgacgcgccagggcgccctgacgctgcggtcgtctgtcccggtaccggtccgggcggccaccccgcgggaagcacagaactacagaagcaacccgaagccggttcgaaagatgttgccggcttgccgccggtaataattgggcgccgggtgcgtgcgcccgcggcccccgcgaacccgagggtgagcgccggacacgcgtcctccaccgagggccgcgaaggcacgtggccggcggggcgagcgcgggtgccgggacgcgtgtccggtatacttccgccgtcgcccgtcggcacgtccggttttagcgtggcgtggcgtgtcagcgcgttgaaatcgtccggcgagtgcgtgaggctggtggtgcgatgacgcgacagtgaacgtgaaccatggccggcggataaagcacggtctgggtgatttgcagtgtcctgtgccgttcgcacgcaacgcaaacgcaggcatggttggttcacgttcgctgtcgctgcgccgaccagggcagcaggaacaggacacagtagtacggctaggctggttcgggatcgcgacgccgcgagactgttccagaagcttttaggctgtttggatcaatggtgcaccaccgcaaccaaacaaacaccctttgttttttccgcttgcgtttcgtctcgtccagggaacaacagcacggggggcagtcggccaacgcccaccgtcagtgctcagcgcggcgctcgcacagggagggattagcgcgtaatagtcgagatatttagaggggtggagtgcgttcgatgcctgggagggattggtccccttgtcgcgcgtccataaagacacaaacacgacgcgaatcgggtccgtgtccgtgtccgtgtccgcgcacagcgcactgcacctgaccgccggcagcggacgggcgtatataaccggctacggcctgtgaaaattgcccccccccccgattggacaccgaatgagcgagctgcgagcaccagtttaggcaagtgagcagctcgccagttgtcggtcgcggcctcctgcgctcagcgcttcgctcgcggtgccggtgcgtgaggtgaggttgatgggcgcggagggatgagcgagagcgccttgaccataaggcggctgagcgggccgtcgaacggcggcggcggcaatgcgggagctagctcttgcgcggtcggcacctggggaggaggaggcggcggcggcggcggcaatgcggcgcgcatccggggcgtcaacgtggggctcatggacgagaaggtgctgcagctcgtgttcctggcgctcaactgggacccgcagtcgctgtgcgcggtggcgcgggtgagccggcgcctgcgcgccgtggcggagcgggtgctgtggcgggagctctgcgtctcgcgggcgccgcggatggtggcggcgctgacgggaggccccgcgggctcggcgccggcggccgggcgcgtcggcggcgggtggccggcgctggcgaagctgctgctcttctgctgcggcgccgcgggcgcgggcgtgacgggccacttcgccccggtctcccgcttctccaagacgtccgggcggagcttcctgccgcgccgctgcgcgggggacctgctgtacgtgtcggacccctgcgagcacgccgtggcgggcgccgacgacgtcggcgtctaccgcggcgtgttccgcggcttcatgcggtccccgacgcgggcgtggctggtgggccaccgcgccgcgctggacccccgcgcgcgatgcccctactgcggcgcgcgcgtctggagcatggccgccgcgggtctcgccccgcgcagcgcgtcccgcaggctcggcgcctacgagggccggctcgagtacttcgtctgcgtcagcggccacctccacggcagctgctggctcgcgcgcctctccgacagcgagggcaccggacccgacgccgacgacacgtccgccggcgccagcgacgaggacgacgcagacctgg

SEQ ID NO: 7495 - DNA, 773 bp, Zea mays
gaagcattggcacgcaaaccatgtgatccccccgtccggcctacttttgcactagccttttacctgggaggtgatatgtctttggcagtggatatcggaaaatcaatcaaccgacaacatgatactggctttcgagagctcttagaacccaaagtctggactgataagcatttggcaggtgaagtacaaagctttgctgcattgatgaagcagacattaactgaaatgactgatgagtatcatgtcgcaaatgctatggcaaaaatccctcaagcaccttcctcagatcttgtatttataccactacaagcctacctgaaggttctcaaatttatcgagtgtgttcaatatggcaaaaaggagcgtggccatgaaccaaaacgcgatgggatgatcaattaccataacctgtctaatggtacacatgcagaaataagaaacctctttacactggtggtttttgacacactgtaccctacagacacggaggatgaaaatgactgcagttcttagagagacatcatgattgggatgaattcaatactttgccagacatcaataaatactccatttgtcccaaaatatatttctttctagtcttttttttggtccacattcatccgaatgatagtgaatgtagacatacatacaaactatattcgtagattaattaatgaatgtttgtttagtcaaatgaattatatttttgactgagggagtaataaatagccagggaccagggacaactggagcgccggcatcagagtgaaggc

SEQ ID NO: 7496 - DNA, 1559 bp, Zea mays
  misc_feature (1539)..(1542): n is a, c, g, or t
  misc_feature (1544)..(1547): n is a, c, g, or t
  misc_feature (1549)..(1549): n is a, c, g, or t
ccggccggggctttctccccctttggcctccccccctctctctctctcatctcctgccgataagaagcttcgccgccgtctcctctttctccgtcctagcaaaatcctccccgtattgagagccaaagaagaaaaaaaaaaaaggcaggaggccggcgaactacgcgaggaaaaattttctttcccgggaggctcgggagtcggacacgccacacgctttggtcaaaatcgtttccggttgttagcgcggctgctgctgccgctgctgtcgggggcgagcaggaaggggagcgaacgagcttgggcagctcaagaagaggggacgggggagggagcctgtggaaggcacctgagtacgcgtgaaggagcccgcgcgagagtaggggggaaaccaaatcgagagacatggactcggagcactggatctcgcgcctggccgccgccaagcgttactacgcggcgcagctcggccgcgtcgacgatgtgcccgggatggggacggaagaggtggagatggaggtggaggacgacggggacatggagatggagttggagatggcgctggagctcggggacgcgacgtggccggaggtcgcctgcccctactgctacgaggaccatgacgtcgcatccctctgcatccacctcgaggaggaccacccctacgagccccacgccgcgccctgccccatttgctcccaaaggattacaagggatatgcttaaccatatcaccatgcaacatggttacttgttcaagaatggtcacagatcccgtagatttattgttccagagagccatgcgatttcattattgagtcgagatctacgtggtactcatttacaggctcttctagggggtggtcatggccacagatcaaataacgcagtgaccacaaacatttccagtgatcctcttctttcatcgtttggcctgagcttctcagcatctgatgcaccagaaccatcaaaatcagcatcttctattccagacggtaccgcaatacgtaaggagacaccagttcagccttgggaatcaagtattgattcatctctcacgagcgaggaaagggagcaaaagcggaaacaggccaccgggagggcaacctttgtgcaaggcctagtgatgtctactctattcggagattgatcgctcaagcagccctaggttcttgcacttgctagatcggctctttctcctgcctggtccgtcgtcagatagtgctccacccggttcggactctgatggcagggaaaattcgccccaggaaacttagccgcgttcacctttttttttttcagaaaagtgcgccgttgattctagcatgatgcagcttgatttaagctagctgttgctgtacctgtacctttgtttttatcaatttatcggccagcaattcttatctgtaactcactggtacatcgtgttcgttaccaacatacatggtagctgtggcatctgcttacacaatgcaagaaaagacttgaaaattgcaaaaaaaaaaaaaaaaaaaaaaaaaaaaaaaaaaaaaaaaaaaannnnannnnanaaacctttaa

SEQ ID NO: 7497 - DNA, 1485 bp, Zea mays
ctctcgctctaggcccctacccataagaaacttcgtcacggtctactctttctccgtcctagcaaaatcctccccgtactgagagccaaagaaacaacaaaggcaggaggccggcgaactacgcgaggaaaatttcgtttcccgggaggaagtcgggagtcgagacacgcgcgggtcaaaatcgcctccgtcgctgctgttgctgtcggaggcgagcaggaaggggaaagaacgagcttggagccttggacagctcaagaagaggggacggggaggcggcagcctgtgagaaggcacgtgacacgtgaaggagcccaagcgagggtagggaggaaccgaatcgagacatggactcggagcactggatctcgcgcctggccgccgccaagcgttactacgcggcgcagctcggccacgtcgacgatgtgcccgggatagggacggaggaggtggagatggagattgaggacgacgggggcttggagatggagatggagatggcgctggggctcggggacgcgacgtggccggaggtcgcctgcccctactgctacgaggaccatgacgtcgcgtccctctgcgtccacctcgaggaggaccacccctatgagccccactccgcgccctgccccatttgctcccaaagggttacaagagatatgcttaaccatatgaccatgcagcatggttacctgttcaagaacggtcacaggtctcgcagatacattattcccgagagccatgcaatttctgcattgagccgagatctacggggtactcatttacgggctcttctagggggtggtcatggccacagatcaagcaatgcagtgactacaaacatttccagcgatcctcttctttcgtcgtttggcctgggcttctcaccatcagatgcaccagaaccatcaaaatcggcgtcttctattccagatggcgcctcaatacgtaaggagacaccggttcagccttgggagtcgagtattgattcatctctcacaagcgaggaaagggagcaaaagcggaaacaggccaccggcagagcaacctttgtgcaaggcctagtgctctccactctatttggagactgatcgttcgaaacagctctaggttcttgcacatgctagttcggcgcttactcctgcctggtccgcatagtcagatagtgctccacccggtttggtgcatctaactctgatggcgggaaagttcgcctcaggaaacttagccgcgttcttctttgtttcagaaaagcgcgcagttgattctatcgtgatatagcttgatttaagctagctgttgtaccgttgtctttaccaatttatcagccagtaattcttatctgttagctcactggcagatcgtgtttgcaccaacatacataatagcctgtaacatgtacttacacaaagcaagaaaggcgcttgtttgagcgcacattcttcttgttgtaagaccagttaaggcctaaaaaaaaaaaaaaaa

SEQ ID NO: 7498 - DNA, 4287 bp, Zea mays
  misc_feature (2482)..(2482): n is a, c, g, or t
  misc_feature (3844)..(3844): n is a, c, g, or t
  misc_feature (3850)..(3850): n is a, c, g, or t
tcttagtgttagcccactaggtatctttacctgtagccatccaaaccctctctctctcttatcggctattcgcccccacgcggtttccagcggacgccgcggttctttcttatccctgcgaccctgccgggaccgggacacggcccacgggcgcacggcgctgggccgccgtgctctatcatccaaacacgccgccgccacgcggggccaggttaccccgtgcgtcccacccgtcatctgctctccagcggcaggtgggtcgcaaccggcggagagtgggcggtcgctgtcattggtgccacggccacgcgctgactcggacgtcgaccagtacgtcgaaaaggaacacgtcgcccccatttcccacccgctttctccccctttggcctccccccctctctctctctcatctcctgccgataagaagcttcgccgccgtctcctctttctccgtcctagcaaaatcctccccgtattgagagccaaagaagaaaaaaaaaaaaggcaggaggccggcgaactacgcgaggaaaaattttctttcccgggaggctcgggagtcggacacgccacacgctttggtcaaaatcgtttccggttgttagcgcggctgctgctgccgctgctgtcgggggcgagcaggaaggggagcgaacgagcttgggcagctcaagaagaggggacgggggagggagcctgtggaaggcacctgagtacgcgtgaaggagcccgcgcgagagtaggggggaaaccaaatcgagagacatggactcggagcactggatctcgcgcctggccgccgccaagcgttactacgcggcgcagctcggccgcgcgcggtgcggtcagcctgccttttcttgcttctcccttcgttcagtaacagcacgcgaggcgatccttgtattgatttgcgggctcttattgggttcgttgcagatgtgcccgggatggggacggaagaggtggagatggaggtggaggacgacggggacatggagatggagttggagatggcgctggagctcggggacgcgacgtggccggaggtcgcctgcccctactgctacgaggaccatgacgtcgcatccctctgcatccacctcgaggaggaccacccctacgagccccacgccgcggtgagtcagtcagctcgcttcttccttcaggactcttccaggtagtgaatttgagcctgagacgtgatgtgcacagctacagctcttgcttcttcctccgattggagctggaggaaacgttgtagcttactgcttaaggggttgacctgatgaatacagctcatgagctctcgtttttgcggtatagtaaccttgtcggaggattttgactacccgtgtgctgtctagttgccatatgcaattttaggggagccaaggttaagtaaatagctgaactaaaggttatggcttcgtagcttcacgcgaagagcagcagtttggattagaaattgtggcttagtgacaaataggatttcagaggaaataatgtagcttctagcttagtccgagttcaagtttattgagtgcttcagactgttggtttaatgacaacacaatttctctgagctcaaccaagacctgtcggctgtagctggctgtcctcatcaccatgctctggcgcctttgggattgggcaaaatggcgcaatctttttgtgccgagtatccctcactccgtcgtgttattaaatcaacgtgtgatgattttgtcatctggaccaaacgattctctcctgagcctcttaattttgatttgtgctgttggtatatttaccttcaaacttataaatctatgatcccccatgtgccggtgtaaacctgtgtacccttcgcttctgcaatcaaattctaggtggggatccccacacccactcaaaaaaacctctaagaaactttgttgtcacatgagtgcttgagaaaggttttggatggttcgcattgtttgacggtagatgaaaaggtgtcgagacactagaaaacttatgggagaagtttctctgtttaaatgtgtgacctgattccattagtttgagaggcaatagttgggataatggattcaatcattacatatttacatctggctcggtatgtaatactaatcttaaaaagtcaccttcttgtagcaaagatagtgccaccttagtttaagtcatactaggtggtccaaaatagccccttctgtatcagaccgcctctatggaaggtcattcaaaatgagcacctcatactggttttgtttacgctgtactgtaaagactgctagcagatgtagacactagacatgtagtgttctcattttcatttttttctctcatttcagccctgccccatttgctcccaaaggattacaagggatatgcttaaccatatcaccatgcaacatggttacttgttcaaggttcacctctaccttcctacctctctctgcagtaactgttcatttgattggtcaattcagttatnaagccttctgacaccatatttttgtttcgtacttacagaatggtcacagatcccgtagatttatgttccagagagccatgcgatttcattattgagtcgtgatctacgtggtactcatttacaggctcttctagggggtggtcatggccacagatcaaataacgcagtgaccacaaacatttccagtgatcctcttctttcatcgtttggcctgagcttctcagcatctgatgcaccagaaccatcaaaatcagcatcttctattccagacggtaccgcaatacgtaaggagacaccagttcagccttgggaatcaagcactgctgctctcctgatataagtttgctagattctttatggaccacatttacgattgttctccataaatttgaagctattttattaattacttgcatatctgctgaaaacgatctcatgatgaacctattgcatcttctgttctcctttagtcctttctattatccaattacctttacattggtttcttaatatatgctattgcctgaggtttggagttgcagtatgatagttcagacttccgcaaccaacgaactcttctctttcaatggaaataatcttagtcttaaattgaattcattgagcaagcggttctttgatatttccagcacctctgcttaaaactaaatcacaagaagggtacactgacaggtaattcgctttactgttaaaggatgcacattcatggcacttcagacaaagggatttcacttcctagatgcttttatgtttttttcttctcatttatgtatactgtcaagccatgtgctttagtgcttacaagtttcaagggctcgcttccttgtgtatgacacacatgaacttcagcttctgtttccttttcgatggcagtattgattcatctctcacgagcgaggaaagggagcaaaagcggaaacaggccaccgggagggcaacctttgtgcaaggcctagtgatgtcttctctattcggagattgatcgctcaagcagccctaggttcttgcacttgctagatcggctctttctcctgcctggtccgtcgtcagatagtgctccacccggttcggactctgatggcagggaaaattcgccccaggaaacttagccgcgttcacctttttttttttcagaaaagtgcgccgttgattctagcatgatgcagcttgatttaagctagctgttgctgtacctgtacctttgtttttatcaatttatcggccagcaattcttatctgtaaaaaaaaagaaaatcgtgctcgttaccaacatacatggtagctgtggcatctgcttacacaatgcaagaaaagacttgaaaattgctgcttttgtgaaggccncaaaancacgcttgtccacgtgaacgcgaattgtttctatcgtcaaggtgctctactctaaattgtagagaagctttatatcctctactttctttaatagcgtccactctctttaacagcgtcctctaaatggtactttaaatttaactactctcttcaattgcgtcctctaaatagtactccaaatttaaaatttattaggtaacattgttggattctatgtatataaaatttttctcttgtttaggaaaactaaaatatatacaatatatttgagagtatcataaatataaacaaaaatttaacttattaagatgtaaaattagtctattatttcgtgttctgtcattctcatttttttttgtcttttccattccctcttctcacacagtctattcccatgttctgctatcattccttattctgtcattctcattcagccc

SEQ ID NO: 7499 - DNA, 3583 bp, Zea mays
  misc_feature (1552)..(1552): n is a, c, g, or t
ctagatttatcatgacttgaactattataatatgaagttttttagtttaatataatttaatctcatatatattgttagtcaaagtttaaaaaaatctaggacaaatctaaaaggacagactcatatggacagagtagtaatttgtaacggagcgtgacaattgaagcagacgtgtgaacaaaatctaaaacatcacattagtattcttttagcgagtgtgatgtgagaggattatcaagaaaacatggtcaaaattttgtctatatcggtagtgacaatgaagtcgaaataacatttctcatttcttttcccctattattatattctaaaataaaccagcaactgcctgaaggtctctccgatatatactgcactgcacatgtcaagatgccaacgatggacctcactgttacgtctctcagctgagccgaaagtctgacgggctgtaccatttcttccaacgccctgccagcgcgagagaccgcgcgcggccttgacccatgtacgttgtcacgcagtctccgtaccaacctccacccggaaacgagcgttccgtcacgcaatccaactccacccgtctccactctccacccaccacggtaaacagcatcgtggcatcgcgtcacaactcacatctcgatcccgtgcatgcatttcctttttttttctttttgctcattttccttttgtttttcaaaagaaggctcctgggtacgttaacacaaaactaggaatctccagagagtgtactacttcagttgtaagcttcaatcaatcaaaaaggtagtactcgtgagacatgtatatatgcgtcctcgacgtgtcttatcgttagagatatggtagaaattaaaataatgttgggatcaccgttgcggctaatataatcacaaggtagaaacatgccgtacgtacgtgttctaagagcgtgtttggttaatttttaatccctattttatttaattttagtttctaaattgctgaaattaaaatagagttttaaattttgtatttagtaatttagaaactaaaatagaataaaataaagtgactaagtccgtataaccaaacatcttctatgggggttgtcggcaaatcgtatatataattgtgtaaaatattattttgtattttttatatattaaaatttaaaataggtagcaaaataagggtgaaataagaaggctcatggagatatctctcttattcctctctaatttctcgtgatccctgatcaccaaatcagccttaagcatcaattcaattccttagtcctacttggcgacaatatggtttgcagttggtaccttttggaaacatcgcgacaacatggttgtgatgcttggtgtaatatttctgttatggcaatgtaaagttcctctatcatgtaaacggtgtgaaaccttgaacactcagtctattttggtggcacatgggaatgaaaatgaatcactaacataacgaagaaaatttttgaatttatcacacgaaaataatataaatagattttagtacgaaccgactaataattaaagcatctccaaaatactangctcgtaaagctaaactttgactatttaacagaaaaataaatatccaacagactcgttgtttgactcgtcgagctatcagactctctaaattggctctctcattagttaaactagatagatagttagttagagtgagatgctatagagtgtaatctttataaatcggccgcttgtgtgtcgttttgtgtggtaaaaattaaaagtcacttgcagatgcgctcttaatacttttagacgactatagttttaatacattgaatttgctggctctcagtcttcgaatatacttacaaaggtagtgtttacacgtgtacgtttttagatgtgaatgtgcacaagctagcgttgtgaatctctatgtgtgtactgtgtatgaagaataattggtcatacgtaatatacacaattggtcatgtacatataacagatgcccacgtacgtacgtaatcaacacgatatcgcttgcagtattacaaagacgtacgtggctgtgtactacgtagatataccgcgcgcggacatactcgtctttgttttgttgagctagcgatcaatccatggagtagcagatgtgtttgaaggcatcaacgtggtcatcgtcgagagccatgaagaggtcgacgccacccttggccgcgcacgacggcaccaggatcatgagaccctcgacggggaggtcgggcggcaggaaggcgcacggtgccccgtacccgaagtcgaggtcatggaatctgaaccccagccagctgtccacctccaggtccgggcagaaggccgtgcccggacccgcggccgtggacgccagctcctcgccggcgcgttccgccatgtccccgaagtcgacgaaggactggatgtactcggcgtcgacgcgcgcgacggcgtcgcggatggcgccgaccaccgcggcgtagctggaggacagcagctcccgggcctgcatccgcgggaacgcccacagcaccatgttaccgaagtactccatgggcaccggagggtcggcgcggcccctgcagttcacggcgacccttatctgcgtgaactcctccggcgccaggtcccgcgccgccgtgaccttctttccagacgtgcgccagggggcactggaacgtggtgcaccggccgcccacgcgggccttgaggtcggcgatgaactgctcccggaagttgatgccgaggttcttgatcctgtccatggggaggacgtcgtaggggcggctcgagctatgctcgccgcggaactcgatgttccggtggtcgaacctgggcacgggcgggttgcgtgggacggcgatgccccgcgcggtcggtgaagggcgacggtagatcggctgccgaggcgctgcgcacggccgtggcccaggccgcgtagaaggagctcatggactgcccgtcggcgacgaggtgttggcacaccgtgccgatcaccaggccgccgcacgtgtaccgcgtcagctggacctggaagagaggctcgtcctcacgttccttatcagccttggggtacagttcgttgatgtgcgccgtcacgtcgtgagccaccagcgcgtcggcaaggtcggcgtcggcggtggcctccacgacaagcaccccggcgtcgttgaggaggaagcacttcctgccgcggtcgtcgacacccatgcgggccgacaggtgcgggtacctcgcgaccacagcgaggaggccatccactatggcctcgttgtccggcgcaggcgcgtaccacgcgaagacggtcgggatgtagccgtcggtggaggcgcggtcgaaggacgtcagccgggacaggctgccgccgccgccgcgggaggacgccggtggtgggggtttcagcaccgtgcggcgcgttatgtccaccgtcactaacgtggtcgtcatcgtcgtcggcttagcttggtagctgctagctaatgatcaatggactagctagctagcagatgatgatgagaataatgattgtgatgaaaaaccaacaagtgagttttttcctcaatgatatgcgtccccgcccgccccagcgttcccctcgg

SEQ ID NO: 7500 - DNA, 759 bp, Zea mays
ctgaagcgtcgccggatcatattgaggacacatggatgcaggtaactctagtattaatcgcaatgtgtccacctcttaggtgcttcagtctacctcttaatactgtgacctgtgcaatgaaattcaggagctaaatgctaacagaccaccaactccgaccagggggcgtccccaagcagtagctaatgaacggggctctctcgcctggatatagtagattcattacacattggttggtatgatccatatgaagcctgagtgatcaggatcttgttatttcatttgtgttcgggagaggggttggtccacagccatacggaaacgaaaggttgatgtacagggagcagagaggactaaagtcggtagaagtgagcttgatctaggacagtgctctccaattcgttccattgaacacaagtagcagtacaaatagaactcatcctaagatccttggaggcttcacttgtatatactcagctgggtggataggtggtgggtgtatggtgtgattttggcatccaattggaatggcaaaggtaatagtgttattgtactaggaattctttcccttttttttctttctcggggcctagaattctcatgttgcaaattatttttgagttgccacagagatttgccaggagggctcgaagtcatgttgttttgtataatagtgctctcagcctcattgtaatttcagacacatgctgatgtgtacaattttgtgttaaagtttgagaatttttgggggtggaaaaa

SEQ ID NO: 7501 - DNA, 1714 bp, Zea mays
gcacgagaccattacctagaacatcctaatcgaaaacgcccgccgctatcatatccatccccgttctcctcctcgccgtcgccactctctttgcgcgcgccacgccgaaaggtgagctgccgggcgtcgtctatagacgtagagcggggcagagggccgtgagctttgggagaggaggagataattaatggcggctaaggagagtagtaggacgatgaaggcggcgcgctctgcgggaaggatcggggtcgtggcctctgtggcgatgaacctcgcgtggcttgcgatgtacatccgccagcgctacggggagatcaccacggtggaggcgtcccgaggcaagccgccggtcactcaggactccgtcgtcatcctcgatcacggcgacccggtcatgtacgaggagttctggcgccgcgagggagacagcgcctcgatcctgatccccgcgtggcagacgatgagctacttctccaacctcggcggcatctgctgcttcctggagcctggcctggagcgcgaggtgcggcgcctccaccggctcgtcggaaacgccgtggtcgatggataccatgtgatcgtcgggactgggtccacgcagctgttccaggccgtgctatacgcgatctcgcctgcaagtgacggcacgcccatcgacgtcgtctcgccggcgccttactactcgtgttacccagttgcgtcgagctttctaaactctgggctctaccgttggggtggtgacgccaatacatttgccggcgacgacaccagctgtgttgaggtcgtctgctcgccaaacaaccctgacggtggcatccgacatgccgtcgtcaagtccaaatccagcaaggcgatctatgacttcgcctactactggccgcagtacacgcccatcaccgaggcggctgcccatgatgtcatgctgttcaccttctccaaatgctccggccatgccggtactaggctggggtgggcactggtgaaggacactgaagtggccaagaagatgaccaagttcatggagctcaccacgattggcgtgtccaaggactctcagcttcgtgccgctaagattcttggggcgatctgtaacggctatgagcagctgccatcccccgcgggccaaacaagaagccacctcttccattttgctcgggagaaaatggcggcacgatggactaggctccgcgcagctttggcggcctcggacatctttactctcccagatgagctatctgagtactgtggtttcttcaagaagactgtcaccgccaatcctgcgttcgcatggcttcgctgcaagaaggatggtattgaagatctggagagctttctacgcgagaacaagatagtcactcgaggtggcacaaagtttggagtggacgggagggttgtcagggtcagtatggttgacacagaccaagccttcaacgtgttcctggatcgtctagccacgatgaagtgagatactactagtgcaaataaacactttgtcgctgcatggatggatgacattgttctaagtttagtgcaaggatgatccttcggaaaacttaataatgttctatttgttctataattagatcatgttttctagtatagtagaatattcactgtcaaatgctatatataattgaggttgtgatctatttgattatcataaaaaacaatttaagtatggatggcaatcatatacgaaaaaaaaaaaaaaaaa

SEQ ID NO: 7502 - DNA, 3869 bp, Zea mays
gcctccgcccgcgaaccgcagcagcgtctccaactctccatcgatggcggaggcgaacgtggcagcggcgtcgctcttcggcgctgacggccgcctctgctcagccgacatcctcgcgccgcctgaggtccgggctaggatcgaggtagcggtgctcaacttcctcgcagcgctagcctccccttcctcgccggccatctccgtcctccccctgattagtcggagctctgccaactgcagcctgcgcagtgggttgctgaacgacgtctcgtcggtttatctctcatacaccttctgcaagaggtctctgacgcacaatccaaaggcgttcgtaagagtgtggaaggtcatggagatgtgctacaagatcttgggggaggggaagctggtccagcaacgggagctgttctacaagctcctgtccgactcacccaagtacttcagctgtcaacgtcatgtcaaccaagccattcaagatgttgtttccttgctccggtgcacaaggcagagcttaggagtcatggcatcaagcagaggggcactcattcccacgcgtccgcccacgcgtccggacggggagcagattgattgctccattcttggagcttcagggcatgcaattacgggggacctgaacctgttgagcaaattaaatttgtcttcgggctctcggtacatcattgtggtggagaaggatgccgtatttcagaggctggctgaagaccgcctgtataatcagctcccttgtattctgatcactgcaaaaggatatcctgatattgccacaaggttcatcttgcatcgactgagccagacatttccgaatatgccgattttcgcattagtggattggaacccagcagggcttgctatactgtgcacttacaaatacggaagcatatcaatgggcctagagtcatacagatatgcttgcaacgtgaaatggctcggggtgagaggaggtgatctgcatcttatccccgaggacgcgtttcaagagctgaagccacgtgatctgcagattgccaaaagcttgatgtcgtcaaagttcctgcaggagagtcacagagctgagctggcgctgatggtggagaggggcaagcgtgcagacatcgaagccctctactcccacgggttcgatttcttggggaagtacatcgcgagaaagatcgtgcagggcgattacatctgacgattggccgctggaatgttagcatggttgcacggaacaatgagctgcatggactgtagtacagtagctatgtccaactgcctgtagactgaaacgatggtctgtatgggaatgtacataaatacaacaagagtagtctaatatcgatcatcatcggccaccgaatcacatgggttttgactctcttgagttctgatgttcagtggcggtgcccggtgtatggtccggcactccggccgatgcagcctgtggatggcaggaccgggaatggatgcagggtgtagggtgtcagtatactacgcaccttgccggcgatcacctccgccatgcctaacctttgccctggcttcatcttcgccgttgcagcctgcttgaggtcagtgtaccgaccgaccgaacttgtactgaaacatgatcgtcagttcaacaaaattattaaacatggatacatccgcagtcctaaggtctaacttgtaactgtggatgtgttattaggtttgagaggtttcactgcaagtgcagccgtgcaggtacacctgagcgaagatcttgggcactcagcactctggtgtgccccatcggggcaatgtgcgtgagcttcctcaagaacccccgcccaggcggcgaagaaggcaggcacgactggatactgtcttctggccggggtcacgatctgtcatgcaggtgcgtactacatctgaacttcaaagcctctattgagcaatagctgtactcacacacaatttttttttgcttgttattacaagttcagatggtgtacacgactacccaactacaagtggcgttatttgttcaatcaacaggcacaggcaccggcaccctagggatagcgaccagcagcagctcagagcgtgggggcatggtgatcccagccgcctccgtcacgtccatctcctcagcaaccatcccctccggcatctcccagtcgaaatggaacagcagagcagcgagcgcgagctccacatgcgctaggcccaaggccgcgccagggcacatcctcctcccggcgccgaacgggacgtactcgaagtccgccgcccccctgaagtcgtccctcgcgccgtcaagctcctggaacctctccggcgcgaactcctccggcgcgtcccagtgcgccgggtccctgccgatcgcccacgcgttcaccagcaccatggcgccccgcgggacgtggtagccgagcacctcgcgtgcgctaaggcactcccggagcagcaccggcgccggcgggtgcagccggagcgtctccttgatgactagccgcaggtagtgtaggtcggtgaggccggcctccgtcaccgtgctctgccccgcgagcgccgaccggacctcggcctgcgccttccgcatcgcccgagggttccgtatcagctccgtcattgcccactgcatggccgtcgccgacgtctcgccaccggcaacaaacaagtcctgtgtgtctctctgtggcgacgatggctgaatgtgcgatgtaacagggaagggattgaaggagagaggagcaagatacataccatgatgacggatttgatgttgagggtggtgaaagggtactgggagtccacgtccttctgcatcctcaacagcaaatcaagcaagtcctcgtcgtcgtcgacatcgctgtctctcctctccaggtgctccaggacgatggagtccacgacggcgtccagacccggaccgatgggccgcatagcggcgcggcggcgcgcgaccacgcggggcacgtggctggcgagagcggcgaggcgtgacgacgggaagaagtccagcaggctcagcttggggagggtcttgagcgcgtcctgcagcgcccgcaggacctcgtcacggtgctcgctccggctgccggcgacggcgcgcgccgaggagtcgaaggcgaaccgcgacatgcgccgggtcaggttcaccggcgcaggcgcaggcgcggacgcggccgcggcgacggcgcggaggaggcggccgagctcgtcctcgcgcacggcgcggaaggagcggacgcggggcgcgctgaagagcccggcggcgcaggccctgcgcatccgccgccacgcgtcgccgtacggcgcgaaggtgacgccctccgcgccgccggtcaggagccgcagcgccggcgcggcggggcgcgacgcgaaggcggcgtcgtgggtgccggtgacctcgcgcgcggcggccggggacgaggccaccaccacggggacggtccgcaggcggagcgccatgagggggccgtaggtccgcgagaggtcacgcagggcgcggtgcgggggcgcgtccccggcgacgtggtgcaggtggccgatgaccggcatcgcccatggtcccggtggtagcctggcgtcgtccctcccaagcgcgcggcggcgggccagtagcgcgacgacgagtggcagcgcgagtagaggaagcaggaggatgtacggtgagagctcgtcagcggccatggcaaacgacgttctaccaccaggctacgttcttcgtcacgtccttgcaatgggacgctccttcagcgctgaacaaatagctggttgtacgcacgaacatgtgcatgtacaatataaagtacactgtacaagtttgattgcatggctgatggcacgtccccagcttgctgacggattgaaagtatcaggtgactgaaaacgtgcaactgaag

SEQ ID NO: 7503 - DNA, 935 bp, Zea mays
acctcgagccggccgggaaaggcacgagaccattacctagaacatcctaagcatacaacccctcggacagaccagccttcaaactagggtttactcctcccgctccgagaaagcaaacaagcgtcagctccgccggcggcctcgcgctctctcccccgccgcaccttctctacgccaggactgccaagatgaagctcgtcagattccttatgaagctaaacaatgagacggtcaccatcgagctcaagaacggcacggttgtccacggcaccatcaccggtgttgacataagcatgaacactcatctgaagacagtgaagcttacactgaaagggaagaaccctgtaacgctggaccacctcagcgtgcgaggaaacaacatccgctattacattcttcctgacagcttaaacttggagactttgctggtagaggaaacccctagggttaagcctaagaagccgactacaggaaagcctttggggcgtgggcgcggccgtggtcgtggacgtggtcggggacgggggccgccacgctgacaggtttcccctgctgtgggctctcttgcctgacaagttccctgtacgatgtaacctctttcccccgcacgctgtgtgaaagaaccgttgcattgttacccttctgatgaacgtggactgaaatatctcaatctcaagtggttcttgtgaaatcaaccatgtctatttggtctaccattcgtgtgtgtcttagggtttacactgtagttaactcgtgatgtctttcccctggcatacataaatggtgccgcagaacttcggatgttctaggttgtatgcttgtttcacatggggattgttgatctggagatatgcaataaaaacgtgtctgcctccatttgatcttttagctctgcttgaagctgaattcccgtcgaccggagatactgattttgc

SEQ ID NO: 7504 - DNA, 911 bp, Zea mays
ggggtacacctccccgccagatcagcattcaaactagggtttactcctgccgctccgagaaagcaaacaagcgtcagctccgccggcttcctccgcgctttctccccgccgccgccgccgccgctccttccctacgccaggcacgccaagatgaagctcgtcaggttccttatgaagctgaacaatgagacggtcaccatcgagctcaagaacggcacggttgtacacggcaccatcaccggtgttgacataagcatgaacactcatctgaagacagtgaagcttacactgaaagggaagaaccctgtaacacttgaccacctcagcgtgcgaggaaacaacatccgctactacatccttcccgacagcttaaacctggaaaccttgctggtagaggaaacccctagggtgaagcctaagaagccaactacaggaaagcctttggggcgtggtcgcggccgaggtcgtggacgtggtcggggccgggggccacgctgagctttatcgttcccctgctgtcggctcccttgcaagacaagtttcctctacaatgtaaaacatctttcctctgcacgctgtgtgaaagaatgttgcatcgttacccttctgatgaaggtggacgaaatatctcaatgtcagtagttcttgctgtgaaatcacgctgtctacctggcccccctactcatgcctatcttaggtttacactctagttaatttgtaatgttttttttctcccccgtggaatacatgtaagctgccgcagagctttggatgtctagggttgtatacttgtgtttgccacatgggggggactggggattattgatctggagctatgcctgtggctggctctgttagatcttgacctctgcttgaagctaaaattaccattgtgctgctcgggggctcgc

SEQ ID NO: 7505 - DNA, 2772 bp, Zea mays
aaaaacctctcacttgcacgggagcacgtacagtcgtacacgctgagccaaagcgatcggcgccgcggcgttaagacgtcggcgacggcgacgatgacgtggcacgaggacctggccactcacgtggggaacacgggcgttcgcctccccggcgccggaggccacgcgccggcggcggcgaatgttgctgcggcgggggccgggtggtacggggaggaggaagaggggagggcggaggaggggtgggcgcagcaggcgaaggggttcgcggagtcgacggcggagatgctgcgggagctaggccgggggctgtgggacgtcgccgcgcagagcctcgccggcgccgaggacagcgaggtggcgcggcggctccggaagcgggcggcggctacggggaagcgcctcagcttcatgaacgagtacctccccgaggagcgcgacccggtgaggtgttggctcaccgtcgccgcagtcgcattcgtctcgctcctagttttaggttttgggagtggcaatgaaactccagtagagcttccaaagaaacttatcatcggccccccaagtgctgatagaatccaacttcctgatggacggcatctggcttatcaagaacaaggagtttcagctaacagagcaagattttcactgatttatcctcattcttttctttcatcaaggctagcaggaatccctggaattagtgcatctcttttggaagaatttggagtacgacttgtgacttatgatcttcctggttttggtgagagccatccacacgtaggccggaacctcaattcttctgcaatggacatgctctatctggctaatgctctcaatattcccgggaagttctggcttgtgggctattctggaggtggcatgcatgcctggagtgctcttcattacattcctgatcgcattgctggtgcagcaatgttcgcacctatggcaaatccatatgactccaagatgaccaaagatgagaggcgtaaaacatgggatagctggtcaacgaaacggaaactgatgcacattttagctcggaggtttccgtcactgctaccgttcttttatcgccaaaccttcctttctggaaagcaaggacagctggagagttggttgtcactgtcattagggaagaaggacaaaactttactggaaggtcctgtgttcaatgcattctgggaaaggaatgttgcagaggctgtgcgccagggagatgcaaggccatttgtagaggaagctgtgctgcaagtatctgactggggtttcagcttatctgacatccaaatgcagaagaaagaggctgggggattttttgagctcatcaagtctctgttcaatcaggccgaaagagagtgggtgggatttctgggcccaatacatatatggcaggggatggacgaccgagtggtctcgccggcagtggccgaatttgtgcggcgggtggttccaggagccacggtccacaagcttcttgacgaaggtcacttctcatacttctgcttctgcgacgagtgccacaggcagatattctccaccctcttcggcattccccagggccctatcaaccctgcaccgccgcagccaggcgaggtggtttcagagctcaccgaggaaacaacagtgccagacaatgccacagatgaggaacaaggaaaatcaggcctgccctgattcaagatcggtttcaggacccacaagtatagatacgagaccttactgctactaaaacacaatacctcaaatagacgggcttttcttcgctgcccatgggagcagcctgtgaatcgagctgctcctcttgcggaagtcgtgaaggcaaagcattggatggaggaggttgtgccgtctcagttcgatgtacaaaaatgctcatcacaaattcgcacggcacctgctcggtgcgcttttagtatagtcggtattacaattcgattaacctgttatgactcagctatattataggcttctttttgcacattatggttgaattgcgcccgcagctgaatttttgttcctttactagctatggcatgatccaacatcccgatccagcttaaggccagtaatgtattcgcctcttgcatgatgtaaaaaagttcgtctcttgctgcggatgtgcggtgctgtgtgataccgtgtgagtgttttgtgtgttaggtgttgtagagcgcagtacatttggactgtgccaaacgggctgggagcctgggacaaatcacgaaattggaggcacgatctaagactgacacggccacgaaattggaggcacaatctaagactggcacagagtagattaatcgtgggcctaagccggtatagcataatatgtgagtggtgtttggacttcaactaagcacacggtctggtctggcctgacacgacctatttaactaggattcatcaaaaatcactgaatattaaatatttttgagctagttatatttttttatgaccgaaagtttttaatgggacaaccacaaaaggctcagtttttttggtcatatatgttccgtacttttgtttatgttttatttcatatgatttgtttcattacaacacataattgaggttgtattttagtggaccatgctttaatgtgtctgggccatatcggagcgggccgacccagacgtacatatacaggacctacgtagaggtgagtgacggttcaagcctcaactcatttctccgttgcaagcgatagagtccagatttaaccatttagtccctcgttcaatccaacttaggccttgttcatttatacca

SEQ ID NO: 7506 - DNA, 3334 bp, Zea mays
  misc_feature (2007)..(2007): n is a, c, g, or t
aagattttcactgattgctcctcattcttttctttcgtcaaggctaacaggaattcctggaattagtgcatctcggcgtgtcgcggccggggtacgacttgtgacctatgatcttcctggtttggtgagagcgatccacacataggccggaatctcaattcttctgcaatggacatgctctatctggctaatgctctcaatattccggagaagttctgggttgtgggctattctggaggtggaatgcatgcctggagtgctcttcgttacattccggatcgcattgctggtgcagcaatgttcgcacctatggcaaatccatatgactccaagatgaccaaagatgagaggcgtaaaacatgggatagctggtcaacgaaacggaaactgatgcacattttagctcggaggtttccatcactactaccattcttttatcgccaaacctttctttctggaaagcaaggacatccagagagttggttgtcgctgtcattggggaagaaggacaaaactttactggaaggtcctgcgttcaatgcattctgggaaaggaatgttgcagagtctgtgcgccagggagatgcaaggccatttgtggaggaagctgtgctgcaagtatctgactggggtttcagcctatctgacatccaaatgcagaagaaagaggctcgaggcttttttgaactcatcaagtctctgttcaatcaggctgaaagagagtgggtgggatttctgggcccaatacatatatggcaggggatggatgaccgagtgatctcgccgtcagtggctgaatttgtgcggcggttggttccaggagccacggtccacaagcttcttgatgaaggtcacttctcatacttctgcttctgtgacgagtgccacaggcagatattctccaccctcttcggcattccccagggccctatgaaccctgcaccgcaacccagcgaggtcgtttcagagctcaacgaagaaataacagtaccagacaatgtcacagatcaggaacaaggaaaatcaggcctgccctgatcaagatcagttttcaggatcaacagtatagatacaagacattactactaaacacaacacctcatatcgacgggacaggcttttcgtcgctgcttgtggactgagctgctcctcttgcggagtcttgaaggatgaaggcaaagtattggatagaggctgtgccgtttcacttggatgtacaaaaatgctcattacagattcgcacggcacctgctcggtgtgcttttagtatagtcggcattaacattcgattaacctgctatgactgcattataggcttcttttagcacatttgttttggcatgcgaacccaatggttcaattgcgtcctcagctgaattttgttactttgtcagggactgtttgatgtagctccactaactctagattgacctaattcagctttacttcacaagaaaaaaattagtcaaacggttcagtttcactaaaatggtgaatctgggggctatatttacaattttggtggacctccttaaaggacgctctatcaacttaagtttggtggagttgactaatactatctcagttgaccttttttaagaaaaaactttgataactcgttttattcaaaatatttaatagaaaatgtaaatttaaatcacgcttaaacgaccttgaatgataaaacaaattacaacaaattaaatgataactcacgattttcttaataaaactagtgatcaaagtatttgaaaaagttaacagcgtaatatattcgtgaacgaacaaagtaatatattcgtgaacggagggaatattagttatgtagtctattagtttgttcttatttttcgttgcttcttttctatacttttacttttttatttatggttggtagttgcgtcctgcgcagcatcgacgattgctccccaaatcgattctctctccctcacacagccacaccaactattaccaccatcggcagctcctctcccctctcgagaagcntcccctctcgagcagccctggctccttcggtcgagcatgccctctccctcacttggtcggtcatgtctgcgccattctcaccttggtcgtccgatcatgtcgaccacctttggtcgggcgtgccctctccctcacttgatcggtcatgcctgcgccattctcacattggtcgtccgatcgtatcgaccatctgcctataccatagggctaggcagaaagcccgtaatccgaaacttgaactcgaaatacccgaactcggacccgaaacctgaatttcgttcgagaaatttgggtgacaacttgtagaacccgaatttatttcgtgtaattcgggtacctaaaattctcgaattttcatgtgacatatactcatatcattgctaattattaatttgtgcatctataattatgtgtaagtgtttacgacttgtgattgtagattgcctgtgttttttaagtgcatgtatatcattattcaaaatttgtttttgtagtaatttaatagggtgtttatgaagctgacacgacaggtcaagtagttcaggagtactcaaacccgaacctaaaatttcgggtacccgaattttagggtattgtaaaacctattgtaattttggtactaattctcagaacctggactttaaatatccgaattacctgattcgaaaatttcgagtaacccgaacgtccacccctatattgcccagctatgcgatcgcgccttggccggtcgcccacacttattatgtgtcactcagtcatccgctcactacatagtcacctacgtctctggtcgtgtctgtccacaactctttcatgatgtgttttcttttttagagaaagaaggaacaaaatacattaacacatggggtctatcctaaggacaacataattaacttcaactaaatgcccctgcatggatatgaagttatcgcatttaccaaataattccacgctggatcttagagtcactagtgaagttgttccattgtgaatcctagattcaaattcaaattttaattagcggagctctaccaaataaaataggcccttaagccttaaggccttactagttatgacatgatgcaatagtctaatcccgtttaagtttagacccttttctagatcctactcatgtggaagtctttggtactagatctactctttctatggtctttgtgatgtatacacaaaaaataccataaatgcgaacacaaggtggagatgtgcccttatggtttgggtctatgacacatgattataaacaaagtagcatcttggtttgggccctgtggactaatcaggtgtgagtatgtgcaacatgtct

SEQ ID NO: 7507 - DNA, 1312 bp, Zea mays
  misc_feature (222)..(222): n is a, c, g, or t
cacttttcaatttttgtgacccactccagcactcctgcatgccagtacaactccgtggcagttgcgagccgccgtgccgcctctcacatttcctacggcctagatccgtggacgctcgtggtcgtggggaagaaagcaacccgggcccggaaccaccaaagccagagacacccaccagaaactcctagactcctagtacagttttacccacacagcctagcnggacctacaagtcagccaaacgtctcaagctcgccatttcgcctcggtttccagctcccactcctcccttcctcgcttcccaatctaaaaacctctcacttgcacgggagcacgtacagccgtacacgcggagccaaagcgatcggcgccgcggcggcaagacgtcggcgacggcgacgatgacgtggcacgaggacctggccactcacgtggggaacacgggcgttcgcctccccggcgccggaggccacgcgccggcggcggcgaatgttgctgcggcgggggccgggtggtacggggaggaggaagaggggagggcggaggaggggtgggcgcagcaggcgaaggggttcgcggagtcgacggcggagatgctgcgggagctaggccgggggctgtgggacgtcgccgcgcagagcctcgccggcgccgaggacagcgaggtggcgcggcggctccggaagcgggcggcggctacggggaagcgcctcagcttcatgaacgagtacctccccgaggagcgcgacccggtgaggtgttggctcaccgtcggcgcagtcgcattcgtctcgctcctaggtaaccgctgatctcgcgtccgccgctcttgtccgcgtcagcgccgctacaccccgcgctcgcgtgacgcgtctctgccccttcctgagcctgcaactgtggttccttgcgtcacgcaacatgctgtatgggttttgtctcgtatttgttcttttacggggatggatctaactgactgtggagaatcgggaataaactcgtgtttcagttccaaaaaaaaaaaaaaaattgaattttggattgtaacttctctctgtgagcagatatctagtctgtagtacgtttcactgtccagttggtgggaaaacgtggcattcgcaaccatacattttcagaccctggggtcatgcctagtttactcgctcaacgttgcgttgacaagaagaacccacaactacactactgtttcatgcgtattctgggtttgtgtttgatccgctgaatcattgcaatggttaaggataccactagtcaattgttttaccttttgagttccttgtcacggaatggg

SEQ ID NO: 7508 - DNA, 1052 bp, Zea mays
  misc_feature (19)..(19): n is a, c, g, or t
  misc_feature (689)..(689): n is a, c, g, or t
gttgttcaacggcagcggnacggcggcgtggtgcacgggcacgggtggacgctggacagcaatgcccgggaggccaaggagcggctggaccagaagctcaggaccaagagggaggccgccatcaagaggcaccacagcacggggagcataaagctgggcgtgccgcaccggagcgccggcgcggacgagcgcggcgagagctccgcgccggcgatggccggcgtgcagcgggaggtgtactcgaagaagggcgtgatgcggcggctgatgcggtggagccggccgcggtgggccgcggcggagcaggcggagtgcgcggtgtgcctggacgagttccgcgcgggcgacgtgctggcgcacctgcgctgcggccaccgcttccactgggcctgcgcgctgccctggctcgagggcacctcgcggtgccccttctgccgcgccgccgtggacgccggcgccgccgccgccgccgacggcgcctagagcggccgaggctctgtctggtcttgctggggcttgcccgtgggacggagccggtcgccttgtcgctgtcggcccacgccaagccacgctaccccccatggcgttgccacgctaggcagtggctagtgggggtggtcatggtgagtggtgaccggcctgcttgtgtggcgcggagcggaggaggacagcgagacgcgcacgacganacccgtgagtgccttggcagtttttgcacgctttacgcgcgcaaaggcacacggttggtgcacatttgttggttgggccgtttggcccccctttgccgtgtcctcctcccatcatcgcgagcaactgatgaacggttttgttttcgtgtctggggagcgctttgtttatgggctctggtgttagcggatagcggttccatatcatgtaattcatgtcaaaaaaaaaaggtcgtctgatctgatcgatctaggagaaagaactgtaattggtttagaccaatcacatctgtgtacagtctcagtgttgttgctgtttgctcagttgaaggtaaatgcagttggaggtgaggtctctttagaacg

SEQ ID NO: 7509 - DNA, 3793 bp, Zea mays
ctaagctggttcagtatccaactgatggcaacctcgcaggtgtgacgcttcatggcagcggcgtcccgatcttatttttgtatgcagtggagtgtcctatcgccagcacggcaccactcaccagtggatgatcgtcacgatgcgtggagaaggagaaacgatagcgaaatgcggaatgactgaaccatcgagatggggggaacgggccgggcccggccgggcccggcgctcacaccgctgtagccccgtcccactcccacgtcccacaccacaccgatagtaacgagacgtggggcagccggtgcgagccaggaggaataatggcgggcgccatgcggctgtctggccgctgctacccggaagcttcggcgaaggcgccatggtccctctcacacctcaccagcttcccggccggcccggaacggacgacgccgcgctccgctccctgctcggcgccggcgccgggccgttctcgctcgctctcgtctcgtctcgtcagccgtcagcagggggttcagttaccatgtgtcccccggctacttttgtcctgtcaggttgccccattccttcgtttcgagagtcgagctctgcccgtcgcggttgcattgcagcactgaccaccaaccagatcggaactcgaaggcacggctcttctcgtgcctgtgtctgtgttcagtctcacttggcgtttcactgaaaaatctccgtcgaaaaaaataaacaaaaaacgtcaatgcggtagtttccaggtgcagcaacaacagtgcaacacctacgcacagagtcacagtcacagactcacaggtcggcagggggagatctttccggaggcgccagtgccggtggcagtttcaactttcaacgcgagaatagatagatgcaggtcgggcggcgatcacatcctggagtgtggtgtggtggcctgacacgacctgatccgaccccaataattctcgccgtctcactcaccagtggatttcctcgccatcccgcgcgggccccgacgtcgtaccagaccgatgccatgatcccacgattcccaccccctcccccggccggcaccccacgtcgtggcgaggcagttggccgctccgccgcgcccccgcccccgcccttgtcaggacacgagtggcagctattaaagcgcggggtggggatccttgcaaccagagccactgccaccactgctgcccacggccacccacaccacaccacaccaatacaccataccagaaggagcaaaaataagacgagatggcggacgagcgcttgcctcaaacggccggcgcccgcacggctctcgccagagctactggatcctcggcacggaaacgcgcccgcgatagttaggtgcgcctgtgggcccggccggctcgtcacttacataggcgcacgcacccccgcctggtgcgtcgtcgatcgctgctttgctggcgcgcggcggccctgtgtggcacagtagaggtctgctgaggacgacgaccggaggcgtgctgcgtggatggtcctcatggccgggatgctccccggcgtggagtgcgcgcggcggcggcgggtccggcagggcggggcggggatgggagcggaggcggccggaggaggcacggggcggcggtcctccttctgcctgtacgcggccggccacggcggcgccggcaattctggcaaggtaggagaagcacagcacagagattcacagccgtctggtcctgttgtcgcgatgtataagcagcgtacgtaaaggcggttgtgttgttgttcacggcagcggagcggcggcgtggtgcacgggcacgggtggacgctggacagcaatgcccgggaggccaaggagcggctggaccagaagctcaggaccaagagggaggccgccatcaagaggtagacgcagacctgccacccgacacacacatccatattattcatccatcctccacgggctttgcttgtgttccgtgccagtctgaacaacactagctagctaggtcgttgttcctaaagatctgaccttgcagcaggcaccacagcacggggagcataaagctgggcgtgccgcaccggagcgccggcgcggacgagcgcggcgagagctccgcgccggcgatggccggcgtgcagcgcgaggtgtactcgaagaagggcgtgatgcggcggctgatgcggtggagccggccgcggtgggccgcggcggagcaggcggagtgcgcggtgtgcctggacgagttccgcgcgggcgacgtgctggcgcacctgcgctgcggccaccgcttccactgggcctgcgcgctgccctggctcgagggcacctcgcggtgccccttctgccgcgccgccgtggacgccggcgccgccgccgccgccgacggcgcctagaagcggccgaggctctggtcttgctggggcttgccctgggctgggacggcgcggggcgccttgtcgctgtcggcccacgccagctacgctacccccatggcgttgccacgctaggcagtggctagtgggggtggtcatggtgagtggtgaccggcctgcttgtgcatgtggcgcggagcggaggaggacagcgagacgcgcacgacgaacccgtgagtgccttggcagtttttgcacgctttgcgcgcgcaaaggcacggttggtgcacatttgttggttgggccgtttggcccccctttgccgtgtcctcctcccatcatcgcgagcaagtgatgaacggttttgttttcgtgtttggggagcgctttgtttatggactctggtattagcggatagcggttccatcatgtaattcatgtcaaaaaaaaaagatcgtctgatcgatcttggagaaagaactgtaatttagatcaacatcaatcacatctgtgtacagtctcagtgttgttgctctgaacttgtataattttctgtttgctcagggggggcctcttgcggttggaggtgaggtctctttagaacgtgatgctaatgtaggatcttgttcccccatgaccacgcaggatattttttttgttctgttaaaattcccgcagtgttctcgcggaacatatgcttccccgaaggatgctacatgatcatgatgcccatacatgtggtcgtcgtggatccgcattaccatatactcggggtgtacggacccaacggtttctccagccctcccacaggccacagactgctgccctagtaggcggcgtccccgggctccggcgactctgctgcagtagctagctgcagcctcctgcaggaggaccagaagcgcagaagccagccccaactcccagagtcccagttccgctttccggtgagatcgcggctggtccttctccagttctcctccctgtcctgccactgccaccgcaccgcacgactctgaacgctggcaatgcaataggcaacggcaaagccggagacacgcttggttttggctctgtccgtgtccgtgcaatcatccatttgctgccttggccccctccggcctccctgctgggccctgggcgcgcgtacgtcatcacgtgtcctgcctgcgcccccggagcgagcggcagttcttgtcgccacgcctctaatggcgcgcatgcatcgcgtcagtttcgatggcgatggcaccagcaccatggcgccgccctctttaccagttaccacccgcctccacacacacacacacacacacctctaatggcggtgagaacggctgttagtggtgcgcgcgcaagtggtgaggatctctctggtctctatgcttatcatctggagaagacctataccctcgtgttccgaaacctgcaggcatgcaag

SEQ ID NO: 7510 - DNA, 1541 bp, Zea mays
agagccactgccaccactgctgcccacggccacccacaccacaccacaccaatacaccataccagaaggagcaaaaataagacgagatggcggacgagcgcttgcctcaaacggccggcgcccgcacggctctcgccagagctactggatcctcggcacggaaacgcgcccgcgatagttaggtgcgcctgtgggcccggccggctcgtcacttacataggcgcacgcacccccgcctggtgcgtcgtcgatcgctgctttgctggcgcgcggcggccctgtgtggcacagtagaggtctgctgaggacgacgaccggaggcgtgctgcgtggatggtcctcatggccgggatgctccccggcgtggagtgcgcgcggcggcggcgggtccggcagggcggggcggggatgggagcggaggcggccggaggaggcacggggcggcggtcctccttctgcctgtacgcggccggccacggcggcgccggcaattctggcaagcggagcggcggcgtggtgcacgggcacgggtggacgctggacagcaatgcccgggaggccaaggagcggctggaccagaagctcaggaccaagagggaggccgccatcaagaggcaccacagcacggggagcataaagctgggcgtgccgcaccggagcgccggcgcggacgagcgcggcgagagctccgcgccggcgatggccggcgtgcagcgcgaggtgtactcgaagaagggcgtgatgcggcggctgatgcggtggagccggccgcggtgggccgcggcggagcaggcggagtgcgcggtgtgcctggacgagttccgcgcgggcgacgtgctggcgcacctgcgctgcggccaccgcttccactgggcctgcgcgctgccctggctcgagggcacctcgcggtgccccttctgccgcgccgccgtggacgccggcgccggcgccggcgccgacggcgcttagaagcggccgaggctctggtcttgttggggcttgccctgggctgggacggcgcggggcgccttgtcgctgtcggcccacgccagccacgctacccccatgggttgccacgctaggtagtagtgcggggtggtgagtggtgaccggccttgtgtggcgcggagcggaggaggacagcgagacgcgcacggcacgacgaacccgtgagtgccttggcagtttttgcacgctttgcgcgcgcaaaggcacggttggtgcacatttgttggttgggccgtttggcccccctttgccgtgtcctcctcccatcatcgcgagcaactgatcaacggttttgttttcgtgtctggggagcgctttgtttatggactctggtgttagcggatagcggttccatatcatgtaattcatgtcaaaaaaaaaaaaggtcgtctgatctgatcgatctaggagaaagaactgtaattggtttagaccaatcacatctgtgtacagtctcagtgttgttgctgtttgctcagttgaaggtaaatgcagttggaggcaaaaaaaaaaaaaaaatgaggtctctttag

SEQ ID NO: 7511 - DNA, 2002 bp, Zea mays
cctcgaggccggccggaaaccccaataccgcgtctctcgctgatcacccccacgtgtaacacttcccatataaaccctggggccccccggccgggccgccaacaccaagccacagccactggtcaccggtacactctgatccgaacaatggacgcgacgcaactgaaccgatcgatggacgccacgccgacgcggctcttccttggcgcgctcctcctcctcgtccccgccgcgctcctcctcctgctccgcgcgcggggcaggcgccgcctccccccgggcccgccgtccctgccgctgctcggcagcgtggtgtggctcaccaactcgcccgccgagatcgagcccctgctgcggcgcctcttcgagcgttacggccccgtcgtggcgctccgcgtcggggcgcgcttgtccgtcttcgtcgcggaccgccgcatcgcgcacgaggcgctcgttgaccgcggcgcgacgctggcggaccgcccggcgctcgcgtcggtcaagttcctcgacgagagcgacaacaccatcacccgcgccagctacgggcccgtgtggcgcctgctgcgccgcaacctcgtcgccgagacgctgcacccgtcgcgggtgaagctcttcgcgccggcccgtgcatgggtgcgccgcgtgctcgtcgagaagctcggggaggccgggcccgacgccgcgccgccccgcgtagtggagacgttccagtacgcgatgttctgcctcctcgtgctcatgtgcttcggcgagcgccttgacgagcccgccgtgcgcgcgatcgcttctgcgcagcgggaggcactcatctaccgctccaagaacatgcaggtcttcgccttcctccctgtcgtcaccaagcacctcttccgcgctcggctcgataaagcgcgggcgctgcggcggcgcgtcaaggagctcttcgttccgcttatcaacgcgcgccgggagtacaagaagcggggaggggaaccgagaggggaaaccacgttcgagcactcgtacgtggacacgctgctcgacatcaagcttcacgaggacggcgatcgcccgctcaccgacgatgagattatcctcctatgctccgagttcctcgacgccggtacggacaccacgtccacagggctgcagtggatcatggccgagcttgtgaaaaacccagccatccaggagaagctctacagcgagatcaaggccgccacagacgacaacaaggaaggggtctcagaggaggacgtccacagtatgccatacctcaaggcggtgatcctcgagggtctccggaagcacccgccggcccacttcgtgctgccgcacaaggcggcggaggaaatggagatcggcgggtacctgatccccaagggcacagttgtgaacttcatggtggccgagatgggccgggacgagcaggagtggaagaacccgatgcagttctcgccagagcggttcctccccggcggcgatggcgagggcgtggacgtgacgggcaccaaggcgatcaggatgatgccattcggcgtgggccggaggatctgcgcggggcttggtatcgccatgctgcacctggagtacttcgttgccaacatggtgcgggagtacgagtggaaggaggtgcccggcgacgaggtggacttcgccgagaagaacgagttcactgtcgtcatgaagaagccgctgcgcccgcgccttgtgcctaggaggtctcacttgaactagaaatactttacgtaccattttctatcctacgttttcctcgttttgtgatgtatataaacatctcatagctataaaaaaaattacggttctacaataattaatcggcagaaactgtaacgttcattcggtagtttcatcttcctgtcgatcgtggatggcttgtgaatatggaaaaatgattagcaaaacgatgctaattataaataacagtgctgctcttctgaaaacttaaactgttgatgcatctgtcttcagatgctcttggttcaaaaaacaaaaaaaa

SEQ ID NO: 7512 - DNA, 723 bp, Zea mays
tttgcaccgcacgcacccgccgacgcccgcgcggccacgcactaggcggcaccgcagcgacggtcgacgatcgccacacccggacaccccacacaggcaccaaccagccacgcgagcggcgaaactgcgggagccaatcagaacctacagcgatgcaatgatcgccgtcgcatcgtccttcccctcgcgcgcccacgcggctccgttcggctcggggacactgccaccgccgtctacgcggcgcagcacgtccctccgccacccgcgcgtctcggcgctcggtggaggcctcgaaggagagccggggaagatactggatccgcgcgccacgccgttccagatcctcggcctcgacgccgccgccggctactccgccgccgaactcaaggccgcctttcgcgcccgggttaaggaattccatcctgatgtttgcaaggacccagaaaatgcagatttaataatgaggcgagtgatcgaggcctatcaggaacaatgttgacccatttgatgaacctgagtgtgaggctcgtgacatatttgtcaatgaacttctatgcattggcactggtacttgttcttgtattgcttcagtggttaaggatgagggttttgtcaatcggccttgttgttgaccatagttttgttataaaaataaggatgtccatattcttgtgttaaaagggcacctcatgtattttcatttttagaagatactggtacagc

SEQ ID NO: 7513 - DNA, 2740 bp, Zea mays
  misc_feature (1120)..(1120): n is a, c, g, or t
  misc_feature (1403)..(1403): n is a, c, g, or t
tgggagctctgtacaggttaaggaattccatcctgatgtttgcaaggacccagaaaatgcagatttaataatgaggcgagtgatcgaggcctatcaggtaactctgtgtactatacttgtgttttgtacaagtgcatatggatgctatcataataaccacaatcaaacatcaccaaacaattacaattcacagtgcgagtgtggccttaaaggtttcagaattgtgaaggaactttagaaatctgactccatgtagtgtaacctaaaaggttggttgaattttactggagggagtgtttccttagttttttcaccttcttgttatataccattatcagtcacactgttttgtttcacacacagatgttatctggcaaccaagaaatgatgtttgaaaggtagagaatattccgatcaacttgtattctggacatatcatgcaatgagcctttttatacacttgtttgtatagataactatgatagaaatggcactctgctcctttggtatggattttcagtgatagattaggttgtaatagccagttaccatggtattctattcatgtttgagtaattgactttgtttgtttgattatgtcattaaacttttagtttgtttgattgctatggtcaatgtggatttatcacctatatttgtttgctatgaattacgaactcatattcttaatctctaaattgctattggttactaactactgaccttgtgttgttctgctggagtgttgatgtctaattggcgcctaggtgctcgcttaggcgcctaggcgtccagctggtgcccgacctcgccgtggcgctgtgataaccacgactaccaatacagtcaaattctgaaacattttgattcaaaacctagttggtcaaatagtagataatatctcactagcaatggggttgccagaggagagtatatgagaaaaagaataagaacgtcttgatttataattataggttttgtagatggtgagaatacttggaaggacatgtctgacatactggtgaaaagcttttccattgagccaaaggtcctaggttagaagcaacctctctgcaaaaatgcaggggtaaggtttgtctggattattacttcgtcaganctcactcatatgaaagctgccagcactgggtctgtcgtctttttagggattgcagatggtatgcagtgaaagatccattatgtaatcataatttgcaccatataagtagccattgacacccctttataagaagaggatgaggtaaaacataatatgcatcacgttaagtacaattattgcttgtgttgaaaaaatatattttggtttgatccagtcaacaatttggcagttatatttttaaggggaaaatctggaattaaccagtgggcttagttaccaactnatctattccaaaatctaaacctacggttctacagtttatccacctatatgtccagaacagagtgttggaaccattgccaatctcagtgaccatgactgcagagaagaaggatttggctttaggagggacttgaattgggagctctgcccaaggcttgataggatcagtatgttttctcagtgaccattgctccaggactgttggccacaatccttaaaagaataattaacaagataactgttcaagaggccatgataaacagaaggtggatttcatatattaagggcgctctgacaatgggagccctggtagattatttatatctatgggattctctttctagcttgtgtctgcagccgaatagggaagatagacacatcttcaccagggcctctgatggcaaatactcagcaaaagctgcctataatggcctcttcttaggctctagctcctttggtcatcacaaaagaattggagaacttgggccccctccaaatgtcggctttttatgtggctggtggctcataacaaatgttggactgcagacagattggcgaaaagaggcatgaatcatcctgctgctgtcccctctgtgaccaacatcctgaatccatcaaccacctgctggtgtcctatgtattcacatgagttttctggtatactatgctaagaagatttggacttcatagtctagcccctcaaccggatgctacctccttcttggactggtgggagatatcttcagacattgttcctaggatgattaagaagggcctgaattccctcatcatattgggagcctggatggtttggaagcaccggaatagggtggtgtttgatggagccactccagacttcacccttctgctcagatctgctgaggaggaaagacacaaatggcaattggccggtgccaaagggctctccttcttggtggcgccaatgtcaaatgtttaggggaggtgctgagcgttgtcgctgattattagtgaacagatggatagtttcttgtacacttgtttctggcctttctaatgggaaggttttttgtaatttttgggtcttcttcagacctcttcctctcttctaatatatttataaagcgtagctctcctacgcttttcgagaaaaaaatctaaacctactgaggattttatgctctttattcactttttcttttgggtttcatctccattagaatcaaagctactgatgacacctttaggtattcaggatcaatgctacaaagagatagtgattttgatgaaaaccaaaaaaaaaaaaaaaacagggtggataaagtggcatcaatgatctgggcgtctatatgacaagag

SEQ ID NO: 7514 - DNA, 1255 bp, Zea mays
acgcacccgccgacgcccgcgcggccacgcactaggcggcaccgcagcgacggtcgacgagccacacccggacaccccacacaggcacgaggcaaccagccacgcgagcggcgaaactgcgggagccaatcagaacctacagcgatgcaatgatcgccgtcgcatcgtccttcccctcgcgcgcccacgcggctccgttcggctcggggacactgccaccgccgtctacgcggcgcagcacgtccctccgccacccgcgcgtctcggcgctcggtggaggcctcgaaggagagccggggaagatactggatccgcgcgccacgccgttccagatcctcggcctcgacgccgccgccggctactccgccgccgaactcaaggccgcttttcgcgcccgggttaaggaattccatcctgatgtttgcaaggacccagaaaatgcagatttaataatgaggcgagtgatcgaggcctatcagatgttatctggcaaccaagaaatgatgtttgaaaggaacaatgttgacccatttgatgaacctgagtgtgaagctcgtgacatatttgtcaatgaacttctatgcattggcactggatgtccatattcttgtgttaaaagggcacctcatgtattttcattttcagatgatactggtacagctcgtgcaatatctcaaggtaatggagaagatgatcttgttcagctcgctgttgggcagtgtccaagaaagtgcatatactatgtgacgccttgccaacacactattttggaggatgttcttgctagtgtgttgatggtgccttacgatcttgctgaagcagcagttctggattccctcctttcaaaagcgaagttcgagaataacaggtataagaagccccaaagaggagcaaaatcatcctccgattatgttgattggatgtgatctgatcccgagacacaaagaggatgccagattcagccgaaggcagttcggtagatttatgctggtttgcctattctccttggtcagttgcccgatagtttataaaatggaatacgtttacgtggacagactgctttgtttgtggtatacggttatgatttctataatatttctttctgccagaattttactccgtcttttcttggcataagaaactcctaggattgactgggagcttaataatgttttggtctaaaaactcacaagtataataatgtatagctattccgtccatagggtaaattagcatgtacaatacagggggcgag

SEQ ID NO: 7515 - DNA, 841 bp, Zea mays
aaacctctcgctaccttccccgtccctactggcggcagcctagggctttccctaagcttctccatcccaagatcaagatgcctccgggaaagaaggggtcacgatgcatactaaatccccagcgacaagaaaaatataaagatacccaaccaagtgcaataaatcttttcaaggagatgtattgcggcaagaagaaatgatttagtaaaattgttcagaaagctattgatgatatggaagcaatggtggcagcatcagttgaagttagacaacttgtgatgtcttctacccaagttgtttctcatgtcttgccgagctcaagtaaattccttcacaatgttggccttcagcctgcctccaagacaagctctatttcagcaaaggtgcacgagcttcaatctcaattggagaccaagagacaagaaaaagatggacttaggcaagaaatggaatccttaaaggctacatcacaagaatttatgaccactattgctaatcaaacaatcgagatcgagaatttaaagaagtcgctagcggaaaataatagccttcttcgtcagatactaagcaccaatcgaggcatgtctcctccttaagattgttgctatagtcgaccatgccaatgttacatccaacaacactggactacttttttattagttgtctatttagtctgatcatattgatactatagtagctgtgtgcagcttgtggcggttgaacatgtcctacttttgcatttaagttatagaaaaggtgtgtgtgttcatgttgtttgatgaaatggtatgcacggtttggattgaattccattatatactggttttattaattgacgaaa

SEQ ID NO: 7516 - DNA, 3267 bp, Zea mays
  misc_feature (1555)..(1555): n is a, c, g, or t
gacattcttattgattttatattgtgcaggatggtggcagggttgcatctgaacatagaggactggaacccatggcagaagacattggttcctccaagcaagctcctgtaagtgcattcatttgtattcactaatataataccacatggaggaactcgaggggtgcatgcggtcgcctctgaacatagaggactggaacccatggcagaagacatcggttcctccaagcaagctcctcaggcagatgccagtgcaatggccatcgatgaaccaagcaatgtcaagaatgaacctgagagctcaactaaattgcaaggccaagcagctgcgtaccacaagccatagctgcgaccatcaagagttgctgggtttctgctaggcaacttcctgcttgatgtggacagtccagaaaacagaagtgaatccgcaatacgtccctgccatttcaaatttgacttggttacacctatctgtgacaatgttaatgtaatgagatcccatggcactagtgaagttcccaggtgtccacctgggattgcttgcggttgagagagacgatagtctgatgacccatgtatacatgaagcccatgatctcagttgtacagtcattagccaatacaaatatgcagtggactaaagggtgattcattgcgtgttcttaatggttttgtgtcctgactcgtccttctttttgtgcggaagcaaggtaggcagttgctgtgccgcaaatttgccgagtttgtagaatgctgatgcaaatacatgcgctatctgcctgtttgttgatagtctgctgggggtggggaggaaggttggctgtcgctttgcgtgctgtttgatcacggtgctgctattatgcgggcggctgaattttccagttttgggctagtttagctactctactttcctaattgattattattttcttaagaaatgaactaatttgttttgggaaaatagaaatctcttgaaaatatagggttgtcaaactatctattttttaagggatcttcatttttaagagaaaataaactaatatttctttgaaaatagaaactccttaataaaattgagttgccaaactagttgtaaaggttttttttcctacgctgcttctcgcccaggtgaacctgtagcgtacaactagattgcttttcggtcgcctacactgagtagtggctacttggaatgtagtcggatacggtttcatatctgtttttatatttttcctctataaatttagattggatactgatattatccttatcaagttgtgtaagataatatttgaatggatatcaacacaaacaacacatttagagcatcctcaatagtcatgtaaataactttctaaatatgaattttaaataactttctaaatatgaattttaaaagttttcaagacaaactcttcttcaatagttatataaatcatgtctctaaatttacaaattccttacgcgacccaatttgatccctgcattttgcatttatcaatctcgttggaactttcttaatcaacactagtgctaaatctattacgaaaaccatantttagccactatttcgcgccgtcccattgtcccgttgacaccgcaccgccactactaaacaagctcttgtgtcgaggcgccgtcagagcacaaagcacatgtgttgtcttcacgttgcgagtatctggtcttccatcgacaacttcaacctcccaagacatcacagaagattgttgatactgatttctgccaccaactcaattaaaaatagaaagcatgctcactttttttgttgacatggataattttaaaacttagtaaccaatcaatagagaactgttagagcacaaacatttttctacttcttaagtattttagcaacttcttaaatctataatttaggatgctaaatttacataactattgaagatgctcttaagctctcacatttacattgttaccatggttacatgctttacctttctagtttagttataggtcagttgataggactaaaacacctttgcattgagcccttgcatctagtttttctctttcttctctctcatgttgaacacttgtcttcacttgtggctatcaccatcaccatcatttttatggttgccgctcttgctcaaacttggatgtggatttaacctagctcacccacaatactagagtaaaggttagtccacaagttgtctcaattaccaaaaccaaatgtagggttttcaatcttcctagcttgaggctttcaatctttcgcacatacgactttcaagtgtgtcataacctttccactatcaaacctccccttcaatgtgaaaccatacttaaacttgttccttcactcacaaaaaaaacgttcactaaagttaggcgacatatcgaacttttctagttcatctaccatattctcaaacacatcttacataaaacagactaaacaatccatctacaaaatcattttagcaaactgtatcatgtcttcaaaatcattctaacgaatctaacatgttactactgaatacatagaacctatagatactaactctggttttatttgtcaaaatagtttaaaaaaataaaagaactaatgttaaactaaacctaaaagaaaactaaacctaaatctagcataaactaaatcttacctacacctaaacctaaactaagtaactgactgtaacttctaaagtataaaccctaactagcaatcatcatataaatgataaatcaagaacgcaaaatataccttactaatgggatgaggggccggggagatgaactcagagtgggggagatgcaagcgcctagagggggaggcggagacggagaggtcatgcctggtagggggatagaaggagatgtcgcggtggctgggagtgatggtgggtagtgcatggagcgtggacgacggtggtggctggcgacgagttaatggcgcggcaagagacctatatcactggtcagcgggcagctgatctaccatgttagcatatgctagctgcgccagatgggttggcatggcagagccgtttggccatgtcagaaaatttggcgccagaaaacatattagttttaaaaaacaatcttgtatgttattatttagaaatagttttaaaaataattgaaaataataaaaaatctctatccaccttaaaagttgaaatctagccatgtgcacgtatagggccgttatcaatatttttcctccacacttttctccgatcctcccaaattcactaaccgcctacaaggatcggagcttc

SEQ ID NO: 7517 - DNA, 2118 bp, Zea mays
actttctcccgtcccgttcatttatttatatataaatcattgcggccatcccggccggcgcttctcgccctaccatcgcctgaccgacgcgcccgttttctcctgaaaacagaaggctccggcctccggcatccgccaaaaaggggaaaaaaggagagataacacacacacacacaaaccccaatcccctgcggcggcgatggacccgtcatcggcgggctccggcggcaactccctcccgtccgtcggccccgacgggcagaagcggcgcgtgtgctacttctacgacccggatgtgggcaactactactacgggcagggccatccgatgaagccgcaccgcatccggatgacgcactcgctgctggcgcgctacggcctcctcaaccagatgcaggtgtaccgccccaacccggcccgcgaccgcgacctctgccgcttccacgccgacgactacatcaacttcctgcgctccgtcacgccggaaacgcagcaggaccagatccgcctgctcaagcgcttcaacgtcggcgaggactgccccgtcttcgacggcctctacagcttctgccagacctatgcgggcgcctccgtcggcggggccgtcaagctcaaccacggccatgacatcgcaatcaactggtcggggggcctgcaccacgccaagaagtgcgaggcgtcgggcttctgctacgtcaatgacatcgtgctcgccatactcgagctgctcaagcatcacgagagagttctgtatgtcgatatcgatatccaccatggtgatggagtggaggaggctttctacacaacagatagggttatgactgtctcgttccacaagtttggtgattatttcccaggaacaggggatatccgtgacattgggcactcaaaagggaagtactactccctgaatgtccctctagatgatgggattgatgatgaaagctaccagtccctttttaagccaatcatgggcaaagttatggaggttttccgccctggtgcagttgtgcttcagtgtggtgctgattccttgtctggggataggttgggctgcttcaacctctcaatcaaaggtcatgcggaatgtgttaggtatatgaggtctttcaacgttccattgttgctccttggtggtggtggatataccataagaaatgttgcacgctgttggtgttatgagactggagttgctcttggccaagagcctgaagacaagatgcctgttaatgagtactatgaatacttcggtccagattacactcttcatgttgcaccaagtaacatggagaacaaaaatacacgacaacaactggatgatatacgatctaaacttctggataatctttcaaaacttcgacatgctcctagtgtccactttcaagagagagttcctgacacagaaatacctgagcaagatgaagatcaagatgatccagatgaacgacatgatcctgactctgatatggaagtggatgaccacaaggctgtggaagagtcatcgaggaggagcattctaggtataaaaatcaagagagaatttggtgaaaatgcgaccagagtacaggatggtggcagggttgcatctgaacatagaggactggaacccatggcagaagacattggttcctccaagcaagctcctcaggcagatgccagtgcaatggccatcgatgaaccaagcaatgtcaagaatgaacctgagagctcaactaaattgcaaggccaagcagctgcgtaccacaagccatagctgcgaccatcaagagttgctgggtttctgctaggcaacttcctgcttgatttggacagtccagaaaacagaagtgaatccgcaatacgtccctgccatttcaaatttgacttggttacacctatctgtgacaatgttaatgtaatgagatcccatggcactagtgaagttcccaggtgtccacctgggattgcttgcggttgagagagacgatagtctgatgacccatgtatacatgaagcccatgatctcagttgtacagtcattagccaatacaaatatgcagtggactaaagggtgattcattgcgtgttcttaaaaaaaaaaaaaaaaaaaaaaaaaaaaaaaaaagcggccgcggccgc

SEQ ID NO: 7518 - DNA, 2042 bp, Zea mays
gccctccgattccctactcaaacgcagccgccgagcgcctctcgcctctcgccctacaggaggcaccctacagaacccaaccaaaaagcgccggcggcaaacagaacccaacccaaagcgccggcggcaagcgaagagaaagcgccggcactaatccgacgatggacgcgtcggccggcggcggcggcaactccctgccgaccactggcgcggacgggtcgaagcgccgcgtctgctacttctacgacgcggaggtgggcaactactactacgggcagggccacccgatgaagccgcaccgcatccgcatgacccacgcgctgctcggccgctacggcctcctcgaccagatgcaagtgttccgccctcaccctgcccgcgaccgcgacctctgccgcttccacgccgacgattacgtctccttcctccggtccgtcacccccgaaacgcagcaggaccagatccgcgcgctcaagcgcttcaacgtcggcgaggactgccccgtcttcgacggtctctacagtttctgtcagacgtacgcggggggctctgttggcggcgccgtcaagctcaaccatggccatgatatcgccatcaactgggccggcggactccaccacgccaagaagtgcgaggcctccgggttttgctatgttaatgacattgtcctcgccatcctcgagctcctcaagtaccaccagcgcgttctgtacgtggacattgatatccaccacggggacggcgtggaggaggctttttataccacagaccgggtgatgacagtctcattccacaagtttggagattatttccctgggacaggggacattcgtgatgttgggcactcaaagggtaaatattactccctgaatgttcccctggacgatggtattgatgatgagagctaccagtcgttgttcaagccaataatgggcaaggtgatggaggtcttcaaccctggtgcagtcgtgctccagtgtggtgcggattcattgtcgggtgacaggttgggctgtttcaacctctctattaagggtcacgcagaatgtgtaagatttatgaggtccttcaacgtcccgctgttgctgcttggtggtggtgggtataccataagaaacgttgcacggtgttggtgctacgagacaggagttgcccttggtcatgagctcactgacaagatgccacctaatgagtactatgagtattttggtccagattacactctacatgtcgctccaagtaacatggagaataaaaacacacggcatcaattggatgacataaaatcaaaacttctagataatctttcaaaactccgacatgctcctagtgttcagtttcaagagcgatctcctgaggctgagttacctgagcaagatgaagacaaagagaatcctgatgaaagacatgatgctgattctgatgtggagatgaatgatgccaaacctttgcaggactctggaaggatgtcaatagtgtagctgcagaacattctagaggcactggacctgtggctgatggagttggttcctcgaaacaaacctttccgaatgccactagtcgaatggccatagatgaaccaaacgctcttgagagttgagcaagagggttcaaacaaattgcaggaccaaccatcgatgcacctcaagtagctaatgtcatctgtagcctgtcgattcttttgcgcaaattcattaactgtaggcaagccatgcgtggactgaagcagggagcagaagtaagtgctcgaccaagaagttgtgcatctgaaatctatattttttgcgcgtcatatttgtattaccgacagttgcaaacgatggtttaatcatgaaaaatttgtctttccacccttggcttctgcagtggaaggggttgatatcgtagtatgcgaaaaaaaaaaaaaaaatccattccccatccccaaatgagaagtgggtagtccccgacgggttttgaatggccaacagttttaagggagggaagcagcccggaggccaaaaaaaaagcaacgagatgtacggcaaaaaaaaaaaaaaaaa

SEQ ID NO: 7519 - DNA, 3064 bp, Zea mays
  misc_feature (77)..(132): n is a, c, g, or t
  misc_feature (171)..(196): n is a, c, g, or t
  misc_feature (342)..(364): n is a, c, g, or t
  misc_feature (521)..(547): n is a, c, g, or t
  misc_feature (587)..(592): n is a, c, g, or t
  misc_feature (898)..(902): n is a, c, g, or t
  misc_feature (1232)..(1254): n is a, c, g, or t
ctcgagatccattgtgctggaaagccgacgcgcccgttttctcctgaaaacagaaggctccggcctccggcatccgnnnnnnnnnnnnnnnnnnnnnnnnnnnnnnnnnnnnnnnnnnnnnnnnnnnnnnnncggcggcgatggacccgtcatcggcgggctccggcggcnnnnnnnnnnnnnnnnnnnnnnnnnncgggcagaaacggcgcgtgtgctacttctacgacccggatgtgggcaactactactacgggcagggccatccgatgaagccgcaccgcatccggatgacgcactcgctgctggcgcgctacggcctcctcaaccaaatgcaggtgnnnnnnnnnnnnnnnnnnnnnnnacgcgaactctgccgcttccacgccgaggaatacatcaacttcctgcgctccgtcacgccggaaacgcagcaggaccagatccgcctgctcaagcgcttcaacgtcggcgaggagtgccccgtcttggacggcctttacagcttctgccagacctannnnnnnnnnnnnnnnnnnnnnnnnnncaagttcaaccacggccatgacatcgcaatcaactggtcnnnnnncctgcaccacgccaagaagtgcgaggcgtcgggcttctgttacgtcaatgacatcgtgctcgccatactcgagctgctcaagcatcacgagagagttctgtatgtcgatatcgatatccaccatggtgatggagtggaggaggctttctacacaacagatagggttatgactgtctcgttccacaagtttggtgattatttcccaggaacaggggatatccgtgacattgggcactcaaaagggaagtactactccctgaatgtccctctagatgatgggattgatgatgaaagctaccagtcccnnnnnaagccaatcatgggcaaagttatggaggttttccgccctggtgcagttgtgcttcagtgtggtgctgattccttgtctggggataggttgggctgcttcaacctctcaatcaaaggtcatgcggaatgtgttaggtatatgaggtctttcaacgttccattgttgctccttggtggtggtggatataccataagaaatgttgcacgctgttggtgttatgagactggagttgctcttggccaagagcctgaagacaagatgcctgttaatgagtactatgaatacttcggtccagattacactcttcatgttgcaccaagtaacatggannnnnnnnnnnnnnnnnnnnnnntggatgatatacgatctaaacttctggataatctttcaaaacttcgacatgctcctagtgtccactttcaagagagagttcctgacacagaaatacctgagcaagatgaagatcaagatgatccagatgaacgacatgatcctgactctgatatggaagtggatgaccacaaggctgtggaagagtcatcgaggaggagcattctaggtataaagatcaagagagaatttggtgaaaatgcgaccagagtacaggatggtggcagggtcgcatctgaacatagaggactggaacccatggcagaagacatcggttcctccaagcaagctcctcaggcagatgccagtgcaatggccatcgatgaaccaagcaatgtcaagaatgaacctgagagctcaactaaattgcaaggccaagcagctgcgtaccacaagccatagctgcgaccatcaagagttgctgggtttctgctaggcaacttcctgcttgatttggacagtccagaaaacagaagtgaatccgcaatacgtccctgccatttcaaatttgacttggttacacctatctgtgacaatgttaatgtaatgagatcccatggcactagtgaagttcccaggtgtccacctgggattgcttgcggttgagagagacgatagtctgatgacccatgtatacatgaagcccatgatctcagttgtacagtcattagccaatacaaatatgcagtggactaaagggtgattcattgcgtgttcttaatggttttgtgtcctgactcgtccttttttttgcgcggaagcgcaaggtaggcagttgctgtgccgcaaatttgccgagtttgtagaatgctgatgcaaatacatgcgctatctgcctgtttgttgatagtctgctggggcggccgaggaaggttggctgtcgctttgcgtgctgtttgatcacggtgctgctattatgcgggcggctgaattttccagttttgggctagtttagctactctactttcctaattgattattattttcttaagaaatgaactaatttgttttgggaaaatagaaatctcttgaaaatatagggttgtcaaactagcccttaaagagaaaagcaaaaaaaaaaaaaaactcacactactagcgtcctcacttgctaaccatctaatctaaccaaattcatgtcgttaactatctaatctatctacccaaaggagtgcgctagacaaaagaacttatggcttgatgctgacttggcttgaactcacagtttacgagctaaacaagccaagtaattcaaagttcgacaacctaaacaacaaaaattagattcagatgagactgaaagtctaaaattgatgtaattcattgtaatattatattattcttgatgcctacatgagactaattgtaagccgtcgttatcaccgctatggcttccgcaaacttaggatttgttatgttatttctgttccacgtggattggatgagatcaaaaaagattatagaaaagattataaatgattttgatttgtttgagatttaaacctacgtaatactatccaatccatacgaataagttatacacatatcctttgtcatgctgaagctatacctataagttatacgttgaagtttgttaggtaaattatatgttaaacttatacgtataatttttttttgctgacaacaaaagattacggagcatgtctgattgatcgtccgatttgaattaggtgagtgaagtcggcacgaaagcctgcggttgctgctcccagcacacgccatcggccgcccggacaagcatctgcaggtcg

SEQ ID NO: 7520 - DNA, 919 bp, Zea mays
cccggggccctcccatcgcctgaccgacgcgcccgttttctcctgaaaacagaaggctccggcctccggcatccgccaaaaaggggaaaaaaaggagagagaacacacacacacacacacacaaaccccaatcccctgcggcggcgatggacccgtcatcggcgggctccggcggcaactccctcccgtccgtcggccccgacgggcagaagcggcgcgtgtgctacttctacgacccggatgtgggcaactactactacgggcagggccatccgatgaagccgcaccgcatccggatgacgcactcgctgctggcgcgctacggcctcctcaaccagatgcaggtgtaccgccccaacccggcccgcgaccgcgacctctgccgcttccacgccgacgactacatcaacttcctgcgctccgtcacgccggagacgcagcaggaccagatccgcctgctcaagcgcttcaacgtcggcgaggactgccccgtcttcgacggcctctacagcttctgccagacctatgcgggcgcctccgtcggcggggccgtcaagctcaaccacggccatgacatcgcaatcaactggtcggggggcctgcaccacgccaagaagtgcgaggcgtcgggcttctgctacgtcaacgacatcgtgctcgccatactcgagctgctcaagcatcacgagagagttctgtatgtcgatatcgatatccaccatggcgatggagtggaggaggctttctacacaacagacagggttatgactgtctcgttccacaagtttggtgattatttcccaggaacaggggatatccgtgacattgcgcactcaaaagggaagtactactcccctgatgtccctctagatgatgggattgatgatggaaactaccagtcccttttttagccatcatg

SEQ ID NO: 7521 - DNA, 3194 bp, Zea mays
  misc_feature (3192)..(3192): n is a, c, g, or t
gatcttggctgtgccatcattgaggctgtggcaacacgtcaggctgttgaattgattgatgtagaaatagcacagccattttcacaacaaaggaaacaaagagaggctggtggtcctgcatatcatgatacctttgcttatgctcaagggccgtttgctcgtgtacctgaagcactgcgtcctaaacctgggcatttatctgcttcccaacaaagagtgtatgaggatttcgttcatgtgtggcatccccatagtcaaaatgttggcgctaccaggttctggtctgtctggtggtgctactgtctcgagcacacttggtgtgcctcgagcttacagcccaaattcagcaccagtatcctccattaatttgtcaactattcatatgagtggactaacatctataactcagccaatggaactggggtctgaggaaccagttactggtattgcacaatttttgagtaatcctgcccaagttggagtaagcgagtcttctgtcctacttggtggaacgattggtgctgcatctaacgaccttcctgtcagttcaacgactgtcacaaccaatgaaataactgctatggtgccacctccatcaacatctgctgcggatcgcctaggatctattttacctgaacttttgaatactggggatgctttggagagataccaacaggttgcccaaaagctggaagccttgattgctaatgatggcaaagatgtggaaattcagtctgttattatggaagttcctgatatcttgcgtaggtgtgttagccgtgatgaggctgcattagcagtagcacaaaaggttttcaagagtttgtacgataacacatcaaataccacttatgtctcctggcttctagcaaccttagttgcaatacgagatgtctgcaagcttgttgtcaaagagttaacaagttgggtaatatattcagatgaagagaagaagtttaacattgatatcatttttggccttattcgttcggagttgctgaatattggggagtacaatgttcatttggcaaagttaattgatgggggaagaaataaggttgcaacggagtttgcaatgtcccttgtccaagcattgtttgctcatgatcctgttggcttcacagagtttcagaatgttcttgatgcactatcgaagcatacaaagagaccaggttcacctgaatcgttgcaacaattgattgaaatcgcaaggaataatgtgagcaccactactggttttgttgctgtgaaggatgaaaaggtcaaactgccgaaggataaaaaggttttagctacccgggcaaacaaggaggaaaacactgctaatgaaattacactagttgatccaaatcaggtggcagtcctattttctgaatggtgtcagatgtgtaatcatgtaagtgctagtgatgcggcatacactcgttttgtcacacagttgcagcaagatggtctgctgaagggggatgatatctctgaacgcttcttccgtattctcacggaacttgctgttacacactctctagtctccgagcaaatcgttgctcctggtggatcatctcagcaatcaccacagcaacctcacatttcatatttctccattgattcatatgcaaagcttgtggttatggttctcaagtactcagtggagataacaccaaataaagccagtatactttccaagatcctatctgttacagtgaggtccattcagaaagatgctgaggaaaagaaagcttcatttaatcctcgaccatacttccgattgtttataaattggctctatgatcttactactaccgatggtcaccatgatagttctaattttcaggttttgactgcatttgcaaatgcattccacatgctacaacccttgagagttcctgcctggagctttgcttggcttgagctggtgagtcacaggagcttcatgccaaaactgctgatgtgcaattcacagaaaggttggccattttttcagcgactgcttgttgctcttctcaagttcatggaaccatatctgagaaatgctgaactcccagaggcgatggaccttttatacaagggaactatgcgagttctgcttgtactactgcatgactttcctgaatttctttgtgattatcacttcagtttctgcgatgtgattccttcaagttgcattcaaatgcgcaatgtcattcttagtgcttttccacgtaacatgagactgccagacccttctacccctaatctaaagattgatttgttggctgaaatttcaatagcaccacgaatcatgtcggatgttgatggtgcccttaaatcaaagcagttgaagactgaggttgatgaatatctcaagaggccggaaggctcttcctttttaagtgacctgaaccaaaaattgctgctgcctcagaatgaagcaagtgttgctgggacacgctacaacgtgcctctgatcaattcacttgttttttatgttggcatccaagctgtgcaacaactgcaactgaacaaggctaatccgtctgcatcagtacagcagattaaccatatatctccgatggacattttccagattggaacagctaccgatatattcaggagtcttataacaagtttggatacagagggccgctaccttctgttgaatgcaatcgctaaccaactgcgctatccaaatagccatacacactactactccttcatcactctgtatctattttccgaggctacccaggaaattacccaggagcaaatcacaagggttcttctggagcgtctcatagtgaaccgcccccatccttgggggttacttattactttcattgaattgataaagaatccgcgttacaacttttggagccggtcttttacacactgtgcacctgagatcgagaaactgttcgagtcggtggcaaggtcatgtggcgcaaaagttgtggacgaaggaatcagcgtgcaggatggcagccactaaagccatctgctttgttcaagtgttgtttttgtgctatttcttctctggcactggaaattttctgtgcttgtacagatcgtctgtatagtaaagctgttagtcacacgtgtcggtgcactgccaaaccttagcaggtgcctgggagaatgcttttgtttgtatgaattttagtcagcaatatggatggtttgcaaaaaaaaaaaaaaaaaaaagagaaaaaaaaaaanaa

SEQ ID NO: 7522 - DNA, 3074 bp, Zea mays
ggttgggtatatatttcatactcctatttaaaagtcaaacgcttgatgtgacccgggctaaactttagcaggagcaaccaaacaccccttatttaggatacagacaatacgtatttattttctgcgttatttttattctagtgtgtctaaaatcccgtgttccaaaggaacgtcgatgtcaaatgtcaaatctttcgttttcagaggcctataaaaaataaaaggcccaggcccatgagacggccttctcgccactgagtcctcccgagtcccgacaaaacgtccagagcagcaagcagccgagcacccaacgtcccaaccgccgccggaggcccggagcgcggagcaaaaccatctccaaaaccctagttattccctagcgccgccggagcccggagcttcgacccacctcatcgcgcctcctctctttctctctctccgccggcttccttggctgcgccgcacccgactctcatttttctccctcgacggtgctcgacccccaccggctcagcggagtcagcgctctatctgtccctctgccgcgccgagagtaatttctccttgggaccgcagaccgaggacggagcgaggagaagccaaaatttgagtttcgtctcttgccgacgccttcatttctttctgtgaaagctgctgtattttgagggaagctagagggtcttcgtcgacccagccaagctctgccttgtttggacggctcgggtacgcgtcggtgtcgcggcccccccggaatagtgaaccctaaacccctctccgttgctcatggcgccgccaccacaaccaaagcagctggtgctcgctgcgtcatccgcggacgcgggcgtggctgcctgggacctccgcacaggcgcggaggacatccgcctccgcccctgcgcctcccgccctcggtcgctcgcctcggttgccgaccgcttcctcgcctccgctcaggctcttcccgcgggcggcaactccgggaccatccacttctactactgggacaaggtaagcacggtttgcataaaacccggaacggcgctcttgaactccgaaccatgaccccgagtcgtttcctggttcgattgcagccgcaagtggccgtcaagagctttcctgctgagccgatccgcgcactcatcgccgatcaggagggaagctacctcattggcggtggcagcaatggcaacattttcctttgggaggtgagggcattgtgctttctttgtgacgatttcgaagcagcctctccgcatttgcagggggagactggccttggttatctctttccagtttccagacctcactcatgacttattgacttcatgagtgagccaacggcgctaggtctgtcctctttttgaaactgttaggacgtgttgtttgatgcttggtgtgctcatttgaggttgctgtggaatgtttccagtgtgtttccttggtcgctagtgagctcaaggtggtgcgaagtggatgctcctggtggtgagtggtgactaatcacaatttgaccagggtctttatttctttccagttggtttggaaaagaacagttgggagttatttagttctgaaatggaatatgactgttaaatttcttgcagtagaacatttcccccatagcttgtgtgctgcactgtacggggtggtgaatgaatgcgtgttttaggttctaaaactttgaaggtggtgcttattttgtgttagtgttctctttagcacttaacaaactgccaattagaagctaattactattccataggctaacaatttgcgtgttttgtgccagaagctcacggtgaccattagaaaactattcgtgtatacacttaaagtttcatgatcaaatgcctgtggaaccagtgctagagggatcctgagtcacgttagcaatgggaagagaggcagggtaaaggcaaagttgacacaggaagaggtagtaaaaggagacatgacaagatggaatatacccaaagatttagcatttaataggagcaaatgaaaaacagctatccacatgccttaaccttgatttgtgatttctgttgatttcaactctatcctaccccaacttgtttgggactaaaaggctttgttgttgttgatcaaatgccactgggtgtcttttaattttttactcgaatgtccatttagctcctgaagacattttctgtgacatcatggtgtgtttttcaacttccattattctacttgagcattaatgttttaagcagaaacacattataatcctcagtttactcccaaagttgtgccaatatttgacatgtttactcggtgtattttcacaggtacaatattaggtaactaattatgccttatgtgcctatgagttttgtttctgtctgcagtttatgctatatatctgaatccgatccatccagcactttctggttgtctaagctatttatctgatccatcatattttatgcttgtttataggtgtctagtggagagcttctccatacatggcatgcacactatcgtgctgttaggtgcctcgggctgtatgactatttgcttgtctcagggtcagaggatgggactatcaaagtttgggatctcatcacgtatgtttgttttgtgtagtaaaattggtcaaactatttttgtagtgttcattgggttttgttgtattggttgcagggtgcttgatgagcaatcaaggctggaggtccagacaccatatttgtatagtttcagtcagcatgcactgcctgtaactgatattgcttgttttcttggagcaatcgctatatcttcttctgaggatcgaacctgcaaagtgtgtgtgcaactcaactcttgttctttttaattgaatgttttgatatgcacttatttatttgtcctagttcttgttagccactcttgtttatatcttaactagtactaccactgattctaaatataggttctttttggattgtatctggtcaaactttattaacttggattataagcatgaaaagttactaggttgacaacatatggttgatgttactatatttatgatggaaaaaaaacttccataatatatatttcactatataaat

SEQ ID NO: 7523 - DNA, 1535 bp, Zea mays
acaatttgaggacaaatgcactcaagcagagtattgtttaaatgctgttcttgagttgaaaactcaaaatgtacggaagctttagatgcatacatatagctgtacttgagttgtagtcacagaatttcccagagataaacacgatgaagattttgaaaccagagatagttactgtcacatgttatgggctgcttgttgtgctgtgtgtcgatttttgtataaaggcgccgtaataactagtcttcaaccaattctatgtgcatgacagcagctactgaaacagcaaatggatcgcatctttttttttttttttttatgaaactgtgaaatccccttcgtttctgtttatcgctttatcaaaattatattgatccagcccgtttcctctatctccaaaaataaatggaaaatgagacagcaccaaagggaaaaaaaaggaagtagtgctatttacacaaggtgagtatgaatagagaagggggggaacacacctacggtacgcaactaaaatgaggctatcagagaaacagcctttgccatctctctgtttggttggctttggccattattgactggcatcgtcagcatctcgctggcacgtagctctcctcctgaatggtctccagcgtgggccgcctggaccgccgcccgccgccgctgaggcgctgcttgagctcctcgatctcggccgcggccgccgcgtcgtcgacggccatctcctccagcctcggggccctcggcttgggcgcgtccatctcctggagctcaagggccgcggccgcggcctcgagcgtctcgggcggcgcgacgaagacggcggcgaccttggccgtggcggcgggggacgacaccggccgcgtcctccccctcgcggcccgagccttttccccgttggccaccaccgcggccgccaggcgcgccacgtcggcgggcgccacgggggcgcccaggcgcttcatggggagcacggcgtacagcgccccgcgcacgaggccctcgtccgccgcgagcgcctcgatccgccgcccgggccgcagcgcccgcgcgtccgccaggaaatggcccggcgcgtcgagcatcagctcggccgccgtggccgggagggccacctgccgcacccgcccgtccgggagcacgacggtcgagccgctggccctcccggccccggccgtcctcgccagcgtgcacgatgcgaagttgcccatggagccccgggacgagggagctgaggtgtgtgcgcgcgaggggcccggcggtttgctgcgagattgcgtgcgttcggatgtgttacggtgggcgatgttattatataggtgaaccgtgtcgtcggacgcagagagagagagagagcggttgcgatcggatggctgatggtgctcgatctgctgcctggccgcctgtgttgcttgcgggaaacgcgtgtgacgaaagtgagctgggacggtgacggcggtgtgatggacggcctgtggggtgcgatgcgtgcgagaggacggacaaccaaaaaaaagttggagtcgagtcgagtcgagggg

SEQ ID NO: 7524 - DNA, 1209 bp, Zea mays
atccaacaaagagtcagccgagtctgctctgctgctccatcggatctcccgcgcgccaaaccatgccgacgcagcaagcatgttctgctgcggcagcattgagatcgcggcggccttcccctgcatccacgacgacgacctcccggcagctgcggctgcgtccgcctcgtgccgccaccgcgggcgtgcggctgacggtgtcggacgcggagctggagtcccgcgggttcgctgtgcggcgcacggcggagggcatcgacgtggcggcgctgaacgaggtgttcgtgcgcgtgggcttcccgcggcgtcaggaggagcggctgcggcgcgcgctggagcacagccgtgtggtgtggctgtcggccggggaggaggaagggcggcccgtggcgttcgcgcgcgcggccggggacggcgtgttcaacgccgtggtgtgggacgtggtggtggagccgtcgagccagggcctcgggctgggacgcgccgtcatggagcgcctcgtcgacgagctgcggcgcgacggcgtggccaacatcgtgctctacgccgagacgcgcgtggtggggttctaccgcctgctggacttcgccatggaccccgacggcatcagggggatggcatactaccgcaagtccgctactaccgccgcttgattcgtctcgtctgtcttgtactcattcatcaatgaaggaagtcgatcgaattccctaaagccccccatgtttgtatgatgtagatatgacatggtttatttttatcactcatctcatagttgctcgtttattacctttcattttatattccgcgaaaacgatctagctagaacatgtacttatatttcgcgcaaatcaagcaatataaaaacctcacttctttcctcgtcagcccgccatgagctcctcctcttcgtcttcgacgactcttctcctcgcaattctctggagatgctggatggaagcctatctactacagtgccatgctgccgtttcgggcgtagacagcagaagcattgtccaatactccaatccaaaagcaaatcaaacattttggtcaaatttctcgtgtgtcgcattctcgcatcttctggtttcatttgttgatcacagtagattttcgtagtgcgcgcctgtggttggtagtgcatagcgtaggtgtagcagaacgaggaaattaggggatcaattcatggctctcgcttgtttgttgcag

SEQ ID NO: 7525 - DNA, 1183 bp, Zea mays
aacgcgtggaacgggaaagccggaaaggcccccgcccgcacacgccgccgccgctgccaattcggtcaacgtacgataccagccgcgggccggcgagtccaggcggtcgcagtcgcacgtcgcgacgcgccttagcattggaccgagccgcggccacttgctttgcaattgcatttgccgggatccatgccagcagctccgtcctatatgtgaagcacccggcccccgggcgcacgcgcgccggcacggcaaattaagcgagcgccggccgaggcagacacaacccgcagcaacaacttgcatcggcacggacgaccgattgagagcctcggcgttcgtacgccacgccaccaagagactctgtgcaacaagtgaagggacgaaatgtatccggccaagcccgccgcctcctccagccagccagcggccgagatggcgcagccggtggtcggcatccccatcagcagccccggcgcggtcgcggtcgggccggtcgtcggcaagtggtcctccggcctctgcgcctgctccgacgactgcggcctctgctgcctgacgtgctggtgcccgtgcatcacgttcggccgcatcgcggagatcgtggaccgcggcgcgacgtcgtgcggcgtggcggggaccatctacacgctgctggcctgcttcacgggctgccactggatctactcctgcacgtaccgctccaggatgcgcgcgcagctcggcctccccgaagcctgctgctgcgactgctgcgtccacttctgctgcgagccctgcgcgctctcccagcagtacagggagctcaaggcccgcggattcgaccccgacctcggctgggacgtcaacgcgcagaaggccgccgccgccgccgccatgtacccgccgccggcggaggggatgatgatccgctaagctaagctagctacctcgtcgccgatccggcccaacctccaacgctaaactcagatgcgttgcgtcagtcagatcatcgcgtacgtacgtgttttgtacgtatggtcgtgtatatttgtacgtgatgcgtatatatataatgttatgactgaatgtctgagttttaagatttgtacgtttgaatccttttcttaaaaaaaaaaaaaaaaagtgtgaaaatctttttttcttgaatttaataagtttttttctttcgaatataaaaaaaaaa

SEQ ID NO: 7526 - DNA, 1861 bp, Zea mays
gctgggaggtggcttcagctacggcgacctagctcaacatgggccactagagcagagaccaccagttgtactcttcatttaagtctcaccagaatgtacgagacgagttgttcatcatcaacaatcttctttgcaaataccatctcttctgcaagagagattatcttgacaatatattctagtgtcgatggactgtatatttatacaggcaggagccgactattacaagaagaattctactcgttacaacatactaaccaactaaataaactggacacatgcaattctgttttggtcttatttgtaatctataattagagctggttttttatctagcccaagagaatcctgggcaactaaggttgtagcctatgtatagcatattctaacagatggtttgcctgcaaatgccattactcagcactttgcattcttttttggccgtttccatcttttttttcttctatcagtcatcttttctgatttatgcaggtaagcggcatagtaagaaatatcgtgagagattggggtgatgagggtcaaaaggaacgtgatgagtgctataagcccattcttgaggagcttaatcgcctttttcctaaccggagcgatcagaggcctccttcatgtcttgtccctggtgctgggcttgggagattggctcttgatatatcttctctgggttttgtaagccaagggaatgaattctcatattacatgctgatctgttcaaatttcatcctgaaccacactcaagaagctaatgagtggtccatatatccttggatacatagcaactgcaattctctttctgacaacgatcaacttcgtcctgtttcatttcctgacattcatccctcaagtgcaggtatcacagagggattttcaatgtgcgctggggactttgtagaggtctacagcgaggaaagccaagaatctgcatgggatgctgttgtaacttgctttttcctggatacggcacacaatatcgttgaatacatcgagatcatatcaaaagttctcaaggatggtggggtctggattaatttgggtccccttctgtatcactttgctgattcatatgggccagatgatgatatgtctattgaattaagtttggaagatgtgaaaaaggttgcttaccattatggatttacaatggaggtgagggtttctgcattaaatctattttttttaaagagttgttgtgatagcatacttcgatatgtgatttgcaggtggagaaaatgatcgagactacttacactgcaaacatgaaagcaatgatgcagaatcggtaccgtgcagcattctggacaatgaggaaagatgcatctcggtcaaaagcttgtaagcctcgttgaagtgaagatcatccatggcggacgatcaatttgtgccatcattattcactgttgtattcaaactccacacaggccgtgccagactaagttagatagatatatcagatgagctgcctgattcacagaatataattggcttaacataggaaaggaggtgctgagccacgctagctagctcatccttttctcctatatcacagatattcaaactgtactatggactctgtaagaatgagcaataaactaagcagacagaagttaaaaatagaagtaacagaaatttaaaaaaaaaaaaaagtggcgccgttgccggggatcccgggtcgcccgcgtgacaggcgggagtctcaccactgtaacgactgggatgcctagggtttagtggatgtattgttccacgactaatgtttagtattggaagtatgatatatagtgtaattataaaactaatcgtatgaaggaggaaagataaacgaattgatcaagtctaaaaactt

SEQ ID NO: 7527 - DNA, 1844 bp, Zea mays
ctcactagtccccccccccccccctgccgttcgatttgagagccaccgattaacccatccatccacctcgccgccgccggagagtatggttgagcggcggtacaccgaggaggaggaggccctcgagatcaagtccctccgccgcatcatcgccgcctacgccaactatcaagatgctgcagaaagggatgtcgagagatatgagcggtcattcaaaatgcttcctacagcgcacaagaaacttcttttccacctcggtctgaagtaccaaagtctgagatggtgtatatccatgaatgcatcttttatcatgaaaatgcttgaggcgtttgaacctccttttgacatgagtcagtatatagatgctgatgttcatgctcatccatcaatcttgcatgaccatagtcatatggattgcactcattccagcgagaggggtgattgctctataattgctatctccagaagcaatttatcattggatgagcagcatgatagtcccaaagaatataccaagagacatgaaccttcaagagaaactgataataataagggaggggaagatcacatggcaggctgctcccagcctgttggcaacatggggatgtctcaaggtgcaggcattgcatgtaatggtgataaaaatacgggtgcagcagcttatttccaggataaagatgtctctgcatcttctgctattgaaaatgtagcactgcggcactgcacagcttcatcgctcaagttaaatgtacctccaattgatgttgacaaggtaagatgcatagtaagaaatatcgtgagagattggggtgatgagggtcaaaaggaacgtgatgagtgctataagcccattcttgaggagcttaatcgcctttttcctaaccggagcgatcagaggcctccttcatgtcttgtccctggtgctgggcttgggagattggctcttgatatatcttctctgggttttgtaagccaagggaatgaattctcatattacatgctgatctgttcaaatttcatcctgaaccacactcaagaagctaatgagtggtccatatatccttggatacatagcaactgcaattctctttctgacaacgatcaacttcgtcctgtttcatttcctgacattcatccctcaagtgcaggtatcacagagggattttcaatgtgcgctggggactttgtagaggtctacagcgaggaaagccaagaatctgcatgggatgctgttgtaacttgctttttcctggatacggcacacaatatcgttgaatacatcgagatcatatcaaaagttctcaaggatggtggggtctggattaatttgggtccccttctgtatcactttgctgattcatatgggccagatgatgatatgtctattgaattaagtttggaagatgtgaaaaaggttgcttaccattatggatttacaatggaggtggagaaaatgatcgagactacttacactgcaaacatgaaagcaatgatgcagaatcggtaccgtgcagcattctggacaatgaggaaagatgcatctcggtcaaaagcttgtaagcctcgttgaagtgaagatcatccatggcggacgatcaatttgtgccatcattattcactgttgtattcaaactccacacaggccgtgccagactaagttagatagatatatcagatgagctgcctgattcacagaatataattggcttaacataggaaaggaggtgctgagccacgctagctagctcatccttttctcctatattacagatattcaaactgtactatggactctgtaagaatgagcaataaactaagcagacagaagttaaaaatagaagtaa

SEQ ID NO: 7528 - DNA, 1547 bp, Zea mays
agatagaccttctagtattaatcaatattatgggggattaggaatctaacagagttcacattagaaaaatcttttaatcatacatgaaagccggcagccacgccacacgccagcaattcaccggcggcttccgctccaagcttcagccaagccggagatggcggggagcctgcaccttcccgtggtggacctcgcgttgccggacctccgcgccgccgctgaatccatccgacaggcgtgcgtggagcacgggttcttctacgtgaccaaccacggagtggaccgcggcctgctcgaggcggtgttcgcggagagcaagaggttcttcgacctgcctatggaggataagatggcgctgctcaggggcgcaaaccaccggggttacacgccgccctacgccgagaagctcgacgcctcttcccagttcgtaggagaccttaaggagagtttttacattgggcctcttgatgatggtgatatgcataacgatgtaaaccagtggccttctgaagagcgcttgccatcttggaaggagacaatgaagctatactttgcagctgttctggatactggcacaaggatactctctctagttgctttgggtttggatttggatgctgatttctttcataaaattggtgcattgaaatgcccgtcaacatttcttcggttattgcattaccctggtgaagtacatgagtctgatagtggaaactatggtgcgtcagctcactcggactatggtatgataactcttttagtgacagatggcactcctggcctgcagatatgcagggagaaggataggaatccccaactatgggaagatgttcatcatattgatggggcccttattattaatattggtgatttgctagagaggtggacgaattgtgctttcagatcaactttgcatcgtgttgttgcaatcggtaaagagcggtattcggtggctttctttcttgatccaaatcctgacacactggtgcagtgtttggaaagttgttgcagtgaagcatgtccaccaaggtttccacctatcaagagttgggactacatagccgggcgactaaattcaacttacaaataatcaccaccacgtttgtaatgctatgctcgtttacaacagcttgacaccacagtaatgtttgaacccaggattaaagatagttttcaagaaaggcggagctatgtatgtgagctggatctccatgtctcccctccccctagtgtctggaggagtgcactttctggatcacgcgtcgtcaggaagcaagcaagcaagcatacgcgcaattcccgctgcgcaattcccgatcgtaccctgctccaagtctttgtgcaagtctctgctcccttgaatgcaactgatgccaatcccatcaatctctttctttgaaaggagacatactgcttcctctagtttcatacctgctgaacacgatcaatggtttgcatgtactctaagatatacatgacccgcatgattgctatagtaaagactattaaaaatgaatttagctgacttcatttccctggccaaaaaa

SEQ ID NO: 7529 - DNA, 3069 bp, Zea mays
gttggatgagtaaatgaacaaacaaccaaaataaattttgtagattttgagaagctatagagttttgtagttcaaaactttttgatttgaagtcatcttgtcaatgaaaactatatttaaattttaaaaatttatagtttgaacttggataaaaaaatacaaaaataaaatttgtagatcttgaaaagttaagaaactttgtagttaacaactttttaatttgaaatcatttaatcatgcaaaactatatttgaattaaaaatttgaatttttcaaacggcctcggatgaaaaaaccaataaaatgaaagttactaaaataaaagttgtaggtcttaaaaagtcatttaactttatagttgacaacttttaaatttgaaataatcttatcatataaaaatacgcttaaagttttcaaatttaaaattcaaatgttgtaaactatctcggatgaaaaaactattaaaataaaagttgcaggtatcaaagagttatgtaattttgtagttaacaatttttgtatttgaatttatttagtgcgttaaataatcaatttaatctctgattgttataatacgtggagagaaaaacgtaatgtagacacaaattagaaaggggtagagtagtagagaaagttgcgcgagagcctgaggtttttttactgtttcttacgatttttaatttgcgaaatgttttactttactgagtgtttttagacactcgacagtgctgaaaaaatgcagccgagaaaaaatattttactaataaaatatttacggagtgttttttaccgaacgtagccaagtgcaaaaatgtatttgtggagtgtttgagacaagtctagtcccgtagtgatgcgtcgatccttggaaagttcgatccagccgatggctgacacaaatgcatgcaagacattcagtgcattacgccagagacaagtagcggtgtcaaccgctttagcacctggcagaaccctatttatagcctccatgaccaaaggcgatgcacaagccttatccctcagctcggctcgcaccaacagccctcgccgttaaatcaacatctagtagcaatggcggcgcaggtcgtcgcagcaggcgacggcggcagctggcctcagcaatggcggctcacgctcgtgctggcggctctcgtccctctgctcagcctctgcctactcctagcgagaacaacaagaagagcaagagcaagtagctggagcagcagcagcaaaggccggcgcctcgacgtccaccgcctgccgccggggccaccgaggttgccgctcctgggcaatctgcaccagctgggctcgctgccgcaccggagcctgcgcgagctggcgcgccgccacgggcccgtcatgctgctgcgcctgggcagcgtgcccacgctggtggtgtcgtcggcggacgcggcgcgggaggtcatgaaggcgcgcgacgccgactgctgcagccgccccgacacgcccggggccaggcgcctctcgtaccgccacaaggacgtcgccttcgcgccctacaccgactactggcgccagatgcgcaagctcttcgtcgtcgagctcctcagcgcgcgccgcgtccgggccgccgaccacgccagggaggccgaggtggacaagctcatcgccaggctgagcagcgccggcggcaagccggtgcagctggaggaccacgtgttcgcgctcatggacggcgtcatcggcaccgtggcgttcgggaacatctacggcgcggagcagttcgcgcacaggaaccacttccacgacgtgctggacgaggccttgagcgccaaggccggcttctccgcggaggactactaccccaacgccgccggccgcctcgtcgaccgcctcaccggcgccgccgcccgccgcgagagggtgttcagggacctcgacgccttcttcgacaccatcatcgaccagcacctggtcgacccgtcgtcatcgccgccgtccagcgccacgacgacgcccgacctcatcgacgtcttcgtcgacctcatggaggagagccggcgccagccacaggtccacggctccctccgattcactagggaccacatcaaagggctgctctcggtacgcaacattcacactcactagtcactactcggcgacagatcatcatcgaccgtactgtgtatatatgtataacatagcatcaattgatgcatgccatgtgctgtacgaattgcagaacgttttcaccgctggcgtggacacgagctcggtgaccatggtgtgggcgatggcggagctgatccggaggccggcgatgctgaggaaggcgcaggaggaggtccggtccgtggtgggcggcgacagggagagggtgcacccggacgacgtgcccaagctcaggtacctgaaggcggtggtgaaggagacgctgcggctgcacccggcggcgccgctgctgctgccgagggagacgatgcggcacgtgagcgtctgcgggtacgacgtgccggccaagacgcgggtgctggtgaacgcatgggccatcggcagggacccccgcagcggggcccccaggcccgaggagttcgaccccgccaggttcgaagacggcggcgacgtggggttcaacggcacgcacttcgagctcatccccttcggcgccggccgccggatgtgcccgggcatagccatgggcgtggccaccatggagttcacgctggctaacttgctctactgcttcgactgggagctcccggagggagtgggggtcgaggacgtgagcatggaagaggccggaagcctcaccgtccacaagaaaacgccgctcctccttgtccccacaagatacaaagccaactgtcagagtcgtcactctttccaattttgaaaacaacggtacaagactggtcaatcttgtggtggattttcgaggattcaacctttagtcctaagaggagcaaggctaataaaatagccggctgctgactatgtgaattttttagccatctcttagttcatccgtacaaatcatataaatcatacgtacagaccaagcctgtgaacaaggggcctgacccttcagatatacgagggtacaac

SEQ ID NO: 7530 - DNA, 1201 bp, Zea mays
gggacatccacatggcgtccgcccaaccctccaaaccaaggcggccaagccccttccatttgccaggcggccacaccatctgatccccaattcgtttccacctatcgagccaaggtgcgacgacggcggtcgcagcgtcccctccctccctccgtaccgctgccgccggtctaccaaacggtgaaatatttacgtaagcgaatcagggtcttgaagatagcttccagatatgtggggttttgcatcaaatgcttgggcatccgggctggggaagaggagtcccccaaattgcacctcttcgagtgctgcttgttccgatgacgaagcatcctcgtgcacgagcagggaagaaggcctggaatgcccaatatgttgggagtctttcaatatagtggagaatgtgccttacgtgctatggtgcggccacaccctttgcaagaactgcgtcctaggacttcaatgggccgtcatcaaagttccaactgtgccgatgcagctacccttcttcgtttgctgtccctggtgcaacctcctgtcgcttcgcatactttacaaagggaacctcacgttcccacggaagaattatttcctcctctggatggttgaggggatgaatggtgagcgggccagatcacgcccagctactcacagcgagcaacatactccatggctctcaagcagcagcagagcaaatggaaatgcaggctgttcaaatcccacaagacgccaccttccgctgccaccgccggttgacactacttcgcccaccaatgcaaatcatgccaaccatggggtccctgtccctctgctgaacgcagagagagtacaagcttcgctgcgcaagtccttgtcgttcctggttcacctgaccgccaagtttcccctggtgttcatcttcctcctcatagtgctctatgcgatccctgccagcgcagcagtcttgctactgtacatccttatcacggtgctgttcgcgctcccctcgttcctgatactgtatttcgcgtatccgagcctggactggcttgttagggaaatctttgcctgagatttccttgttcggtaaaatctcaatactgttgttgagtccttgtataactgaaccttccctagatcttgttgcaagcgtggatgctattgcaaagttttggtttttacaccatgagatgtgtttacctcaagtccaaaaaaaaaaaaaaaa

SEQ ID NO: 7531 - DNA, 4835 bp, Zea mays
  misc_feature (3245)..(3245): n is a, c, g, or t
tatgatttcaaaacaaaagaagcaaacaactagtggccctaacatgtttgcatcagcctctcctcatgtgggctagttgttcctttcctagcgacataaggtgagcaaaagagtcaaacaacccttacgattgtcactctatgctgatctttttgatttgatatctcctaaaaatatgtttctgtcatttgtctttgctttcctatgcctgtatgtttgtgatctctgaatagttatttctgtctcttggcctttttgaatgagggtgttttagagtaaaagcgctagttagctctgtgcattcttgtatttgtatgacactttgtcgtttggctacttatttcctgaagaatgctaatatttcaaacgatcccattcctacccactccctttggtaaaaatatgcacttacacagtgatctgatttgatcttccaccaacttacatgcatttttctaagttcttataggtttatgtctccctctttctaaaatgccaacattagctatacattgtaattttcttattaatgctgtgttctatatggaagctctgatacatggttcacttgtttcaggtctacccccaagtgaaatcagggtcttcaagatagcttactgagatgtggggttttgcatcaaacgcttgggcagctgggctggagaagaggagttccccaaaccgcacttcctcgagtgctgcttattctgacgacgaagcatcctcgtgcacaagcagggaagaaggcctggagtgcccgatatgttgggagtctttcaacatagtggagaatgtgccttatgcgctatggtgcggacacaccatgtgcaagaactgcatcctagggcttcaatgggccgtcatcaaagtcccaaccgtgccgatccagctaccgttcttcatctgctgtccctggtgcaacctcctgtcgccccgcgtactttacaaggggaacctcacgttcccacgaaagaactatttcctcctctggatggtcgaggggatgaacggcgagcgggccagatcacgcccagctattcgcagcgagcagcatactccgtggctctcaagcagcagcagcgtggcaaatggaaatgcaggctgttcaaatcccactcgacgccacctcccgccaccatctgttgacacttcgcccaccaacgcaaatcatgccaactacggggggtcccctctgctgaacgcagggagggtacaagcttcgctgcgcaaatccctgtcgttcctggtccacctgactgccaagtttcccctggtgttcgtcttcctcctcatagtgctgtatgcgatcccagccagcgcagcagtcctgttactgtatatccttatcactgtgctgtttgcgcttccctcgttcctgatactgtattttgcatatccgagcctggactggcttgttagagagatctttgcctgagattttttgttcggaaaaaaaaatctcaatgctgttgttggggtctgtgtaactgaattctccctagattttgttgcaagtgttgaagttattgccaagttttggtttgggacccatgccgacatgtgatagatatgtttacctcaagtctccatggtatggaaggtcctctgttgctgtgttgcattgcaacacatcagcgtgctctgtgctgctgacatctgttatgttggcttgtatcgcttgagtgcttggaatggcagggattgacgaagtgtgggggtatctgaaaagaaaagttctttttttttctggatttggtatggcttctcgaaatatatttgtgtcaagctgcctaaccactttgttatccttacaagtggcgccgtagtgacaactgttttctgaaacaaaactgtttaactacgggagtgtttggtttaaggtcaaagagggataaagtgggatgaggcgggggcgatactgttctctcgatttttgggatcacgtcgccataaaaaactactccgatgtttacctcatcactacgataaaaactgtggtcgctctattctatttcttcgtgtacatccaaccaaacacattatacattactaaaaccgcgttaaaatgtgaacttgagccctggaactgcggacacgaacaatcgaacatcacaatcaccggaccgcaaccagcgtactgccacgccacgctggtgcccgtgaaagaaagctagcagcgttctgtgggcatgccatgccacttgttcgctatgtggcattattggcgagccgggtggagccaagtggttgatcgcccttggcgtcctagacgaggctgacgagcgagatgatagcagcaaccagctacccaacttggccggcatgagtatctccgcaaatatactctttgtcatctgcatcccagtccacacacgtacgtgccatcgacttggcattcttgctggtcatgtcatggtcatcctcggcttgcaacttggtgacctcgacgcccacgaacaaggacgacgacgcaggaaggctgaaagcgaaacggaaatgtgggtcgatgtcgatcaagagccaacgtctaggtaggatttcagttcgaggcgacagaactgacgctggatcgatgaagatcgtcgccgttggtttctgatccagcacctctcccaactgagccgcgcccaaaggtgtagtgctgcacgctcgctgccagtcgttccttgacggttccacaaactataaaagcaacaacttggtatatcccagccagtctcaagggcgaactctgttcttatttcccaagtgttgcttggagcgtctgctctccaaagatgttgagatctgttctccctttacaaaggtagagtacacttcagtcttagctggacatttgcgtattggctagctggtccatagcaagtggtaccggccgctcacatctaaatcgccaagttgcaagcctttaaatctttagcgttcttttttttttgtccctcccttttccttatatttataactttattgaaaacagttttgttataataatgtgcccgagcaaaaaaataaaataaatcgtcccatatataccagaaatatctcttttacgattttatctctccccccccctactcgaacgtcttcgccaataagagcaactccgaaaacctttgtttatcattccatatcgatatgaatgtagattttggtgaaaaatgtcttccgacagattccttaattagatcttcaaatcttgccatcctctattctaggtttctctctaaccaaagatagaaaccaanaatgattcactagagtacgcataaggtatagaaaagttgttagagggcaaaaagatatagagaacagtttttttttcaaatggctctgttaatgtggatttagagaaagagtttacaaacgactcttggagatgctctaagaactccaacgaggttagggttcgaggcacgaggttggtgctttcttggagatatgccagccttagcggtggacatgcccagagggaggttgtgggtgcgaggctgccacagtcgtgtgaggtggaggaggtgttgggtagggcagaggcatggggggtttatgtaaatctagttagcttaatatttgtttgaagaggcaaatatggtagcacccattgtggaatatgatatagggaaagtgggtcaatggagtgacgatgctaggcagcatgaaaatagagacattaatgtggcacaggtggcaaaggagcggtaggtaaggtctttggctcctcgccactaggaacagttagaggtagggaaatgagtagtgtgttggcattggcttatggaagaaaagaagagggcttggggatataggaagaaaaaaaatgagggccatgatgatcgggtcgctaaaaactagggttgtatgtggtaagtgatgtgcccatcgacaatgatatatgtgtagttacttcacttagtttttcaaattaggaatgcaatattttttatatgttgttttcacattcttagtggccaatggatggttagagagtatgtgtaacattggaattaattgcttcttcactaagttcaactttatgttacttgggcatgtctttgagattattccttatattcttggatacatgaacaacattatgagggaacaacagtagaattcaaaatctaagcatgacccaattatgctttaaagaaagaagaagaggagagaaaaataacctgtcaagagatcatctaggaatgcaagtaatgctcctcattagaaagagggatggtagattctctggtacataaatagataagtatcatattctaccagaggggaagaaaagaaatagcaaggaattgaccgacagtgatgatgaggatgatgatggtgcaagagagggtgaggatataggccaaccaccttgaaaggaccttgatgtcacctttaggagggtgaataagcattcatgacaattaacaaagcggattaacaatgcacataacctctatgtaatcatgtcgaacttatacacaaaggcctagaacctccgctcaacatagagagctcaaacaacaaatatgactagggttttatcacgaactaaacttatgtatgtgtttggagatgtctagcatcaagtctatgaagtatctacactcataaacacatgaaaccaatgagatcaagtggaaaaaatgttgcaattaaaaacacaagagagaaggatctgtttcaccgaaattcaggttcctacttgagccttacgtttgtgttgaggtgagaagctcacaaagctcgtgctcatgttaggtccatcttgacctcttttctcatctccactagtttatatttttccttctaggggcaagattatagcccttgcaaacttt

SEQ ID NO: 7532 - DNA, 1268 bp, Zea mays
cattgggaccctcgagcccggcccggccaccgccacccaggcccgcaactgcagatccccaattcgtttatttcttcccaccgagccaagctgcgacgacggcggtcgcagcgtcgccttccctccctccgtaccgccgacgccgacgagcatattgggccgagcgcccgagcacctctcctgtcagcagcggcactcgccattccaagtacgaggtcgacgcgctgtggggcttgctgaaacgagcaggtctacccccaagtgaaatcagggtcttcaagatagcttactgagatgtggggttttgcatcaaacgcttgggcagctgggctggagaagaggagttccccaaaccgcacttcctcgagtgctgcttattctgacgacgaagcatcctcgtgcacaagcagggaagaaggcctggagtgcccgatatgttgggagtctttcaacatagtggagaatgtgccttatgcgctatggtgcggacacaccatgtgcaagaactgcatcctagggcttcaatgggccgtcatcaaagtcccaaccgtgccgatccagctaccgttcttcatctgctgtccctggtgcaacctcctgtcgccccgcgtactttacaaggggaacctcacgttcccacgaaagaactatttcctcctctggatggtcgaggggatgaacggcgagcgggccagatcacgcccagctattcgcagcgagcagcatactccgtggctctcaagcagcagcagcgtggcaaatggaaatgcaggctgttcaaatcccactcgacgccacctcccgccaccatcggttgacacttcacccaccaacgcaaatcatgcccaaccacggggggtcccctctgctgaacgcagggagggtacaagcttcgctgcgcaagtccctgtcgttcctggtccacctgactgccaagtttcccctggtgttcgtcttcctcctcatagtgctgtatgcgatcccagccagcgcagcagtcctgttactgtatatccttatcactgtgctgtttgcgcttccctcgttcctgatactgtattttgcatatccgagcctggactggcttgttagagagatctttgcctgagattttttgttcggaaaaaaaatctcaatgctgttgttggggtctgtgtaactgaattctccctagattttgttgcaagtgttgaagttattgccaagttttggttttggacccaaaaaaaaaaaaaaaaaaaaaaaaaaaaaaaaaaaaattaaaaagg

SEQ ID NO: 7533 - DNA, 1820 bp, Zea mays
tccctgcacgtttgtctccttcccggccggttcattcggtggtcccaagaacgcccacctccggcagctgtggacagggccttggacttggagagaggttgctcctgttcaaggccgacatgcccgatcccgacgccctggcggccgcggtcgccgtcgccgggtgcgagggggtcgcctctcctgtgtcctgtgcccgtagataaggtcctcaatcctgaggaaagttccggtccaatctcttccaattgacaccgtgttggtgttgttctgacttctgttgaataggatgaacctgcatttacggaaaaaattctccctttgatgacccaacccctgtgaaaacaaaacaaccctcagaagatgtccaaactccaaacacacgaaaaggggagcgtgcgacgactttccgccgacctgcagagctgaatgtgcatttttggtcgtttgcatccttcgccgccggctctttctgcgtgttcttcttcttgtcgatttccgtcttgtgtatatactatatactatgctgctgtgctgggttacaagacaagcaagtggcaactggcaatatacggacaagccgtggcgggtatatacggacgaagaggaggaccggaggaggaagcttcagtgaggccctggactgcagcgggatggcgtcgccgccgccaccacgcgtgtgcgtaaccggtggcggcgggtacgtcgcctcatggctcgtcaagctcctgctctcccgcggctacgccgtgcacgccactgtccgcgacccaagtgatcccaagaacgcccacctgcaacagctggacggggcccgggagaggttgcgcctgttcaaggccgacgtgctcgaccgcgacgccctggcgaccgcggtcgtcgcgtgcgagggcgtcttccacgtcgcctcccctgtgcccgcggacaaagtcctcgatcccgagtccgaggtgctgtctcctgctgtcaagggcactctgaacgtcctccaggcctgctcggcaaacaacgttcagaaagttgtcgtggtttcgtccacggctgctgtttactttaacccgagctggccccaaggtagaaccaaagacgagagttgctggtcagacagagatttatgcattaagaacgagaactggtactgtgctgccaagacgattgctgaagaaactgcagtggagtatggagagaagaacgggctggttgttgtcacggtctgcccttgtatcgttttaggcccactcctgcagccgctgatcaatgccagcagcgaattactcatctacattataaaaggaggtcctagggtgctgaaaaacctcccctggaacatagtcgacgtccgtgacgtagctgatgctttgctcctagtatacgagaaagtggaatcatccgggagatacatctgtgcgcctaatcggatcagcacaaacaacatggtgaacttgtttaaaaagtcctaccctaactacaattatgtgaactgcgacaacaaggactatgaatctgaaatctcaccagttacatcggagaaacttaagagtctaggctggaacccaaggacaatggagaaaactttgttggacaacattgagtatttcgagaaggcagggtttttgcgtgatgcagagggttatccttgtcgtctactacctcatatttttcatttcgcttctgactaatgaaatagattctgtaaaacaattacgacaactactataactgtctttggacaattcatttcaaaaaaaaaaactgtttgttttcagatgtactgcacacgcttttacagattgaactggataacaacaagccttcattat

SEQ ID NO: 7534 - DNA, 1769 bp, Zea mays
aatcgcttccccagaccccagtccccagtccccttttcccaacggccacactttcatcagttcccctttccacggcgccgccggaatccccacaaagcccccaaaaccctacggccacctcgccacccccaacgaaaacccagaccacgagatggcccccggtggagagggcaagccaagcacgggcggcggcggcggcggcgtcaagggtgggaggaagcgcaagttccttccccacgggaagccggtgcggaagggggcctacccgctgcgccccggcgtgcagggcttcttcatcacctgcgacggcggccgcgagcaccaggccacccgcgaggcgctctccctcctcgactccttctatgaagacctggtggatgggaaaggatcggatgagaagcctaaaaacattccagacaagccactgaacaaaaagataaagtttgaggactctgattcctcagatgatgaggatgaagacaactctggtgaggaagccgacaatgggaatgtgaatgatgtggagaaaggtgaaaccgctccatctgagaagcaacaggaggtgcttgatacctctaataccgcaagcaaggacaatactgctctatctgagaagaaagaggaggtgcttgatacctctgataccgtgagtaaggacaatgaggaacaagcagtcactgctgatgaaccaagagaaaagaagcaacgagtggaagatcctccagtttttgagcaggccgtgcaaaaagagactgctgatgaaccaaaggagtccactgataaaccaaaggagtccagtgaaaaaaatattgacgatttaattgatgaggacctgaaagaaataggggacaggaaaaagaggctctttgcaagcctcgagacaggctgcaatggatgcatattcattcaaatgcataaaagagcaggagaccctggtccagttgagattgtacaaaacatgatgtcatctgctgcattgactcgtaaacatatgtcaagatttattctgcgagttttgcctgttgaggtggcatgctatgcatctgaagaggaaataacaaaggcaattagtccccttattgaaaagtacttcccaaaagaatgctcctcaggtcataagtttgcagtgttatatgaagcaaggtcaaacacaggaattgatagaatgaaaatcataaacgcagcagcgaaatctgtaccacaacctcataaagttgacctgaagaacccagacaagactattgttgtccagattgcaaagaccatatgcatgattggagttgtggaaaggtacaaagagctctcgaagttcaacctaaggcagctgacctcaccggagtcggagaagtaagcctatgagtgacaaaatcttccaggcaaaacgtggaccaacttaaatcagcagcagcgtcaggtggttaggcgctagcgaattaaattaaggccggccgaacctcactgtcttgaaagattcagatgttctaatgtttaatgctttaccaccagtggttagtggttgctggttcatgcttcccaggttagagtcacgatttttttttttgaggctgtagaaagatctgacgatacttcatgtgtgctttctctctgacgatggttccatacaggggcttaccaaagacgtagaatctatcgttgcagctccattgctctgagcatttctatagcttgaataaatctgcgtgctaggtttctatgcatgagacctgaaatttaaaaaaaagttgcggtcaaaaaaaaaaaaaaaaaaa

SEQ ID NO: 7535 - DNA, 1407 bp, Zea mays
  misc_feature (1352)..(1354): n is a, c, g, or t
cctcgaggccggccgggctggcctggccggtctgcctcgtccgcttctctctcacccttccttcccctcctctcctgtggatgctccctccctctccggctctccgcctctcccccgccccccaagcccaaatcaccgcgcctcgccccacagcaccggttgcgtgggaggagggagggaggaaggaaggaggggaggcggctgtcgggcgagatgagcgactcctactgccccgactgcaagaagcatacggaggtggcgttcgaccattcggcgggggacacggtgtgcaccgagtgcggcctcgtcctcgaggcgcactccgtcgacgagacctccgagtggcgtaccttcgccaacgagtccaacgacaacgaccccgtccgcgtcggcggcccctccaacccgctcctcaccgacggcggcctctccaccgtcatcgccaagcccaacggcgcccagggcgacttcctctcctcctccctcggcaggtggcagaaccgcggctccaaccccgaccgatccctcatcctcgccttccgcaccatagccaacatggctgacaggctaggtcttgtggctactattaaggaccgagcaaatgaaatcttcaagaaaattgaagatctcaagtctattaggggaagaaatcaagatgccatattagccgcatgtctatatattgcttgtagacaagaagatcgccctagaactgtgaaagaaatatgttcggttgctaatggggccacgaagaaagaaattggcagagccaaagaatttatagtgaaacaactggaagttgagatggggcaatctatggagatgggaaccattcatgctggagattttctgaggcgtttctgttcaactcttggaatgaccaatcaagctgttaacgcagccaaggaggcagttcagcgctcagaggagcttgatataaggaggagcccaatctcaattgcagccgccgtcatttacatgataacccaactctcagaggacaagaagccacttaaagatatatccttggctactggtgtggcagaaggcaccatcagaaattcgtacaaggatctgtatccctacgcctcaaggctcatcccgaatacctacgccaaggaagaagacctgaagaatctctgcacaccttaggaagctttactttttttccccttctgttatataaatcggaattagatttgtcaaagagtgagtgaagttgttcctgttgtgaccgactgtactgagcaatgtgtcgtcgccggcgcgcttaactttgtggatggaccaatgagaacagaagttgtcatcatcagatcgaatttcttttcagagcaaaaaaaaaaaaaaannntaaaaaaaaaaaaaaaaaaaaaaaaaaaaaaaaaaaaaaaaaaaaagggcggc

SEQ ID NO: 7536 - DNA, 1839 bp, Zea mays
ttttcttagatgggttgggtctcaaagtgatgtctagagcagcctatatctaagtgatcccgaattccaaaatccggtaacaaaacggtatcatcccgataaaaaacgggatcccggttaaacggtcgggaaaacaactctaccgttttcgtttaccgttttcgttccgttttcgttttttacatcagattcaaaatcaatcggaacaaaactaacaaaatcgattatgcgataacagccccgacgccgccggccgcgtgcgatcctaaccctcacccacccaaccttcggcagtccccatcctctctcctgtgggcgctccctctcccccgcccccaaatcatcgcgcctccctcgccacgcctcacagggccggttgcgtaggagaaaggagaaaggaaggaggggaggcggtcgtcgggcgagatgagcgactccttctgccccgactgcaagaagcatacggaggtggcgttcgaccactcggcgggggacatggtgtgcaccgagtgcggcctcgtcctcgaggcgcactccgtcgacgagacctccgagtggcgcaccttcgcgaacgagtccaacgacaacgaccccgtccgtgtcggcggccccacaaacccgctcctcactgatggcggcctctccaccgtcatcgccaagcccaacggcgcgcagggcgacttcctatcctcctccctcggcaggtggcagaaccgcggctccaaccccgaccgatccctcatcctcgccttccgcaccatcgccaacatggctgaccggctaggtcttgtggctactattaaggaccgagcaaatgaaatctacaagaaagttgaagatctcaaatctatcaggggaagaaatcaagatgccatattagctgcatgcctatatattgcttgtagacaagaagatcggcctagaactgtgaaagaaatatgttcagttgctaatggggccacaaagaaagaaattggcagagcaaaagaatttatagtgaaacaactggaagttgagatggggcaatctatggagatgggaaccattcacgctggaaattttctgagacgtttctgctcaactcttgggatgaacaatcaagctgttagggcagcccaggatgcagttaagcactcggaggagcttgatataaggaggagccctatctcaattgcagccgctgtcatttatatgataacccaactctcagaggacaagaagccacttaaagatatatccttggctactggtgtagcagaaggcaccatcagaaattcgtacaaggatctgtatccttatgcctcaaggctcatcccgaatacctacgccaaggaagaagacctgaagaatctctgcacaccttaggaggcttacttttttccccctttctgttactacataattcggaattagatttgtcaaagaggagtgagtgaagttgttcctcgttgtgactgtaccgggcaaggtgtcgtccccgccgtgcttaactttatgatggaatttcttttcagagcacctaccacctgaagatttgtgggatacgtatactcacttcggaaagaatgtagatagcaagcagttggacaagcacaagattttaatttaaaacatgattttgttctccatcttctgaagaaaaaaaaaaaagaccatcggcggccgcagtgccctccttgataccaagagaattgttagttgtctaaaattaggtaaaattatgatatgtttggactggcaaccccaatctagtcccattaactcctatgtattatgaataataaggtgccgttccgttttcacggaacggagacttggaacaaaaaaaaaaaaacaagg

SEQ ID NO: 7537 - DNA, 2074 bp, Zea mays
ggcgattgggtttctacgaggccggccgctctggcctggccggtctgcctcgtccgcttctctctcacccttcctccccctcctctcctgtgggtgctctccctccctctccccccccccccccccccccaagcccaaatcaccgggcctcgccccacagcaccggttgcgtgggaggaaggaggggaggcggctgtcgggcgagatgagcgactcctactgccccgactgcaagaagcatacggaggtggcgttcgaccactcggcgggggacacggtgtgcaccgagtgcggcctcgtcctcgaggcgcactccgtcgacgagacctccgagtggcgtaccttcgccaacgagtccaacgacaacgaccccgtccgcgtcggcggcccctccaacccgctcctcaccgacggcggcctctccaccgtcatcgccaagcccaacggcgcccagggcgacttcctctcctcctccctcggcaggtggcagaaccgcggctccaaccccgaccgatccctcatcctcgccttccgcaccatcgccaacatggctgacaggctaggtcttgtggctactattaaggaccgagcaaatgaaatcttcaagaaaattgaagatctcaagtctattaggggaagaaatcaagatgccatattagccgcatgtctatatattgcttgtagacaagaagatcgccctagaactgtgaaagaaatatgttcggttgctaatggggccacgaaaaaagaaattggcagagccaaagaatttatagtgaaacaactggaagttgagatggggcaatctatggagatgggaaccattcatgctggagattttctgaggcgtttctgttcaactcttggaatgaccaatcaagctgttaacgcagccaaggaggcagttcagcgctcagaggagcttgatataaggaggagcccaatctcaattgcagccgccgtcatttacatgataacccaactctcagaggacaagaagccacttaaagatatatccttggctactggtgtggcagaaggcaccatcagaaattcgtacaaggatctgtatccctacgcctcaaggctcatcccgaatacctacgccaaggaagaagacctgaagaatctctgcacaccttaggaagctttactttttttcccttctgttatataaatcggaattagatttgtcaaagaggagtgagtgaagttgttcctgttgtgaccgactgtactgagcaatgtgtcgtcgccggcgcgcttaactttgtggatggaccaatgagaacataagttgtcatcatcagatcgaatttcttttcagagcacctgccacctgaagatttttttgggatagcaaaggtgtcgttttcgtatactccctttgggaaaggatgtagatagcaagcagtccttggaagtgcacaagattttatttaaaagaacaggattctgttccccatcttcaaaagaaaccgtcatttatccatcattctgagtcaaacaaaatgtttagccaagttgtcaactcgctattagccaattagctgatcaatcctaacttactgatcaacccagcaaatttaagttaattttagccctggccatggcaagggggaacatccttgtccttaacgttgcaagggggaaacatcatgtgaacctttcgaagaaaagtctctgttcatgtatggcgtgtttggtaggctacatatgggccggccaggctgctgtatctgagatacacgtttggttgcttgtctctgtatctggtggactgaagggtatatctgtgctcacctgcattgcgggatgcaacagagtcaggctatggagaaacgggtttcatttctgtgtctcaggatttggttgcttgtctctgtatctggtggactgaagggtatatctgtgctcacctgcattgcgggatgcaacagagccaggctatggagaaacgggtttcatttctgtgtctcatgagtggctagcctgtttggagcggccaggctacactgccaaacgaaccaaacatgctagtagtatttgtcacccgtgggcaggttagcagggg

SEQ ID NO: 7538 - DNA, 868 bp, Zea mays
ggcgattgggtttctacgaggccggccgctctggcctggccggtctgcctcgtccgcttctctctcacccttcctccccctcctctcctgtgggtgctctccctccctctccggctctcccccgccccccaagcccaaatcaccgcgcctcgccccacagcaccggttgcgtaggaggaaggaggggaggcggctgtcgggcgagatgagcgactcctactgccccgactgcaagaagcatacggaggtggcgttcgaccattcggcgggggacacggtgtgcaccgagtgcggcctcgtcctcgaggcgcactccgtcgacgagacctccgagtggcgtaccttcgccaacgagtccaacgacaacgaccccgtccgcgtcggcggcccctccaacccgctcctcaccgacggcggcctctccaccgtcatcgccaagcccaacggcgcccagggcgacttcctctcctcctccctcggcaggtggcagaaccgcggctccaaccccgaccgatccctcatcctcgccttccgcaccatcgccaacatggctgacaggctaggtcttgtggctactattaaggaccgagcaaatgaaatcttcaagaaaattgaagatctcaagtctattaggggaagaaatcaagatgccatattagccgcatgtctatatattgcttgtagacaagaagatcgccctagaactgtgaaagaaatatgttcggttgctaatggggccacgaagaaagaaattggcagagccaaagaatttatagtgaaacaactgggagttgagatggggcaatctatggagatggggaccattcatgctggagattttctgaggcgtttctgttcaactcttgga

SEQ ID NO: 7539 - DNA, 1406 bp, Zea mays
actcgcccactcccgtgaaccccaaaacccttcctccccaaacaaccggcggcggcgcgagggcttcgctttgcatccatggctctcgtcgccggctcctacgagcgcttcatctggggcttctcactcaaaaccctgacaaccccctccgccaccggcgcctcgccctccgagaccctcaccctcgcgccgctcttctcgtacccggcccacacgggcccggtgcgctgcgtggccgcggcgccgcgggcggggctggtggcctccggcggcgcggacgactccgtccgcctctacgacctcccttccgccgcggacctcggcccgctcctggacccctcggccgccgtctccgcactcgccttctactcccggggccccgtgccgcggaacctcctggccgcctgcgacgacggctcgctccacatctacgacgccgacggcttcgcgctgctctccacgctccgcgccttcccgcgccacgaggccgccgaggcgctcgccgtgcacccgtcgggccgggtcgcgctcgccgtcggccgcgcgggggcgcttgccatgctcaacctcgtccgcggccgacgcagcttcgcatgccgcctcgagcaccctgcgtccgcgatcgcctacgctgaggacagggatggcggggaccgattcgtgatggctgccgagaacaaggtcagcgtgcacgactccgtggatgccagggttattcatgatatggactgtggcaagaaggtgctcgccatggcgcccgcaaagagtggggtcctttacactggtggcgaggaccgttgtattactgcatgggatctgtccagcggcaaggtctcctcacgcattgagggtgcccatgcaactcgtgtaaaaggggttgttgtttttggtaatagcaatgatggatcacagctctccaatctaatttcttctgcttcgtccgatggtgtcataaggatatgggacattcgaacaatcgggaacggaaagcctactccattagcagaggctaatacaaaagcaaggctaacttgtcttgctggaacgtcactgaaatgactcaaggaacctacagtttgctaggcgtctgattctgcattgttagctgaattagaaaacctggacatgaaagaagaaattgaaggtgaaagatctggcacgcgagcattatctgtgtgcgtttggaacgtatccatccattatgtacaccgacatagttttggcttagtgtctgagctgcataacttatttatatttgattgcgcgacaagttttgcaatgagaaccgttttcagtactaactgtgcaattgcatcacgtacgggactgagttctctgtcaagagagtcattgacgccacaagttattgcagtggcaatcatttccagtttgcatcatttggcatg

SEQ ID NO: 7540 - DNA, 810 bp, Zea mays
ggcaattgcccagcatcattatgcagtctcagaatgaaagcattaatggtataagttggatattcattcagagaggctcaagtgatagctgcaagtagttttaccttgtgcccagttttcttgtttttttagttttgatagaaaattcttctgctacctatacatgaatattactgattgcttgcactaatgaaagtcaaaatatcgtgggacatccagctgagcaagaagatagtgctgcaccaagttcagtttttttgtcatcaagttttaggctgcttggtacatccacctgagtgagaagacagtgctgcaccaagcgagaagatagtcctgcaacaagttcagtattttctctcgtagctcttgcgatcggcttcctgctggtgacctgcaaccttctcttgtagctcttgccatcggcttcctcgatggccctcgacggcgaacgctggtgatcatagaaaccatattgtagaaacgtctgcgtggttgaacaattgatttcaaagtgttttatgaaaattatagagagctattggagcattgtttttttatttactattttttaaagagatcccgatacccttgttttgggagctataactttaggagttgttggagatgcttttactaattctgaaccgatgctgtaacaacatatctgatgagaattgttttggttagagctaggatctctattattcattattgtgctgttgtaataagacttgccttgcctagctatctgcttgaattaaaaaaaaaaaaaaaaggttttgatgggacactcattcaaattaaccaact

SEQ ID NO: 7541 - DNA, 3761 bp, Zea mays
  misc_feature (2077)..(2077): n is a, c, g, or t
  misc_feature (2506)..(2506): n is a, c, g, or t
  misc_feature (2509)..(2509): n is a, c, g, or t
  misc_feature (2547)..(2547): n is a, c, g, or t
  misc_feature (3458)..(3458): n is a, c, g, or t
ggggaagagaaatttgtcaaaatgggtcgccctcctcgcgacgcagtgcgaccacgccgccaccttcgcctaggaaccgcgaccgctccatgaagaggggatcagatttgctcatcgcgacctaccttggggattcattttgtgttgttgggttggatggggagaagtgtcgagcacatggtgcttgcagtttggtttgtttgtgttgacgatttctctgtggggcgttgcagggaagatgggggtcgaggagaggcaggcgcagaagagctcctaggaggagcatcccaagaacctcatcgtcgatgccatgatgctggactcccgcgctgtcaatctcgacaaggggccaccctgtcgctctggacaagggggctgccctaaggtcctgtttttgcttccttcagatgaaggaacatctatcctggagcttggtgctggaataggttgtttcactggagaactcgctaaaacagttaggaacgtttttgcactagattttattgaaagtgcgattaaaaagaatgaaagcattaaggtatgcagttggatattgcattcagagaggctcaagcgatagctgcaagtagttctaccttgtgcccagttttcttgttcttttagaaaattcttctgctacctatacctggatgttactgatagcttacactaatggaagtcaaaatatcgtgggacatccagctgagcgagaagatagtgttgcatcaagttcagtttttttgtcatcaagttgtaggctgtgtggtacatctagctgagtgagaagacaatgctgcaccaagcgagaagatagtcctgcaacaagttcagtattttatctcgcagctcttgcgatcggcttcctgctggtgacctgctaccttctcttgcagctcgtgccatcggcttcctcgacggcgaacgctcgtgaccgtaggaaccatattgtagaaacatttgcgtggttgaacaatagatttcaaagtgttttatgaaaattatagagagctattggagcattgtcttttttggatttattatttttaaagagatcccaatacccttgttttgggagctataactttgtgagttgatggagatgcttttactaattctgaattccgatgctgtaacaacatatctgaagagaattgttttggttagaactaggatctctattattcattgttgtgttgttgtaataagacttgccttgcctagctatatgcttgaatggaaggttttgttgggacaacatgtaagtttgttctctatccattacataaggaatcatatgtaatctcatttaaacatggtctatgtgatatatagaaactgtattaatgaacatcagtgccctggagaacaagtttaagtaagaaacatcgtttggggtggctgctaatgaacatcagtgccctagagaacaagtttaagtaagaaacatcatttgggggtggctgcatatgaccattgagggagtcatattcaacaaatattttcctttcagtcatacaaacgcaactaagatcctgttcatgccttttctgttcatatgattacttttgtccttaatgacatacaacatacccaaaatgatctttattccacgctatagaattacaatcacgctcttggtgctactatgatcatttctggtttatccattgttgtccattatacatagagtactcgagtaatagcatgcctgctgattcgtgctcattttggacatttgactatgatgggtacctaccactaaggtaactgttacttttttctgcactatgtacatgtttaacactgcgggcatacactttttccccaccgatctaccacacttctatttttgtgcgcgcgatcaacatcactgtgtacttcttgcctccacatgccttccctcgcactacaccaacagtatcgatcaaatatattgacgtcggatttgtagtgacacggtgaggcacccgatccatcaattctggttgcttgcttatccttggaacatatatgcacatctctggcagatgcctttccatgcataattttaataaggttataaagttaattttagtcnaccggaaggatgagacattgcacttagggttgcatttatgttagccttggctcttcattgtgccggttttggacatgcaagatggcgatgccagcatatgagctaatgttttggaaactctccccgcataatatgtttgaggattactttgaccaagctaggaatatgacctcaaggatcatgttgaagccgttggaagatcctcacgaggatctaattgctactgtatcatgtaaaacaatacctatgtttctttaccctttcaatatcatggttcctatctatatttaggatatgattgatgttaaagggatcaccaactgagctatattgtcaggttttttatttgttcatgctcgtgcgttgctaggatttatatttctctgtgatgttgacacaagcaatgcctacttggttctacgatctttnctnccagtgagtacgttggtagcttcttgtttttttgcttnctatgtatgacatctttgtcgttttaaattcctggggatgagtaaatataactggagaaactttctatgtgttcatatatccttatctcattatgctagctctgtaaatcatgcaaattctaaaataggcatatcatataactttgattactcttgaacaatttaatttaagaaacaactatgtttgtatatgaacagaggatagtcgtagaaatgcacggacaccttactatatcttttaaggtatgtaaatatccattttagtgatgctaacaaaagtatagagaataataattagtgttttttcatatcaatgtattttatcatattgattttgtaacaacgcacgagcatatacctatcatatataaaagtctgtatgatacttatagttgtaatgtagtggtgaaataagctagattaaaataacaaaatttatgtatggctaagatcacaaatgaatccactaagacacacaaatatataacacatcaaatattatatgaatccactaacactcaaaaacaaatactattttggatagagggagtatttattatttgcttgctctgattgtgttgtcatcaatcacaaaaagggaacgattataaggaaaaacttattgagacccatttgataacattgttttggtatttgatgaccaacataataattttgactaacattatttgctagtatctttggatatagtttaaaagatgcaacatagacttagacgaaggcaaagtggtgttcaagatgatcaacacctcaaacaagacattaaagacttaataaagatctataactatatgcaaaagttcaagacacacgatgaaaccaggccgaagataaagatcataaagaaacgaagcaggagaaaagtttgaagggcgttggaccaaagcgtnggaccatcctgagggagttgtcgaacaatacggttgaagccaaccctaaccggcaatgaaaagaagcatcagaccaaaacattgaatgagaagtagtgaaagcatcaaacatgtaatggtactattcatcttgtagaggcgttagaccataattgttcgcaggacatcgaactattgaagtagagcccttaatagctctttagtaatattttggatagcatcagacctagccacatcggtctgatggtggtggctaaggtggcatcaaacaagataaacacatcattcatcgaagcatcccca

SEQ ID NO: 7542 - DNA, 1469 bp, Zea mays
gcacgagaccattacctagaacatcctaatcgaggcggcttctcgattcttgaccatcctgctgttctgccttctccgtccgcgccttcgagaaggccacagagcgaaggaattgcagagttttcttggcgcgaaagaaggggagagagagagagaaagacgaagatgtttatccagaaggcatggaggacggcggcgtttgggctctacggcttcaaccatttcacaaaatctggtttcctggagcatgcgaagaaattcagagaggaggatatgcagatccggttggatggaaaaaattgcctagtaactggagcgaattctggcattggttttgctacggctgagggcttggcttcacatggtgctaccgtctatatggtctgtcgtaacaaggagagaggggaggcagctctcaaccaaataagatccaaaactggcaatgcaaacgttcatctggagatatgtgacctttcatctatcaatcaagtaaaatcgtttgcaacaaagttcacttcgatggataaaccactccatgtcttggtaaacaatgctggcttattagagcacaagcatgagactacagcagaagggttggagctcaattttgctgtcaatgtagctgcaacatacactttaacagagctagttatgccgtcattggagaaagcggcaccagatgctcgtgtcatcacagttgcatcaggaggcatgtacaccgagccactgaacaaagacttacagttcaccgaaggcaccttcgatgggacgcaacagtatgctcgaaacaaaagagttcaggtggcactgactgaatggtgggctgagaaaagcggtgacaggggagtcggtttctacgccatgcatcctggatgggccgatacgcctggggtcgccaagagcttgcccggactgtcagagaggttgtctggaaacctgagaacaaatgacgaaggagctgatacagttgtttggttggcttgcaacctaaggagaagttagcctcgggagccttttacttcgaccgtgctgaagcaccaaaacatttgaagtttgctgggactgcagattcgcacgctcagataaaccctatcgttgatagcattagatccatctgtggtctctctgttaatggttgagctgccaaagcaaaagtgatatacagctccatcgtcaatagcattagattcatctgtggcttctctgttaaaggttgagcttccaaagcaaaagtgaagtgatatattacttgatataatgggtgcatgattcataaaaccgcaaaaaattgaagagtggaaaaaaaaatgcaccagccgggaatcgaacccgggtctgtaccgtggcagggtactattctaccactagaccactggtgcctttgatgctaaagttatgtacgtatttaatttcttttgaatcaacaatcaaacatagatccaacattcttaccaaaaaaaaaaaaaaaa

SEQ ID NO: 7543 - DNA, 2127 bp, Zea mays
tcccatagaagatcccattctctttcttggttttgctttttcaactgctccccggccggtggctttctccttttcgagccgtcggcgccatgcagcagcttgctggtggccgtccgctgctggccgtgccgtggtcgccgccgtggcggcggagatggagacagccgtcgcggatgtgagaaaacagagatttatgacacatagtatgggacttggacgtacagtaccctgtatgatcgaaacagcaatcagtagtgaagggagaggcggagagccgcagaggagctgagcaagcgagcatcgcgcgtccatggcgtgaatgaatgcagcaggtgcagctgccgaacggcatggccactcacggccagccagccagcttgcaggatggatctccagccccgagctcagacttccagtgcccgcctcgtgactccgacgcccacaccacaggtcacgttccggcaacgtctggcttcgaccaatcgattccactcacgcattcactgcaccattaactcccttctagccgcccacctactcactccgtcctctttaaacccagctgcgcctcagtggctcattgcggccccgcgtgccaccgcagtctccctagcaccaccgtgtcttcaacgcacgggagatcgaagagcgtccccaagcgatcttgggttggctacttggctgcagctgcaggttggccggcggagatcgatggagctacagctgtcggccgtgctcggctcgctcgccctcggcggcgcggtgctggtgctgttcttcgttaagtggtggcagccgctggccggcaccgaccggcgcgtcaaggagcttgcagacgcggtggaggccctgctgcggcagcggtccgaggtgctgggccacgacccggcgccgtcgtcggataccgtgcgcgcgtggctgcggcgcgtgcaggaggcgcaggacgagatggcgtccatcaaggcgcggcacgacggcgggcagctatacgtggtccgcctggtgcagtacctcttcctccccacgggcccggtcgcggggctggccgagcagcagctcaaggcagtgcgcgcgctccgagagcagggcgccgcgatcctcgatgccgcgctggccacgccgcaggcgccgccgcctcttctctgcgaccccgaggagctggagggcctcccggcggaggcggggcccgcgagggcctacctcaacgaggcgcttcgcttcctgcggcgactgcgacgccgcgcttggcgtctggggtgccggcggcgtgggcaagaccacggtgctgaagctggtgcgcgaggtgtgcggccgcgtcgcgcgattcgaccacgtcctactcgtcgcggcctccagggactgcacggtggccaagctccagagggaggtcgtgtccgtgctcgggctgcgcgacgcgcccacggagcaggcgcaggccgccgggatcctgagcttcctgagggacaagagcttcctgctgctgctggacagcgtgtgggaacgtctggacctggagagggtcggcatcccgcagcccctcggcatggctaacggcaaggtgaggaagatcatagtggcgtcgaggagcgaggccttgtgcgccgacatgggctgccgcaacaagatcaagatggagtgcttgaacgaggaggatgcgtggagcctgtttcaagctaatgttggcggcgacatcatccatggccacgctcaaattcctgcacttgctaaacaggtaatcagcttatctgttcagacagtgcttttgctacttattatcactccatatataaaattcgaatttcgaggtgtatcccgtaatgcaaaactattataataaggaaaatatttgtaatccgctagtttatttctaaattaaaatgcgataaataaaaaattgaaaggagtatctttttattacatgatcttgtaacatccatattgtttcacaaagactctaggagtagtatattaagttccacaaagattataggagtagtatttaataataaagcaattattggtataagctttttcctatccaaatgaaatacctgtcagtcctgtcctgtcttaagatgaccagggggagtagttgtttcgttttgacgagtattttttcagttacct

SEQ ID NO: 7544 - DNA, 790 bp, Zea mays
gggatctcgctcaaagcaaagcacacacgtgataaaatcccctctaccaaattgcaagcaacttcatattctacgcgaggtttctggtcgcggagatcaacgtccacctaccgcggcggcggcgcaacaaggatgacgtgcggtaactgccgcggggagctggacctggatcggaggtcgtgaagagcatggcgagtggggcggttgaggctgctggccctgctggggctgtcgaagctggaggtggaggccatccgggtcgagggggagtgcgcgttcccggagctgcggcgccttcagacgagggggttccctcggctgaagaggattcagatgcgcccggcgcgcgggcagcagggcaccgtgcggatcgagtgcgacaagcactggtggaacgcgctacagtgggcgggcgaggacgtcaaggcctgcttcgtccccgtgctctgagtctccgactcacttcacttgagcacttgcagtaggaagacggagctgcaatttttggcgacagctgatattcgacgaccactggagctgcaatttaccgtgaaaatagaaatcccttgccaaactagccatcagtgatgggaaaacctgcgtgctggatgaggaaactttttattagttctcatgagtaccttgtaccgaccaattgtgtggcctaatccagtaagtcatctttgtaaaatcatactaactcttattgtaactggatttggtttcgaattaattcattttacgaaaaaaaaaaaaaaatatgaatataatattggctgtcagataataa

SEQ ID NO: 7545 - DNA, 2537 bp, Zea mays
gttgtcgcgcgcttcgaccacgtcctactcgtcgcggcctccagggactgcacggtggccaagctccagagggaggtcgtgtccgtgctcgggctgcgcgacgcgcccacggagcaggcgcaggccgccgggatcctgagcttcctgagggacaagagcttcctgctgctgttggacagcgtgtgggaacgtctggacctggagagggtcggcatcccgcagcccctcggcatggctaacggcaaggtgaggaagatcatagtggcgtcgaggagcgaggccttgtgcgccgacatgggctgccgcaacaagatcaagatggagtgcttgaacgaggaggatgcgtggagcctgtttcaagctaatgttggcggcgacatcatccatggccacgctcaaattcctgcacttgctaaacaggtcgctgccgaatgcaagtgcttgcctttggccctcgtcaccgtcggccgcgcaatgtcaaataagcgcacaccagaggagtggtccaacgcactcgacaccctcaaggcatcgctccgctccggcacgcccggcttggacaagagcacgcaggcgctagtgaagttctgctacgacaacctggagagcgacatggtgagggaatgcttcctgacctgtgcgctatggccggaggaccacaacatctccaaggaggagctcgtgcagagctggataggactcggcctgctccccgatctcggcgacatcgaagaggcccacaggttcgggctctcggtgattgccatcatgatggccgcgtgcctgctggagcccggggacaaccaccgctacaacatgttcccgtcagacactcacgtcaggatgcacgatgtcgtgcgcgacgcggcgctccggctcgcgcccgccaagtggctggtccgcgcaggcgctgggctcagggagcccccgcgcgaggaggcgctgtggcggggcgcgcagcgcgtgtccctgatgcacaacaccatcgaggacgtgccggcgaaggtgggtggcgccctagcggacgcgcagccggcgtcgctgatgctccagtgcaacaaggccctgccgaagaggatgctccaggcgatccagcatttcaccaagctcacgtacctggacctcgaggacaccggcattcaggacgccttccccatggagatctgctgtttggtcagcttgaagcacctcaacctatccaagaacaagatcctgtcgctgccgatggagctgggcaacctgagccagctcgagtacttctacctgcgcgacaactactacatccagatcaccataccaccggggctgatctcgcggcttgggaagctgcaggtgctggaggttttcaccgcgagcatcgtctccgtcgcggacaactacgtcgcgccagtcattgacgacctcgagagcagcggcgcgcgcatggcgtcgctcggcatctggctcgacaccacccgcgacgtggagcgcctcgcgcggctagcgccgggcgtgcgcgcccggtcgctgcacctgcgcaagttagaagggacgcgcgccctgccgctgctgtccgcggagcacgcgccggagcttgccggcgtgcaggagagcctgcgggagctggtggtctactcctccgacgtcgaggaggtcacggccgacgcgcacgtgcccatgctggaggtcatcaagtttgggttccttacgaagctgcgcgtcatggcgtggtcccacgccgccgggtccaacctccgcgaggtcgccatgggcgcgtgccacagtctaactcacctgacgtgggtgcagaacctcccctgcctagaatcgctgaacctcagcgggtgcaacgggctgacgagactgctgggtggcgcggaggacagcggcagcgccacggaggaggtgatcgtgttcccgcgtctgaagctgctggccctgctggggctgccgaagctggaggccgtgcgagtcgagggagagtgcgcgttcccggagctgcggcgcctgcagacgagggggtgcccgcggctgaagaggattcctatgcgcccggcgcgcgggcagcaaggtaccgtgcggatcgagtgcgacaagcactggtggaacgctctacagtgggcgggcgaggacgtcaaggcctgcttcgtccctgtgctgtgagtcatttcactaggcggacggagctgcaattttggcgccagttgatatgttcgacgaccacggtccacgggttgcaccacggttcaaggcaagatgagcgatgagattggaaatatctctcgaacagcgaaaaggcggtttgttttggatttcttctaagaacaattcaaattttggcttaattcccgttatgttgagaactggtgacctagttaaaggcgcttttgtcagtgctccggcttcttaaagacacttccggatctaattcctctagctctttggcttttctaaaaaagttgtagccattttataatttgtttagcaaaataacttatttctgtgtctatttcgaatgatgtacgagaacaacatagaagtcagaacaatgtagaagc

SEQ ID NO: 7546 - DNA, 626 bp, Zea mays
  misc_feature (561)..(561): n is a, c, g, or t
gcaaagtacacacgtccacctaccgcgccggcggcgcaacatggatgacgtgcggtaactgccgcggggagctggacctggatcggaggtgatcgtgaagagcatggcgagtggggcggttgaggctgctggccctgctggggctgtcgaagctggaggtggaggccatccgggtcgagggggagtgcgcgttcccggagctgcggctccttgagacgagggggtgccctcggctgaagaggattcagatgcgcccggcgcgcgggcagcagggtaccgtgcggatcgagtgcgacaagcactggtggaacgcgctacagtgggcgggcgaggacgtcaaggcctgcttcgtccccgtgctctgagtctctgactcacttcacttgcagtaggaggacggagctgcaatttttggcgacagctgatattcgacgaccaccggagctgcaatttattgtgaaaatagaaatcccttgccaaactagccatcagtgatgggaaaacctgcgtgctggatgaggaacttttttattagtgtctcttattgtaactggatttggnttcaaattaattcattttaaaatgctcgtgtgaaggcatgaataaaaaaaaaaaaaaaaaacgac

SEQ ID NO: 7547 - DNA, 4942 bp, Zea mays
  misc_feature (4392)..(4392): n is a, c, g, or t
ggaaggcgaagggtcaaggcgtctggcacttcagcttgtcccgcttgcagcttgctcctggagtcctggttgctccgtcttctccggtcgggctcttgtccgacgaacgtgtggctgtggcactcggtaggtcccttccgcgatccttcatgatttgttttgctctaaaaaacccttctttatttttatttttattttttgttttttaatctactagtatagcaatgctagatcacgtgttcgaaatcattcgtgtgtctcttctgatccagtagcgctagagcatcttatctttcagattgattgagattttgtgtgaatggatgagttgggcaaacgaggattttcatttttactgtatccgcattttggccatctacagaggaagtacactgagcagagcattccatggagctcgaggcgatcggaaagcgactccgtataagcagcggcagcagcagcttggcccgcgacaggctgacctccctgccggattgtctcatccaccacatcatgtccttcttgagggcccgtcaggtggtgcagacctgcgtgctgtccaccaggtggaggcccctctggcgctctgtgccatgccttgacattgaccaggacgagttcaaggccgccggctcgaaccgcatcacagagaaggaacaggaagacttcgaggactttaccgaccacctgcttatacctaataatatttccattgcgctcctggatacacttcgtctgcatgttagcgatgatgaatattatcatcgtggagcatcagttagatggatccgtcatggcataaagtacagtgcccagaatcctggcattatgcacaaggaatcgaacttagccttttggcgcctcaaaaaactacacctctccggtgtatatctggatggcagtttcatgaagcatgtcggttcagggtgcccgtatttggaggttctcgagctcaaagattgcccgtgcacatttgaagaggtcacatcccacacactgaagaacttgattctggaaaattgcggatgcaatgggctttatgggattacaattacatcacccacgctgaagagtttaacaattattggtagtgaatattacaacacaattacgctggttttgaaggcccctgctgttgcttatctgctcctggatgtgattgcttattttgttaaattcggtgtttcatttgatgagatgtcatctcttgccaaggcttcaatttatctaagggactgtgtaggaagtggactcagcaagcaccaattcaagcttctttgtagtgtgtttaatgtgacaactttggtgttgtcaggtttccagacaatggtttgactgctgtcttcatcgatgttttcttattgctcttaattatattgcggttccatttttgttactcaacgagctatacaatacattccaggtgatcagtgaagaattcccagaattccgtaaccttttgaccttgttattggaaaaatgtgatcttagtgataacttccagatgttggcaaactttcttcagcattcacctgatttggagaagctcactttgggccgttgcaaggtatactgcacttttgacattgaacatctgatcctgactaattctctagttcaatatcgtacattttctgtgatgtgaacagttctcaaaagatcccaagaaaaagaaaggaaaagccagattgagcaaggggtgtctgaaccagtttaacgtccggtgcaagaacctcaagcttactgaaattatctatgaagacgacgatgcgaaaaaggtggtggaacttttgtggagcatgtcaggggacctgcccaagaattacataaaactcaccaaggttgacccggatcatccttagtccaggtcatctggcacttggtcacacagtggcttctatgaactttgcttgcatgcctcccctgtgtttagacgtccttagttgaactgctgggcgtgttcttttggactcatttctagataatttagttctacgagctatggtacttattttgtgtggtctgcagctcgagactctagtccttatggtgtaagcttgcatgcttcaaagggaacagaaaattgcatgtttgcttcgtttccttgtatatccggtttcaagtttggtggatgcaggctgtttcgtatttttgttgaacctgcatgcgttcactaatctacaaagctaattcccaatctgttatgcttaaacttcgcactgattcgatggacttctggttggaccttgcatcctgtattcctgtgccttttggtttggtaaccacttctcatctcctgcaaccgatgagccaaaatgccatgaatcctttgcagaccatcagtttttgtgagagggacctctggcctctagcattctgttgtcatgtctctatccaccgctctactcctgtgctataaaaatcagtccaacttcatggataatatcattcctgattctgctacactgctctcactttgtctctacttttccttgtgcaacttctgagtgttattcgacttctgtgatgcattctcatttccatccccgattaagctccaactatggagggtttcaggtggggatcgaccagtcagttgtgctcttgcactcttgctcccacagttggcccatgcgtgttcctagaagcaccacatttttttaagataaaggataatcatccaacctcgacacgcaccagtgtgtgaatttggcccaaattcctaccaaccacaacaccaaagggatatttgaattcactagaattaatagttagttgactaaaaaattactagtgcattaaccagctaacaaatagttaactaactattgcctaatttgctaaaaatagttaatagttgaactattaactagactgtttagacgtcttcagctaattttagcagttaactattatctttagtgttctcaaacaccccacgctaatagattataatctttactcttataaagcccaaatttttacttgatttctacagtcattcctttagaaaaagaagtcattacacttctctctaatttaacccgctgccctagactcttaatctcaacactgcctccatagctttccctcgctctcatagaacccttgctctgttcccctccgtcgcctcgccccgttctcttggatcgcaccgtggaaaccgctgcctcttctttctctcccgacctccccatcccaatgttgtctctatcgcttcgcctcgctttgaatgtggcttcgacaccgttctcttgaattcgatgcggggatttagttggatttcaaccagcagcatgtggaggacctacaacctgttgtgtactaataaatcctttctcctaactcttttcgtacaagatatttgtaggtatctttttgttttcctggtaagcctagttacttagtagatatatgttgattttgtatggcgtcggggatccgcgtggcggtgcttatcatttagaactgatttggcgaccagaaaaatagaaatgaatctctttcggtgaccaaaaaaatagaaaggaatctctttcctattcaaaattgaatagaagagaatttcttctctgtagatctatatctatcactggtcacaaaatcagcccttaacaaactgagtacaaacttgcaagaagcatacaatgggacacttcaacaccaacgttacatggagcatgatcagctacccatgcacatcactcgaatgacataggaatgactgaatacaaatgttaaaacaattgtcagaaaggaatacttacgatgaggccaagctgtctggttttccctgatagcttcaatggatcatcttgctctacaaaacaaaatgacatgattatggatcattccattcagcactgtaaacagaaaattaacattgttccatctgcacatgaagcatgtcagcttcagacacgaggcactttttttgaaagacagatatggggcactaagaccctgttatctacaaaatatatagcccattctccattcagactttacctgccagcgggtttcctcaattttttcggcctctgttcggagccgagaccagtaggattcgattcgagcagagatggcagcggcatggacagtgctggttgtgttgctcgtcgcgtcgcgacacaggtgcgtcggcagcgccggtcacagcgccagcgttcctatgggcccccaaaagctatggtgattattaattcgttgtgtttattgtttccgttagatccagagtttgttagacacgatgtgcgatattgatgatcggggttctgggtgggctgtttggtttgaaaaaaccgatccattctagataaagtaatgtatcatttgttcataccacaaatttgacagaaataacacgtttattatattattaataattatttntctacgaggaatgaaatgctaatagattaactcattctatttcacaaaccaaacaaaaaagtgagatgtgataagtgagaaaataatggactacctcattcattaaaccaaacacgctattaataagtggaacccattacgaataggttccttgactaaagtttagttcgtgtcacatcaaacatttgaatattaattagaagtatgaaatatagacttaattaagtttaataaatttgtctcgcgttctgtaaaattaattgtttaattagactatatttaataccgataattaccatttaaatatttaatgtgacatgagctaaactttagcagaggacaacaaaacacagtagtgtatagagctttgccatacatatagaatttcctaatatttgttcatcgaatagtttctttattatctactattctttcattgttgcctttgttaagtaaggtattaaaatttttaaggccgcacaaatttgcatctttgacgttgcatgagatcacatgcttgttagataagatggccatggccttgcgtgtt

SEQ ID NO: 7548 - DNA, 2330 bp, Zea mays
gtaccctcggccgccccggctttttccccctccatcgctcgggaaggcgaagggtcaaggcgtctggcacttcagcttgtcccttttgcagcttgctcctggagtcctggttgctccgtcttatccggtcgggctcttgtccgacgaacgtgtggttgtggcactcgaggaagtacactgagcagggcattccatggagctcgaggcgatcggaaagcgactccgtataagcagcggcagcagcagcttggccggcgacaggctgacctccctgccggattgtctcatccaccacatcatgtccttcttgaaggcccgtcaggtggtgcagacctgcgtgctgtccaccaggtggaggcacctctggcgctctgtgccatgccttgacattgaccaggacgagttcaaggccgccggctcgaaccgcatcacagagaaggaacaggaagacttcgaggactttaccgaccacctgcttatacctaataatatttccattgcgctcctggatacacttcgtctgcatgttagcgatgatgaatattatcatcgtggagcatcagttagatggatccgtcatggcataaagtacagtgcccagaatcctggcattatgcacaaggaatcgaacttagccttttggcgcctcaaaaaactacacctctccggtgtatatctggatggcagtttcatgaagcatgtcagttcagggtgcccgtatttggaggttctcgagctcaaagattgcccgtgcacatttgaagaggtcacatcccacacactgaagaacttgattctggaaaattgcggatgcaatgagctttctgggattacatcacccacgctgaagagtttaacaattattgatggatattacaacagaattacgctggttgtcaaggcccctgctgttgcttatctgctcctggatgtgtatgcttattttgttaaatgctatgtttcatttgatgagatgtcatctcttgccaaggcttcaatttatctaagggacagtgtaggaagtggactcagcaaggatttcaagcttctttgtagtgtgtctaatgtgacaactttggtgttgtcaggtttccagacaatggtgatcagtgaagaattcccagaattccataaccttttgaccttgttattggaaaaatgtgatcttactgacaacttccagatgttggcaaactttcttcagcattcacctgatttggagaagctcactttgggccgttgcaagttctcaaaagatcccaagaaaaagaaaggaaaagccagattgagcaaggggtgtctgaaccagtttaacgtccggtgcaagaacctcaagcttactgaaattatctatgaagacgacgatgcgaaaaaggtggtggaacttttgtggagcatgtcaggggacctgcccaagaattacataaaactcaccaaggttgacccggatcatccttagtccaggtcatctggcacttggtcacacagtggcttctatgaactttgcttgcatgcctcccctgtgtttagacgtccttagttgaactgctgggcgtgttcttttggactcatttctagataatttagttctacgagctatggtacttattttgtgtggtctgcagctcgagactctagtccttatggtgtaagcttgcatgcttcaaagggaacagaaaattgcatgtttgcttcgtttccttgtatatccggtttcaagtttggtggatgcaggctgtttcgaaatgaatcttcgagttcatttcgtatttttgttgagcttgcatgcgttcactaatctacaaagctaattccccatctgttatgcttaaacttcgcactgattcgatggacttctggttggaccttgcatcctgtattcctgtgccttttggtttggtaaccacttctcatctcctgcaaccgatgagccaaaatgccatgaatcctttgcagaccatcagtttttgtgagagggacctctggcctctagcattctgttgtcatgtctctatccaccgctctactcctgtgctataaaaatcagtccaacttcatggataatatcattcctgattctgctacactgctctcactttgtctctacttttccttgtgcaacttctgagtgttattcgacttctgtgatgcattctcatttccatccccgattaagctctaactatggagggtttcagttgtggatcgaccagtcagttgtgctcttgcactcttgctcccacagttggcccatgcgtgttcctagaagcaccacatttttttaagataaaggataatcatccaacctcgacatgcaccagtgtgtgaat

SEQ ID NO: 7549 - DNA, 890 bp, Zea mays
gccggccgtgccgggaccgccccggcgcccggcgcggcatacctgaaacttcactgcctttttaattgtcaggcacactggtctggaaatcagtagcctgttggctgctgttgctattaatcagttgggagagagggagatggccaggaggaacatcggagtcgcagtggacttctcgtcgtgcagcaaagcggctttgcggtgggcgtcgacgaaccttgccaggaacggcgacaggctcatactcatccacgtgaacagctcctgccagaacgagcggggcgccgttcatctctgggagcagagtggttccccattgatccctctggccgagttttcagacgtcgccaggacatacggtgtgtcaccggacaaggagacgatcgagatcctcactcaagcggcaaaccatagagggatcgaagtctttgcaaaggtgttctacggcgacccagcaaagaagctctacgaagcagccgacctggtcccgcttagctgcatggtcgtcgggagcagaggactaagcacgctcaagagggctctgatggggagcgtgagcacgtatattgtgaaccacgcggcctgccccgtgacggttgtgaaggagatggtgtagcgtgttgaacaccgctgtttacaagcttcaccctagccagattgaataagcgtgcttgataagcactgatcaagggggatcttgctacttatacgacattttgtgcttggaatttgggtaactaggaccgggcagaacatgtctatgtcttgggctcatggcactgacatctgaacatatgccctaagtctgttgtaatcgcaaaatatttttgcttataaaatcagttaagaaaacaaaaaaaaaaaaaaaaaagcggccctaatgataacat

SEQ ID NO: 7550 - DNA, 847 bp, Zea mays
ccggccgggaacaccatacctgaaacttcactgcctttttgtcaggcacgctggtcaggaaatcagtagcctgttttggctgctgttgctaatcagttgggagagggggagatggccaggaggaacatcggagtcgcagtggacttctcgtcgtgcagcaaagcggctttgcggtgggcgtcgacgaaccttgcgaggaacggcgacaggctcatactcatccacgtgaacagctcctgccagaacgagcggggcgccgttcatctctgggagcagagcggttccccattgatccctctggccgagttttcagacgtcgccaggacatacggtgtgtcaccggacaaggagacgatcgagatcctcactcaagcggcaaatcatagagggatcgaagtctttgcaaaggtgttctacggcgacccggcaaagaagctgtacgaagcagccgacatggtcccgcttagctgcatggtggtcgggagcagaggactaagcacgctcaagagggctctgatggggagcgtgagcacgtatgttgtgaaccacgcggcctgccccgtgacggttgtgaaggagatggtgtagcgtgttgaacaccgctggttacaagcttcaccctagccagattgaataagcgtgcttgataagcactgatcaggggggatcttgctacttatacgacattttgtgcttgaaatttgggtaactaggaccgggcagaacatatctatgtcttgggctcatggcactgacatctgaacatatgccctaagtctgttgtaatcgcaaaatatttttgcttataaaatcagttaagagaaaatatatggctccgagttttttt

SEQ ID NO: 7551 - DNA, 1270 bp, Zea mays
tttctggtcttttctgttttcctcccacctccccctctccagctctcctactgtcccctcggcctcccgccggtgagcgatggagcggcggtcctccgtccgctttgtgccatccgagattgcaaggatggagaaattggctgcagatagaaaagaccaagtctttgataacaagttctgccagaagctcgcagaagaatttaatcgttctgttggccgtgctggaagtaaagcgttacaagctacacaggttcaaggatggtttcttaataagtttccagcatcagccactaaacctacttgtgtgcccactgcttcccaagaaaagacttcagcctcagaaataaatgtatcagtttctgaaaaaagatctgcagcttccgaagagaaacttttccctcttgatacaggtgtttcaaataatgaggatgaggtttctcctgtttttccattagaaactaaagatatgattcctgaacttgaagacctggagtttgaggccaagtctacaaaggattttgcctggtatgacattgccctattcttggcacacaggaggaacagggcgggtgaagtagaagtccgggtgagattcgagggttttggggcggatgaggatgagtgggtgaatgtcaagaagttcatccgccagcgttccattcctctggagtcctcacagtgcaaaagcgttgttgaaggtgaccttgttctctgcttcagggagggaaacgaggaggcattgcatttcgatgcacatgttcttgaggttcagcggaagcagcatgatattagggggtgcagatgtgtattccttgttgaatacgatcatgaccaaagccaggagagggttagcctgagaagattgtcccggcggccaaagtacttttgaaggctgctcctgttagcctgatgggcatatctattctggaactggaactaaccggagcgtgaaacttaggtgaagttagtttgtggcgtccttggtcatgtgtgtattagcaaccggcggcagcaagcatgggcttgcatctcaacccctttggcacaggactggctgactgaattttatagactcgttatcgtgcagaagagggaagagtacgcggcttgagcacttagggtgtcacttaggatgtgtttggttcgtgaagtcaccttatgcttcatgcatgaggtgtatcatgagttcatcctataattttttgtggcatcaacctattcctcgtttatatattaattattagtttatgagctaaaaaaaaaaaaaaaa

SEQ ID NO: 7552 - DNA, 1154 bp, Zea mays
aaacagaaatctagcttaagcatccggctcgcacgcaccgacgcgcgacgcacgagaccgaccaccttcctccgccccaccactccccccgcgcgcgccgtgcgatcaccgccggcccccgccctcaccctggccgccttgaggaaaagcaaggccaacgccttctcctcctcctcctcctctccaccgaggtcgcgccgcgcgattgccgtcacgatggccgcgtcgctgctcgtgctcgccgtggcgttcctggttggcgctggccacggcggcatcgatgggggtgcagcagctcacatggaggtagagggctctgaggtgacctacgggagtgtgattaagctgttgcatgagaagacaaagcaccgtctgcactcacatgatgtgccgtacggctcaggcagcggtcagcagtctgtcaccggctttcctgaaggcgatgactcaaatagctactggatcataaagcctactccagattcatcgtctaagcaaggtgattccattcaaactggtggcatcatcaagttgcaacacatgaagactcggaggtggttgcacagtcacctgcacgcttcaccgttatctggtaaccttgaggttagctgttttggtggggatgaattgtcagatactggtgactattggaggctagaaattgaaggaagtggaaaagtatggaaaagagaccaaaaggtacgacttagacatgttgacactggaggttatctgcatagtcacagcaagaagtacaaccgccttggtggtgggcagcaagaggtctgcggtgtccgagagaagcgagctgagaacatttggttggcagcagagggtgtttatctcccggttaacggaagcaagtgaaaaagcactttcagtatttaccagttttaatgttaattagcataggatcagatattttactcgctttcattcgttcttgtttttcttaagataaatgaacatgggacatgacccctagtgatatgaaattggaatgttgggcatcgaaggtgtcgtacatgcttgtaattggatatttgtgatacatgtgtgaccgtgtagagactcagagatgcaagtgacactttgttcacaagtagagatgctgatcatcttctaggaggtgacgcagaaaagacagtcgtggc

SEQ ID NO: 7553 - DNA, 2547 bp, Zea mays
cattgggtacctcgaggccggccgggcacgagtacctcgcccgaaatcgccgagagcctcccctcagtttacgccgcacgaaccgacgcactagaccgacccgcgaatcccccgcgcgcgcgccgtgcggtcaccgtccgaggccacggcaccgccggcccccgcccccgccccggccgccaagagcaaaggcaaggccgacgcttcctcctcgtcgtcctcctcctccactccaccgaggtcgcgccgcgcgcttgccgtcgtgatggccgcgtcgctgctcgtgctcgccgtggcgttcttggttggctctggctccggggggatcgatgggggcgcagcggctcccgtcgaggtggagggcaccgaggtggcctacggtagtgtgatcaagctgatgcacgagaagacgaagcaccgtctgcactcgcacgatgtgccctacggctcaggcagcggtcagcagtctgtcaccgggtttcctgaaggcgatgactcaaatagctactggatcataaggcccactccagattcatcgtctaagcaaggtgatgccatcgaaactggtggcatcatcaggttgcaacacatgaggacacggaggtggttgcacagtcacctgcacgcttcaccgttgtctggtaaccttgaggttagctgtttcggcggggatgaattgtcagatagtggtgaccattggaggctagaaattgaaggaagtggaaaagtatggaaaagagatcaaaaggtgcgacttagacatgttgacaccggaggttatctgcatagtcacaacaagaagtacaatcgccttggcggtgggcagcaagaggtctgcggtgtccgagagaagcgagctgagaacatttggttgacagcagagggtgtttatctcccagttaacgggagcaagtgaaaaagcactttctagcatttactatttttaatgttaatcagtataggatcagatattttgccagctttcattcgtccttgtcttaagaaaaacgaacatgggacctgaccccctagtgatatgtttaagttggaatgttggatatcgatgatgtcgacaagaccaggacagcgcatgcttgtaattgatatttataatccatatatgaccgtgtagatacccagaggccagagatgcatgtgatgtgacactttgttaacaaataaagatgcggatcatcgtccagatgtgacagacattcgtggcaaatcttttgagtttttgccgcaccctgctacatttgtgatgccgaaatttgaaccgtcctgactggcagtttatacatttgtgataccgaaatttgtaaaatttagaacccattaccacccctttgtatcttctgagctgcaaatttcgtgtagcccaaattttgcttatcagccattggtgctgatgccagaggtggtgccgcccaagccataccaatgccccagactcggcatcttttgtaccagaatggttctgctcagcaccaaacgctacctgttacgcttacaaaacaagcgcaggcactatcggagcaacaagctggtgcgatcgtggaagtgagaacggttctgttgcgtgcctatatctctttggagggatcagataaaaatttggaacaaaacgagttttttatgtgggacatgaactaaataacgacagtgcgttctctcgttatagcacccaagttttcaagtgtcgactagtcggcacctagtcatcgtgtctgccctgagatctcgattggtgaggccggctcgacttttctagcaagtcggacgacttagagacgactggaaattctcagtcgactaatcgtcgacttggtctggtaagtcggccgacttgtgtcccagttcggcgcaagcaacccaaaggcacattatacaacataaaccctacctccaacacctctggccacctccagcccctcctctgcacgtcacccagccgcttccagcccctcatctccacaccgctcctcctctggccgcctctagcccctcctatgcacgccgcctccagcctctcctctacacgacgcccctcctttggccgcctccagccccacctctccacggcacccctcctctgcacaccctcacaacaaagctctggtgagtcctgccccccctctcctgccctcatagcaacctacgccgcccctctgcacgccctcacagcaagctctggggagatgaaagatgcatctgcagatcgaccacaaggggagtcaagaagccagcagccatacggtctagctaaagatcctaaaagaaaggcaaaaccgaaggatccaacatggaactatagttactggccggatttgaacaaaaaagatgtggtgaagtgcatcctttgtggcaaaattgtttatgcatgtgttagaaggttgaagcagcaccttgttggtggtcatggtgatgttgctaagtgcccgaaggcaacatcgacaatcagcaaagagatgagtgattatttgaagaagaatgctagagagaagcctattgagttggatcatgataaagagggtgataaagacgatg

SEQ ID NO: 7554 - DNA, 1727 bp, Zea mays
gcacgagaccattacctagaacatccataatcgaaaaccctttattcctccttggcaaggccatgccaccgtcgagcccaggaggcggaagtcaacgtaaccaagcgaacccatccatggcctccgctgctgccgtcgtctccctcaacgtcggcggcgagatcttccagaccaccaccgccacactttcccgcgccggcgcctcctccccgcttgcctccctcggtccctcctccccgtctgctccgcacttcctcgacggcgacccgcgcctctttgcccaactcctatccttcctccgccatggccgcctccttgctccgtcctatccctcagccacgctcctcgctgaggcgcgccacttcgcgctcgatggcgccctcctcgcttctctctccccggcctccgcctttgccccgctctcgctgcgcccttccgcgctcctcccgctcaccggccgcgtcgcgccctccgccgtagcgctgtgcccctcgccgcctcacccggtctccctcgtcgccgcacacggtggggtcgtcacctgcttcgacgccgcgctcgcctcccgcaccagcgtcctcacgccgctgcccgccgttgactcgctcgccgcggtgtcccccgtcctcgccctcgccggcgcccgcgacttccacggggtccacctctgccggttctccgacgacgcctccgccggctgtactgatccgaatgtgctttcgtggccgggatcgccctccgccaccgtgctgtccatggccactacgaccgcgtcagaagcaccgtcgccaccctggctcttctccagcttcgagtcagcgcggcggaactcgagtgccgtggtggtgttcgacctcaattccttgtctcctgtggtggaaatcgggcggaaggaggtgttcggcgcggacatcgaggctgcgatcccagcgagcaagctcgcgtggcttggtgggcacagcctccttctcgccgctggctctcactctggcccggccggggtagtgggggacatacgtctctgggatgtccgggcgagcgccacggtgccagtgtgggaggtcagggagaaggaggattgctttgctgatgttgcggcgtctgacgcactgtcagcggtgttcaaggtgggtgcagcatccagtgaggtgttcatggctgacctgaggaggcttggtaacggtggtggcgttggattggagccatgggtgtgcattggcgatggacagaaggcggctgcagccgcatcatctggaaggaaagagaggaatggttgtagaattgagtgctactgcagttgggtgtttgtggcacggggcgcggacgtcgaggtgtggagtcaggtgggattggcaccagaagccggtggaaagaaggtgatgaggaggaattgggttggcagtgaactatccacaaagcccaagattgtgagctgggcatttggtggcagcaggatggcattggccagagctgatcagctgtctgtggagatatgggatagtgctacagcagcaattggcgcaaacccctgagtagagggaggatatcgcaaaagcaagccgacgcttgtcaatgttcaattgctgcttgttcctctatgcaatgtaaatttactttagcgtgttgtttgtgttgtatcccagatagttagaatcttgaatgcaatgcctggaaggtatggaatgattttactggggttgaacaaaaaaaaaaaaaaaaatatgtat

SEQ ID NO: 7555 - DNA, 1664 bp, Zea mays
cattgggtacctcgaggccggccactgcttccacggttcctcagcttcgtctctctcgccggcgcggcaggcaactatcatcacttcattagctcatccaatctattccgatgacgaccgtgcccacgccacagcaggtggcgcactcacgggcacggctcgcaccccgcgcgatcggcgccttgctggagtttgccccagcctcctcctccctccgcttcgccgtgcaccgctgccgcactgctcgcctagaggtgaaggcatctggaaacacgtttggaaactactttcaggttgcaacctatggtgaatctcatgggggtggtgttggttgtgttatcagtggttgtccacctagaattccactcactgaggcagacctacaagttgaactcgatcgaagacggcccggtcagagcagaataacctccacaaggaaggagactgatacatgcaaaattctgtcagggacacatgaaggggtgactactggaacgccaattcttgttattgtcccaaacacagatcaaataggcagtgatcaccgtgaaatagccaatgtgtaccgaccttctcatgcagacgcaacttatgacttcaagtacggtgttagagctgtacagggaggtgggaggtcgtcgggcagagaaaccgttggaagggtggctgcaggggccctcgccaagaaaattcttaagctcaaatgtggattagagatcttgtcgtttgtttccaaagtgcatcaggttgtgctcccagaagacgcggttgattatgggtctgtaactttggaacagatagagagcaacatcgttagatgtcctgatccagagtacgcagagaagatgatagacgcaatcgacagagtacgagttcgaggggattcggtcggtggagtgatcacatacgtcgctagaaacgttcctcgcgggctcggttctcctgtgttcgacaagctcgaatccgaactggcaaaagctatgctttctattcctgcgagcaacgggttcgagattggcagcggattcgccgggaccgacttgacaggaagtgagcataatgatgagttttatatggataaggctggaagtgtcaggacacggactaatcgctcgggtggtgtgcagggagggatatcgaatggtgagattgtgcacttcaaagttgcttttaagccgacaccatctatcggggtgaaacagaacaccgtgtcaagggagcgtcagaacgttgagcttctagcaagagggcgccatgacccatgcgtcgcccctcgagctgttcctgtggtggaatccatggccgcgttggtcctcatggaccagctgatggcgcacgtggctcagtgcgagatgttcgcgctcaatactgcacttcaagaaccagttggctctttctagcagaggcagagcacacctgatgagctcgcgccaaattttatcatttatcatagtaataagtagctcaagcgtggcttggtttgcttgtctcttgcaccgtagttttgttttttttttcccgcaagtgtgatgcgatgaagtgaataaggcacttggtttcctgtgcatttgtacacgtttcatataatgtaatctacttcgaagatgatgcatttttatagatgtggccttgtgaaaaaaaaaaaaaaaaaaaaaaaaagtacc

SEQ ID NO: 7556 - DNA, 5333 bp, Zea mays
tgaccaaaataattttatctacaaagaaaaccaatatacatggacaattgaacgaacgtgctggtgagaactcggcgttggagaagccaaaaaataaaaaaaatagagaaaaaacaaacggacgacatgttcagaaatcaagcgccagaaatggtcagaattcacgatggagtaaaaaaaggtttttctggtgtgctcatttttacccttagttgtgttttttttttttgctcagttttgcctttttcagtgctatagaacagaagggtaaaactgagcaaaaaacacaactaagggtaaaaatgaggacaacagcaaaaccgagggcaccaccataaaaacaccaaaaaaaaaaagaatgagagcagctgaggaatggatgttcaccatctcaatcactctgacctcgagcgcctccaatgtctacataatggtatgtccaatgtctacataatggtatgaacagaggaggcacaaggcatcagaacagacaacagggattctattgtactgcatgtcaatattcctgcttcatcttcatccatgatctgatgatcataagtggattaagagcagtagagcactactaaacgaaacagcacagtacagatttagcgacacgattcagaaaccctccacttcaaaagcagttcaaccaagctgaaatgagctaaaattactaacaaagtacaagctccgatggtaatctgtactccatagttccacaatccaatgtccaaagcaaaaacaggtaagcagagatgtatctactcaacaaaaaaaaagataaataactcttcattgcttttttgtctatcaatatactttattaagatagattggtctcctgatccaagacctaacaaatgtacaccctatctggtatctaatgctatgctactagtatgaatatggcaacaaatggctaagtcacgcatgcatggattgacggaggtgctaaataactaaaacagcaagtaatatcaagtaacatgatccgatcgtcaatcagaccatggtccgtctcactcgggtatggtctgcagcgacggccgccactgcccctcctccctgtgccggaagttggagctagtgctggccacgcacaggagctccgagatgacgtcctggacgggcactccgcagccaccgccgtgcttgccgtcctctacgcgccgcagcagctcctccagctgcttcctagtgatcctgatcttcacctccgtggccgccgccggcgcgtggccggcgccctcgccctcgcccttgcacgcctcctccctcctgtcctccacccacacggggttcgtcctggcgtaatgcacggagcccgcactgccgctgccaccgcgacgaggcctctcgagacagcagtttcccatcgatcgggttccccctggtgggcacggcacgggaactggatacggatcggctgctgctggaggcgaaggacgagcgagtttcgtccgtgtgcagtgtggccgaaatgattggtgcgtggaagaaaccgcagatcgtttacgagggcggccgtggtggagtagttataggcgcggcgggcagagacgggaggggaggggccgaaggaacgaggaggaggaggacgggacagggggagccgggagcagatgcgcgtccgggacacgtggatggccgtgatcggggtcgcggatgacgggcccgtgggcgggccgaccacgtcgccgcgctggctcgtcgttgggtgtgggatgggctcgatcgggctctggcggtgccgcaaagtgtgaaacggggggaaagggggatcgtgtttaaaagcaaagtgggaccttgtaaacgtgcctgccgttggcgacgacagcgctttgtatttgcagtagttttttttcccctgtgaacaaatatttattggacggtttgtacttctttactttgtacgtttctgagctgctgttatgcacgccagtatgccacgaccacttggttttcttaactgtgcgatgccccacgtggcattggcagctagcttgtacgacttgcatgcgctcgagaaaaaaatatctatatgcttgtgtagcttactaaaagagtagcgcagcttgctaatcatgctagctagtgttgtacaacagagaaaaaatatctacatgccttgatgtcttcaatctcactagcttcatcatcatcatgaacacgagacaacagagaaggaacgctagttcaatcagttcaagtccttagccatatttcttcactccagagttaatctgaccttacgggcaacagttcatcatcggtatgtttgtttgcatacctatcgtgccaagcattgacacacgttttctaccatacttgtctaaggttatggacatgtttgttttcctacctaaggtgctataatatgtctgagctagttgcttaataaaaaattaaccttagatagaaaagttagacacgttgtggtattttaggcagcaaatcaaacaacccataggtgttcaaattccgcgtcagaccatggtgtgactaagagaattttgtcacactttttatgagtcattgatgaccggaacctacgcatcagtagaaaaatcatgttacaaccgcggctacaaaccaaaagcacgcctaactctatcaaacctggctagccttaggcttgaaaaattatggcaagcgaggtagcgaaacaaacaggctaaaatttcgcctgcagcgccgcagtagttttagatctttgtattatctttgctggtctctctacgtactatagtctatagtatagtctggaaaactataaagtcaattcgcagatgctaatacattttaagttcagcgacaatgcggagttttaccatcccttttgaaatatgatacgctttttccctctcagaaaatcatacggttcgctgctgctgttgtttttcccagttgttgcagcttatcattaggctgacttgtgtaatcatgaaccatatcccaaccggagaatgattagcagttagcgtatggcattggtaccacctctctgaataatataatgcaggtctacactagcactactacatccctgaaacggtcctctcaccttgaatgatttgattttggtcccaaccattgcaacttctggaacgaaccatgcatggctgggtatccatgctagctcctcctgcttccaatctaactccggcttagtactagtaaacaatcttctggtaaccaccgtttcctttttaatcccctgcagactaaaaagaagacggtgcaggttgtggcgttcttagaacaatcatggggtggtgccaaccactgtaagctagctaaaatggttcggttcagacctgggaactgcatcatcgaggtagtactactagtaaggtggacgcatgattggttgcagtatatatatgtatatacctgtccgatcagacacgcattatactccaacagctgagacctgagatccgtcgagtcatctaggtcaacacaattccccggttggttgggggatatatgccgggttggtccggccacctgactgattggtttctttgggaccgcccgccagcctctgacccccatgcacatcgccgccaccggccaggagttggccggtcgccgtcgccgccggctggctggctggcttgcttgcttcccgtggaggcggaggcgacccaaccgcgctcatttgacaagcagcgccctctgccttttaccagtggttgacattgtgatggtactggcgatcgctccagtttgtttttctgcctgtgaagttgtgctgctgttgggacctgggactcgggaggacgattgattctgattgcaacgccgacgtggtaactgaaacgaaagcgggcggctattgcaagcaagttccgtcgttcatgtgcaaacttgagtgataatatattttttttgacaagtaacttgagtgaaacagtgccgggaaattgtttcgtggtgggataaaggcccttcataaacagaacgctaggctgtttctagtttgttgcagccagatgcaatcctattctgttgcagcctctcgaatctacaagctgtagatctatacacacaaaagtcatagctgcttgagactccatataacttctgtccacgtgggggtctgcagctgataaatgtgaggggttctatcggaatggatttgcattcagtatatatagggacttttttccgtttgtattggttgaatcgaatagaaaagaagattataacgaagaaaacccaagtgagacgggctacgggatgagacgttgggcctgcgtgagtgagtaaagtgtttcaggccgaggctttagtgagcagacagatgggcctgcgcctttgtgcaaagtctggatagcagacagatgggcctggcgataaactgttcgtgggtcggttttacattcacagtgagatgggctcgctaaatcttgaacgcttaagcccaatggagagcggcccactttgtctttgctcgattttgcgtaattttgaaaccaacgatttgttctcgcattgatttttggggtgctcctgtacaggaagctttgtcgcattcgtgctccggctgttccattgggtggtatcgggctatcggcggtgtggagaaaagttttctggttgttgttgttgttgtttgttcctgtacaagtgtagagcctttgcaaccatatgtgtaggggtggatatcgagccagctcggctcgttatggcttggctcgttatagctcgttattgtaacgagccagctcggcttggctcgttatactaacgagctaaacagctggctcggctcgttaggaagctcgagccagctcgttaggctcgcgagccacacaactaaatataaagatctatgtacataaatatatgtataactgaaaaatcatattctaagtgtttaacactacaaacatgtagccatgcaataatacaaatatctaagcacatgacacatccacacatgtccatatcacatatcataacaacgagaaaacaagactatgagagatgagacaacaccaacgactagacaaacttgtgttgtggcttagctcgtttggctcgcgagctagctcacgagctaacccgagctggcttattagagaatcgagctagaatgctagcttggctcgctacaaaattaaaacgagccgagtcgagccgagctactaacgagccgagtcgaacgagttatcgagccacgagtatttcgtccagccctacatatgtgtaccccataccataccagagagtgagtacgatgtaatgaattttgctgccataaaataatttacaatcgtgtttccttgtagaggtttatatggcttcatgttctgcag

SEQ ID NO: 7557 - DNA, 4567 bp, Zea mays
  misc_feature (634)..(634): n is a, c, g, or t
atactaataagctaaacatctagctcggctcggctcgttagaaagctcgagccagctcgttaggctcgcgagccacacaactaaatacaaagatctatgtacataaatatatatataaccgaaaaatcatattttgagtgtttaacgctacaaacctaaaacctttataatattattatcgaatcatcatactagcttctaacttttgatattaaattaaataaccaaatatatattaacttacatattaacagacccttattataataaaatagcaacaagcatcattataaagcaattcatcatacattccacaaacatgtaacatttcattgcacaacactaacatcatatgctgctagaaacaaagttcacaaaaccataaccaataattaaatattaaatatgtaatgtaggtatgtaaccatgcaataatgcaaatatttaagactatgagagatgagcgataccaatgactagaaaaacttaagttgtggcttagcttgtttggctcgcgagctagctaacgagctaacccgagatgactcattagagaaccagctagaatgctagctaggctcactacaaaattaaaacgagtctagttgagccgagtcgagcgaattatcgagcnacaactatttcatccagtcctgactacagcaggtaacgcaagattagagatttcgatttttccctgttgggctggactaaggtattgcctgaacaacatcgggccatattgggccctcctctgcccgtgtcagggggtgatccgttcagttccaatccagtgcagtgcaaggcctcaaccgcgaaggatgcggcgccagctctcggtcccgtggctagcgcgtccgccgatcattcggttcctgcacaccaagagtgtgcccccccgtgcgtccgtgctacaagcacggtcgtttcgttcctgctgccgctctgttcccgactgtacccttacctataaaaactaacagtggttcggacgatccgtcatccgtgcatacatgctcattgctcaccaagggcaagggaggaggagaggacacacagcagtagcggcgaaatggcggcgatgatgatggatagtaccgcggagaaagacctcgccggcgacggcgctgcggtgagcgggcacgggcaggacttggagcggtcttgccatgaccaggagcccgccgctgcagatggtgcgagcagcagaggcctagccatcgggcgtttcgtacgggaggtacagttcccgaacataaacacactgcagctagctacagtaaatccgcaataataatagtctagttgacgacgaccatatagactgagagattaactagggtagtactagggtagcagctgatggtcttgcgtcgtgtcgtcgaacaactctatctagtttatttatttccttttcattcggctttatttgatgcatgcatgggtagctgatggtggagggcgtggcgtcgttcctgctggtgttctggtccgcggtggcggcgctgatgcaggagatgcacggcacgctgacgttccccatggtgtgcctcgtcgtcgcgctcaccgtcgtcttcgtgctctgctggctcggccccgcgcacttcaaccccgccgtcaccgtcaccttcaccgtattcggctacctctcctggaccaaggtactacgacgtatctatgtatactactagcccaggccatccatgcatcgaccaccgtcaccgcgccctcggctacgtcacgtactctgcgtaatagtgagctcctcctgcccgcagctgccgttctacgtggcggcgcagctggcaggctcgttgctcgcctgcctgtcagcgaacggcgtcatggagccgcgggcggagcacttctacgggaccgtccccatggccggcggcgacacgaggctgccgttcctgctggagctggtcgcctccgcgctgctcatggtcgtcatcgccaccgctgccagaggctccgtacgtctgtccttatcatcctttctctcagttaacttgttgcgtccatcgcgtcgcgtgctcataatgttttggctgatggcaaacgcagaatcagacagcaggagggctggccatcggcgccgccgtcggcgccctgggcctcgtcatcgggtaataaaaagaagaaaaaaatatataaaagactgataaactttcagtttgtttgttcacagatcaaaagtgcaagtgtcacacgtacactgccgctgtattaacaagttattgtacgtacgagttgtgcatccgatccatccaggccggtgtccggaggctcgatgaacccgatcaggaccctgggcccggccatcgtgctcggcaggtacacctccgtctggatctatctcgtcgcgcccgtcgccgggatgctcatcggcgccctctgcaaccgcctcgtcaggcgctccgacgccatcatcgccttcctctgcggcgccaagcccagagtggtggcgccaggccagaaccgcgccgcgcgccgttggagcacttgcgtctccgcgctactagcaggctagccgtcgggcgccgccatcgtggcctgcttgttgtaacagttatgagtcaaaccactcttttgtgatacacgctaacacgcctacacccaacgtttcgaattaaaactggctttttagattactgcagttataatttatatagataaaaatactgtagaattaatagaagacagtatatattaaaatcaaacaaacatgccatcaatctgactcaaactgaagaaaatactaccagttttttgctcctgcaatagaacgtcgcgtaattaatttggattatgtttgtagtaaactggtacacataagctctatatcgacggttgtaaacctatttatactgatatttttataaccatcagttttaagggtcagtagaaataattttttctacatacggataactgagaactgctagtgaaaatcgatttttactgccagttgagctaagaaaatcgttagtaaaattcaattcctactagcgatcgaggtaataaaaccgccggtgaaattattttctacgaaacataataataatttaaaaatagcaaaaaaaatttattagaaggccccaccgtccacccgtcttcgtcgaagtcacggtatttttcgcacaaaataagtggatgtgggaagcgaaccgatatcccccattcacattactccctctaccactctgtctatcacttacttcttatctatattgcaattttattgccgcatattataatcaactgagtgtaaattgattgtttaaggttgtaaacaaattcaaatgaaaaggttgtcgactaaaaagtttcataactttttaagttctacaactttggttttgacacttttcccatccgagatagtttgcaaaatttacattttaaatttaacaaatttagatgtaattttttagagccgaaacgattccagataaaaaaagatgtcaattacaaaatttcataacttttagagatcacaacttttatgttggtgttttttatacgaggtcatttaagaaaacttaaaaattttagaataaaaatgatttctagtgacggtttttaagaaaatcgctattagagatcgatttttaatcgcggttctttaaggaaactgtcactataaattatggatttctagtgatggttttcttaagaaactgtcactataaatatcactatgtttgctaactgaaatcccctgtaaaaattaaaccccaccacactttcctactagtggtattcacaggatgtcatcactcatacgaatatctcgtgaataatatgtgacaaatccaaaacacacgtggaacatctaatgatatgtaatttaatgaagagagaaatgaaagagtttcatatgagagcaagtttaataataatagccagctgctgactataagaatctttatagctagcaccttttagcccattcgtataatgattagttgctcactattaatgtataactcagttgtctctcgcacataatttattgttcttgtgtcgaaactcgctgtaagtttgctggttgtaagtttactgccaatttctcctctctcatccacctcaacatttaactagtttatagtcgagcataaaactctggataaggttttctagatagatattgacatgacaaccttaaaaataatacatcaactattcatctaaaatggcctcggagtaatctaaaatgcaatgtcagtatctgatggatagtatatatgagcaatccaaagcacaccacagaacaacaatccaaaatacactcacacaacatgcggagtgttatagatttcataatggaatgcattaaaccatcttaccactacagaaaaataggaaaaatatgtcaacctagataaaaacatcaacccttacgttcttaatctgcttaagaatgtcgatttcttagggccgacatacctaagtttaagttcgtcggctttagcctgaccgacgtccttattttttaagtacgtcaaataatgtacatcggttaaaacgtcaacctattagagtaagaatgtggttcctggcc

SEQ ID NO: 7558 - DNA, 1501 bp, Zea mays
atgctacgccaagcgcgcaattaaccctcactaaagggaacaaaagctggagctccaccgcggtggcggccgctctagaactagtggatcccccgggctgcaggaattcgcacgagaccattacctagaacatcctaatcgaaaagtaatccgtgcatacatgctcattgctcaccaagggcaagggaggaggagaggacacacagcagtagcggcgaaatggcggcgatgatgatggatagtaccgcggagaaagacctcgccggcgacggcgtgcggtgagcgggcacgggcaggacttggagcggtcttgccatgaccaggagcccgccgctgcagatggtgcgagcagcagaggcctagccatcgggcgtttcgtacgggagctgatggtggagggcgtggcgtcgttcctgctggtgttctggtccgcggtggcggcgctgatgcaggagatgcacggcacgctgacgttccccatggtgtgcctcgtcgtcgcgctcaccgtcgtcttcgtgctctgctggctcggccccgcgcacttcaaccccgccgtcaccgtcaccttcaccgtattcggctacctctcctggaccaagctgccgttctacgtggcggcgcagctggcaggctcgctgctcgcctgcctgtcagcgaacggcgtcatggagccgcgggcggagcacttctacgggaccgtccccatggccggcggcgacacgaggctgccgttcctgctggagctggtcgcctccgccctgctcatggtcgtcatcgccaccgctgccagaggctccaatcagacagcaggagggctggccatcggcgccgccgtcggcgccctgggtctcgtcatcgggtaataaaaagaaaaaaaaagacgataaactttcagtttatttgttcacagatcaagtgcaagtgtcacacgtacactgccgctgtattaacaagttattgtacgtacgagttgtgtatccgatccatccaggccggtgtccggaggctcgatgaacccgatcaggaccctgggcccggccatcgtgctcggcaggtacacctccgtctggatctatctcgtcgcgcccgtcgccgggatgctcatcggcgccctctgcaaccgcctcgtcaggcgctccgacgccatcatcgccttcctctgcgccgccaagcctagagtggtggcgccaggccagaaccgcgccgcgcgccgttggagcacttgcgtctccgcgctactagcaggctagccgccggccgccgccatcgtggtcgtggactagtgacacgtggacctcccttgcttgctgtaacagttgagtcaaaccactcttttgtgatacacgctaacacgcctacatccaacgtttcgaattaaaactggctgtttagattactccagttataatttatgcagacaaaaatattgtaaaattaagataaaaatactgtagaatcagtagaagataatatatattaaaatctaaaaaaaaaaaaaaaa

SEQ ID NO: 7559 - DNA, 3326 bp, Zea mays
agtcgacctgcagcagcagcaccaggaactgtagtaatcaagcagccacagcttcagccgcttctaaaaacggcagccgagcaggggtataccacagcacattccagacgcaaactgaaaccgaaatatggtgatacaatcttttttcaaatgtctttttgagtgagagtaaggtgacgttgaaaacctgggcggcaaacagttgctttttgggtacaagttcttgcctctcccatgagatagggagaaaaaaaaactccggcttctatagaacggttgttaggctcagtaccgcatcgagttgcatgtatttctctatttgcatatagcagattttctcgtgatatgtgcgacgtacggctgtacgtgctgttaactcttacaaggaacaatggccaaggaagcgccaaaattactctggatttaataaccagctatttcagatgtgcatacagtacaagttacatgatgaacacagccactactaggggtggatatcgagccagctcggctcgttatggctcggctcattatagctcgttactgtaacgagccagctcggctcggctcgttatactaataagctaaacatctagctcggctcgtctcgttagcaagctcgagccagctcgttaggctcgcgagccacacaactaaatataaagatctatatacataaatatatatatataaccaaaaaatcatattttaagtgtttaacactacaaacatgtagccatgcaataatacaatcatttaaccacatggcacatccacacatgtccatatcacagatcataacaacgagaaaacaagactatgagagatgagacgacaccaacgactagacaaacttgtgttgtggcttagctcgtttggctcgcgagccagctcacgagctaacccgagctggctcattagagaaccgagctagaatgctagcttggctcgctacaaaattaaaacgagccgagtcgagccgagctactaacgagccgagtcgagcgagttatcgagccgcgagtattttgtccagccctattgcattccacgagccgagcgcatgactcccccgccggccatgctcgatctaatctagcgagtcctggcccgtcacgagttcacatgccagaatcgctacggcagctggccagcatccaccgaaccgatgctaatgctgtaaaaggaagctgctggcaggtggccccgtcagcgcaagtgtgcaacagggaccccagcatcggattacacgcgtcactgcagtaactaatgcttggctaaaagaagcctaaacgtgacaggaaaggaagggggcgtccgcgggaggctgcaactgcaactactaaaggcgtaagcacgctttgggggagagctttgtttgcacttgccaaagcagccgtagctcatccacaccagccaagccaccactgcgcctcaaagcaagcaaaaaaaaaaaaaaacaaacaaggaaagcacgcagcacgcacactaggcactcgcattgcacggccacagattcacatttcacagtgatccactcaaaaagcagacgcgacgcagctgcgactgcgagctcggctcgtggccaaacagaacacatggagcgtgaatgaaaaagagtaaaagagtggaggagggaggccggggccggcagcggccactggccagcacgaacgaacagcaagacgagacggccatatgcctatccccacaaggattgtcttgcgttgtgccgtgcgtgcccgtgactgactgtaccggcccgtgtgtctcggcgagacggtgccggtgccgggcagcgtcagtgggagagcagagcaggagcagccagcccccttccaaagtgaaagccaagggcgctttagctgtttgcatgggcgagcacccgcatcatggtggccttgcacttgcgcgcaaaaaaggaaaaggcaccgccgctggtcgccctcggcttccctagaccgtggacgcctcgtcggctcttctactccgctccgggttttttttttgttgttgttgttcttcaaggccaggcctggtgcgtgtgccacggtgtctaacacttgttcttgctccgttgctttctgtttaatgttctgactgatgatttaggccacgatggttaggacttaggagtaggatcatcaactaaacgcatgcatttcgcacacgactgggcggcatctggcattttgctaattcaggaaggaaaaagtgagctctcaagttgactgattgatgagggctcggcgcccagcggcacgagactcgagaaacgacagcagcctgagcactgagcccagacaggatccgcagcagcactacaatgccacaacacgcatggaatgatggaagcgacggacggactagcaggcttggtgatttgattcacacgactcgtgccgttttttttttttttttttgcatggaatcaggatgcccgcagcgtaatccatgtctcactaggcaccagggatgccgccaagcgatctactactactagacacaaaagaaaccagcaatgccgaggctccgagagacgagactcgtcagacggcggcctcaattctcggctcgaacgagagcgcggacacgaagcccgtggtggcgtcgccgtcccctgcggcgcgccgagggagctcctcccaccggttggtcccgacgtcgcacaagaagctgccgccggcgccggcggagctggagctgacgcagaccatgaggcggccgccgtggccgacgcagttcacgtccgccttggcgccgcggaagccgtgcgccatggcgggcggcatcgcggccacctgccgccacgcgccccccgcgaactcccacacgcggaggctcgcggcgtcgaggaactccgagagcaccaccgcgtaggcggcgccgccgcaggccaccacgtcgatggagtgctcgtggtaggcgggcaggatccggggcagctccgcgaacgcgcggcgcgccaggtcgcaggccaccaccgtgcccgagcggctcaggaagtaggccacggcgtcgccgccgccgcagccgccgcacgccacggcggacgagtactgccgcgacgcgctccgctgcatggtgctggccaccacgtcgccggacttgctcaggaagtagaccgtgtcgtcgccgtcgccgtcgccgacctccgcgacgcgctcccgggacggggcgccctccacctctggttttcgggagagcgccgcctgctcgctccacgcgttcgtggacgagtcgtacgccaccgtggacagctccggcagctcgcccaggatgagcaccacgcggtacggcgagccgtacatggcgacggcctgcag

SEQ ID NO: 7560 - DNA, 1062 bp, Zea mays
  misc_feature (1027)..(1027): n is a, c, g, or t
  misc_feature (1056)..(1056): n is a, c, g, or t
ccggcccccgcgcgagcggaggccggccgggagctgacaaccagacgcgccagggtttcaggcttccacgaatctccccgccgccctcaattcccctcggcgccgccgccctcaattcccctcggcgccgccgcctcctcccctcgcttcggtcctcggttagttaaccatccaggttctgtcaagatgtctgatagccatgagactgacaggaacattgagatttggaaaattaagaaactgatcaaggcattggaatcagccagaggcaatggcacaagcatgatctctctaatcatgcctccacgtgatcaggttgctcgagtggctaagatgttaggtgatgaatatggtactgcttcgaacatcaagagtagagttaatcgtcaatctgtgttggctgccatcacctcagctcagcagaggttgaagctctacaacaaagtgcctcctaacggattggttctgtacactggaactattgttactgaagacggaaaggaaaagaaagttactattgattttgagccattcaagcctatcaatgtgtcactctacctttgtgacaacaagttccacactgaggctttaaatgagctcttggaatctgatgacaagtttgggttcattgttatggatggtaatggtactctttttggcacactaagtggcaatacccgtgaagtgcttcacaaattcactgttgacctcccaaagaagcatggtagaggagggcagtctgctctgcgttttgctcggcttcggatggagaaacgccataactatgtccgcaaaacagctgaacttgctacccagtttttcatcaatccagctactagtcagcctaatgttgcaggattgattcttgccggttctgcagattttaagactgagctgagccaatctgacatgtttggatcagcgactccaagccaagatacttaatggggggttgatggttttcgaatgggggcgagaaacgggtttcaaccaagctatttgaattatctggctgagattctagcanatggtgaaattcattcaagaaaaagaagntaattg

SEQ ID NO: 7561 - DNA, 2042 bp, Zea mays
cattggggcccccccccccccccggagctgacaaccagacgcgccagggtttcaggcttccacgaatctccccgccgccctcaattcccctcggcgccgccgcctcctcccctcgcttcggtcctcggttagttaaccatccaggttctgtcaagatgtctgatagccatgagactgacaggaacattgagatttggaaaattaagaaactgatcaaggcattggaatcagccagaggcaatggcacaagcatgatctctctgatcatgcctccacgtgatcaggttgctcgagtggctaagatgttaggtgatgaatatggtactgcttcgaacatcaagagtagagttaatcgtcaatctgtgttggctgccatcacctcagctcagcagaggttgaagctctacaacaaagtgcctcctaacggattggttctgtacactggaactattgttactgaagacggaaaggaaaagaaagttactattgattttgagccattcaagcctatcaatgtatcactctacctttgtgacaacaagttccacactgaggctttaaatgagctcttggaatctgatgacaagtttgggttcattgttatggatggtaatggtactctttttggcacactaagtggcaatacccgtgaagtgcttcacaaattcactgttgacctcccaaagaagcatggtagaggagggcagtctgctctgcgttttgctcggcttcggatggagaaacgccataactatgtccgcaaaacagctgaacttgctacccagtttttcatcaatccagctactagtcagcctaatgttgcaggattgattcttgccggttctgcagattttaagactgagctgagccaatctgacatgtttgatcagcgactccaagccaagatacttaatgtggttgatgtttcgtatggtggcgagaacggtttcaaccaagctattgaattatctgctgagattctagcaaatgtgaaattcattcaagaaaagaagttaattggcaagtattttgaagagatcagtcaggatactgggaaatatgtctttggtgttgatgacactctgaaggctcttgaaatgggtgctgtcgagaccctgattgtgtgggaaaatctggatatcaacagatatgtgatcaagaacagtactactggggaaattattataaaacatctgaacaaagagcaggaagctgaccagagcaatttccgtgacccatctaccaatactgatctcgaagttcaggaaaaaatgtctctcctggaatggtttgccaatgaatacaagaagtttggttgctcgctggagtttgtgaccaacaagtctcaggagggatcccagttctgtagaggatttggtggcattggtggcatgttgcgctaccagctggatatccgttcttttgatgagctttctgatgatgacgatgtgtatgaagactctgactagcaatcagccaatctcatgccatgtgctggcccatggaaggacgcaacagctcgacctcgccatacctacgcaggagcacacgaaaagcaactatccaaggattaatgggcatgggccagcgtcatcctcttcaagaggagcttaagactaagatgattttgagtcacaatcatgggagtaacgtgacaagaagataccctactatatcacaattattccagtaatgcgtcgagaagataccgttgtttaagtgcacaaaccaatacagtgacgtgccaagaagttaccgtattttaaggatgtttaattttcagtattcgtcggggtagtactgtgtcagaaacttatttgtacctaaaaaggccaaatattgccgttgccttggtgctttatgctatgttatcgtcttttgtgagtctgtgtgctaaggttgttgcttaatgctttgtgactcgcaagctgctactcttgcagtttttgcaacgacgaagctatgatatggagtacaattctgtgtcaacaaaaaaaaaaaaaaaacaaacaaaaaagtactctgcgttgttaccactgctt

SEQ ID NO: 7562 - DNA, 808 bp, Zea mays
gtttgcagtctgagaagacccctgtgctgtccagccaacttttccacctcagtcttggatgccccccctccgccgtctagatctccccaactcctccgtcctcttgcttcctgtcgtcgacctcggtggccgccgcgagctgcgggtggttcatcgccgtcgacctcgcctctccgctccttctgcactgcctgttaccggcttcctggtggtcgaccggtgcggcgcgggtcgtcagtgaagctccgactatccggattgactcggatcgacctctcctctcgtgggtttttggattttgatcagttatatcagaggagtgcttatggatgatttcatggctgtagcttgctaggccctgctttcctgtttgtacagatacatcatggcaccacgcagtaggccttcgtctaaaaggcctctctggttcatcgtgttggttgcatttgtctgtgcagtagccattggagcctacctttatactccacggcattacacagcatgttatctggtaccatcagaagcctgcaattctcggcctcctccagaacctgctagggtatacactgatgatgagatcgctgctcgtgctatcatgagagacatcatccgggcacggccagtgcagtcaaagaatccaaaaattgctttcatgttcttgacgcccagttcattgccatttgagaaactgtgggaaaaattcttcatgggacatgaagaccgatacaccatatatgtgcatgcatcaagagatagaacaattcatgcaagtccagtattctctggcagggatattcgaaagtgaaag

SEQ ID NO: 7563 - DNA, 1561 bp, Zea mays
gtaaaaaaaatctttttatatatataggtgcacacccccggcccggccggggagggagtcaagcagaagcagaagcgctgaagcagcgcgtttgcagactgcaaagacccctgtgaatttgtgatgtactgaggtgttgtccagccaacagtccttgctcccaagattcttccgtactcccccctccatcggaccatcctctaccatagatctcccgaactccgccgtaatcgggacgaatcccgcgcgtgctcttgctccctgtcgttctccgcggccggcgcgagctgccggtggttcgttgccgtcgacctcgtctggccgctcctctgccctgccagctgccggattcctgctgctggactggattgctgcgcgtggagtcgtgagtatagctccatctatcctgactgatacggatcgacctctcctctcgtgggtttttgggttttgatcagttctatcagaggagtgcttatggatgattgcatggctgtagctagctaggccctgctttcctgtttgtaaagatacatcatggcaccacgcagtagggctccatctagaaggcctctctggttcattgtcttggttgcctttgtctgtgtagtagccattggagcctatctttatactccacagcattacacagcctgttatctggtaccatcagaagcctgcaattctcggcctcctccagaacctgctagggtatacactgatgatgagattgctgctcgtgttatcatgagagacatcattcgggctcggccagtgcagtcaaagaacacaaaaattgctttcatgttcttaacacccagtttattgccatttgagaagctatgggaaaaattcttcatgggtcatgaagacagatacaccatatacgtgcatgcatcaagagatataccgagtcattcaagtccaatattcgctggcagggatattcgaagcgaaaaggtgatatggggcacgatttctatgcttgatgctgaaaagaggctcttggcccatgccctacaagatcctgaaaaccagcattttgtcttgctttctgagagttgtgtgccacttcataacttcgattatatatatagttatctcatggagacaaacgtcagttttgttgactgctttgatgatcctggtccacatggagcaggtagatattctgagcatatgctacctgaaattgtgaagaaagattggagaaagggtgcgcagtggtttacagtgaaacggcagcatgcgattcttattctcgcggacaccctttactatgggaagttcaagcgttactgtaagccaggaagcgaatggcataactgctattcagacgagcactacttgccaaccctctttaacatggttgatccgactggaatctcgaactggtcggtgacgcatgtcgactggtccgaagggaagtggcatcccaaagtctacagggctgcggacacaagcttcgatctgctcaaggacatcgcgtccatcgacgagagcgtccacgttagcagcaacgcgaagcatgtcgcgcagaggaggccgtgcgtgtggaacg

SEQ ID NO: 7564 - DNA, 1438 bp, Zea mays
gtcgagcagaagcagagtttgcagtctgagaagacccctgtgctgtccggccaacttttccacctccgtccctttgctgttcagtcttggatgctccccctccgccgtctagatctccccaactcctccgtcctcttgcttcctgtcgtcgacctcggtggccgccgcgagctgcgggtggttcatcgccgtcgacctcgcctctccgctccttctgcactgcctgttaccggcttcctggtggtcgaccggtgcggcgcgggtcgtcagtgaagctccgactatccggattgactcggatcgacctctcctctcgtgggtttttggattttgatcagttatatcagaggagtgcttatggatgatttcatggctgtagcttgctaggccctgctttcctgtttgtacagatacatcatggcaccacgcagtaggccttcgtctaaaaggcctctctggttcatcgtgttggttgcatttgtctgtgcagtagccattggagcctacctttatactccacggcattacacagcatgttatctggtaccatcagaagcctgcaattctcggcctcctccagaacctgctagggtatacactgatgatgagatcgctgctcgtgctatcatgagagacatcatccgggcacggccagtgcagtcaaagaatccaaaaattgctttcatgttcttgacgcccagttcattgccatttgagaaactgtgggaaaaattcttcatgggacatgaagaccgatacaccatatatgtacatgcatcaagagatagaccaattcatgcaagtccagtattctctggcagggatattcgaagtgaaaaggtgatctggggcacaatttctatggttgatgctgaaaagcggctcttggcccatgccctacaagaccctgaaaaccagcattttgtcttgctttctgagagctgtgtgccacttcataactttgattatatatatagttatctcatggagacaaacgtcagttttgttgactgttttgatgatcctggtccacatggagcaggtagatattctgaccatatgttacctgaaattgtgaagaaagattggagaaagggtgcacagtggtttacagtgaaacggcagcatgcagttcttattcttgctgacaccctttactatgggaagttcaagcgttactgtaagccaggaaatgagtggcataactgctattcagatgagcactacttgccaactctcttcaatatggctgacccgactggaattgcaaactggtcagtgacgcacgtagattggtccgaagggaaatggcatcccaaagtctacagggctgtggatacgagcttcgagctgctcaagaacatctcgtccattgatgagagcgtccacgtcagcagcaacgcgaaccatgtagcgcagaggaggccgtgcgtgtgga

SEQ ID NO: 7565 - DNA, 3296 bp, Zea mays
  misc_feature (2362)..(2362): n is a, c, g, or t
agcgtggattgtatctgtgttagagatatcaatggggaattcttcaccgggttatagtatcccagacccatccttatcatatttgatttatcctcatactcattctcatacctatcatgggtgcaaaactcatcccatactcatccccattcgggtttcgggtccccaataggttcccatccccaattaagggataactaggtactaacagtcagtataaactatccagatttcatatatcactacatcggcaagcactcatacatgaaccatgatctattcatccatccatcaaaaaagaaatcagtacttcgggaccaatagaagaaatggagaaatggaatcttcttacctttcttggtcaccatccgagttcgttggcgcctgagaatctatggtcgtcaccgtcatcctaggcttctagcagtcggcgtagtgtatggctgattattttagtgttttgtttttttgctattctgctagttgccttgtgagagccggtcggacgtgtggacattggacagtggagagtgaacactcggttgctgtgttgctgtgtgtttcggttcagactttcagtttcactgtttgtgccttggtgctatgattttgtgtgtgttgtttgtctcggtgtttaatatcgggtagtttaatgttatccaaacctgaactcgaaattgtgggtagccaaaacttcacgttcaagttcgactgatgaaaaccagaaatataaaaaaacctcggtaccccgagcccggccggcggtaaagccgaactcccagcctgacccggagggagtcgagcagaagcagagtttgcagtctgagaagacccctgtgctgtccagccaacttttccacctcagtcttggatgccccccctccgccgtctagatctccccaactcctccgtcctcttgcttcctgtcgtcgacctcggtggccgccgcgagctgcgggtggttcatcgccgtcgacctcgcctctccgctccttctgcactgcctgttaccggcttcctggtggtcgaccggtgcggcgcgggtcgtcagtgaagctccgactatccggattgactcggatcgacctctcctctcgtgggtaagcgactcgagctttgcctcagttggaggttggagttcgctgctcgccttgtccttggcgaccttcctgtcccgtctgcgctgcgagcgttaaaattcgattttttttttctaacccggttacctgtggactcttgagctgcgtggtgtcctagttatggagtcgagaatccatctaaaatcttgcctagggtcttcagcgcctcaagcatggttgcggccatgccattttggagtccgtctggcgatattagctggcaaggtttagggagggttttgtgctgtgctgtggaaagtttgatgagcggctgcgtggacatgtgacaagtacgtggaaatagacagtgaagagaatttagcttaaaattggtacaggccatgaaccagggagcataagggaaaaaaggagagataaggcagacagagcttgtatttcgtattatccctaataaacttgagttcatttatgggtagaaactggcaagttcccggtaaaaagtcaactgtcctgctttattttgtaacctagaacgacttgtagaatctcctacttgttaactagagcgttggtttgattaaaatgtgtagttgtttttcatttttgggtaacaagtatatatatagtttttccccattttttttatttgtaagcacctccatcaatatttatttttactttgtatatgttttaatattctgtcctttagtatgcacatgtagttttaaactttggattcaacctagtgcaatatcaagcagtttctgaactgttgtttgtcttcgaaatagtttaatcttctatatatacatgtctttttgttatacaatatggattgttggtcaagacacaaaaaaatggtacttttggctgaaagcctgaaggttaaactaaaatttcctttttccctgtgttgtccaggtttttggattttgatcagttatatcagaggagtgcttatggatgatttcatggctgtagcttgctaggccctgctttcctgtttgtacagatacatcatggcaccacgcagtaggccttcgtctaaaaggcctctctggttcatcgtgttggttgcatttgtctgtgcagtagccattggagcctacctttatactccacggcattacacagcatgttatctggtaccatcagaagcctgcaattctcggcctcctccagaacctgctagggtatacactgatgatgagatcgctgctcgtgctatcatgagagacatcatccgggcacggccagtgcantcaaagaatccaaaaattgctttcatgttcttgacgcccagttcattgccatttgagaaactgtgggaaaaattcttcatggtatggtttttgcagtatttgcgaattgcgagtcgtagcaaaattgactcaatgattgtgtttcatcatgtagcactaatattctctcctattaggaaagtaaactgtaaacaaactctatttgacatactatctcatataagaacaaagatatatccattgttgcggccccccctgagtgtgtatgcgtatcaaatctaaccacttgagtttatctttcagggacatgaagaccgatacaccatatatgtgcatgcatcaagagatagaccaattcatgcaagtccagtattctctggcagggatattcgaagtgaaaaggtatctaactagcattggcttaaatctgtactatcctcattgatttacgaagaaaatattttctagccttcagtatataatacacactgattttgaaaaaaaaatgttttgttttctctcagagtgccgtctctaatgattgtagaaccccattctttaaacggatggatatagtttgtagagtacgtcccgggatttattaatgttgttgaaccatcacctgtacatatcatgtccagtagtacgtgcctacagcaaccgtgtccaagactattttgaagtcaatgtcaaagttttagttatagttgttgtaggatctaatttttcaattttctcgccaggtgatctggggcacaatttctatggttgatgctgaaaagcggctcttggcccatgccctacaagaccctgaaaaccagcattttgtcttgctttctgagaggttaatcatttttcatttgttctgttcccatctaaatttgagtgataggccccgtatcctaacactttattctaattgcaggggtaccga

SEQ ID NO: 7566 - DNA, 1738 bp, Zea mays
gagctcactagtcccccccccccccgtctgctcggcctcaagtggcccagagggttgctactccacggcccccctggcaccggaaagacaagcctggttcgagctattgttcgagaatgcaacgcgcacctgacaatgatcaacccatattctgtacacaaagcccatgtgggagagggagaaaagttcctgcgtgaagctttttctgaagcatattctcaggcttcgcggggtaaaccagctgtgatattcattgacgaacttgatgccatatgtccacgccgcaatagtaggagagagaatgagtcccgcattgttggccaacttcttactctcatggatggaaacaaaaaggcgtcaaagatgcttcctcacatagttgttgttgcatcgactaacaggatagatgccgttgatcctgcattgagaagggcaggacgttttgactcagaggtagaggttgccgttcctacagttgaagaaaggctgctgattcttaagctttataccaaaaacctacatctggatgaaaaagtcgatcttcagactgttgctgtgttctgcaatggctatgttggagctgatttagaagcattgtgtcgagaagctgccaagcttgcatatcatagaatgttaaacttatgtgagggtgacaaagtacttaaactacttatggaagactgggaatgtgctagatctatggtgggaccaagcataacaagaggggtaaccaaagaaatttcaattgtttcgtgggatgatataggaggcctgaaagatctaaagaaagagcttcagaaagctgttgaatggcccatcaagcatgctgctgcattttctagacttggaataccaccagtccggggggtgctgttgcatggcccaccagggtgctccaagactactcttgccaaggctgcagcgcatgctgcccaagcttctttcttttctttgagtggtgcagatttatattccaagtatgttggagaaggggaagctctgttgcgtagaacatttcagaaagctcgtcttgcttctcccagcattatattttttgatgaggctgatgccattgcccccaagagaactggccctggtgggaattctagtggcaatgccacagtcggagaaagacttttgtcgactttattgaccgaaatggatggtttagaactggctacgggaattatcgtattgggtgctacgaatcgcccaaatgcaattgatgctgctcttttgcgtccagggcgtttcgataaggtgctgtatgtcccgccaccagatgtggaagggcgacacgagatactacgcatccatacacggaaaatgaagttgggagaggatgtagatctttggaaggttgcagagtgtaccgagctattcaccggtgctgatcttgaaggcctttgcagggaagctggaatggcagcattgagggaagatatctcagcaagtttgatacatgacgctcacttccaagccgcacgaagttcattaagcccctctcttacaaaagcagtagttgatgagtactcaaaggtagatataaatgatccatcgagtaggaaacattgatatgttctttttctatttctttgttgcacactaggcgcaatacacatttgcaaccttgccaccaagacacacagatggagatagagagatctttttaagaatattctttttaaaaaaaaaaaaaaaaagtcagctctggatgttatttaaaaaaaatgccctc

SEQ ID NO: 7567 - DNA, 3879 bp, Zea mays
gctaacacacttgctacaagactcattaagtatgtagtttttttgtttcatagaattgtgtaatcttacactttagtttagttttatgattcaatgtttaaacaatacaggtggagattccaaaactttgatgtttgttcaaatcagtcctaatgagaacgacgtgggtgaaactctttgttcattgaacttcgcgagcagagtacgaggcatagagcttggtcaggctaaaaaacaagtcgatgttggagaattgtcaagatacaagctcatggtatgatagcattatgccaatatatatgtatgtgcagatatgctgtaaattctgaagttcactaaaacgtaactctctattgattctgctaggttgggagagccaaacaggatagcaagaacaaagatgctcagattaagagtatggaagaaaggatacaagcacttgaagtgaagaataaggccaaagacttgctcaccctgaatctccaagagaaggtatatcctgctatatttggttgcttattgccattaaattattctcgtgatcaccttttcctgtgtataatttagacgtgctaattaaagttttcaatttcactgtggtaaccaagaaattttgtattctaatacatcatgttttttgtcaaatgtgatgcggtgactgatgatgtagtgtgcatgggaaaactggaatgagaagaaaaaaaaaccttacatgcttatcgctacttctaaactcctgcagatcaaagagctggaatcccagcttctagttgaaagaaagatagcacggcagcacgtcgacaacaagattgcccaggatcatctgcagaagcagcacggcatgaaagaagagaacaactcgtacctgagaagcccaatggccgagaggaacctcaactccacagcagagaaagcagcagcaacacctaaaggcctgtgcatctccaagcagatgttctccgacagcaacaccgacgcctacagcttcaagcagctgatgtcactaggggaggaggaggagaaggagaacaaccctgaagccgccgcgcagctgccggcgcccagtacgaaagcgaggcgagtctcgctcggcaacggcggaggttaccagcagccgctgaagccgatttcgcgccggacgtccctgataccgcttccgcgccacaactcgctgctgccaatgcccacagcagcagcagcagcagtgtcgccgcttgacaggatcacggagaacctgtcgtcgcgctcgccctcgccgtgctctcctccggtcgtctccgtcgacaagggcagccggagtagaagggtcagcagcctcctgcgccgaagcctgcagaagaaggtagtcatcaggccgtcagtggcggcgcaggcagcgaagaaagccggtgctgctgcacctgctgctcaagggactgacagtagtgcacgcagagcggctcggcgagtgcctgcgagcggcggcggtgttggtgggcagaaggtgcggcaacagaacagggacaaggagcgggggtggaacaacgggacgagcctcaggaatttctgaccagtaaaaggagtgttctgttagattgcttgtacaaaattcaggtgatgctcggtttgagtttgtgagttctcgcgtattgtgagagaactctacgaattgctgccggctacagtcagtctcacaaacttgtgtgatgctgtaaaaccacttcgtgctgattttcatttggagggttatcattgtcattgagaatccgtctataattaagaaaatttgcaaatgggtttcaagaccttttgattgagaatctcatcccgtaagtattcaaattgcaaagttaacaacgattctcacagcaaaacttatcgtaatccaaactattttagcgtatatagtggacgactatcatacaactgaaatgcttgcgtagttgcgtgccagatcctcacattcttttctcacgtccagttccaactcagccaatctaaacaatgcaaatcagaggcgtagcgtagcgtagcaagaaatttgtatttttgacactctaaacaagtgactttgcataattgacactctaaagattgacaccgtaaatttaacccccataacattgacacattgatttacttgacattttatccctttaacagttttatttctcttttttttctattttctagattttttaaggactaatctacccttctatccatattcctaggaacgtggtacaatataatacaaccggtcaaccgcatgtacatgcagccaccactgatctcgccaaaggggccttgttgccttgcgccgccaacgaacaactgcgcacgagggagaaggggcctggctggcagcgcccgtcgaagccccgcggtggctttttattctcgattgttgtttcgtgccattgttgttgagccggatcgtcgactcttcatccccgtcgtcgaattgtcagttgcaggagatctccctcgcagtcctagttccatcgcacagacgtcattcttcgtcaccaccacggtctaggcgatggaatggaaccttattcaattgagtcatctagacggtattagtaattatattttcagtatcagccttcagcagtattatttacagtgatgaatcgtggttaaccaccaacaggatcaggttttcaatgttgatatggacaactttgctcataaattatgattagagcatttatgattcaatcaattatggcttcacgttttcctaattgttgcaagcagggtagattcggaggttgccatggggagcaatactgatgctccattgttgttgtttgaggcttctttacctatcccacaataacttaaaaatagtagagactcatgatgaggaaggaagagttgaaccattgagtgaggatcagctatatgtgatattgggcttgagggatgaggatgagaggagaaaggtagctgaaccgaatggtcgtacaatgcgtgcgtgagcagggagatgaaaatactgaagatgttgccattcctattagtgatgccataccagatgaggtagtgataacatatgataaggatcacccaaaattggatcttggcacattgtacccatcaatggatgaatttaggttggctgtcaggcaatttgctattaatgaggagtttgagctaggcatagagaagtaggtttagaggattctgcaagtctagtaaagaatgcccttggaggattgttggtagaaggcaagctgatggaaaaacgataaaggtgaaataatattgagtatcattctaacttgcacagattttttatgtgtatgacactcaccattttgtattcatttccctacaggtgacacttttagttgataaacatgactgtatttcaagcagtagggtgaagaccataacaccatctcaaaagtgggtagctagtagagctgtgagcatcattcgaaacttacccaacattggagctacagaattgcaaaaaaaaaactacaagaccaatactctatcaccattccttatggcagtttggagggggaaagaaaaaagctcttgcagaggtttatggtaaataggaagaaagttttgagatgttatacagatggaaggctgaggtactaaagaggtcacctgaaagtgttgtggagattggcgtactagaaatagaaggcaaagtgtactttcatcgatttttctgtgaactaaaaccatgcattgatgccatttagcctcagctacagcagttgatggtcataattggatgtatccacttgcttatgggttcattgcatctgaaacagaagaaattgggacttggtttatgaatcagcttaagatcgcaattggagaccttccacttcttgcactgtgcacaaatgcttgtaaaggcttaaa

SEQ ID NO: 7568 - DNA, 1223 bp, Zea mays
gtaaaggcgacaggcaggtgcgagccgtgaaggacgggagcgagcagtgaccactgcgccagattcagaccacaccacccaccgcaatcaggagcggagccaaggaaggagggggcagcgggcgacgacgaagcagcggcaatccgacggcgtaatggcggcggggagggggtgaggcggcgccctgagccgtaaaggagccggctttcgtagctcttcctgggagtgaccttctccgacgaaacgaaatggcccatcaaggaccaggagtgcctaagtttggaagttgggaggatgagggcgatcacccctacacacagtacttcgaaaacgctcgtaagggcaaatctccaggcagatctgctactcagaacgagcacagaactggagatccggaagcgctcttcaaagaagacacgacgccatctgctaaagcttctcccctgcggactgggtcggaggatcctgtggcgccaaagcccaaggacgcggcctttgctcgaggcaagccgtatgctgagccagcaacccataaacacggtgctaataccagctatgaaagaaaaaccggcatggagagatcgcctctgcatcctcaccaccaagcaaggctcgtaaacagaggaggggtttcgtctccttcatgggaacgcaggggttcgtcagaaggaaaccgtggagctgcgcccaccacacctgggaggtcgtccaagatgaggccaggcggccgtggagacgagacgcctgagagaggatctgccgtgcccaagtttggagaatgggacgagaaagatccctccacaggtgaaggcttcaccgacatatttaacaaggtgagggaggagaagcagtccggcgatgctcctgtcatcaccagcggcaacgcaggtggtggttatagccgctccaaccaaggccgcaaatacgaatcttcagcttgctcatgcttcagttggttcaggaactgatgcttccttgcatggttgctgatgcttcagctggttcagcagctgataggtgccgttgaagatttggatgaaccagtgccgatcgtatcattttcacatgagctgtagtcccatcgtgttctccctgttgtgatgctgtgtggtagcaggacgtgccagaacttgactttgagaagctgaggttcagtagtttgagctgtttttgcaaaaaaaaaaaaaaaacccccccgccctgctcgtgcccggacgtagcgc

SEQ ID NO: 7569 - DNA, 2105 bp, Zea mays
  misc_feature (69)..(69): n is a, c, g, or t
ctatatattttatatattataaaactatacttttatgtgaattaattatatatgcctaaaggctactangatagaggacataaattgtctttagctctagtcaaattttgaatactcattttttaaatcctggccttgcccttgcctatggttatccattgacatagtagcttgacaaagagccacacgccccgtccttcaagctcactcggactcgcgtgatttttttctttacttaaggaagcaaatattttttttttgttcagactgtctccgacagttgaagggcgggcctggtgcagcggtagagcctaccgtctgtaaccggaagcaaatattatgcgggtaaggcttaacgcttaaagatacccttccccaggccccgcacagtagcctacggcactgggtacgccctttgtctccggcagttagtgtaaaataggggatacataactatagatgatactgtttgatactatttactagaatttgaaatagaagataagatataagatgtgcttgcttgagataaaccggcaggtgctacagcagtagatagggatggaggagagtaagatcgtaggaagaagaaataccagagagcagtggccaacagcctgctctgctgttcctgcgaagtggaactgcaaccgccaccacgggccccaccgcggcaaatcgccaccgacccagagaatggagactggagccgtctcctcctgtcctcccgagacccgactcaactttctctcggcacgccactgccaattccccgccagcagcagaaatcacactccgcttcatcttccgctggatccctagtctacgccggcctaacgccttgggacctccgctgctgttctctcgccggtcatttttggttcaggggctgatcgcttgatcggatcggtgtcgcagccctatacatcatacatgacgacgcccggctcctgtcctgcgacaaccgccgccacccaccctcccatgtgcgccgctagcgccgcaggtggatcgcaaaaaatggtgcgtccgcgactagtgctcttcggggactccatcaccgagcagtccttccgccccggtggctggggtgccgcactggctgatacctactcgcgcaaggctgatgtagttgtcagaggctatggtggatacaacacaagatgggctcttttcttagtacatcacatctttccgctggatggtttagcaccccctcttgcaaccactattttctttggagcaaatgacgcagccctgttaggaagaactggcgagcgacaacatgttccagtttcagaatataaaaataatctcaaaatgattgttaatcatttgaaggattgttctaattccatggttattgtgcttattacgccacctccaattgatgaagaaggaagagaaagatttgcacggtcactttatggacagaatgcgaggaagctacctgaaaggacaaatgaaatggctggggtctatgctggttattgcgtcgaactagctagagaaatgtgtataccctgtgttaatatctggtcaaagatgcaggaggcagaaggatggcagaaactttacctaagtgacggtctgcatctgacacaggaaggaaacgcagttgtccacaaggaggttgtcgaagcattgagaaatgctggtttcaaagctgaacagatgccgtacgactttcctcatcactccaaaatagatggcagttgtccagaaaaggccttccaatgaaatgatttcgagttgtgtgatgttttggagttttggatcctgcattgaagattacgataacgtccaatgacatgatcttgagctgttacattttgggagtttgaaatcttgcgtatattttggagtttgagatcctgcattgaagattgtaatttcctccgtgcaaattaaggacctaggcttctccaagatgccggtgttgcttcttctacacttacattgttacattttctggattaagacatgttagcttccatttctcgttattgtggtggatggtttggatattgaacgaattgaatattcggatatctagggatgaaaacggtcggaaacgatcggaaaacacaaaaaaaaaaaaaaaa

SEQ ID NO: 7570 - DNA, 1379 bp, Zea mays
gcacgagaccattacctagaacatcctaatcgaaaacggggcctctgtgtttataaattccatcgcatccctctgcaggtgcagagcagctccattccattgcccctagctcaccacacactcgagtgacgagcacacccaccgacgatcgccatggccggcggcagcagccttaagaacatggtcgtcgccttcctcgtcccgctcccttccatcctcttctacctctccttcgtccgcgccggcggggacaccggcgccagcccgctcgcctcgtggtgcgccgcgcaccctctgctcctcgccaacgtcctcttcttcctcaacgtggacgtcctcttctggctcgtcggcctcctcctctccaaccactggctcatcgacctgtactggaccgtcatccctgtgatgctgctgcactactaccgcggccacccggcatccgtggcggacgcggcgaggtctgcggtggccgtggcgctcacgtgggcgtggagcgccaggctcacgcacaactacctcaggcgggaggggtgggagttgggcaagcgggaggactggaggtttaacgagatgcgcggccagtacggcaacacctggtggtggatgtcgttcttggccgtctacctctcccagcaggtgttcctgatcggcatctgcctgccgatgtacgccatccactccagcaaccagccatggggcgtctgggacctggtggccgcagccacctgcgttgccggaatcctcatcgctcacttcgctgacacccagctgcacaggttcgtgaccaggaacgagaagctgaagcggctgggcgagccaaccgtcccgaccctcgaggacgggctgtggcggtactcgcgccaccccaactacttcggcgagcagctctggtggtggggcttgtacttcttcgcgtggaacctgagccagcagtggatgttcttggggcctctcgtcaacagcctgtgccttggctacgtcacggtgctggtcgagcgccgcatgctgaagcaggagcaccgtgctgaggcgtacaagctataccagaagaggacttcggtgtggatcccttggttcaggaaggccgtccctgaatcgaagctgaaggagacctaaggccacagtgtcgtttagttatttgggccataccccttgtccaggttgttcaccatgttgtttgttccaccacgccgtccatgtttagaacctgttgtttcatccgctatgtgtaattcactgtatgtgcatgaggtgcagcttgtatcatatgcatgatgacctgtttaaggtgcaagttaaaagtaatgtatctaaaaaaaaaaaaaaaaaaaaaaaaaaaaaaaaaaaaaaaaaaaaaaccaaaaaaaaaaaaaaaa

SEQ ID NO: 7571 - DNA, 793 bp, Zea mays
acccctgctctccctacccgcaaacgcctgtgtctctgccataaagcgagctggacaggaaatcggtcgcgcggcccgccatttccacgcctccaaagcaccagacatccgtccatgacgacgtcgtccagcgaggtcacggtgtgctcccacctgttcacggtgagaggctacacccacacagggggcatcggcgtcggcaggtccatcgagtcgcaggcgttcgacgcggccggccaccgctggtccgtcgtgttctacccggacggcgacgaccaggacgcgaggggccacatctctatcttcgtcaggctcatcggcagcggcggcgccggagacgtcacggtgctctacggcttcagcctcgtcgacccgagtggcgccgcgccggcgtcggaggcctccaaggcccccaaggtcgccacgttcagacattcggcgggcggcgactacagaggtatcggccgcttcatggagcaccagaggttcgaggcgtctccgtacctgcgggacgactgcttcaccatcaagtgtatcatcggcgccgtcgagaggcccggcctgccgccgctgccggcggcggcctcggagctgcaccacgatttcgaccgacttgcggtagacggcggccgttcggaggacgccatgtccgacgtcgactgaggaagccatgctgctgtgcactgtgctatgctcctcttcctctaacctctactatgcaacgagcgcagctgcgcaggggtatcatcagcaaggccgcgaaaagtaaagaggggggggggggggggggggg

SEQ ID NO: 7572 - DNA, 1309 bp, Zea mays
ccccgcatcagcgcccccaatcctcctccaacttccactcgagtagggttctgccggccgtttcctcgtcgtcgcaatggagttctggggtgaagaagtgaagccaggagccacggtttcttgcaaagttggtgatggtttggttatccacctttcacaggctgcactaggggaaccaaagaaagcgagtgagaatgtcattgtgtctgtcaaaattgatgataagaaactagtgcttggaaccttatcagttgagaagcatcctcagatctcttgtgatctggtatttgataaagattttgagttatcacacaattcaaagacagctagtgttttcttctgtggctacaagtcacctgttcctctgtttgaatctgattctggtgaagatagttcagatgaagagctagaacccgatctaattccaatacagaataatgaaattaaaatttctacggcaaaggttcctgtgaaggttggtatacaaaatgctgatgaagatgaaacttctagtggtgatgatgatgatttcactgatagtgatagtgaaatgtctgaggaagatgagtccagtgatgaagatgaattgtcaagcgatgcagatactagtgatgattctggttcggaagaacagacacctaccccaaagaagactgatgtagtagttggcaagaagaggccaattgaagctgagacaccttctggtaagaaggctaagtctgaacaatctgctcagaaaacaggcgacaagaaggtctcaacttctcatcctgcaaagcagtccagcaagactccttcagacaaatctacaaagacccccacagctgacaagaagtcccccaaatctgggagccatgcctgcaagtcatgcagcaaatctttcgtcagtgcgtcagcacttgagtctcatcagaaggcaaagaagcatgaagcctagagcacgtgctgtaccatctactccttatcaaaatcagtggtcttatttttgaacttgaaaatgtccaagtttggaacttgcccagtagtcatttgattagtggccttatttttctttgaacttgggaattgtcaagtttgggacatatgcagtatgccttgttaagaacattggaaatgtcaggttagaacaggtcctgctggcccagttttggtcgtcgtcgaatgttgctaatgtttgaactgagcattgtgacccgtaagggagaatctttgttatctggtagtgcctagtgcaaatcacatttttcctcagttgttaaaaaaaaaaaaaaaaaaaaaaaagggaaaaaaaaaaaaaaaaaagcggccc

SEQ ID NO: 7573 - DNA, 1383 bp, Zea mays
aatccattccggcctcgctttaagagcggcacttcccgtcaccccccgggcgacgctgccgctaaaccctaaaccccgcaccagcgcccccaatcctcctccaacttccactcgagtagggttctgccggccgtttcctcgtcgtcgcaatggagttctggggtgaagaagtgaagccaggagccacggtttcttgcaaagttggtgatggtttggttatccacctttcacaggctgcactaggggaaccaaagaaagcgagtgagaatgtcattgtgtctgtcaaaattgatgataagaaactagtgcttggaaccttatcagttgagaagcatcctcagatctcttgtgatctggtatttgataaagattttgagttatcacacaattcaaagacagctagtgttttcttctgtggctacaagtcacctgttcctctgtttgaatctgattctggtgaagatagttcagatgaagagctagaacccgatctaattccaatgcagaataatgaaattaaaatttctacggcaaaggttcctgtgaaggttggtatacaaaatgctgatgaagatgaaacttctagtggtgatgatgatgatttcactgatagtgatagtgaaatgtctgaggaagatgagtccagtgatgaagatgaagtgtcaagcgatacagatactagtgatgattctggttcggaagaacagacacctaccccaaagaagactgaggtagtagttggcaagaagagggcaattgaagctgagacaccttctggtaagaaggctaagtctgaacaatctgctcagaaaacaggcgacaaggtctcaacttctcatcctgcaaagcagtccagcaagactcctgcagacaaatctacaaagacccccacagctgacaagaagtcccccaaatctgggagccatgcctgcaagtcatgcagcaaatctttcggcagtgcgtcagcacttgagtctcatcagaaggcaaagaagcatgaagcctagagcacgtgctataccatctactcgttatcaaaatcagtggtcttatttttgaacttgaaaatgtccaagtttggaacttgcccagtagtcatctgattagtggtgttatttttctttgaacttgggaattgtctagtttgggacatacgcggtatgcctggttaagaacatgggaaatgtcaggttagaacaggtcctgctggcccagttttggtcgtcgtcgaatgttgctaatgttggaactgattattgtgacccgtaaggccgtaagggagaatctttgttatctggtagtgcctagtgcaaatcacctttttctcagttgttaaacatcttgcttttacggtgttcgttttttccaaaaaaaaaaaaaaaa

SEQ ID NO: 7574 - DNA, 1358 bp, Zea mays
tttattttaaaaaaaaaaaaaaaaaaaaaaaaaaaaaaaaaaaaaaactaatcagacacgatccgtattccctgttgttccctctccgaattcgaccccgccgctaaaccccgcaccggttgccgaggcgtctcccgctccagctccgactctcacgcgactagggttctgtgcgtccacttccccgtcggcgcaatggaggtcgggggtcaagaagtgaagccaggagccacggtttcttgcaaagttggtgatggcttggttatccacctttcacaggctgcactgggggaatcaaagaaagcgagtgagaatgccattttgtctgttaatattgatgataagaaactagtgcttggaaccttatcagttgagaagcatcctcagatctcttgtgatcttgtatttgataaggattttgagctaccacacaattcaaaaacacgtagcgttttcttccgtggctacaagtcccctgttcctctgtttgagtctaattctggtgaagatagttccgatgaagagctaaaaaccgatcaaattccattgcagaataatgaaattaaaatttctgcggcaaaggttcctgcgaaggatgatgatgatgatgttttcattattctagcgatgatgatgatgatttatagcagtgatgatgatgatgatgatttcactactagtgatagtgataatgaaatgtctgaggaagatgactccagtgatgaagatgaaatgtctgaggaagatgactccagtgatgaagatgaaatgtcaggtggtgctgatcctagtgatgattccagtgatgaatctggttcagaacatacttctgccccaaagaagactgatgtagtagttggcaagaagagagcaatcaaagctgaggcaccttatggtaagaaggctaagtctgaacaatcttctcagaaaacaggtgacaaggcttcaacttctcatcctgcaaagcagtccatcaagactcctgcagacaaatctaggaagacccccacagctgacaagaaatcccccaaatctgggagccatggctgcaagtaacgcaacaaatctttcagcagtgcgtcagcactttagtcccatcagaagccaaaaaagcatgaagcctagaggagcatgtgctgtaccttataggttgatctacttgaattatcaaaatcagtggtcttatttttgaacttgaaaatatcaagtttggaacttgcctagtagttatgcgattagtggtcttactatttttaaacttaggaaatctcaagtttggaacatacctggtatgtcttgttaataacatgggtgtgagaggagaaaacaaaataaaaacaagaagaaaaaaaaaaaaa

SEQ ID NO: 7575 - DNA, 4131 bp, Zea mays
  misc_feature (1247)..(1247): n is a, c, g, or t
  misc_feature (3934)..(3934): n is a, c, g, or t
  misc_feature (4072)..(4072): n is a, c, g, or t
gttcgcgtcggtgttgcttttcaagcgcctcgcctgtccctgtcttgccctttgcgccttcgtcaccgcgacgcgcttgcgttttccaatccttccttgtcttatactccgtttcgactttgagctgggtcgatttcttcttcggccgatctcttccgctgctgctgattccttgttctcgcagatctccatcgggcgttccgctttcgtgcgacgcggggagcgagcctgtgttcggtggcggggttattgagtttgccgtttatttttttcctgcaattcgtctagttatcgtgtgcaattcgtctagtcatcgtgtcgatcttgtttcgtctcgcctcctcagcgtgtgggttgcaggattggatccgatctggtgtggggagttcgtcatgttcgcctggactcggaggcaggtcagtattctgtcagatccaacggttcattggttgtcacttggacatggattcggtggtttcaggcccaatcatctcccggtggggtaccaccagaaattgtcacttggacatggatttgaagatttcaggcttaatcgtctcccggtgcggtagcatcagaaaccgataatgcagttatagcctgcacaccaggtggatttggagaaccttcggtccgttcttatgttaacggctgatctcgcttctggtcttttggttgtttgtcctccttaaacttcagatgcatgaagggtccttgctggttatggagagatcatttgaagggtggaggtttgctattatggttcattcgccgtttctcattcctattcatcatattgtcggaagattagcaccgaacttactctaagcttcgttggaaatgctgcctctagatctgcagaggcaacctaatattggaaatagattggggcgttgattggactgcaattcgtagtattggcgagaagatcgtttggatatatttacctatcgcccatcatattattaaatttctatccgttgcagttttaatttcttacattggggtgatggttttctccagcaactcgattaaatggatggattggtggaggcgagtttgatcctgcttctgtttgtgtaatcagtagttcggaattgttcagagttccttgtgtttgttcactaaccatccttctgtcaatgttcttcgaaaactaacttcacacataggctccctttaatgtttcgttagtgtatctgcagttttgggagacatcactacagagttcatccccctaaatgcantaatggaagtccttgctggtattgtcctcctagatgcaaaaggaaagatcccttggttatgaatagatcggttgaagggtgggaggtttgcttatgttccttggttttgatctgctatatggctatttttatgttagcaagttttgatccagcttctgcttgtgcaatcagaacttctgaattgtttagagttcctttgtggttgttcactaaccatcctcctgtcgatgttctttgaaaattaacttcacacataggctcccttaatgcttcgtgtcgtgtctgcagttttgggagatgccactccagagttggtccccctagatgcaaaatggaaggtccttgctggtttgtcctagatgcaaaaggaagatcccttggttatggatagatcggttgaagggtggaggtttgcttacgttccttggttttggtctgatatatggctatttttatgtcaatcacggtggcgtgaagatcgccaccggactaattagaagcttggttgtccttaattggaataatgtagaggcaactgaggtgatgttttggacgtagattgaagctttgaccggactaagttcatgtcatgcagataacatcgttgggatatatgtatctctcactcttctattggcactcttaaatttcttatttcttatatttcggctgatgtttttctccagcaactggattacaacatctggattgtatatggatggattggagcctgagtttggttctgcttctgcatgagcaataataagttctgaactattcagggttccctttttgttcaaagaacaattctatcctgtcaaatgttagttcactcgtaggctacttaatgatcggactttatcctatcccacattatttgatgaacgttcatgctgtttgagtgttctaagttctcactaccaaatagatagttaccagagggtggtcctactgattgcaggtctctaggtgggatatttgcatgggcacagaaggaacccgatctattcaaacctacaacgaactttaactctcattgtgtttgttcagtggttctaccttgaagtagataaacttatccaatttacaaaatgctagtatatgaaccatgatgaaaatttggatacttctgttttaatctgcacttctgcagtggtagaaggcactggatatgtttgggacgtaggagattcaagctgatatgggtagaactacaacttcgatttcgatttaatcgaacttgtttctgctttatcatgctatatgcattaactgaagctttaattcttgtgctgctgtcatttctgtgttctgcagatcatttagctcaagtaattggtagtccaacggtcatgatacttgttttggtttgggattagctttatctacatttttgtcctcgcttttacatgtgtttgcagggtaagtttggcaattggaaatccctgtagcgaagaactgatatttaaaactggggcaggttagaaatcattccggttgtgttggttccatcacttgttttcagtgatttcatatctgaatgattggctaacattctgactctccaatgatatcgctggaacagtagtagtagtattagcagcaaggttcgagatgcggacattggaggtggattttccttgcactctggtttttcttctcttcgtgtcggtgttgctattcaagcaccttgcctgtcccgtcttgccctttgtcacttcgtcactggcgtgtttgcgttttccatttcttccttctctgtactctctgtttcgacttcgagctgggatggtttcttctccggctgatctgttctgctgctgttgcggttacgtgctcttgcagatccccttggggcattctgctttcgtgccacgcgggagtgggcatgtgtttggtggcgggattgttggatttgcggtttatttttaaggcaaatcgtctagttatcgtcgatcttgtttcgtcttcgccttctcagcatgtcggttgcaggattggatctgatctgagttcgtcatgacgttgtgtggcgatctgtttgtctgagttcggagataggttagtattctgtcagatccaatggttcattggttttgtcacttggacatggattcggtggtttcaggctcaattgttcatctcctgttgtggtaccgtcttcaaaccgatagtgcagttgtagcctgcataccagatgcaaggagggtccttgctggttatggaaagatcagttgaagggtggaggtttgcttatggttcattcgtcgtttctcattctgatatcatcatattggtgcaaagattagcaccagacttgctctaagcttgattggaaatgctgctggctagatctgcagaggcaacataattttggaggtagattgaggcgttgactggagtggagtttgtagcatcggcgaggatatcagttggatatatttacctatcgctcttcatattattaaatttctatctgctgcaattttaatttcttacattggggtgatggttttctccagcaactcgattatatggatggatgggttggaggcgagttttgatcctgcttgtgcaatcagaagttcggaatgttcagagttccttagtttgttcactaaccatcctgcgtcgagttcttgaaaatcaacttcacacacaggctcccttaatgcttgttagtgaantgcgttttgggagagttgaaggtggaggttgctacatccttggtttgaaagttttaggcaattttagtcaatcaggtgccggaagatgccacgactaatagagctgatgtcctaatgaaaaaagcgtagaggcaaagnaacagagtgagtttggacgtagatgagcttgacggactagttcaggcagcgataacaca

SEQ ID NO: 7576 - DNA, 545 bp, Zea mays
  misc_feature (24)..(24): n is a, c, g, or t
  misc_feature (27)..(27): n is a, c, g, or t
  misc_feature (539)..(539): n is a, c, g, or t
gagagagagagagagagatctctntancccccccccccccgaactattcagggttccctttttgttcaaagaacaattctatcctgtcaaatgttagttcactcgtaggctacttaatgatcggactttatcctatcccacattatttgatgaacgttcatgctgtttgagtgttctaagttctcactaccaaatagatagttaccagagggtggtcctactgattgcaggtctctaggtgggatatttgcatgggcacagaaggaacccgatctattcaaacctacaacgaactttaactctcattgtgtttgttcagtggttctaccttgaagtagataaacttatccaatttacaaaatgctagtatatgaaccatgatgaaaatttggatacttctgttttaatctgcactggcactggatatgtttgggacgtaggaggttcaagctgatatgggtagaactacaactttgatttaatcgaacttgtttctgctttatcatgctatatgcattaactgaagctttaattcttgngccggc

SEQ ID NO: 7577 - DNA, 1993 bp, Zea mays
ataaaaaatgatatatgtattagaaaagctaaaatatcaaaatagagagagtccttactagttcaatagattgaccatgttgttgaacccgaagccattggttgccgccgtcgacgagccatatcacaaaccccccatccttctttgacttttctctgaatttcgaaccctcgaaatgatgtcctgtccatcactccggtccctgtcactgagatgagcgagcctctagagcatcagctgcatatgccaacacgtcagcaccactcgcaccgcgcacgggccgcgcactgcccgtgcccgaactggaatcttttaggacccagaactccacgcatccacacgttttccacaatccggaagtaaaaggacgcatggaccggtctctttccgatctcccacctggcgccgctctgtatctgtgcaccgtgtcgccgtgtgcctctcgatggctgctctcaagtgtcaacctatataagcgcctccacccgcagctcccccccggacagttcgaaaggttcaacttcaaacacactccaaactccaagcctcaataatctcgacctctgtaatgaccaagaagctcatctccatctccaccatggccgggaagcaaggttgcaaggagcagtccaatgatcggaggatccaggcttcgatccaaggagacgccaagagcgtggtggtggggttcggcggcaggctggtcacccgtgagcaggagcaggaggacgccatcatcgtcgcggcgctgcggcacgtggtgtccgggtacagcacgccgccgccggaggtcgtcgtcacggtggcgggcggggaggcgtgcgggacctgcggcatcgacgggtgcctcggctgcgacttcttcggggcgccggagctggcgcaggaggcagtgtcctgcggcacagggcaggtggcgacgacggcgtcggtcgggggcggggcagcggcggcggcgctgaggccccggcggcgtaggaacaggaacatgtaccgcggcgtgcggcagcggccgtggggcaagtgggcggcggagatccgcgacccgcggcgcgcggcgcgcgtgtggctgggcacgttcgacaccgcggaggaggccgccagggcctacgactgcgccgcggtcgagttccgcggcccgcgcgcgaagctcaacttcccgggccacgaggcgctgttccagggccacggcgacaccgcggcggcggcggacaccgagacactgacgccgtcgccgggagagtggcagctgggcggcggagcaggagacgagctgtgggaaggtctacaggacctcatgaagcaggacgaggtggaccgctggctcgcgccggttttcggcgccgcgtctagtttttgagctgttgtactgtgcacacacaagcgtggttactgacaggatcacagctagactgaccaccattcttttgctgtctattgaactagttggttcttttgtagcgtatttttttagggaaacatgattctttttttttttttgccgtgtgttgattgggatatagagagtttttttccctctcttgatggaagtacttgggaagctatgttgatagactgaacatttttttgtactctggctgctgagattctttgacgaattatacggtgaacaaagcatcgttttttatataaataaaaaaacagttgaccgatggaaccatacataactcgtcactcactagtcagaggccaaacgtcccaggtcaaaacaaacatggtaaaagtaaagtaggaaagcgctggagtcaatgttaattcattaaatttcttccctttcatttggcatcccttgtttatctcatccttgctctgagcatatgttgtttaagcattcctgattctgtcgcgttgcgctctgaaattcttgtggaaggatttagctaccagctgtggcgatagtgacaggcttttgcttctgtatcgaaaaagggaattaatgtgaaaggtgtggtagacaaaagaaaacgatgca

SEQ ID NO: 7578 - DNA, 1846 bp, Zea mays
  misc_feature (12)..(12): n is a, c, g, or t
gccgtgccgggnaatttcgagcggccacgcgaccacgggtgacagcctcacactcacttgaccgaccctttgcgacgccaaccggccaaagctcccggctcggcggcgccgcttcgtttcgttgatggattggtccacccggttccgcacccgaaacccgtcgccggccgtgtcccactttgccggccacaggcggagtcaagcggatagggtatttctccggaccatggcgtcggcggccccggtggaggagccgacggcggcggccgaggcgaaggggcggctgaccggtgactccttcatccggcgccacctcaggaccctcgccccgtatcagcccatcctgcccttcgaggtgttatctgctcgccttgggcgtagaccagaggacataatcaagttggatgcaaatgagaatccatatggtccacccccggaggtcgctgcagcactaggtagtctcaagttcccctatgtgtaccctgatcctgaaagccgccaattgcgtgctgcccttgctgaagattctagacttgaatctgattacatacttgctggatgtggcgcagatgaactaattgatttaattatgagatgtgtgcttgaaccaggcgacaaaattgttgattgccctccaacattcacaatgtatgagttcgacgcttcagtcaatggtgcacttgttatcaaggttccaagactgcccgatttttccctagatgttgatctcattgtcgaagtggttgaacaggaaaggccaaaatgcatatttctgacatccccaaataatccagatggcagtgtaatcaatgatgaggatcttttaaagatacttgatctcccaatacttgtagtgctggatgaagcttatattgagttttcaagccttcagtcaagaatggcatgggttaagaagcatgataatttgattgttctccgaacatttagcaaacgggcaggtttagctggtcttcgtgtgggttatggtgcatttcctctgagcattatcgagtatttgtggcgggccaagcagccctataatgtttctgtggccgcagaagtttcagcatgtgcagctttacagaatccaacttatctggagaatgtgaaaaatttactggtaaaagaaagggagaggttgtttaatcttctcaagggaataccattcctgaagccatttcccagtcattctaacttcattctctgcgaggtcacgtcaggaaaggatgcaaagaaaataaaggaagaccttgcgaagatgggagtgatgatccgccactatgacaagaaggaactgaaaggctatattcgtatctcggttgggaaacccgagcacactgatgcactaatgaagggcctgaatgcacttcgattgtgagagcttttgcacacgatcaagcttttgcacactatcaagcttttgcacaccatcacatcaatgtaaacagtgtattcctttgcggatatatatccgtcaggctggatgcagtctataagaggagattgcatcactccaacgcatgtgaagcccaaacagacaagggtcgtgtgggtttcactatccttttgtttaccatgttgaagtctgtttttgttattcagcgacataacagctattcacaagattatcttgttcagaacaagtgtagcagttgaattcctggtaggtggtttctgatgttgggttgagacttgagagaactgaacattgtgtaggtataaataaaggccaacagagcaatgctgttgtcttagtacttgtatcaaaggtcattcagtcgttgcaaatttcgaccaaataaagggatgaaatgaaagcttggaaaaaaaaaaaaaaaacatccat

SEQ ID NO: 7579 - DNA, 2157 bp, Zea mays
gctatccccgtgtcctccaggtccaactccacccaaccccaccccgtcccgtgatcgtttgcccgtccctatcgttctctctcccccccctttttcctgcgaccaatccgcgcgctttagtttttgttcctgctcctcgcaccgcgcgccgccgacgccgcagccatgaacggtgacggcagcaaggaggacgccaacaggcgcctcgagtgggccaccttgaacctggagcgcggcgtcgtcgtgagcgagacgacgaagggcgacggcaatggcaatgcaggccggaaggcgccgataagcatcgtccggctcttcttggcctgcatggtctccggcggcatccagtacggctgggcgctgcagctctccctcctctcgccctactctcagactcttgggatctcgcacagctacgtgtctctgacatggatctgcgggcctatcgccggatttgtggtgcaacccatcgtgggctactacagcgaccggtgcacctcgaagatgggccggaggaggcccttcatcctcgcgggatgcatcatcatctgcctctctgtgttggtgatcgggttctcggcggacatcgggcggcgcctcggcgacaccaaggagcactgcagcacgttcaccggctcccgctggtccgccgccgccgtctacattgtcggattttggttccttgacttcgccaacaacacggtacagggaccggctcgcgcgatgatggccgacctggcagctggacagcacggccccaacgttggccaggcgatcttctccctgtggatggccctcggcagcgtgctcggatacttgtccggcgccaacgcgaaatggcacgactggctcccttggctcaaaaccgcggcgtgctgcgatgcgtgcgccaacctcaagggcgccttcttgactgcggtggtcctcattataatcagcatgtctgtcaccttgtggctcgccggcgaggagcggctcgacaaggaaagcgtcgacacctccggcggcgcgtgctccgcgttcatggatctcttcaagaccctcaagaagcttccgcctgccatgttcagcgtgctcgccgtcacggccgtcacatggctctcgtggttccccttcttccagtacaacaccgactggatgggccgggagatcttccacggcgagccgcagggcgcgggcggaaaggcggacctgtacgaagccggcgtccgcgagggcgccatcggcctcctattctgctccgtcgcgctcggtgtcacctccttcttcatccccaggctgtgccggaagctcacgtcccgggtcgtctggtccgtcagcagcctgatggtgttcgtcctcatgacggccatggtcgtcctcggcatggtctccatgaagggctacaggccctcgctcgccgcctccctctctggccccgaccactcgttcaagggcggcgccctcgccatcttcgcgctcatcggcatccctcaggccgtgctctacagcgtgccttgggccgtggcgtctgaggttgccaccgaggacggcggtggtcaaggtctcaccattggcgtcctcaacattgcaatcgtccttccacagctggtgatcgcgctgggcgcaggccccatcgacggcgccttcaacaaaggaaacaccccggccttcggcatcggcgccgccttcgcccttatctgcgcggtcctggcgctcatcctcctcccaaagacgagaggcgtctccaacgccaccgtcatggccggcgggcactgatctattatctatctccaggcaggcttgtcgcagcggctgaccggctgagagtagatcagaaattcagaatctgcttcttggtttcagccccacccgattaaggaggtgtttgattcatccggaagtccagggttttagatgccgattaagactataattataaagctaattgataagccatggttaattcgcgagacgattgtattaagtctaattagttcataattagcacatttttagtatcgcaaaatatgagcaaatcatgtattaatagattcgtctcgcgaattatacaattagttttataattagcatgtgtttagtcgtcctaaaaaaaaaaaaaaaaaaaaaaaaaaaaaaaaaaaaaaaaaaaaaaaaaaaaaaaaaaaaaaaaaaaaa

SEQ ID NO: 7580 - DNA, 1304 bp, Zea mays
gcacgaggatggatcctcgagaaacaatgggacgctgcatggattctagtaaagggttgggttttactgaggttgcaaaagcccgtgcgagtacaaacaaagttgtttgttgccatttctcattggatgggaaacttcttgccaccggagggcatgataaaaaggtcgttttatggtttacagatgtgctaaaacgtaaatccgcattagaagagcactcttccctaattacagatgtccgattcagccctggcatgacccgccttgccacatcttcctttgacaaaaccgtgcgggtttgggacgctgacaatccagattattcgctccgcacttttacaggtcattcagcatctgtcatgtcacttgattttcatccgaacaaagaagacatcgtttgttcgtgtgatagtgatggtgaagtgcggtgttggagcataaataatggtagttgtgtgacctgcgttagggttttcaatggaggagctactcggttaagatttcaacctcgccagggtaaatatctggcagctgcctcagaaaagggaatatccatactggatgcggagacattacaagtttgtagaactcctttgcagggccacgtacagattattcagtcagtatgttgggatgccgcgggcaactatctggcgtctgtcagtgaagattctgtcagggtgtggtcatttacctcagggaactacatcgaatgcatacatgagctgatctgcagcgggaacaagttccattcgtgtgtttttcacccaaattacccgaatttgcttataatcggttgttatgagtccctagagctttgggacattagggagaagaacacggtgacaatcagcaacgctcatgacggcatggttgctgccctagccgcgtcaagtgcatcggggctggttgcatcagtgagtcatgatcagctcgttaagctctggaggtgacactgaagacagcaacgcttgtctgtgtgtcattctcatttccagtgtcgtggcaaaagcgaaagggcagctgatctgatctcctagattgatttgcgactgtggcatgcgcaaactattcaaatagttgtcagtaatgtgcttcccttatttctttgtttgtttatccatgccgggtgatactttgttacaattcatctatttagagaactgctattataatttgacctcccacttaggccttgtttggctactctagtattcattccaatccatgtgtattgaagtgggttagggtgtaaattagtttaatttatacacaattcaactcaaaaaaaaaaaaaaaaaaaa

SEQ ID NO: 7581 - DNA, 878 bp, Zea mays
  misc_feature (851)..(851): n is a, c, g, or t
gcatcatataaaaggcgagctggcttgggacccggccggtccggggaggacctctctgtaagaatcaatacctaccccatggagaagctctcttctcgtcgctattcccggccggcgatgtccctgctgatcatcgtggccatcgctatctcctgctccgtcgtccacagttcggaggctccagcccaagaagcagcagtacctcctctggacggagaccatcagggccaagcgccgccgacaccggatgccggcaaaccgcgacagccacagccgccgtgctgtcttcggcacggcgcttaacgtcctaaaatggaccagagaggatggaggatactttgagatcaacctaggccgcgacgaccatatgtttttaaattttattaggactagtctgaaaactctatttttctaatggatttccatttttccaaaaaaatgtgtttccaaagtagtctttaataatacaaacataagagaacccgtacaccatccgtgtcaaattataagtcatatatatataggtcggggtgcataactgagataatttggttcatgtatcatttgtagtcctacgagttcatccgtgtgtttggtttctcaaggtaacaccactaccacccatatataatcgttgtaaggccccgtgttgctttaactataactagtataatgatgtgtaaagcgacggcacccaaacatacttgatacttataaaaaataaatttagtattaaagtagacatatgctccatacataagatattaaactaataaaacaaatattacactttatcttagtcaaagacccagaaagtatgagttgaaaatatagatagccaaatgggccgncgacacgccactagcactaacactatt

SEQ ID NO: 7582 - DNA, 2563 bp, Zea mays
gttcgattcctgatcagctcatcaataaatctaaggttcgattcctgatcagctacagtttttttttttcttcgcgtgaaacggggagggcagaacgacgtaacacggccaggtctggttcgggttcgcccgtccgtcctcgcgtcgcccgccacccaccctcccctatttttcctccgctctttgaacgctttcccccgctttcgccggacaccccggccccgcttcttgtcctcttcgctgggtgtcccctcccctccacgagtccccgttaacgcacggggcccagcaggaaccggggtccacctgtcagccaggcaccggtagtgcgggacggggcagccaccaagcgtcgagatccgtccgggctccatccaaaatatctgcgtccacggacccacctatcagtggcgcgttcgatgggggcgggccattgagcgggaggacggagacacgcgcggaatctgtcaagcgggccccgctaacagcggggcaatgacaatgccgcgcgtatggcttccgtcgacagcgcgggcgagagcgagcggtggttctgcttcctctccactcgctcactccactccactccacagtggcacagacgcacagtctcgcactctcgctcagagtcagatcacgcccctcccctccatttctctcctccctataatgcggcttgggttcctaggagtccgcccgccactacccccagccgggccagcccccccaagccaagcagaatcctcgccccgcaatgcagcacctggccgccgtgctcctcgtcctggcggctaccaccgcgctgccgcccggcgcggcggcgtggcgcccgtggccgccgcgcgacaacgcgacggctgcggcgggccttggcgcgtccaagaggctggagggctcgtcggagttcgtgaagctggagtaccacatgggcccggtcctggcgtcggccatcacggtgcacccgatctggtacgggccctggccggcggcgcagaagcgcacgatccgcgcgttcctccgctccctgtcgccttctgccgccatcccttcgccgtccgtgtcggcgtggtggcgcacggtgcggctgtacgcggaccagacctcggccaacgtgtcggcgtcggtgtcgctgggcgcggagaagtcggacgcgcgcatgtcccgcggcgcgcggctgtcgcgcatggacatccaggcagtggtccgcgacgccgtgacggcgcgcacccggcccctgcccgtggacgccagcggcggcgtgtacctggtgctcacgtccccggacgtcgccgtggacgacttctgcgggcaggtgtgcggcttccactacttcaccttcgcgtcggtggtcgggtccacgctgccgtacgcgtgggtgggcaactcggcgcgcaggtgccccgaggtgtgcgcgtacccgttcgcggtcccggcgtacgtgcgcgggcgcaggcccgagtccccgcccaacggcgacgtcggggtggacggcatggtcagcgtcatcgcgcacgagctcgcggagatggcgtccaacccgctcgccaacgcctggtacgccggcggcgacccgtcgttccccacggagatcgcagacctctgcgagggcatctacggcaccggcgggggaggggcgtacacggggcagctgctcacggacgcgcgctccggcgcggcctacaacgtgaacggcgtcggcgggcgcaggttcctcgtgcagtgggtgtggaaccccgtgctcagctactgctccggccccaacgcgctcgaccagtagctgtttggtttcggtttcgtttcatctcctactaggatggaatggaatgggattttactacgtaccaatgaatcgaatcctctagcgcatttggattttcctctcctctcctctcctctccccggggaaatccatgggatgcttctgtatagagttgttattatcaattaattaatgccactttcggtggaaggaaaaggaacatgtctgtaacctgcagagctggctgggttaaaaccgtcagggtttaccatccattggctggctttactagcaggtgcagtacacagagtggtgggcttcttctctcaaatgatgatggcgctaacacagcaagcattttagcaggacagtgcgtaccatgcttcggagggagtagcacagcacagtgcagtgtgcagagcagaaaaggacaagggccggagtgcactgtgcagcctgcagcgcgcaatgattccccgggactcggactgggtgagggcggtttgtagtgactgcgctggggtggtaggcgtgtcagctaggcgtccccccttccctgtggcagtgcagtgcgtcttcgtggtgtgggtcaccgcggccggcacgaattatttgattgactgttgttaattggcctccgacagaaacagtcccgagggaagactattgttcttgctctcccgcctgcttccaaccacctccattctagtgcctccaaccaccaatttgtttgattgactgttgttaaaaccgtctggaatcaagtcatcgccgtattaagaatccgtcactttttagatcgtg

SEQ ID NO: 7583 - DNA, 1324 bp, Zea mays
atcacgcccctcccctccatttctctcctccctataaagcggcgtcccgaggcaagaatccagcctccactacccccagccgggccagcccccccaagccaagcagaatcctcgccccgcaatgcagcacctggccgccgtgctcctcgtcctggcggctaccaccgcgctgccgcccggcgcggcggcgtggcgcccgtggccgccgcgcgacaacgcgacggctgcggcgggccttggcgcgtccaaggggctggagggctcgtcggagttcgtgaagctggagtaccacatgggcccggtcctggcgtcggccatcacggtgcacccgatctggtacgggccctggccggcggcgcaggaagcgcacgatccgcgcgttcctccgctccctgtcgccttctgccgccatcccttcgccgtccgtgtcggcgtggtggcgcacggtgcggctgtaccgcggaccagacctcggccaacgtgtcggcgtcggtgtcgctgggcgcggagaagtcggacgcgcgcatgtcccgcggcgcgcggctgtcgcgcatggacatccaggcagtggtccgcgacgccgtgacggcgcgcacccggcccctgcccgtggacgccagcggcggcgtgtacctggtgctcacgtccccggacgtcgccgtggacgacttctgcgggcaggtgtgcggcttccactacttcaccttcgcgtcggtggtcgggtccacgctgccgtacgcgtgggtgggcaactcggcgcgcaggtgccccgaggtgtgcgcgtacccgttcgcggtcccggcgtacgtgcgcgggcgcaggcccgagtccccgcccaacggcgacgtcggggtggacggcatggtcagcgtcatcgcgcacgagctcgcggagatggcgtccaacccgctcgccaacgcctggtacgccggcggcgacccgtcgttccccacggagatcgcagacctctgcgagggcatctacggcaccggcgggggaggggcgtacacggggcagctgctcacggacgcgcgctccggcgcggcctacaacgtgaacggcgtcggcgggcgcaggttcctcgtgcagtgggtgtggaaccccgtgctcagctactgctccggccccaacgcgctcgaccagtagctgtttgatttcggtttcgtttcatttcgtttcatctacgtaccaatgaatcgaatcctctagcgcatttggattttcctctcctctccccggggaaatccatgggatgcttctgtatagagttgttattatcaattaattaatgccactttcggtggaaggaaaaacaaaaaaacaa

SEQ ID NO: 7584 - DNA, 1320 bp, Zea mays
agggcgaatgggatcctcgaggccggccgggagaaccagagcgacagaagtaccagtcctgttcagagatgatgggtttcagctgccaacaccgttccgcctccctgcgcatcttcctcgtctccgtcgtcctcctgctcaccgctcctgcggggcgttgccattgctacaagcgcatcttcagcttcggcgactctatcatcgacacgggcaacttcgcgcgcagcggcccgataatggagtacccatttggcatgacctacttccaccaccctaccggccgcatcagcgacggccgtgtcctcgtcgatttctacgctcaagcgctccagctgccgctgataccaccaaatctgccggagaaggacacggggctattcccgacaggcgcaaacttcgctgtgtatggctccacggcgatgcccccggagtactaccgcaggtggaaccacgacgtgcgggcctgttacctgggcgtgcagatgggatggttcaaacaaatgctgcaacgaattgctccctgggatggcgccaagaggcagatcctgagcgagtctctcatcgtgctgggcgagatcggcggcaacgactacaacttttggttcgctgcccgtaggccccgcgagcaagccggccagttcatcccagacatcgtcgcgaccattggctctgctgcccaggagctcatcggcatgggcgcgaaggcgatcctgatcccgaacaacttccctatcggctgcgtaccgacatacctgagcgggtacaggagcggcaaccgcgcggactacgacgagcacgggtgcctccggtggttcaacgacttctcccagaggcacaaccgggcgctgcgcggcgaggtcgaccggctcagggcgcagcaccccggcgtgaagctcatctacgccgactactacggtgccgccatggagttcgtcaaggacccgcacaggttcggcatcggtgaccccctcacggcgtgctgcggtggcgatgaccagccgtaccacatcaacaggccgtgcaacagagcggccaggctctggggcaaaccgagcggcttcgccagctgggacggcatgcacatgactgagaaggcgtaccaagtcatctcccatggggtgctcaacgggccgttcgccgacccgccatttgctaaatggagctgctagctgttagttttggtggtaacggtgaaaggggattggtttgttctcttagctgagagctcacagcatcttcaatagactttttttaaattcatcgctctctaaatcatcatgtaaagaatcatttaaataaaaattactttctataccttct

SEQ ID NO: 7585 - DNA, 2969 bp, Zea mays
cctgagcaggacttggtggcgtagatcttgaggaggaggacgaggaccgagaagaggtgggtcatgtccccgaggaacctgaaggcgttcatggctgcggctccggcggtggtgacgccggtggcgcagaggttaggacggagggtttgggggtttagaacaacagctccagatgcgcacagaaatggcggagaggatcagaggagaggtgggcaggacaccaggacaggaagaaacgagaagggaggtggcaccctcgtgagccggtgtggacagagtctgcagagtgggaaccacatgccagtgaccctatggaccagtgaagttggtgcactgcagcaagagagatccagaggggggtgtgcgagcgaccggcgacgcgtgtgcctcggtgcggactccctgtcggtcccacgtgtcggttaaaaatggcgaggtgtgggcgccgtgaagttggtgtaggtggggttatgtggggcagcgagcagaggtgacgtggctgggcaactcacctgcgcggtgacagcacctcgccggcttttcttccctcaggcttgcactttgcacagcctctcacatcacatgccgctgatgcttcgcgtctcctactccttcctgcttccacctattaatccaccccactctcttccctccccgttccacccgcctctaccgccgcgagatccggctccgcttccagaagcttctggaacgcccgttccatgagcgtctgatcggccgccgccatgggctgcgctggatccacccccaaagtcgacggtatcttcttgatgcttccgttctcgatacgtttgctttggctgcgtgctgttaggtgctaagatccgatttgagccgttccaaggcacagttagtaggattaatcgcgtgtactttactcttctcggttgtctatgcaagtgacgctaaatcccatcccgtaacttttaaggcatcagttaacgagtcataaaagaattcagttgccgaagtgttgatcaggaggaaatttagcaaattgtctctgacggatggttggattgttttcacaaactactgctttatcaaatttgtcacaagctattagtaattgtccaatttggtgtgattgtccaatttggtacggctatcagttgtaattgtccaattctggtgcggctatcagtatagtggagtcagtagtggtagaaattcttgcatcccgaagttagtattcggttagtggaaggataccattatcatagcaaaaaaaaaaagtgcccaagtgtcaatgtaatgcgactataacaaagcgttggaacctttctctaaaaaaaagttgtccaaaggatggctatattttctagcaggacaaaagctattttattttacgtaataaaaagcaaaggtaagcgatagcaatgacggttcatgcttaccataggacgaaagaacctttttttacggattgagcacatttgcggttttgatagctagtcccttatctagtttaaagcactttactagaaaatgatactctctgcaagttcttattctcaattggaaatctgcataataaatttttcgtttgttgtgctttcctaacttcagcaacaccaaattgcgcgttcaattaatggtagcttttgctcacagtctacatagataatttagcggacactaatcattttccatgttctgcaaagagtcatccatccataatcttgtttgtgaattgtggtcttgccgccaactaaagaaaaaaaaatattgcatccttcagttaccaacagttcgtgaatcatgattccttctcgactacctctatatgctagcaccatggggtatctttgataactcactattgggggggttattagcatttagcagtactctctgataactctatgcctttggacctggtatccgatggatgaacgttaaaatacattttttttcatgaatacagagaacagcaagaaactgaaaaggcctaaggcttggaagcatacccaaccaattacaccggcacggctgaaacagatgcgtgatgagttctgggacacggctccgcactacggaggccaaaaaggtacaggttttagctgtttgtgccaagttgaacagaaccagttcttgtgcgggtgtgtgtgtgcgcgcgcgcgcgcgcttcatggtcctcgcgacgttggttggtttcgtcatctcttatgtttcgatatagtttcatgatagtaactggtcggtgcttgttttgacctgtccaatcattatccttaaaaattaggagtttaactatgagacgtactgctaattagcgtacatcagtgttgtaacgagtcaccgcctcgctgtccagagatctgggatgctctgagggttgccgcggagtccgatctagcccttgcacagaccatcgtggacagtgctggaatcatcgtgtcgaaccctgacatgacgctctgctacgacgagagaggtgagcaaggacttgctaccccccattttcacgactctctttaccgtcctgttgtgcatgcaagaccaatgtcgaaaactgaagactccgttgcaggcgccaagtacgagctgcccaagtatgtcttgagcgagccagcgaacctgatccgcgacgggtgattctggaccccaaaaggttttgcagcagcacgaaacagggccacgtgaatttatgcggatggttgattcggtcgctggttctggattgtaactttcagggacagtgaaagctcgtttcagcgctggatgttgtatagtgatgttattggacacgatgtgtagtctctagacctgctactgctgaactcggtcattcagggacagtgaatgcagtgtcgtttaggctatatgctgcagacttattcacctcatatttcagacttcagacttaactgtatctatataaatagtgcagtttgcactcatatttcaaacttcagacttcagtaaaaaaaaaaaaaaaaaaaaaa

SEQ ID NO: 7586 - DNA, 922 bp, Zea mays
cattggctgcctcgaggccggccgggccggtcggacatcacatgccgctgatgcttcgcgtctcctactccttcctgcttccacctattaatccaccccactctcttccctccccgttccacccgcctctaccgccgcgagatccggctccgcttccagaagcttctggaacgcccgttccatgagcgtctgatcggccgccgccatgggctgcgctggatccacccccaaagtcgacgagaacagcaagaaactgaaaaggcctaaggcttggaagcatacccaaccaattacaccggcacggctgaaacagatgcgtgatgagttctgggacacggctccgcactacggaggccaaaaagagatctgggatgctctgagggttgccgcggagtccgatctagcccttgcacagaccatcgtggacagtgctggaatcatcgtgtcgaaccctgacatgacgctctgctacgacgagagaggcgccaagtacgagctgcccaagtatgtcttgagcgagccagcgaacctgatccgcgacgggtgattctggaccccaaaaggttttgcagcagcacgaaacagggccacgtgaatttatgcggatggttgattcggtcgctggttctggattgtaactttcagggacagtgaaagctcgtttcagcgctggatgttgtatagtgatgttattggacacgatgtgtagtctctagacctgctactgctgaactcggtcattcagggacagtgaatgcagtgtcgtttaggctatatgctgcagacttattcacctcatatttcagacttcagacttaactgtatctatataaatagtgcagtttgcactcatatttcaaacttcagacttcactgtaacaaaaaaaaaaaaaaaatttgcaatgcaaaaaaaaaaaaaaaa

SEQ ID NO: 7587 - DNA, 932 bp, Zea mays
  misc_feature (13)..(13): n is a, c, g, or t
ggcagcgagcagnagtgacgtggctgggcaactcacctgcgcggtgacagcacctcgccggcttttcttccctccctcgaggcttgcactttgcacggccgggcctcacttcacatgccgctgatgcttcgcgtctcctactccttcctgcttccacctattaatccaccccactctcttccctccccgttccacccgcctctaccgccgcgagatccggctccgcttccagaagcttctggaacgcccgttccatgagcgtctgatcggccgccgccatgggctgcgctggatccacccccaaagtcgacgagaacagcaagaaactgaaaaggcctaaggcttggaagcatacccaaccaattacaccggcacggctcaaacagatgcgtgatgagttctgggacacggctccgcactacggaggccaaaaagagatctgggatgctctgagggttgctgcagagtccgatctagcccttgcgcaaaccatcgtggacagtgctggaatcatcgtctcgaaccctgacatgacgctctgctacgacgagagaggcgccaagtacgagctgcccaagtatgtcttgagcgagccagcgaacctgatccgcgacgggtgattctggacccccagaaggttttgcagcacgagacagggccacgtgaatttatgtggatgggttctggatttgtaactttcagggacagtgaaagcttgtttcagcgctggatgttgtatagtgatgttattggacacgatgtgtagtctctagacctgctactgctgaactcggtcattcagggacagtgaatgcagtgtcgtttaggctatatgctgcaggcctgcagcctcctctcttatttcagactccactatatctatataaacagtacagtttgcaatgcaaaacaaagtatgttcaggcggcccc

SEQ ID NO: 7588 - DNA, 2027 bp, Zea mays
gcacgagaccattacctagaacgtcctaagcggaagaatttccgagcgatttcctcgtcatttctctcatccgctgcgctccctctcccactcggcgaagaaggggggggaaaagctcgaaagcgggagccggcgagcgagatgggcgcagggagcagccgcgcggacgcgccgtcgcggcgccgggcgcgcctcagcctcggcgggtgcttcggggccggatcctcctcgtccgcgcacgacggcgggagcttcgccgctgccgggccctcctcctcgcgcgccatcgaggtacaatcacgacagtcagggcgacaagtgagtgccctgaattttcaggcttctctagctgctaaggatctccaggtttccagtgagtcaaatccaaggctgcattcgtcttcaagcaccataagccatcatctcagattcaatcacctcaattaccatgaaaacaaggaagatggcctggggtctgaaaacgctgaaacaagtggtcttcaaagctcatctaggaaacctgtcatggtaaggggaagtctcattaatgaagctgttgatggtgacatatcaggagaaggaataagttctgtaggatcagagctggaaaatgttcctagcacagtctccactaatgaaattggtggctcaacttctgaatctggtttgggcccctcatcgatgacatctgaaaggatcatgtctgactcagaagtagagatatctccgcaagggacctcatccacaactgtcatgacaagtgaaagatcagatgcatctcaatctagcttaacatctgtgttttctaactcttcaactgcatcatctgtgatcgtggaaccaatgccagacccaatccctacaacggcagatgtccccatattcagtgggccacatggtgaagctggagggagtatattacatgacgacatgatgagcattttctcaaatgacggtgtaggacgctctatagattcaagcagcagtgaaacaaggaggagtcacagaaggatcctgtgggatgcattttccaggcgtggctcaagaggttatccagaatctgatgctgatgaagtgggattttttagtacatggctagaccttggtgatgatatttttgaagagttgggggaatcaagatattttcatcgcaggcgacatggttcaatcagagtaagccagtattcaagatcccggattagggagcatcgccgtgctgtttttgatagtggtaatgaacaaaacactgctgcatgtcctttggggattcatcaaattggccgatgcacctgtaattctttctttattgctgaagaatctagcgcccgagcaagtatatcaagaattgtcatgttaactgaggcgctatttgaggtgttggatgaaattcaccgtcaacctgcatcactttcactttccatggtgtctgttcaggctcctgaatctgtagttgattcgttgccatgtgccatatctgcctaaccgaatatgaggacggagaccagataagaacccttccgtgcaagcacgagttccacctgcaatgcgttgacaagtggctgaaagaaatacacagggtgtgccctctgtgccgtggagacgtctgcgaagtcgcctcgtgaagaccttggcgctgccatccttccgatgtggcgccggtggatagggcaccaccgccaggcgccagctgttccgtggttgaagctggttcggtcaggcaatggtgatcttgtcaacttggacagttgacaccgcaagagcacgtcaactttgactgtctccctgccgaagagaatggccaaaccaaccctgcgaccgatgagtcgctgttcctgtcatcaacttttaagataccgagactttgtatacagtagcttttgtagcctcccgcctcgtgtatgacagcctgtacatatttgtaaattctggaatcaaatgtcacaatcccctgttctcaaaaaaaaaaaaaaaaaaggcccctatcggtgctgatggagccgggaacagagatgtgctgatggagatgg

SEQ ID NO: 7589 - DNA, 1916 bp, Zea mays
  misc_feature (1914)..(1914): n is a, c, g, or t
ccggccggggacgtcccggcccggccccgcacgcacggcacttcccagcgatttcctcgtcctctctctctctctctctctcgcgctccctctccctcgcgaccctcgaggccggccggaaagcaatcgcaagcgcgagccggcgagcgagatgggcgccgggagcagccgcgcggacgcgccgtcgcggcgccgggcgcgcctcggcctcggagggtgcttcgggacccgatcctcctcctccccagccgccgccgccgaagcgcacgacggcgggagcttcaccttggccgggtcctcctcctccagcgctatcgaggtacaatcagggcgaccagtacgtgccctgaattttcaggcttctctagctgctaaggatctccagatttccaccgcgtcaagtccaaggctgcattccccttcaagtaccataagccatcacctcagattcaatcacctcaattgccatgaaaacaaggaagatggcctggggactgaaaatgctgaaacaagtggccttgaaagctcatctaggaaggctgtcatggttaggggaagtttcagtaatgaagctgttaatagtgatatgtcaggagaagggataagttttataggatcagagctggaaaatattcctagcacagtctccactaatgaaactggtggctcagccgctgaatctggtttgggcccctcattgatggcatctgaaaggatcatgtctgacttagaaggagaggtatctccgcaagggacctcatccacaactgccatgacaagtgaaagatcagatgtatctcaagctagcttaacatctatgtttcctaactcttcaactgcatcatctgtgattgtggaaccaatgccagatccaatctctaccagggcagatgtccccatattcagtgggccacatggtgagactggaggggccctccgtgctcgtccgcgtgatgagcattttctcaaatgacggtctaggacgctctagcgattctagcagcagtgaaacaaggaggagtcacagaaggattctatgggacacgttttccaggcgtggctcaagaggttatccagaatttgatgctgatgacctcggattttacagcacatggctagaccttggtgatgacatttttgaagagttgggggaatcaagatattttcatcgcaggcgacatggttcgatcagagtaagccagtattcaagatcccggattagggagcatcgccgtgctgtttttgatagtggtaatgaacaaggcactgctgcatgtcctttggggattcatcaaactggccgatgcacatgtgattctttcttggttgctgaagaatctagtgcccgagcaagtatatcaagaattgtcatgttaactgaagcgttatttgaggtgttggatgaaattcaccgtcaacctgcatcactttcactttccatggtctctgttcaggctcctgaatctgtagtcaattcgttgccgtgcaagagctacaaaaagcttgaggcaccccaacgcagtgatgatatggaacagtgccatatctgcctaactgaatatgaggatggagaccagataagaactcttccttgcaagcacgagttccacctgcaatgtgttgacaaatggctgaaagaaatacacagggtgtgccctctgtgccgcggagacgtctgcgaagtcgcctcgtgaagaccttggcgctgccatcccttcctcacggcaccggcagatagcgcatccttcctgccatcaactttttaagataccgagactgtatatagctcttgtagcctctccgtgtatgacaacctgtaatatatgtaatttctagattccaatgtcccattattctgtcctacattcagatcttattctcgcagccctgatgctcaaactagctttaccagantc

SEQ ID NO: 7590 - DNA, 2339 bp, Zea mays
ataggaacacacgaatacgcgaccacacgttcacctcggccatgatccaccaacacagcagctccctccccgacatcgcgggccgctcttccatgaatttccacacggccagcttctgcgcttccgcggcgataggcctcccaacagcccccaaaatatcggcttcgttggctactggtcgctttgcctgccgcagtgagagatgtctggagacctggaccttcagatctcctgctatctgccttcttgctgctacccccacacgctgcaccctcacagacaccatggatccgagctccgacatcatactcgacactccgttcttccgcatctacagcgaccgccgcatcgaccgcttggtcggcaccgataccgtgccggccggctttgatcccgccaccggcgtcacctccaaagatgtcgttttagacagcaactccggcctctacgttcgcctgtacctcccggacacggctaccgggtctgaccactactccaagaaattccccgtgctagtctacttccacggcggcggctttgtcacccactcggcagcgtctccgccctatcagcccttcctcaacacccttgccgcgaaggccggcttgctcatcgtctccgtgaactaccgcctcgcgccagagcacccgcttccggcaggttacgaggactccttccgcgcgctcaagtgggcggcctctggaagcggggacccctggctatcacatcacggcgacctgggccgcatcttcctggccggggacagctccggcgggaactttgtccacaacgtcgctatgatggccgccgcgtcagagttgcaaatcgagggcgcggtcctcctgcacgccgggttcgctggcaagcagcgcatcgacggagagaaaccagagtcagtggcgctgacgcagaagctgtgggggatcgtgtgccccgaggcgacggacggcgtggacgacccgcggatgaaccccttggccgccgcggcgcccagcctgcgaaacctgccgtgcgagagggtgctcgtctgcgcggcagagctggactcgctgcgggcgaggaacagggcgtactacgacgccctcgcggcaagcgggtggggtggcacggtggagtggctcgagtctaagggcaagcagcacgccttcttcctctacgactccggctgcggcgaggccgtggagctcatggatcgactggtcgcgttctttgctgggaacttgaattcgtcatgtgtggatgtgaccacacatcacacgaccacatccggtgagaccctgagatgaatggaacaaacgaagatgcagctcattgctcaatcgaaataactgagctcagtcctcaaaacaatgaaaaaagaggaagaacagctgagatcggatccttgtactgatcagtttatgttatcgcttgggtcatcaatttctactagttgtgtgcccgtgcgttgcaacggaaacatataataccattgatagcttatgtacgttgggatgaacatcgacatatatctgaccggatcttcttcttccttggggatctggagaaaagcctgttcgaaagccaaacatgttaagacctgtaaaaaaaaaaaaaaaatgtctctaatcatcatcaacacactgttcaacgcttgtaggagtcttattaatttgcatgcctcgtgcatagtctctcaaccatcaattcactatggtatacagaatccgtgtgacagatattatcaaattcacataaattattttaaagagtcaatatagagttttatatgatagagaaatacatgtggattaaaaaacgcttaaacataagaatctaaaatataacagttcgatcaagttgcataagatgtacaatttttccaactgcttctgcatttgagaagtccacctttctatgttatctttgctatttctgacttaatagaatccaaatagtattgaacactaagtaaaaatacaaaacgagatggagttgtgttgactgaaaaacatatgtatgtagcatttggaataaaaatatacactttaagtattcaagcaccagataatgccagacaagggattaatgccacacagcaaagtataaaatccatgactagatatttcataaattattaatcgttatttttgcataaatttagaatttttatcgtttaaatgtgggagaggagagagaggtgaatggtattgttgccataagatatataagaaatatgggtctgtacccagaacataaactccaattaattagcgtattcttgccccctcaagttaaaataatgcatcaatagtaccacaacaatacaaatccgatgtgcatactacataacaagaatg

SEQ ID NO: 7591 - DNA, 4433 bp, Zea mays
  misc_feature (4388)..(4388): n is a, c, g, or t
  misc_feature (4415)..(4415): n is a, c, g, or t
ctgcagctgcgacgacgatgatgaatagtgagcgagctagagtggctagggcttgcacagaggatccagagacgggagagaagcgcactattggcgaataaatttgcctcgtgttttattattatctgaacaacaggtacgaaaaagttgcattgtgatgaataatggtttctcgttcacaatgtctaaacttatgatgatttctgccctcggtgtgctaccgctgtgttaaatgagctcgagttggcaacaactgctgggccactgttgagctttagaactcggttataaaaagaaaagaagaattccagtaacttttgggggcatctttgttttatatggcccctggtggttaactatgcccacccctatctctatcttcgatccctgctcgcctaggggacccctccctgatctcattcccagagcgaggacatcacagaagctgccatggaaatttcacaggcgtgctgctctccgtgccaaccagaccggccctggcccacgtgtccgcctgcatttcttgcagatccggcagcttgcgtgccgttcgaaacggtcgatggatagataggtggtggatcgtcacgacggcaggaacggatcgccgctctgtgccccccggcctcgtgacttcatgccgtcccaacccaacgctgcacagcaccggtagcggttgccggtcaatgcgacgcgacccaaacaggtgcagtgcaggagaggtgctacgcacgaacacggctacgctacgctagcagcgagagggagggaggccgccgtatctagcgcacggtgcacgtacactgcgctcagcgagaatcgaccacgtcatctctttttttcttctaactctgcaaagtcaacgcggttatatgataacaagcctcttaaactatctactatactagggtccggatccatcaacaccaaggaaagaggagaaccagcagaaaacaagaaggtaaaaacaccgacaaaaccaaaccaggcccccttcccaaccctaattaaaaaaaaaggtaggagggggagtcgatctcaattctcaacacatcaacgaacatcagcacgaattgtttgtttcgtctgacctcagcagagtggcccacactcgcgcaggtcacaggtcagggcggcgctccgctgctaacccacaccacacctaaacgctgccaatctctagtccctaattgtatcccccgctggggcttctcacacaaagcttcccttccctctccccttccaacctgcacagcaactgcaagtacttggagagccaggactagtccactagtgctctttcttttgttgcgtcgccatccactccaccacaccaccacctgcccccgaccaccgaaaaaaggtccaagaattcgaggacacctcctcctcttcctcctccacgatggccatgccaagatccttccccaaatcgtagcctttgtttgttcccccaaaaggaaggatttcattccttcccgttccatcgttccgatttgccgtcaagcaaatgcgaagcgtctcccctgtgatcttctttcaccttggcgagctgtgcgactgactggttgatccaggctgtatatacatagggttaattaatgagcggcgccaattcttcgttgccgatgcctccgccgccgccgccaccggcgcccgctgcgtcggcgctcgacaacgtggaggccaagataagccccagcatcgtcttcgtcgtggccatcctggcgatcgtcttcttcgtctgcggcctgctgcacctgctggtgcgccacctgctgcggctgcggcgccggcgccgccgcgcgcgggaggacgcggacagcgtcacggcgttccagggccagctgcagcagctcttccacctgcacgacgccggcgtggaccaggccttcatcgacgcgctcccggtcttcctctaccgcaacgtcgtcggggccgcgccgggcggcaaggacccgttcgactgcgccgtctgcctgtgcgagttctcgcccgacgaccagctccgcctgctgcccaagtgcagccacgcgttccacctcgagtgcatcgacacgtggctgctgtcccactccacctgcccgctctgccgccggagcctcctcgccgacctctcgcccacgtgcagccccgtcgtgatggtgctcgagtccgagagcgcccgcgacatggccgcgtccgcggctcgggccaccgacgccgagcccagcgccggggccggggccacgctgccgcggggccaaggagcggacgaggtggtcgaggtgaagctggggaagttcatgtgcgtcgaaggcagcaccgccaacgccaacgccaaggcggcggacggagcaggcaccagcggcgacggcgacgtcgacgccagtgccaaggaaggtctcggtctcgggcagagacggtgccactccatggggtcctacgagtacgtcatggacgaccgcgcctcgctccgcgtggcgatcaagccgcccaagaagaagcccgcggcctccaagtcgcgccgccgcggcgccatctcggagtgcgagttcggcgcgtccaagcgcggggagacctcgctccgcctgccattcccagcaacggcgcacaagcagcagcagcaggccgacgcgaccatggcgaagctcgccaaggacagcttctccgtgtcgaagacctggatggtgccgccgaccaagaaggatcccgccggcgagaggcgcgccgtgtcgttccggtggccggtgagcggcagggacgagggagaaggcaaggacaggaggagcgggagcgaggctgagtgggacgtggaggccgggagctgcggcagcgtgtcgtcgctggcggaggagaggccgtccttcgcgcggaggaccctgctctgggtcgtcggaggccggcagcagagccgagtcgggagctgttcgtgatcagcagcgcacggttgctcgaagattaaaaaaaagaaagcagagaaattcttttgtgctctttcggcagattggtagtagcgagtagcggttgcaatagctagagatttgcagaacccgaaagctctgaaaaattctttctttcttcctgcttcgtttgaaaacaagtggcaatggcgagcagcggtgaactggacaaatgacgaacatctgcaggtcctaaaccgcaactaacaacagcttctgaaacagctagtgggcgttgctgctcagagattcagaaaccaacagtctgaaacagcttctgaaagaggatcgcgatgggagtccgtgttgcctgctctgcgcgcatggagaaaggcggtttggttggatcgccgcctgccctgctggttcgctggctcgcgcctcgcggtgacgggcatgtgagcgctgcgtgctgcgcgcaccggccaccagtgcgccatggcgtgctcctttgtttgctcctgcttgtaattggaattctggcagggtggctttctccttttcagaagcggcaacgcgggcgtggagtcgagtttaggaaggtggcatgcatcttaacctgacctgtaaaggagggttcggctatcaacaaaagattctctcctctgctcctctgactgctctagtcgagtatatacattttgatacgcagggtcctggatttcttctcttttttttcctggatcaaataattcaaatgtagtgcaagtagaacacactggtgattcaaatgcgtgcgatgggaatggggtcgttcagtaggagaactggtccaatcgctcaaccagtgacaatcacctcaagcgaaggatttgaacgccggtgagctgttcttccattagagcactaataccaacggaaacggtggagtccttcaggtcacaggctgttccaaacaggcagttaatgcgcttcgtactactccagtgcgcagatatggatctcggcatctcgctttcttaattattcccgcttttgaaccaaacggtggttaatgtgcgagctcgccacgcgctccaaatcaagtcaaacgcatctaaccacgtttacctctgattaaagtttttttaacagctccatgctttaataagcgatcgaaatctggatttagaggtcacatccatattcattagagtactctgtaaaatgttggatttatatgtccccacataattgagcggtaatcacccacgatccacgaataccaatacaagtcagtacaaagaaaaggcatttatactttttctcgagtgtatttcttcctcgttcgattgcggtttgccatccccatccatgccgccatctccagcggaacatgaatataacacacgcaaaacacggttttaaaccataaactgcactatttgcatagtaaattttaaaatacgggtagaacatggaggctgcgggagataactgcggtacctcatcttcggaggtgggatnctgggcacgttttggcgtcagtcggangtatgatgctctgatcga

SEQ ID NO: 7592 - DNA, 954 bp, Zea mays
ttttttttttttttttgaacgagatcaatgcaggcgagtactttactcttcaattttcatcatattataagcaccgcatcagattaaattggcaatacagaatttggccatttgctaagccatcagcatctactaattacattgactaatcttacatgctacccttttggctgcatggcacagctgctaggatgagggtggcagccagtgagaaagctgaggctgagaagatactccagatcaagaaagccgagggagaggcggaatccaagtacctggctggcgtgggtattgcaaggcagcgccaggccattgtggatgggctgagggacagtgtgctcgccttctcagagaacgttccaggcaccactgccaaggacatcatggacatggtcctggtcacccagtactttgacaccatgagggagattggggcctcctccaagtcctcttcggtgttcatcccccacggtcctggagctgtcaaggatgtctcggcgcagataagagatggcctcctgcaggctaatctgcactgagggtaccttgcagacgagggaacagcttccgaggtcaacgcagtcgagctgcgagaacatccgcgccatcacgtgtgccggggcccgcagcgccggcgccggcgcccgcatgctcctccccttgcctcggaggcgccatggccgatccgcccgccccgccgtcccggctcttgtattggagtggacaagtgggctgcagccctgcaggtgcagaaacctcgatcaattcccgaccatgccttgtgtcagtgtcaccgaggttgaagaactggacgaagcaattctttattgggattggttacgccacgaatccaattatccaaacttgattcatcgacggcggaagaagaaaaaaaatgccatctcattgtgacgcgacgagatgtccattgtttgtcagaacagaatacatgag

SEQ ID NO: 7593 - DNA, 2609 bp, Zea mays
gggtacctcgaggccggccggggattagcgttttagtttagcccctcctaaatttttttctagatccgtccctgtttgccgctgtgtttagctctcttccccgcaaggatccatcgatcggtcggacaggataagacatgggtcagattttgggtttagttcaggttgatcagtcaactgtagccatcaaagaaaattttggcaagttcagcgaggtcctggagcctggttgccacttcctgccctggtgcatagggcagcagattgctggttacctctccttgcgtgtgcgccagctggatgtccgctgcgaaacaaagacaaaggacaatgtctttgtcactgttgttgcatctgttcaatatcgcgctcttgctgataaggcatctgacgccttctacaagctgagcaacaccagggaacaaatccagtcatacgtatttgatgtcatcagagctactgttccgaagctgggcttggacgatgcatttgagcagaagaatgagatcgcaaaagcagtggaagaggagcttgaaaaggcaatgtctacttatggctatcagatcgtgcaaacgctaattgttgatattgagcctgacgaccgcgtcaagagagcaatgaacgagatcaatgcagctgctaggatgagggtggcagccagtgagaaagctgaggctgagaagatactccagatcaagaaagccgagggagaggcggaatccaagtacctggctggcgtgggtattgcaaggcagcgccaggccattgtggatgggctgagggacagtgtgctcgccttctcagagaacgttccaggcaccactgccaaggacatcatggacatggtcctggtcacccagtactttgacaccatgagggagattggggcctcctccaagtcctcttcggtgttcatcccccacggtcctggagctgtcaaggatgtctcggcgcagataagagatggcctcctgcaggctaatctgcactgagggtaccctgagaaaacgaaggattcagagggatgagggcatcggtcctatgatgctataaaattgtcaattatagactatatatgatatatagaggcaggcttgattgatttgtaaaagcatagttaagcaccgattgagctataagtgcacttgtgagtgagcctgggtatccaaacctgtcagctatttggtatgtatatgttctgcgtgcaaaatcctactgtagccatagcgttgaacaggaagaattgtaaatggatttggtgagtttatcaatcaggttactgcacaggagtaactgttccagcaggcaccgagatacccaggacaaagggccggcacgggggcattccgcattccgtcgaccatcgcacgcgcgcggggagaacagaaggcgagggagggacgactcacttgcagacgagggaacagcttccgaggtcaacgcagtcgagctgcgagaacatccgcgccatcacgtgtgccggggcccgcagcgccggcgccggcgcccgcatgctcctccccttgcctcggaggcgccatggccgatccgcccgccccgccgtcccggctcttgtattggagtggacaagtgggctgcagccctgcaggtgcagaaacctcgatcaattcccgaccatgccttgtgtcagtgtcacctaggttgaagaactggacgaagcaattctttattgggattggttacgccacgaatccaattatccaaacttgattcatcgacgacggaagaagaaaaaaaaatgccatctcattgtgacgcgacgatatgtccatttgtcagaacagaatacatgaggtgatccgtggataaaaccgctgacaaataatcgacatcatgtattcacggtttcagtgtacaggaaggaaacgaaagaagcacaatccctcgcgtgcatgttatttttttattacagaaacttaaaattttgtatataattagattaagatggaaagaatatgtttgaattttttagattttttttgaattttattaattcatgtgcaccatatatgcaacaaagactaatgtgtaccggatatgttaccaagagcgaaaagatacatggaagttaacttgaaataaaatacaatcgattacagatagaatgaattactcatccggatgtatacaatataacaaataattacaaaaataccttcagctcttacaaccagctcttacaatcagtaccacgaaggtaaaaaggattacacagcttcaaatgacgagtcgaataatccactctgataaaaaaagtactacgtatgacattattcctctatttatagtcacatgtcataatttcggtagaattacaatcatacccttaaattgagatacccactactgcccttaaaatttatccgcactcgtgagtacgcgtcatcaatactaagattttacttcgtctttgtcagtatctcaaaattgagatacccactactagggatgttcctaaacacatccgaattgtatcacaaatctaatattttagaatagatatacatagaattttaagttaatttttcggcatgttattaagaaatatatgaagtatttaaataaatttttgtataattttttatgta

SEQ ID NO: 7594 - DNA, 1124 bp, Zea mays
agtgatggtccattgggctttcctatggaaaccgaaggcttgttggtaagtgcaattaatcctgtgaagtgtcagcctaatttgtcaactgacgttgagatcaattaccgaatacaaaaggatgcccaacaagagatctcaacctccatggtttcacagtcattcggtcagtctgatatagcttttaactcaattgattctgcaatcaacgatggtgtcatgttgaatagaaattcttgcccccctgcacctccgcagagaatgcggacattcacaaaggtctacaagcgtggagctgtaggccgatccattgacataggcaggttctccggatatgaagaattgaagcatgctgtggcccgcatgtttggtatagagggccaacttgaggaccgacagagaataggatggaagttagtctacacggatcatgaggatgacgtcctacttcttggtgacgacccatgggaggagtttgtgaattgtgtgaagtgcattaggatcctatccccccaagaagtgcagcagatgagcttagatggtgatttggggaacaatgtcctctccaaccaggcttgcagcagctcagatggtgggaatgcctggaagcctcgccgcgaccagaaccctggtaacccttccatcgggttctacgaccaatttgagtgacctgatcacggaaattcgagatgagaattatagctgcaaaaagcaaccagtgtccagccatctacagaattatcgccacggaaagggtaagcagatgcaggatgctgtagacgtcttggcttttatagttgggagaggaaatgctcctcagattagggtatgttctagatatatgtgtagttttctttgttttgaaacaatttaggcaagaagaatgaaacttacctagagctgttgctgagtcgaaacatcagacaagatggttaggcaaaacctgaacttcagacagagtaggcagatctgaagataaagtattttgattgagagtattttgtaattctgtattgaactgccgctggggtttgcttgagacccatgcggcactatatgagtctctcagttcagaaaatactgaagcagatctaagaggtcctactgattattactatttgttt

SEQ ID NO: 7595 - DNA, 2954 bp, Zea mays
tgtaatgagtttatgctttactattcttcttcatcgtatttttattattttttaggtatcatttcaagaatgagttaacaaataatggcaatgtaaaatcaatacagtccctgttggtatataccaaagggaatttatgatacttcagattgctggccattctggtttcaggtgtatctagaggtctacctgactgtcggtctccatgatcaacccttgcccatctcactagtgatttttatgtatgtttagagttctcccgagtgtaatgtgagatgtaacacatttctgcaattcagtcaaacttgtgcttatatatgtgctatctcatagcatgcacgaggttgtggttgtagtagcatctgctgaacttttatttatgttgaaaagccagaatttcccatcatctagtcctaaggagaaactgaactttcctctctacactttcaaagttttaaattatgtgttggcgctgaaactgttaaagtccagggcaccggtatataaatgtaaaatttcctgctggctggtcctatatgggagatgctggacggacgcccaccacaatctctaggtgcgggctattgtgatcaagatctagagagctgcgttcgattcagttgcttctatgctgttcaggctgctactttggatcgggactgcagaatctgaacctggtggatggctgcacgaaaacaaattgctaagagaatgaactagtgtataatgtgtgacttttttaattaaataaacttggtccatcagctaacagctctgctatggaattaaatttttttagctagtgtatcgagcgcgagaaggcgataacttcaggctgctgctctctagttgccttaaattggcgttctctgtttcatctctctagttactcaattctagaagttaaaaaagacaaattttctgacaaatagtaatagttcaaatgcccctaaatttgttttttttaactgctagagtaggatgaatttaaccatgaaattttatatagataaggtaggctgagatatggattcatgatttcttttagaattttttgaaactttttttaagtagggttgcacggtgttgcaacaaaacttggtttgcactggatatcttcccttttaaaaatcctgaaatttctctttcccatcttgcttgattcaaattcatgtgcgttctaaaaaaagaaaaaaatttgaaaaaaattcccatagcttgtgaattaggcctattgggcaatccaacgagacacatgtcctgaccaccaactcagatgggccgagcccaggcccacttcgtctcctccacgttcaccctcgggaccgcaaagggctctagcatccccaatcccatcggtcagcctcatccatccgcagggcgccggcggcgggagtcttgccggccacatcgtcgccgatttcaccgatccgagctccggcctcttagccatggaatctccacgaactctggaagccctcaccaacgacctcgtggtggagatattcctccggatcggctcccctgccgacctcgttcgcgcctccgccgcctgcgtcgccttctgccgtctcatcgccaacccctccttcttgcgccggtaccgctccgtccacccgccgctacttctcggcctcctcgacccttatggcgatatcgaacccaccgagacaccccatccctccgctgctctcgctggcgccgtcgctcgcgccgctgacctccgcttcggcgagtattttcctagcagcaagttatccggctattgtgtctctgacgtccgagacggtcatgtcctcctcaccatcacgccctaccttgaggacgacgaggatgagaagttggtgccagacctcgcggtgtgcgaccccctggcccgtgtatgcctgcgactgccccccataccagacgaccttctcgcctccgtccaggttcagcagcaagatctcgtacattatagttgcgatacattccttgtcccttcaggagatgaagaagatgtcacttcttttagagtgatcgtcatgatgagatctacacagatgctagtcgcttttatcttctcttcaaccactggtgattggagtgctggttcacctttcagcctgggttctctgagaataccatacgacaacattccgagttatgcttatggctgcttctactggaaagtcgagtctgagaacaggttgctcacgctcaacatgagcagtatggagttctcagtcgttgacctcccacctgggcccgataggagtttcgtcatcatggtggaggcaggcgaaagcaggcttgggatgtttagtctaattaaccatggtaccactctctgttatgccattaggcaaattgggagcgagaagtccaatcagttggagatggacagtgtgatccctttacctgagggttatatttactttcgcattcacggttcatatgaaggacacattctcatatttggatacgcgtttagtgaagacgcatgcttcgcacttgagatcaagactatgaagattgagagagtctgtcggaagtggcgtggtttctgtccttattttgtgttcctgccatccatgtcacaaaggaggatataatgtggactgaattcacatccaggtttggggcttcttccaatccattctgctggtgtggagttgagctaggtgatggcacaggccctcatgtagatgtagcacatctgcaacactgtcccatgttatcctcctagtctgtcgtattgtctagcttacattagtagctactgaaactttagttatatctatatttttaagttctcccgactgtaatttaagatgtgacaaaggcgtctttagtgtatcaagagccaacttttataagccggctctgtgtgctgcgaaatcacgtgtttgctagtctagaaaagaaatatcatgccagcatcatcagacatggtacggtcagcatgtttctcg

SEQ ID NO: 7596 - DNA, 1745 bp, Zea mays
  misc_feature (842)..(842): n is a, c, g, or t
ggttatatctgtctgttataattttacagtcattctgtttattttgctatctgtttattttcagttgttccgtaataattcatgaaccatgtttatatacttattatatttatatgattcatatgctttatgttctcttgatccatattggtatgggtcaatttgagatcatgatttctatgtttaattatcttttatatttcatcatcataatgttaatttatgaaattaaaatgatatgaaaaatgcctataattctaacaatatattttgttatattttaacttaaacttatttttgtgcatttatttgacatttttttagatcgtatttttagaagttgagatttttttagcgggtacgggttacttaatgggtaaaattacccacgccggtacaaatattgatgatattttatacggcaaatatatatagttaacctgacggatatgatttcttataatagatatgagcacggggtatgaaatgctataacagttgccatctttagatagatagcaaacgtgtggtatccgcatagtccctttcgtggccgccaatctttcccgtagaccgactagacacttgcttgacctcgtctaaaacaagggaaggaaagaaaaaaaccagaaaccagtctggcttacacgcgggcctcacggatggacggtcccactgtcattgagaatcgcaagtaagtttctcgtcccagcccaagtctcttgttcatagacttggatccgtgacggtcccactgtcacggatgcccttgttcactcgactaggattctaaagtctaatttaaataatctgatccgaggacccggccgcatataaatatnagcttggagcaaatctttcagccttgggtccctcgaggccggccgggacccgatccccaaccgcccggcccgacattccctccaaccgccgctgcggctgcgccgcccaccgccgacaggcgacagcatcgacaggcgcagcagtcaacaggaaccgagccatggcgagcgcggatctgctgcggagggaggaggagttctactcctccctgtttgattccgccaaaggcgatggcgccaggtcgcgctcacagctgatcgagaggaagatcgaggccctggaggacatggccaccagggtcagtaaccggagatcgcggaagtggtttaacgaccgtttgctgattgaactcgtcccgcgtctttacgttgaagagatcaaaggcctattcgctcctccgccgtggggtgagcaagtgcccttgtcagcattctacagggcaaatgttggtgaatgggattccttcaggagcattgacatggatgctgaggctagattgatgcagcatatgaaaaaatcattggaaaaacccaggaatcatgtcgatgaaggggaatcgattgcgctgaatgcttggcatcgaatagatcgacatactagagaagcaataaagagaaatttccttcctgatctgcttggaatatatgaagaacgagttagggccttcattgaagacgctagtgacaaagacgatgctcttgtgctgaatgttcaggacccatttcagagactactgctccacggtgtttgtgagttctacaacgtgagctcgacaaccaccagcagtgtgagagaagatgtgaaggcttggaaacaagtcataaaaggcaccagcatcctcggcgtcgagagccacccgctgcacctgcacggcttcaacttcttcgtggtcggccaagggt

SEQ ID NO: 7597 - DNA, 1055 bp, Zea mays
atacatataaatatagcttggagcaaatctttcagccacccgatccccaaccgcccggcccgacattccctccaaccgccgctgcggctgcgccgcccaccgccgacaggcgcagcagtcaacaggaaccgagccatggcgagcgcggatctgctgcggagggaggaggagttctactcctccctgtttgattccgccaaaggcgatggcgccaggtcgcgctcacagctgatcgagaggaagatcgaggccctggaggacatggccaccagggtcagtaaccggagatcgcggaagtggtttaacgaccgtttgctgattgaactcgtcccgcgtctttacgttgaagagatcaaaggcctattcgctcctccgccgtggggtgagcaagtgcccttgtcagcattctacagggcaaatgttggtgaatgggattccttcaggagcattgacatggatgctgaggcaagattgatgcagcatatgaaaaaatcattggaaaaacccaggaatcatgtcgatgaaggggaatcgattgcgctgaatgcttggcatcgaatagatcgacacactagagaagcaataaagagaaatttccttcctgatctgcttggaatatatgaagaacgcgttagggccttcattgaagacgctagtgacaaagatgctcttgtgctgaatgttcaggacccatttcagagactactgctccacggtgtttgtgagttctacaacgtgagctcgacaaccaccagcagtgtgagagaagatgggaggccttggaaggcaaccaccatcaagaagaggcagggcaccggcgttccctctagaatcacactagttagctttctgagaatgaagaagaatggatcgcagtaacgttagttagcgttcaagaatacaacaaaattgctttagattccgtttaggctgttgcaagacaagtgagtggtcactggcaatgtgttcttatatcgcatcagcctgctggctacggtttggaacttcctgacagaaagtagaaacttccggttctcgaaaaaaaaaaaaaaaaa

SEQ ID NO: 7598 - DNA, 3256 bp, Zea mays
tgcagaggagaagggacaggatcaatgagaaaatgcgcgccctgcaagagctcatccccaactgcaacaaggtacgacgatccatttctaccatcttttaattaggccccgtttgatctgattagtccctctattttagtcacatttagtccataaattaccaaatggtgggacttaaacagagactaaattgttctagtctcttaagaggtgactaaaaaaactaaaccatataaattcttccgctcgcccccaactgcaacaagttgcactaacgacgggcgaatgctacgaggtattttggttctcttatgattcatttaatctgttttaaatacttttagttactaaaactaaacagtgttgttttaaatacttttagttactaaaactaaacagtgtagagactaaaaatttagtctcctaactaaactttagtccctgtactaaagtaaccaaacaaccccttacttatccgacacttttgaatccctaggcatttggtaaatcggtagcaacagatgcatcacctttcttgcagattgacaaagcctccatgctggatgaagcgatcgagtacctcaaaaccctccagcttcaagttcaggtgacactaaaaccacctaattggaaatgtagcacggttctttcagatagatgcaaacataaatgcactgacaagatggtggctatctgacacgcagatgatggccatgggaagtggactgtgcattcctcccatgctgctgccgcgagccatgcagctgcaaattccttcaattgctcatttccatcatctcggcatgggattgggttatgggatgggtgtcctcgatatgaacagcacagcggcagttccatttcagcccatccctggtgctcactatacttgtccgatgatcccaggcacgccaccacaaggtcttggaattggaatgcctggcacaaacacgatgccagtgtttggactccctgggcaagcaatccatccctcagcgtctagcgtacagccattcccatcgttggcgggtcttcctgttaggccaaacctggcacctcaagtcccagccgtcatggctaacatggtgcaggagcaacagcaaggcgtagcgactcagcagcagcagagtctgaataatgaagctcaacagaaagcaaataccggagatccacaaatactacaaaaatagatgaagagatcttcgccagtaatcagtttctggatggtggtggcaacaggactaatactatagggagaaatgaggctgaaacataaaaacggtcagcaagtgccagtgtgtaacctgactcgagctaaacttgacacaaatcatggaacttggcagagcgttattatcctaatagataacatggctgatgattttcaggtctcgactaacaagctgcaggtgtgaatatcagcaccaactcatcatggaagagcttaacgagtttcatgattcacgaagcagatctatcacttgaaaaaggtccaatcaatcaagatggatttggtggcgggatgtctagcttagcgagctaagatgctccaaagttttgtgtaaaatgtagatggaaccttgttacaagtaacatttcttggcagcgatgccgttttcaggtgttttttttttttgttgcttcactgaagttttcttgagtcaatatatcttattttcccagaccttaagtgatcatatgcacaaagatatctgtgtggctctgctttaactctatctcttcacaaataataatgagctaataactgttcagagctgcatccttaagcaaatatgcaaccacattattctgcagatgtatgcatagggccagaaaagcagtaatatgaaagttttgaaaatttccagtaatgacaccatacttaaatatcttttgaacatcaaggagcagaaatgaattaattcacatagatgatctgtatagtcaatataatttagccgaagttatgttctagactgcttagtttgccacaaaaaaaataagaatagaagatgtaatccatattctggtcaatcagagtactactttaaaaagtgtgtagtcttaatttgaacacaagctacaggagagatgtcttaaaaaaaggagtttctggggagcgtgcaaaaaaaatctcaatcgtgaatatattttacctacttttgattacatgttagcgtcatcatgttgacttcaattcttaaagtgtaacctttgttagcccatcaggaaacaaacattaaactattagtcataatataaatcgcatattatactcaacaatactaaaataagttcagggcccagcatgcagcaagtacaatgcaaaaatgaaaaggtggggctaaattttaatctgaaatgctggacttgataaagtcttaaagtacgtacatctttggcctagaaaaagaaagcatgcatcacggtgtactgctagtactagtcatctgccctggcattttaatcttatgttttccattgcacacaaatcactctacagtaaactgtgtaagaggataagctagttatggtatctaacattattgtatcacttgatggaggtacaggattgcttttccctacctttttttattcgtgatgtgacataacttggaagactggtgtggacaggcatcttgatacattcatgcatctatgcatgtggagaaagcacaagcaaagtcccctccaataattcaggtcttatcattcaggactaggtgttgtcgtcagttttcaggcctatcttcagatcgtccattgatggatcttgatcccctcaaatcgaggaaatgctatgtgccttgccagcttatcctacgcctatcttttcttttcctcctctgcttttgtataacagatattttactactccatcccgacttgttcttttggtcagcagtcagcacctatccatgccctgatcaactacagtaaggaaaataacagacagcgatatctaagaaaggaaacgctgatgtacatatattcaaggactgaagtgggtccagcaataaaaacatctcatgtggtggtagacagaaataaacatgcacatgataagacaactccattgtctttattatagatattattccagcaatacctggagttgtactatgatggactcaacaaccacaatcaagttgcacagttaggccctatttggttcctctagtcacctttctaaactttaggtattaaactttactctttaaaaactcagccagtaacacgttccgtaatagtcata

SEQ ID NO: 7599 - DNA, 1533 bp, Zea mays
ttgggaccctcgaggatagaccggattaaaaccctaggccctagccaccgcccaccgtcgcctcagcaaatcctcctcccgtttcaccatgccgccctgctgctcccccaccacctccgccgtcaccgctgcggcggcatctcccggcgcctcgcgcagcgggggcctcctgcgccgctcgcgcccagcccccgccgccgtgaattgtaaaaagattgattctctgaggtcaatcaatggagcaccaccttgcattccggtgtccaacaggtcgttattgactcctgtaaccttgccagttttccgggatccaaacatgaggaacgacacgaggctgcgcatcttctcaggcacagccaatccttccctttcccaggagatagcaagttacttggggctagaacttgggaagataaccataaagaggtttgctgatggtgaaatatatgttcagttgcaagaaagtgtacggggctgtgatgttttccttgtgcaaccgtcgtgtcctccagcaaatgaaaatcttatggagcttctgatcatgattgatgcctgtaggagagcatctgctaagaatatcactgcagttatcccttattttggttatgcaagggctgacaggaagtcccagggcagggaatctatagctgcaaaacttgtagctaatatgattaccgaagctggtgccaaccgtgtccttgtttgtgatcttcattctagtcaagcaatgggatactttgacatcccagtagatcacgtttatggccagcctgttattcttgattatctcgccagcaagacaatatgttcagatgacttggtagttgtatctcctgatgttggaggtgttgccagggcacgtgcctttgccaaaaagctgtcagatgcacctctagctattgtagataaaagaaggcaaggacataatgtcgctgaggtgatgaatcttattggagacgtgagaggaaaagtggctgttatgatggatgatatgatcgacacagcaggtaccatttccaaaggagctgagctactgcaccaggaaggcgcccgagaagtatatgcttgctgcacacatggtgtttttagcccacccgccatcgaaaggctatcaagtggattgttccaagaagtaatcatcacaaacaccatccctctgaaggaggagaagagttttccgcagctgactattctttcggttgctaacctcttgggggaaacaatctggcgcgttcacgatgattgctcggttggtcatgagccatactccagcttggatattgactgatgcttaaggaatagttgtggcagctcgcaaccttctctttcttttcttttggcctcggtttttgtctgtgcgtgtaataagcaatgtttttgtggaattctgttagcgcagaacctcagccttgtatttgagtgacagcacataagatgacattccagattgtagtgcagtgtttcagctatcctcaatcacagcacataatatgtgtttgcttgcaaaaaaaaaaaaaaaaaactcgagcccgg

SEQ ID NO: 7600 - DNA, 2180 bp, Zea mays
atctgacaggtaggctctttctactcccgatccatccgcagcgggcggcggccgcctcctcggctcctcccccgcggccgagctcgcccctcgccccgccgcctcaactcgtctcgcccgcgaccgatttcctccctccgctcgccgcgccgcaacccggagataaggccgcgctcgatcgagaaccacctggggtccagcgtcatcgcgaccagctccggcgaggcgtccgccctttgcagcccggtgtctctgcgaccggcacacagctccagagggtgtcttggactgaagaagatatcagcaaagcttgaaaaggactgagagatgtcattgggctatgctgagaagctgtcctaccgggaggatgtgggtactgtgggaatgcctgagatctttgagacccctgagctagtccagaataagatagaagagcttgctgccatggtgcaaaagagtaagcatttagtggtgtttaccggggcagggatatcaacttcatcaggcatacctgattttcgagggcccatgggtgtctggaccttgcagcgtgcaggaaaaggtattcctaatgcatcacttcccttccatcatgctgttccaagcttgacacatatggcactagtcgaacttgaaagagcaggatttctaaagtttgtcataagccagaatgttgacagcctacatctccgttctggtttcccaagggagaagttggctgaattacatggcaattctttcaaggagatctgcccatgctgtaaaactgagtaccttcgtgattttgagattgagacaattggactgaaggatactccaagacgttgttctgataagaattgtggagctagattaaaggatacagttcttgactgggatgatgctttaccccctgaggagatgaatttggccacggagcattgtcgatcagctgatcttgttctatgtctaggaactagtttgcagattactcctgcatgtaatatgcctctgatgtcaatcaagaatggggggagggtggccattgtaaatcttcaggcaactccaaaggataaaaaggcaagccttgtcatccatggacttgttgataaggtcattgctggagtcatgagcaagttgagtctgcgaattcctccatacatacgtactgactttgttcagctcactctcaggcactcactgaaaaagaaatgtgttagatggactcttcgagtaacaagtattcacggcctccgagcaccattgccatttcttcagtctgtcaaggtttcctttccagaaagacctgatctgaagtctgtagtgcttaaagagcaaccattctctttgcagagggaaacatcgatgaacaaaccatttttcatgctgttgacattaaatttcagtgatggttgcagctgtttgagctcctcaattggatggcctgttgattttcagaagcgaaaagacagcttcgtcagagatagagctctagtcctacgggagttgtactctgctgcacagcgcgagtcttgcattgggcaacaagaaattctggaaagagagaacctaccaagagctgagacgtctattcatggaatcgtgacaaacatcgttaggtatgacactgaagatgaaaagttggctccacccaagaatgatttgatgaatcacagccgcagcaaccctgcaaaacggcacgtggaaggcactgattgccactcgtcattgccaaagaaactgaagtactttttgaaagacaagaagctgaactgctaaaagtgtaaaaccgtagaaggtagatagagaatgctgtaggtttgtttattttggttattagacgagttatacatagcatagatgcatgggaagttcgcatgctaaggttgaactcttctgctgcataggaaagttggctgacttcttatattatgcgagcctagcttaggtacctcctgtggggagaagcgattgcaatacatggtagcatgttgtagagctcctcaccccagttagtcagtgactgatgatggtatcctcttaccagtcctctggtggtatcatcttttgttcacggaggtcgatgaagtactgcctccgataaaaaaaagacgcttttgacattattgctccccaaaattcttattttgacggctatactttgcccagcgagtcatatctaagaagggtacttttaacgc

SEQ ID NO: 7601 - DNA, 2946 bp, Zea mays
gcacgaggcggagccgcaggccgcagccgccccggcccacgccggcacgcccggagcaccgtcgccgccgcagcgcgcagcgcgctcgcccggagccagaagccggagcactgctgcagcgccgctccccccgccgccacgctttcggaggcctaaaaccctcagcgtcagtggccggcaggcggcctctctagtgcccatcggtgctatggcagctctcgcgccgtggatcctacggcggcgacccgtccgctctgtcgcttctctggcctccattcgtgattcatggcatcgaaggtgtgggtcctcttcctcatatccttcagcatcgttcaagtgtttgtggggatggtttggaccagaggcacacgggcggaggaggccgtggtttcagcagcccgtgaggtgcgggagcacgacggtcacacttgatacagatggcaagtttgcgaggtttggagtcggcgatatgggcgtcaccaagcagaagtggaggcagcagtcgcctccaaagaagaagatgtcgagaaaggccaaggtcaaccagctcaagtggtaccgcctgaaggccaagaagaagatgaagtcacccaaccccgaagttaggatcagatacaagcttgaaaaggctaagaggaaggaggaatggttgattgagaagctgaggaagtatgaggtcccgaggacacctgagccagttcatgaccctgagattcttactgaggaggaaaagttttatctcaagcgaacgggggagaagaagaagaattatgttcctgttgggaggagaggggtatttggtggtgtggttctcaacatgcacctccattggaagaagcatgagaccgtgaaggtggtttgcaagccttgtcggcctggccaagtttacgagtatgctgaggaattgacaaggctcagcaaaggcacagtcattgatattaaacctaataatacgattatgttttatcgcgggaagaactatgtgcaaccaaaggtgatgtcacctcctgaaactctttcgaagcagaaggccttagagaaatatagatatctacaatcccttgagcataccagccagtttattgagaagctggagaaggagcttgaagattacaagaagcatgttgctttattcaagaaccataataagggggttgctattgagaaaatcagcaatgaagataccactgttgatgatcctgcaactacctcagattctaaatgagctaactatttggacatgctggcatgatagatctttcagtcgtcaaatcttgcaagcctacatagctcaatgttcactattcatattaaatatgctggcttcagttgtggtgatatagggagctagcttgaaaactcagattcagatagaagaagtaatagccataggattttaaaggcttgcaagattaaaatcctggttgatggaaagctgtattacttgaaaaatacctcgttcatcaatctatctctataaggaaaggctagtagcatgatactgagtgcagatcagccttttaatatttctgcaatctttcctgtaaacacttttatgataaaataggacattcttttgaattgtggcccccttttatgtaggcttttcacttcttgggccttccttgctacatagaagacaatgaaattgtaattttggagctggaatagttctgcaggaccctctcagaaatgaagacttttactgtgccacacgttcacgtactcagtattcatacaccaatgatggacgtcagaagtgcacaagatttctgtgcgtcatttgggcattggtgcatgaactttgaaacaacttgttggtctacatttgtgtgctttttgcaggtactgggctgttcctgagctgagaagatgggcatgtgcagaagcacaatggtgactttaaggatttggcttgataaaaaggaagcgaaaagacagcttcgtcagagatagagctctagtcctacgggagttgcactctgctgcacagcgcgagtcttgcattgggcaacaagaaattctggaaagagagaacctaccaagagctgagacgtctattcatggaatcgtgacaaacatcgatggttgcagctttctctttccagaaagacctgatctgaagtctgtagtgcttaaagagcaaccattctctttgcagagggaaacatcgatgaacaaaccatttttcatgctgttgacattaaatttcagtgatggttgcagctgtttgagctcctcaattggatggcctgttgattttcagaagcgaaaagacagcttcgtcagagatagagctctagtcctacgggagttgtactctgctgcacagcgcgagtcttgcattgggcaacaagaaattctggaaagagagaacctaccaagagctgagacgtctattcatggaatcgtgacaaacatcgttaggtatgacactgaagatgaaaagttggctccacccaagaatgatttgatgaatcacagccgcagcaaccctgcaaaacggcacgtggaaggcactgattgccactcgtcattgccaaagaaactgaagtactttttgaaagacaagaagctgaactgctaaaagtgtaaaaccgtagaaggtagatagagaatgctgtaggtttgtttattttggttattagacgagttatacatagcatagatgcatgggaagttcgcatgctaaggttgaactcttctgctgcataggaaagttggctgacttcttatattatgcgagcctagcttaggtacctcctgtggggagaagcgattgcaatacatggtagcatgttgtagagctcctcaccccagttagtcagtgatccagcaacgatagtggagctgcgaccggatctggtggtatcatcttttgttcacggaggtcgatgaagtactgcctccgataaaaaaaagacgcttttgacattattgctcccc

SEQ ID NO: 7602 - DNA, 2148 bp, Zea mays
ctgcagataatagaactactttatattcgttctactgctgtccatgcaaagttgaaactgctgaaggagatagctgaggaacatgaagttgactgggatccatcagagacagagatagaatttctcaaacctcatgaagatctattggtaaatatatatacggatttgtgactaacatggttagttcaatgattcaaatcttacttgatactatgttttcgatctattgaatggcccgacctacttcaacggctccacactacctcttcccaaggagaaacacgaggaaacagtagcggcaagtgctgccgagcggcctgacaaagactgcgagtcagataccggtcttgactcactggatttgcctgaagtcccaaaagcagcaatccgtccaccttctaacacaccattgaccccagatattggtccccatgctccgggctctcagcagcttcctcgtgagttctcagaccgtactaacttggaggagaatccaacagctggcggcgcttttaatgttattcagatgaaaagcctggaacatcttatctctgcaccatctgctcagccaaacacaccagatttgccagatgaaaagaagcaatttattccttttgcatctccaccgccagttgttgctactccattggaaaaaactgagacagttccctcaccttcaatgtctcctccagtgaagccaacagagccaaaaatctccacaaagcgggttgatgaattggccacacctccagtacctcccactgattatacgttcacaaaacaaccagaacaagtacggccaatctcttccgagagtgaggcaagtatcgacttggacgatgtactatctgctgctcagacagctgctgaatcagcggagcgagctgcgtccgcagcccgcgccgctgcgaaccttgtgcagctacgcattgcagacctaaagaagaattcaagggtctataacaagtacaccgacagtgctcaaaaggaaagccctcatcaggccgagggtacacagaaaccagtatttgatcaccaggactccttcaccaacgagacacaggactatgtgccgtctcatgtgccgcagaggtcgccgtctctggaggacgatccgtatttctcctaccccaacttgttctcggcgccaaaaccttgaaggcggaaactagtggcctgtaactgctagtagtagtcctattatgtcttggtcttcgctgttgcctcggaatttctgtgtgttgctgagtttggtacataacggtacaaaaggagactactgggttattacttggctacgaaacctgtctagtttgagtctctgtaaactgtacatgtacggtgtctgtatcagttttctgaaacatttctgcagttctacacgtaagtaatgccagatcatctagtttggttgggctgggcccaaaacaacatcttgtaatttggaatggacttggaataaaggaagtacctggagatcaacaaaaaaaaaaaaaaaaaaaaaggaaaaaaaaaaaaaaaaaaaactagagagggtctgccaatcggactcttctctcatctgtgccatcaaccttctctttatatccctttgtttacggtgtgacgaggctgatataatttagggctggttcggttaggggtggattgagaaggattgaaggggattaaatatcctcctattgaaatttgaataggtccaatccacatcaatctatctcaaactgaataaggctttagggctgatttgttgatcaaggatcacgagagattgaaatcccctccaacaccctgtgatcctcttgtcaccaaatcaatctagggagtgtttggctcccaccaccaccttctagactaaaattttagtcttttagtttgtaaactactaaacagtatgactaagattctgtttggaggcaattaaatttttaagaaactgattttttttatcttttagttaggaggggctagcttcttggtttttaagaaactatgaatcaaatttttataaactgaggcataaactgatatgtttgaaacaacctcaatttccataaacaatttttaaaaaaattgggcaaataggctctaaatgtagtctcacaaatataaattttagggactaaagtgtagttcttaaagtttaga

SEQ ID NO: 7603 - DNA, 966 bp, Zea mays
gctcttcgttccggccatcctgacctctagtctgtcgctacccatgcccctgtgacctgcctgttaattcctgtcctttccctgatgctgcgccaccagccgcctaattgccgcgcgctgcttgctactgtgccgccggtggcagaggtccgcatcctcgtaatcccttcctaacacgacatgagaggaatttaatgaactgttccttgaattgcgccaagtgggttgtggagtatatctcaaagtcttggaaccactgcgttggcattagtgggcatgcttacgaatcttcagttagatgcctatcagcggcaccttggtcaaagctgctaaactttgataatatttgattatgtgaagaaaattgagcttgattccaaaacctgaatattggggtggctacaaattgacaccgacactttttgagttctggcaaggacaacagtctcgactgcatgaccggttacaatactcgcagagagaagtagatgggagcacagtgtggcacatcgagaggttgtccccttgactgttagcctgtcaacacttcggtaatagcgttgaggttatcaccagcaaccaaatcttctccagctgcaagatgtgcgaactgccccaagatgttaccgtggtgattagatcccgtgtttgagtaccgcagcccagaagctcagttctgtgcggacacccttttcagtttccacttgggccttccattgtagcggtgggtgaggagagagtgaagtgctttgcaaagtcatcagatctcttttaggcccttgcgtttctcttccgtaaatggtatccatcgaaccaggtttctaaatcctgccgattgtgaacttgtgccgtgatacactagtactgcgggaataatgatcttgggatggcattgtcagcaccgtgctagtaaataaagatgcaatttgatttattcaaaaaaaaaaaaaaaaaggggggaaagga

SEQ ID NO: 7604 - DNA, 1534 bp, Zea mays
aaacgcacacccaaacctctatattctggtctcgttactcagcttcctccacgcccgcccccattcatacctcgtcgaagacctacctaacgaattacctcgggagtttgatgttattgttgatgcaatgtttggtttctcatttcatgggacacccagaccaccctttgatcatcttatccaaatgcttgtttcattgagtgatattcaaaatccagataagcgcccagcaattgtttctattgatatcccttctggatggcatgttgaagagggagatgtcgatggaggcattaaacctgatatgctggtgtcattgactgcacctaagctctgtgcaaaaaagttcactggcccacaccattttcttgggaggaaggtttgttcccccgcacctatgttaaacaatggcggacttcagcttcctccttaccctggcacatcaatgtgtgtgagaattggaaaagcgccatctgttgaaatttcatctctcagggagaactatatttcccctgaacttcttgagagtcaagtgatgtctgatccatttgatcagttccttaaatggtttgatgaagcagtaacagccggtctgcgtgagcccaatgcaatggctttgacaactgccaacaaggaaggaaaaccttcttcgaggatggttcttttaaagggagttgataaacagggatttgtttggtatacaaattatggtagccggaaggcgcatgacttgtgtgaaaaccctaacgcagcactccttttctactggaatgagatgaaccgtcaggtaagagttgaagggtcagttgagaaggttccagaagctgaatcagataaatatttccacagccgcccacgtggaagtcagcttggtgccatagtcagcaagcagagtactgtaattgctggaagagaagttcttcaacaggattacaagaaattggaacaaaaatattctgatgggagcttgattccaaaacctgaatattggggtggctacaaattgacaccgacactttttgagttctggcaaggacaacagtctcgactgcatgaccggttacaatactcgcagagagaagtagatgggagcacagtgtggcacatcgagaggttgtccccttgactgttagcctgtcaacacttcggtaatagcgttgaggttatcaccagcaaccaaatcttctccagctgcaagatgtgcgaactgccccaagatgttaccgtggtgattagatcccgtgtttgagtaccgcagcccagaagctcagttctgtgcggacacccttttcagtttccacttgggccttccattgtagcggtgggtgaggagagagtgaagtgctttgcaaagtcatcagatctcttttaggcccttgcgtttctcttccgtaaatggtatccatcgaaccaggtttctaaatcctgccgattgtgaacttgtgccgtgatacactagtactgcgggaataatgatcttgggatggcattgtcagcaccgtgctagtaaataaagatgcaatttgatttattc

SEQ ID NO: 7605 - DNA, 2389 bp, Zea mays
aggcacaaaccagagctcagcgtcgattctatctcttcaaactcagtgtggttgatccaccctgagtttgaattgggggggggggatgttagataagattctattttcctattgtaactctatttctctattgtatatagataggtcttcatgctgtatctgtgtatatatattttctttagagcctcatattgaataaagtgctattcataacatataataatgtcaactgggctagaggacactgaaagtgaggtcgctttgctagtggacaccgaaaaaaattgattagctggtggatactgtgacaaatttgctggaagacaatagacacattaaaatattcatttcttgctcgtgaggtgagaggacagctgtaaaatgttgttttttcccctatctctttcttctttttctcttcttttctattccttttcaattgaagatcttcctgctcttcgttccggccatcctgacctctagtctgtcgctacccatgcccctgtgacctgcctgttaattcctgtcctttccctgatgctgcgccaccagccgcctaattgccgcgcgctgcttgctactgtgccgccggtggcagaggtccgcatcctcgtaatcccttcctaacacgacatgagaggaatttaatgaactgttccttgaattgcgccaagtgggttgtggagtatatctcaaagtcttggaaccactgcgttggcattagtgggcatgcttacgaatcttcagttagatgcctatcggcggcaccttggttaaagctgcaataaacttggatctggtggggggatgtgaagaaaattgtaggtaccgaattctggaactggctgtgttatctgaagtgttaaatctgaatcccctggctgtgtttaactgcaggagcttgattccaaaacctgaatattggggtggctacaaattgacaccgacactttttgagttctggcaaggacaacagtctcgactgcatgaccggtatgcttcgatcatccttcaatctgttatccattttcactgaaaaatcctgtatgccccagaacgggatggcatgtatgttgatacgtgtgatgtaaacaggttacaatactcgcagagagaagtagatgggagcacagtgtggcacatcgagaggttgtccccttgactgttagcctgtcaacacttcggtaatagcgttgaggttatcaccagcaaccaaatcttctccagctgcaagatgtgcgaactgcccccaagatgttaccgtggtgattagatcccgtgtttgagtaccgcagcccagaagctcagttctatgcggacaccctttttcagttttcacttgggccttccatagtagcggtgggtgaataagagagtggaagtgctttgcaaagtcatcagatctcttttaggcccttgcgtttctcttccgttactggtatccatcgaaccaggtttctaaatcctgccgattgtgaacttgtgccgtgatacactagtactgcgggaataatgatcttgggatggcattgtcagcaccgtgctagtaaataaagatgcaatttgatttattcctttggcccagcgtcatgattttgttgtgtttcacatctgttggtactgcggcatgctactggttgaaactgtgtttgtgctgcaccatcctgtgcgcaaaataatacagcggccaataggccatgtcgccgcattggatgtgcattgcacttttgtttcaagcaagcaggttcgcaccatggttttaaatctcccgctgtacaatttagccgctatctcccgctatagctccatttggaactatctccaagagaacacacaaaatcttcctaaaaccaatattagagatgaaacccaattttttattactccaacagcaccctcttcatgcccgcattttttcgtgtcccacatatatgacctgtcgtcccacaaatatgagggagaagaaatctctcccaagcgcctcgtacatgcattttagtgtgtgaaaatcacgtcgcacaacatgctgcgatctagaaggtgaaatcacgtatgtttgtttaatatgggccaagcccttctatcgagtgaaaacatggctcatgcaacaaaaaaggccaattcatgcctagggtttttttagctgtcccaattttcactttagtcttctatttgaggaactgctggagtaactacggaatcttaagagctgagtcagggggtcgctattgagaaatttctaatcgcaaatgtctcgtgtagggcgttcctctttctggacgccgggtccagcatacgctacagttggtggaccacgatgtcctatggcgactacggacgcctaagagctgagttagctagaattcctatttttcattaatctagaccc

SEQ ID NO: 7606 - DNA, 1358 bp, Zea mays
  misc_feature (8)..(8): n is a, c, g, or t
  misc_feature (10)..(11): n is a, c, g, or t
  misc_feature (26)..(26): n is a, c, g, or t
cggccgcncnnctttttttttttttntttggttgagaagatataaccactctttcttctcacaatatatgttgaaataacaactctttcttttttttttttttttttagtaaagctacgctagctgagtggataaaataacatacgtgccttgtctgaaacagaataaaaaaagaacaaaggattatgttctatatcctaatgagctcaagcaaagttttatttgctccatttagcacgaccgatcagatgcagtttgggggaaaaaaagatccgcagcacagtgcgagaggtgcgagtacgccgctccctcatttactctgccacttccttgtcgaagaaaccttcgcccagcaggtcgtcgtcgccattgtattgcggcttgttagctccatagcttgccccaccgccagaaacccccccggtaacatttccagcaaagttgttgccaccaaaacctccaccaccaaactctcctaaggttccaccactggaactcgaacctccagtattgtagttgcctgcaccatacgggttgggatacgaattgtacccaccagtgtttccatcagaactgccaatggtattgtacctaccattgctgttgtatccgctgctcaagttgttagcataaccaccactggcagctccattgccgtaaccatcactgcctgaatatccaccacctgatgcattgctgtagttgccactgccagatccaacaccgtaaccattggcagcataacccccagaactataaccaccaccagaactatctccaccaccgccatacccaccagtaggatatccacctccaccaccataaccaccaccagatccgaatccaccacccccgcgtatcccaccagcgcgttcattggcatggttcacccttatatttcgtccttgaagttccttgccatccatggaagtcattgcagctgaggcttcttcagtggatgtaaaagttataaaaccaaaaccccttgacctccctgattcccgatcaatgatgatccgagcttcaagtacattcccaaactcagaaaatgcatccttcagagtggtttcgtcggtggcaaaagaaagtcctccaacaaagagcttggaagaggacatgcatcttactggctgaagcagtggggagcaagtgggcgctaaagttctcctgagcgcatttccaattctactagcgaaagccatccctcgaactcctcacggtgtgagtcgggctgcgatcaagcgtcgtcgccgcctcaggctttgccgagcggagcgtcggcttcccagttctcagtcccctcccttgtctgctaaaccctatactaccccgccgcgtccgggtcgagccccggccgg

SEQ ID NO: 7607 - DNA, 1661 bp, Zea mays
cctcgaggccggccgaccaaaccgcttcgcttgctcctcagctccctgtcgcacacaccttacgccgggtaggcaggagcaggactcccactgtcccaccgagccagaggccctccgatccgagcgagcaggggcgccaccgtctccaatggctcggccacagcaacggtaccgcggcgtgcggcaacgccactggggctcctgggtctccgatatccgccaccctctcctgaagacgaggatctggctgggcaccttcgagacggccgaggacgcggcgcgcgcctacgacgaggcggcgcgcatcatgtgcggccctcgcgtgcgcaccaacttccccgaggacgccgccgccgacggacaggggcagccggccgcgacggcgcttctctcccccgcgctcgtcgccaagctccaccgcttcaaccttgcgtccgtgcaggcggcgcgcggcagggccgatgactccgcggcagccgccgcctcggcgcccgccgtgctcgcacgcatcgcgccgatgcctgccagcaatgccagcatgcgaatcgcccccttgacgtcggcggctgtggctgcggggcactggagcggcgactttctcgaggagcagtacgtggaccagatgatcgaggagcttctagactccaacttctctgtggagatctactagtttcacccgactcctctgctccgtctcatctctctgtttggtttcgtcagctcagctcagctagggagtgtagtgagttagtggtgagttagtacagtagtatcattagccatgccaggaggaacttgaggtttctttggttagactcttgagcagtctgatgtgtatacggtagcgtcgtcagagcataaaattttttctcctgccaaagttgggactacagtaaagtggtaatctgataaacataacaacgccgcattgaccacaaatgctactgcttggaatctcttgctacgtgtttttcttggttgacaagtcttggatgggagtatgggacgcaggacgcttcatcagagtcagacacgatgcatgctacactaccaggtgatcgatgcgtgtgtactacactgctacgcaatgcccttggtactttgtataccagtccaactttaactgcaactgcaagcaaggaaaaagagcttctaaaatccaaggacagaatcttggcatcaaggacaaaagccgcgtgatttatggctcctctggcactcaatcccgacgaatccatgaactctgcgttgcgctgcatctgcatgcatcctctgaattcagctgagtagcaattggcaatggcaggggcggtgccgtaattcaggtcgtagggatcgcagcaattgaggcgctgtgcgtcatcgatgacagtaatggtgggggggcgttgatctgctgctgattgacggagtagtatctatgcgaggattcagctcatcatggcatgtgccaccacatgcgcctcgcccaatcatgctgccccgctcgctcgccttctggccttgagacttgcgacgcaagagacgtcagcctgcgctcttgccctcgtttgtcaaaagaatacgcggccttttgcggctgtgacagtgatggatatgcttattttataggagctaggatagtattcactgtgtgtgtgtaattatagcctgtccgtcag

SEQ ID NO: 7608 - DNA, 859 bp, Zea mays
ataatggtacggtataaatctaattttctcacagtttggcgatcgccgatcgggaccttccctcagccacaggccgacagcccacgccgtcgaacggccggggatccggtacctccgctccgccccgactccctctcgccggacggctgcagatccggtcaggccgatccgtctcggacccggtggtagcagtggaggaatccgctgccggtccatcgatcgggagagatgcggcagcagcggggcggggtcggggccgggaggagggaggatgacccggggctcctcacgagagccgtcaacagggcgttccgcttcgttcgcctcgccgagttcgagatcttcttcgtcctcttcttcctcatcgccttctttctcttcaaggacctcatgtcacagcctcaatacaatcagctatttgtcaagaagcctgatctagataacccctggccttagggagtacagaactacatatgtgtataagttgtagcctactagcctggtcttttctttgagttgtgttgcaagtactctttgaagccctgttatcaggagcatgttttatgattagttagaggattctcttcggtgacgatgaatatatttagctagtcattttaatattggtatgtgtgatactgaggttaatgccggcagttatcgttcacgctgtttatgtggtgtgaagtccaatgagctcggtgagatgatcatataagtgcagttctaagtggcatccagtgtttgtaatagttgacagataacgctaggataaagaggtgtattgtagtgtggtgtactttttgtatgacagcctctttagttgagttaaaaaaaaaaaagaaaaaaaaaaaaaaaa

SEQ ID NO: 7609 - DNA, 2925 bp, Zea mays
cgagatatctatgtcgatcggcatgcagcactgcacgtagtctaaagattggcacctgcagcgtgcccagcgcatgcatcgtagatcatcatcggcgactgccaatctctcaagtgtgagtaagaaacacacaatcatcaaatggcatcaaaccttgcttagcaagtgaaaccactcgatgccgatcacttgcatcaacagccattccgcactagcttggttgcctgtgggcgtgtggcctcctctcccctggtctcgtcttcgtccctaacgggcgtccgagccagcgcgcgcgcgagagacagagagagagagaagggaggaaggggaaaaataaccacagaatataggaggaccacttccctcccctccgactccggccaacccgcccctccctcccaccgctcgtccgcccctcgcccgcaccaccggcgccggcaccggcgccggagcgcgacccggaggagcgtccgcacccgcgccgcgccagatctggccccgcccgcagctcccatgcccctccctccccagacccgcctgacctagctacgaccggccggccggacccgccccaccccccgccatggatgacgtgtccaagtatgcgcacagcccggcgcacctcgccgtcctgcggcgcgaccacgcggcgctgcgtcgactggtggcggccctcccgcgcctgccgcgcgccggggaggtggccaccgaggaggagtccgtcgcgggggaggccgtggcggacgcggtctcggccgtcatcgaccgccgcgacgtgccgcggagggagaccccgctccacctcgccgtgcgcctccgggaccccgtcgccgccgacatcctcatgtcggccggcgccgactggtcgctgcagaacgccgacggctggtccgcgctccaggaggccgtctgcacgcgcgaggaggccatcgccaccatcatcgcgcgccactaccagccgctcgcctgggccaagtggtgccgccgcctcccgcgcatcctcgcctccatctcccgcatccgcgacttctacatggagatctccttccacttcgagtcctccgtcatcccgttcatcggccgcatcgcgccctccgacacctaccgcatctggaagcgcggcgccgcgctccggaccgacatgacgctcgctggcttcgacggcttccgcatccagcgctcggaccagacgttcctcttcctcggtgacggcgccaggcccgaggatgccgggggcaaggagctgcactcgggctcgctaatagtgctggcgcacaaggataaggagattacggatgcgctggagggggcgggcgtgcagcccacagagtctgaggtggcgcatgaggtagcgctcatgtccaagaccaacatgtaccgtccagggatcgacgtcacgcaggcagagctcgtgccgcacctgaattggcgccgccaagagaggacagaagccgtcgggcaatggaaagccaaggtgtatgacatgctgaatgtcctggtcaccgtgaagtctaggcgcgtgcctggggcgatgacagacgaggagctgtttgccatggatggggaggagaagaatgggaggggcgcagtcctggccgcccgggtagacgaagtgttgacagccgaggagaggaagcaacttgattctgcgcttaggatggggaacaacgaagaggaatctgaggagaggggcgacgaaggtgatgctggtgctgatcatacggatgcgagtggcgtgaccaaagataagaagggatggtttggttggggcgccaagaaaggtgccaagggcgatgacaagccatcaaaggtggggagtaaggatgaaacaagtgacccagggaagcaaaaggagaagggcagtgggaagaagaaaaagggtggctcatctgctgagtctgtaaaacatgagagcgagtacaagaaggggttaagaccagtgttgtggttgacaccggatttccctctgaagacagatgaactcatccctctgcttgatgtcctagcaaacaaagtgaaggctatcaggaggcttagggaactcttgacaaccaaacttcctacaggcacatttccagtcaagatcgccatccctattgttccaacgatacgagtcatcatcacattcacaaagtttgaagaactacagcctctagacgagtttgccaccccaccttcaagcccgacacagtttcaagacgcgaaagccaaagaaccagaaggatcaggctcatggtattcatgggtaaagggtggccgaggtacgcagtccggtgacagtggtgatgggcggaactggaaagacgaggttgatccgttccacataccgtcggactacacctgggtcgatgccaccgagaagaagcggaggatgaaggcaaagaaagccaagagcaggcggaccacagcccgaaaacagtcctcgaagaacacttcttcggaaggaggccaccgccccatgatggatggcttcgaggagtaaaccgcgttctcacaagcatagtaagttgtatttgcattcttaaaatgttagttgttgatggcagctgcacgccagaggcagattgattgatgttgtgcctggagcaccccctcccttggcgtggcaatgaatcggagtcgaatctccttgagaacgtacaggatggcttatacccaccccactaatctgtaattcagccagcgctatttttttttgcccccctccgtgtttcatcttgctggatgtatcatgtatgtttgacagatgatgacgatgatacgaccctgttgttgaaaaaaaaatgtgtttgaggggactgtagtgttccctccccctgttgtaatggaagatttaccaatatgcagcgattttctcgcaaagcagcgagcttctcgcaaagaggaagctccaatgcacatgcttgttaaaaaaaaaaaaaaaaa

SEQ ID NO: 7610 - DNA, 3646 bp, Zea mays
ctgagctaatggcgccatttcccctccagctcccctcttgcacctgcagcaagagatcaattcaatcagatcgcggacaggagtcttcctcctcctggcagctggcacagacgctcacctgccggcccgtccggggactggaacggcgacggcggcggcgaccggtgactttgttgacccggttgatgtcgccgcgtttggcgggtctgggatttgtccgcgccggaccgccgaacaaccggcgactttcgacgctggttgcctggttgagcgcgtggtttggtgcggcttgattgctagttacagcgacgggcacgtgttggacacatttctttctcctagctgctgtattgttacgcgtctcatgctatcttacttcttattttaaattttacgttataaacagtgtgatctaatgttgttcacttttagattaaagtcagtttttccagactgcttcagctataattcatagagataacactatagaaacagtaaatacaaattaaatctaaacaaatagcctgaaaaatgtaacataaatatagttaggatttattatggaagacaacatcatccatgcatccatccaatctctcgagagtcgagagtgagtgagaatcactcgtcatcaaaccttgcttagcagctgtgcaagcaagtgagaaacacccactctatgacgatcattttgcttcgacatcgtcacggaattcatggaacgggatgggacgaggggaacagcacagcagagcaaagtggagagagataggcaggcaaggtaccaacagcccagagagagagactactagcctgccaatggtctgtgggctgtggcctcctctcctctcctctcctctcgtcttcgtcccgatcgggcgtccgggccagcgcgcgcgcgagagagaagagacacagacagcgagagaaagggtggaagggaaaaaataacagccgagccgacccagaataggaggaccacttcccttccctccccctccggccactacgcccctcttccccaccgctcgcccgcaccacgccggcgccggcgccgtcaccggagcgagcggccgcgacccggaggagcctccgcacccccgccgcgccagatctggccccgcccgcagcccccatgctccagatccgcctggcctagccacgaccggccgtccgctccccgcgcccccgcgtgccatggacgacgtgtccaggtacgcgcacagcccggcgcacctggccgtcctgcggcgcgaccacgcggcgctgcggcggctggtcgccgcgctcccgcgcctgccgcgcgccggggaggtggcgaccgaggaggagtccatcgcgggggaggccgtggcggacgccgtctcggccgtcgtcgaccgccgcgacgtgccgcggagggagaccccgctacacctcgccgtgcgcctccgggaccccgtcgccgccgacgtcctcatgtccgccggcgccgactggtcgctgcagaacgccgacggctggtccgcgctccaggaggccgtctgcacccgcgaggaggccatcgccaccatcatcgcgcgccactaccagccgctcgcctgggccaagtggtgccgccgcctcccgcgcatcctcgcctccatctcccgcatccgcgacttctacatggagatcaccttccacttcgagtcctccgtcatccccttcatcagccgcatcgcgccctccgacacctaccgcatctggaagcgcggcgccgcgctccgggccgacatgacactcgcggggttcgacggcttccgcatccagcgctccgaccagacgttcctcttcctcggggacggcgccaggcctgaggacgccgggggcaaggagctgcacccgggctcgctcatagtgctggcgcacaaggacaaggagatcacggatgcgctggagggggcgggcgtgcagcccaccgagtccgaggtggcgcatgaggtggcgttgatgtccaagaccaacatgtaccgtccggggattgacgtcacgcaggcggagctcgtgccacacttgaattggcgccgccaggagagggcagaagccgttgggcaatggaaagccaaggtgtatgacatgttgaatgtcctcgtcacagtgaagtctcggcgcgtacctggggcgatgacggacgaggagctgtttgccatggatggggaggagaagaacgggaggggcgcggagcttgatgctgagttagacgaagtgttgacagccgaggagaggaagcagcttgattctgcgcttaggatggggaacaatgaagaggaatctgagcagaggtgcgacgaaggtgacactggtgctggtcatatggatgagcatgccgccgccaaagataagaagggatggttcggttggggtggcaagaaaggtgccaagggcgatgacaagccatcaaagatggggagtaaggatgaaacgagtgacccagggaagcaaaaggagaagggcagcgggaagaagaagaagggtggctcacctgctgagtctctaaaacatgaaagcgagtacaagaaggggttaagaccagtgttgtggctgacaccggatttccctctgaagacagatgaactcatccctctgcttgatgtcctagcaaacaaagtcaaggctgtaaggaggcttagggaactcttgacaaccaaacttcctacaggcacatttccagtcaagattgccatccctattgttccaacgatacgagtcatcgtcacattcacaaagttcgaagaactacagcctctagatgagtttgccaccccaccttccagcccgacacagtttcaagatgcgaaaaccaaagaatcagaaggatcaggctcatggtattcatgggtaaagggtgggcgaggcacacagtccagcgacagcggtgatagccggagctggaaagatgaggtggatccgttccacataccgtcggactacacctgggttgatgccaccgagaagaagcggaggatgaaggcaaagaaagccaagagcaggcggggcccagcccgaaaacagtcctcgaagaacactgcggaaggagcccaccgcccaatgatggatggcttcgaggagtaaaccatgctctcaccggcgttgtaagttgcctctgcattcattcttaagatgttagttgttgatggcagcttcacgcccgaggcagattgaaagttgtgccttggagcaccccccgtggtgttggtgtggcaatggatcggagtcgaatctcattgagaacgtacagatggcttataccccactaatctgtaattcagtcagcgctatttttgtccccacctccgattttcatcttgctggatgtatgcttgacagatgatgatacggccctgttgttgttgttgttgttgaaaaagatgtgttgagggtactgtagtgttcctctcccccctgttgtatggaagattaccaatatgcagcgattttctcgcaaagaggaagctcaatgcacatgcttgtttgttcacattcctttttctgctctgagtttctgctgatgcatgtgtaacgacagtgtaatttgatgtttgtccacgctttcgagctaaggctttaatctaaaatatcttctattgtttatataatattttgtcttcatagatcacagctgcag

SEQ ID NO: 7611 - DNA, 994 bp, Zea mays
cctcgcggccgggccgggacaccggcagcgaccagccagtgatcgaccgaggcagatactgactaggagcagagagcagcggagatggtgaagattccgagccccaggaggctgttcaggagccggtccaggagcaccaccatcatcggcggcggcggcgcggacatctgcgccatggtcgccgagcacgagaggatcgagtgggaggtgcggcccggcgggatgctggtgcagaagcggcgctcgacggaggacgacgcggcggcggccgtggagtacatcctggtgagagtctccaccaccgggtggcagtggcacgacgtctccatcgacgccaccgcaaccttcggcgacctgaaggtgatgctgtcgctggcgaccgggctgtggcccagggagcagaggctgctgtacaggggcaaggagagggacgactgcgagcacctgcacatggtgggggtccaggacaaggacaaggtgctgctcctggaggacccggccgtcaaggagaggaagctcaggtcaaccaccttggcgcagctcatgggcgtgccctgtcactccttcatccaagtgtagagagaaacccccggggaatatttcttgccatttttctcccgtctcgtcgtcgtcgttctccaatttgcctgcgtgagcgaagggtttcagtccagtctaaccgcgtttgttcagagcctgctgagttccatctcagggcttgaattcggccaatcgaatcaagacagtcgcaaacgataggatataaagatgatggatacatggcgtaaattactgtgaacgggtacgtaatgtcatcccagtgccagtgtgcgtgagccagtagttctttggttccttgctctgtatatattctctctttttttttcttcctgagatcagcaaaacagttcggaattccatagatgctgctgtaaatcccttgtcttttttccacggaatgcagcccccttttctagtaaaaaaaaaaaaaaaa

SEQ ID NO: 7612 - DNA, 1344 bp, Zea mays
tattttctgtttggtttaaaaaagtttatagtcttagcttcgtagccccctctttaattaatcctggatccgcgccactggctgccgacgtttcttccacgccgtcgctgccgagttcccatcttccccctcaggtacgagttcccatcttccacgccgccgagtactctttggaaatggaggcgccagcaggtggactcggcagcaggtggcctccacgctgccgagttcccatcttccctcacgcggatggaggcgcctccagcaggcaccaatgcagttgaagctccttctgaagtgagtcaaaagtgttccttcctccttccgaagtttagagatcacacaagcgaggtataatcgtagatttcttgcattaatactctgagatagtatgcaaggtggaattggtgttggttgatgatctagtatgcaagaaaaccctaaaccctaaatgagttcaggtggaattggtgatggttgataaactgtgagataggatattttcggtggaattggtgatggacttcttgccttcaggagtattaaattagtttaatgtgtggtaattcagcacctgttatgcgatacatgtagaactcaaataaaagttgggagtaggggttcacttattgcatttttctgtcactatttcggtgactatttgagtttatagaactatactatttgagtttacattaatatactttatagaatctatgacaaaacgcaagcagaagacattgttgggagtatcgacatgagcaacattgtttatggcactagcagaatacgaccgcgtcatcgattatccagcttacatgatccgatatgttttagcgtcaggagcattatagatttggattggcaatactgatgtgtgatagaatctcattcttctatttgtattgtaggtgtagagattaaatagagtttggaatggtcttttagacgtcattagacacatgcaagtctcagctgatgagttgaggaggttgaccagacgcaaccatgtacctgagtatgtagagtacctgcacaaaaatagcctagttaatgccatgagtgttgtcactgaaattgcacaaggtctagaccatgtgagcacagatctggaggaagttcttattggtctgtaacctcttcttgaagattatgaagcccttggtttgtacaatgatcgtcgtctaccgcatatgaacgagcgtatatgagatatttgtttgcgagagagtctgtaccactaatgcatgtatcttatgaattgtactgcctttctgtcaagtctgtatcttatgaagccttagttagttgccattttgttcctgctgaaaaaaaaaaaaaaaa

SEQ ID NO: 7613 - DNA, 2571 bp, Zea mays
tttaaaaaccgatacaaacattgatcgaggaaagccccattctcccgtgaatcccgatccaaacctaattaacaacattagcctctgtattatacagctctgggatgtgcccgatacaatcacgaagctctcgattgcccggtccactatgtacggcaagaaatgagcatcgtgccatgaggcatagggaccgaccttgaatgcaataacatatgcaaacgagaaggcgcgcactccacgcccttgatccttatatataaactagtaactggcgcgccagcacgcgtttttaattgtaattaagttaaatttaattgtatttgttaataatcataataattgcttagatgagtgatagaagttgattaagtagatatttacatgtaaaatgatataaaatgttctttctgcataaagacggagaggaactttaaaggcaattttgctaggtgttgctttagcttgaggcacgtcatttttgtaggacatatatggtctataatcatattggtacacataaagatgtgacaaatatagaggtacccgcatgacggacatgaggtgttacttgttaaaacaacatgttttgtatctatgacgtacgaattaatgatttttttaaagaaaggtatacgagttatcacttccgttcatctataatacttgtaagaaatttaactgaaatggttattatttgaactatggaagcattgcacaaacttcaaaatttatgaacagaagaaaacatattacctttctatgtaacatatgacgaatataaccggaagcatatatgaaaggttgagatgaagcaagtttagtaaatcaaggaggaaaaacagttaactgataagtatagaaacaattatggtggctttataatatgaattgtttgtcattattggaccatatgcaaaaaagaaagaaacataattttgattttctcctatgtctagttccaaggctgcaccaagaaatgttagaaagctaggaatgaaatattttgctgtgtaaatgacatcaaaataaatattatcatttcaatgtaaacatgatatgaacagggaaagcacacaatagaatgggcaaaagagcctaagaatctaggaataagatatatgttgattaaaagacatcctaataaatattatcatttcaatgtaaatatggtactaatagggaaagcacattatagatattatatcagtactaacaaaacaatgcaattctatacaaataacgacaatccttttttttgcttttattctctgttcctcgctggtttcatgataaaacacagaactgagtattattcgttcaaaagtttgcaattcgaagttagagatatgaatcagttacaatttattatacaatgcaattaattaccaagtacacctacaattaagaagatagatagaacataaatatgtattcaaaagggatgcatctatattgttgtctcatcatgcaagagaaattaattttctttgttacctgaaactgaacgtacattaaaatatgtatctttgcctaagaagcagcaccttccggtgatcggtgaatgcatggtgaccgttttctatttaacatagttactaaatgtttgaagataagtatgttttattatttgcaatagggatggtgtcccaaaacatgtcacagtggttgttttcatatcaatagtgagcaccgactgagccgcgcactgcggcatccagcaaggttggagtcgggcagaagtatgtaaaaatacttgctccttcgaccgcagttggttgtggcctaaaattcagaggttgtgtcctggccatcgagaaccattcgtgcgaatgaaatatgaaacaacgacgtgagaatcccgcgatatatatgcaggcaaccagtgtaagtcctgtttgagccactcaaaattttgtttttcattctagctcgcaaacaaaatgaactcaaatttgactgacacaatcagacagtcaaatccaatgaacacaataatcctacgatattaaaaggcaatcatacagttaaactcatatgtgactgatacaatcagatagttaatggatgatcgaacggcgtaaaaatgatgcggatggtctagcattccagattggctcccactcttaatatatagaaagtagtagtgcgaatgtttagaagagacaacatccaccattgggctaaaataacaaactctaaatctgccctaaactactctattctatatgttcttctatttctctgtagctgattccttggttccagaattccaaatcctccggttgaaagtaaaaccgagacatggatcagggccatgtgtggaacagaattgctattgaagattaagtttgtttgcttctgatcacaaatctttggcaagcaaccatttagcagacagaaaatctcgtttatgaattcataaatttacagctcaataatatcgataaacatttgaaatattgaaaaaattaatcaatattgaatacattgcttgctcttggagatgctctaagaccctagcacgtgaggcaagctctgctccagcgtttaatattatgaattttccataag

SEQ ID NO: 7614 - DNA, 1101 bp, Zea mays
cagcttgcatgcctgcagcaccgacacgtaggagcgccgctgaacgtctgcgactgcgagaggccgagagccataggccccgagcgcgcccgtccaccacacagcacgcacttcgcgccacagcggacgctcttctcgcgagcgcgcaccgatcgagcgcggacgcgtgggcgccggaggaggggagggatgatgtggctcccattcctgtacccggcgccggcgtcggcgtacatggcggcgatgtcggcggtgtcgttcgtgtccatggcgaacgcgggcctcgccgagctccgcggcgaccacatgccctactccaagttctggcacgccgtggcgggtgccgccggcggggacaccaggcagcggggcgggatgccgctcctgcgaagccgggacggcatgctgctggcctacgccccggcgctgctcgccgccgccgcgtccttcgcggtgccgggcgccgtcgagggcgcgcgcgccgagctgctcagcgccgcgctcgccgcgcacttcctcaagcggatcctcgaggtgctgtgcgtgcaccggtacagcgggagcatgccgctgggcacggcggccaccatctcctgcagctacctggtcagcacggccaccatggtctacgcgcagcacctcagccgcggcctcccggaccccgccgttgacctgctctgccccggcgtgctcgtcttcgccgtcggcctcgccggcaacctctaccaccaccgcctcctctcgggcctgagggccgacgacggcacagggtacaaggtccccaggggcggcctgttcggcttcgtcgcctgcccgcactacctcttcgagatcctcgccttcttcggcttcgccatgatctcgcagacgctgtacgcgctcgccgttgccaccggaacggcggcctacctcgccggccggagctgcgccaccaggaggtggtaccggtccaagtttcaggacttcccgccgaggatcaaagcgttgattccgtacgtgctgtagtgagctagctaggagagtgatgagtcgcatgtacaagacacactgttcatttggtacagagcatcatctgttgcagctgaacgtaaacttcatggg

SEQ ID NO: 7615 - DNA, 2337 bp, Zea mays
cattgggtacctcgcggccggccggcgccgggacacgcctccttctccccccccaaaaaatccagcagcagcagcaagccccacgcaacattagcagcaggagaccaccccaatcccccacggacattcgtcgcgaacccttatctgcacgccgcgccatggccgccgccgccgccgccgcggtcgcccacctctccatccacggccgcctccgccgctcaccggagcatcggccgtccatcaccaccaccaccacctcctcctcttcctcgtccgctcaccgcccgtccctgctgcggtgccgcgcgttcaagcaggaggccggcgacggcgacccggctgaggccgacgcgcggaagcgcaggaagggcccgctgtacaagctcaaggcggcgatccagggcctcgcgggatcccgctccgccgccgccgaggtgtacgggggagagtaccagtaccagcgcgccgtcgagaaggcggaggagatattcttctcggttactactcagctaggcagatatgttatcactatgatgagcagcggtgttgtacttggggttggattccagctgtcaggtggagacagccaaatgaacgaactaatttggtatagctggcttggtggggtgattatcggcacaatgataggtgcaaacagtgtcctagaggaacactgcaaagctggacctcgcaatgtcgtcataactggaagcacaagagggttaggaaaagcgcttgctcgtgagtttcttctttctggagaccgtgttgtaattacttcacgaagtcctgaatcagtccttcagactataaaagaacttgaagagaacatacaggaagggttatctgttgccaaaaagaagcagaggaatattctatcgcatgccaaggttgttggtacagattgtgatgtctgtaaacctgaagatgtgaaggagttagtgaattttgctattaatgagcttggttcagttgatatttggataaataacgctggcacaaataaaggttttaggccattggtaaccttttcagatgatgacatcactcagatcgtctcaacaaacctagttggttctctactgtgcaccagagaagccatgaatgtcatgcaataccaagagaagggaggccatatattcaacatggatggagcaggttctggaggatcaagcacaccactaacagctgtctatggttcaactaaatgtggactaaagcagttccaaggatcacttctgaacgaaagcagaagatcaaaagttggagtgcatactgcttcacctggtatggtcctcacagaccttctgttaagtggttcatcgctcagaaataaacagatgttcaatttaatatgtgaacttccagaaacagtagccagaactttggttccaaggatgagagttgtaaaaggaagtggaaaggcaatcaactacttaacaccaccaaggatcttgcttgctctggttactgcatgggttcgacggggtcgatggtttgacgacgagggaagagcggtgtatgcagctgaagctgatagaattcgcaactgggctgaaagtcgagcacgcttctcgttcaccgacgccatggagatgtacacggaaaacacatgggtttccgtattctcgctctcggtggtctgtgcgttcataatcctctctagctccggtggacctcttccaggcacatgattcccagagctgccaaactactagtagacggccatgcacatgctcattttttaccccaccaaaggcattctactaccagaaaccatttgatacagcacttaatgaatggggaagaagagaaccccccacagatgtagatacattggtgcaagggagattagcagctgcctcctcgcaccatttaaagtttggctagctaacctatgtgctcatagaagggtaaatagaatttattgcgtgggcattccactgccgtacgtaagctggactatgatccgtgacttttttaaggacatgtatgcaaagttaggtgagcaggatcagagtcgacattgcctcgtgtacatgcatgtagttgtcattataatcactgtaacttctggtatcgcttgtacccttcaaaattcgaagacattatattgtgaagcgaagtggcacacaccatgtgcatatggtttatctataaaaaaaaaaaaagccaccataacaaaccgggggtgggtggtttggggggcgctaattgcagggaagctgcagcagaagatttacagaggtgaggttgctaagacgcgcactttggtttcttgaattgcttggattctgagttgatgaacagcaatccagtttataataactgcacctg

SEQ ID NO: 7616 - DNA, 1673 bp, Zea mays
  misc_feature (1483)..(1483): n is a, c, g, or t
gattcttcctcttccccacacctaaaagatccgaatctagggacgaccgggttcctccaccccaggattctcgtggcgacctcgcaacaaccttgctcttcgcatcttttcagttgccgaatctctctcgccttctctgcttcaggctatagtcagtctgttcttggtgataggtttagtcacagtaactcttctactatcgtttgcttgctcctccgatttgcgccgagaagcaaccgctatagttttcagcggtttcttttgttccacttgatgttgctttcgcttaaagggcggttccttcctccatttgcctgccaatatccacttttgacgagacagatatttattggatctagttccggaagaagataagattttcctcacagattatcctttttgctttgctctattctctttgattttgtcagctttgcgcccccaattttcaaccggatcaagacgacccgagcattctttgatttctttcccccacaacggccatgtcgctgagccgattctcgcagtggatatggccggggagcagagccagaaaccgtagaggccgcgaccgcgagccaccggcgtggagcagcacggccgtgacgaaaggcctcttcccggactccccgtccgggtttcgggagccagacgccggcgtcgggcgcacgggcatgatcagccggcgcggcggccgcgcggaggacagggtcgacagcgagcacggcatggttatcgtgcagtccgacggcgacggctgcctgtctgactcggactccgacgcctccgactggtccatcggctggttggagccgctcgcgccggatctccatagtgacgtggactccgagggcagcttcgccgtcctcgtgccgtgctatcgacgcggccgcgttgaccgacctgcccgacctgatggtaggttccctggtcctggtggtgtccccgcccacggcggcgtttctggtgagctgaatacgctaactgctagttattccctccactagcacttgcggagtactaggtgttgtgcagagttggtaaatagacagtaattactaattacagtacatcgctaaacctgtttgtttagcctgttaaaccgatgtcctaaatggcaagtttctagttatcggctgttgaattcttttgccaataatattgtctaggcaccggataagtgtacaatctaatgaggccacaacagtataatgagaggtgaaacacttgcgttactgcgagcagaaaaagaacagcaagagttgtaatcttgggtgtacggcctatcagcatttaagattcctatagtgtcaactgtcatatagtgtcataacacaacttacatgactaattaagtttaccatatggtatgagtaggacataactttacttgatacatgcttgtttcctcttcgtttgctatgctgccgtcgtgccatgatcattcatacatgtcgtttacccaaaacctcacacacatatnattgtgtggtgttccaagttccaactaggatgctgtgaatcatgtcaattcaaacctgtaatgactgtgtcgtaaatttatcagacaccttgaacccaccgggtcagcggcactgctgtttttgttcttgtagatgtgccctttcggatagcctctgataattttgcatctagtctagtttcttaatttg

SEQ ID NO: 7617 - DNA, 667 bp, Zea mays
  misc_feature (14)..(14): n is a, c, g, or t
tgtcctttattacntattcccgtttcaaatcaaaaaaaaaaaaaaaaaaaaaaaaaaaaaaaaaaaaaaaaaaaagaaggcgacgcagtggccgtacagtagtgtcacctgcacattgcagaccgcctcagcgcctcaccaagcgaaactcgttggcggctagggttttgctgcctcccgagcccaaaccctagagcacccgcgcccatcccatggcgtgctaggcttcgattgagactggggggattagtaccgcagctgggattagagcaagcgccgagcggaaatggcatcgagtaaccaattcgatctacttggagacgtcgagaacgacgaccctgcccacctcctcgcagctgccgagaagaaggcggccgcggtgcctaagcccgcgcccgcgccggccaagttgcccaccaagcctccgccgcccgcgcaacctgtgagggaggaaaggaactatggtgctccaccgcgcgatggtccaggacgtggaagaggcggccgcggtggcaggactggcccgaggcgagattttggcgatgctgatgcccacggctttgagggggggtatggtggcggcggcggcggttttggggacggtggagttgctcgcggtgaaaatggtgagggtaggcaggcagagaggggccgtgggccccgccag

SEQ ID NO: 7618 - DNA, 694 bp, Zea mays
ggatcggagtatcggacggctcactaccccgagttcggcccgtggagcccggccgggcctcgggtaaaaaaaaaaccttgacaagaacgaattcgcctccggctctcctcttctcgagcgttttcggcaccacggcgcagtaggatggcggcggcggccccgacgagagcagaggtgctgtcgctcttccgttccttactccgcacggcgaagaagttctcggactacaacatccgcgagtacacgcgccgacgcgccgcggactccttccgcgaaaaccgcgccctcgccgatgcgtcggccgccgccgcggcgttctcggaggggaagaagcagctagaggttgcgaagcggcaagcggtggtttactctctctacgcccccaaggccaagagcgtgatggagttgaaggtgcagtgatggctgcgaccttttcttccccaccgttcccgttccagattcgttgcttttgtgtgatgatgaaactataaactgctccgttgtcgcattttctggatgattgtcatgatatagtttcgttctgtgcaataaattactaaattctaccgccaaaaaaaaaaaaaaaaaaggcccctagggcccctcgggccatgttgaaatccaatgagaaggaccctgtcgtagtcaaatccccacaaaaaaaaaaaaaagggggccctgggcccccagtttt

SEQ ID NO: 7619 - DNA, 1120 bp, Zea mays
agtgtattaagagtttatctgtatttaaaaaaacactgatcaaaactatattttggagaccatataattgtttaaaacgatattaatagaataccgcactactcaaaaggaaaagaagacaacaactacgtagttatgtaagcagtctccgttagattagtcgtcgaagaattcggcacgagagcgaattcgctaaaactatagagaccaactcgcaggctcgcagccggcctctccgcctccggctctcccctcctcgagcgctttcggcaccgtagttcggtacgatggcagcggcggccccgacgagggcagaggtgctgtcgcttttccggtccttactccgcacggcgaagcagttctcggactacaacatccgcgagtacacacgccgacgcgccgcggacgccttccgcgaaaacagcgccctctccgacgcgccgtccgccgccgccttgtttgcggtggggaagcagcagctagaggttgcgaagcgacaagcggtgatttactcaatctacgcccccaaggccaagagcgtgatggagttgaaggtgcagtgatggacgaggtgctgcgcccttttcttcctcatcgttttcctttccgaattcgtttcttttctgtgacgatgaaactataaactgttgcattatcacgtttgctggatgattgtcatgatatagcttcttactgtgcaataaattactaaattttattgctaaaaaaaaaaaaaaaaaaatgcaacgcaatctgcttgagtgattgcgatttttgccttgcgctggtactcttctgccggctctgtttatttgttgtggttgtttgattgcaccctggacgcgactatgttagcacagtaccgaattggcacggttgaagtggggcactgagcctaaattgtagtgctcatcagctatttgatgaaatttcccccactaacacgcagatctcagttactctctctgtcccaattcccaaaaagatgcaattctagctttctaccaagtcaatctatctcaactttgaccaaatacatatatgtaaaaatattatttcagataccaaatagttattgtttgaatcatcatgaaatatattttcatagtatatatatatt

SEQ ID NO: 7620 - DNA, 1189 bp, Zea mays
ggtcacattgaaaggctggaaatcagctgagcctgctggattcataagaacaacacgttcaaaaatatcatagcgtcatcaggcctcaaaaagatcaggccagatattatacatacgctccacaagggagcattgtctgtagtagacaatccatatggaagccgacctactgcaacaaccaaacacaagagctcctcgtatggagcagttaaacgtactgcccctagacagattcacgggagatcattattggcctgtccgggaatcagcgagctaaaactagaccgacacgcatcacgcaaaaaggatagagccagccaactctccgatccagacgtccaggcaccgctttgctgtggtccagtactccgggacctcgaggcgagatcggcacggaatggcttgagctgccgctttgctgcaccatcagcttccttgtcttctggttgaacgcgtggcgcgtctcactggagctgctgagtcctctacaacggggtctctggttttccttgcccttgaccgcgacacgcctttgccaacaggttgtgtggattgaatctcttcgctgccaccttctgttcctgtaagtggggctgatgtctgagaattctccgtactagtatccgcactgtgctctggcgtgttccccctatattcggtgctgcggtccaccgaaggatctacaacaggatctctggttttctttgcccttaaccgtgacatgcctttgctaacaggttgtgcggattgaatctcttcaccgccaccttctgattctgtaagtggggctgttgtctgagaattctcagcactagtattgacactgcattctggcgtgttctccatatgttccgtgctgctatccacagaaggatcgactacctcgctagtttcatcttcagcagaattcccactgttctcactaacttccttagtaaccagaaattcatcaagcgaatcaattctctgtctgtgtgcctcagcattttttgttgtttcctcctgctctttcttttcctgatgaaccttgctaagtttctcctcaaattcctcaatgcaaatttttagctcaggtttcgcaaacttcttgcactttgatattacgcttctgaagtggttcatcaccggacccgcggataatgcatgttcaaacatcttaaaattggggggggggggcctacgtagctga

SEQ ID NO: 7621 - DNA, 2175 bp, Zea mays
gcacgagaccattacctagaacatcctaatcaaaagaatggctgattgccatgaccaccatgccatcttctttattaccgataaaaatcaatccggcccgaggaagcaaaaggcgacgggggaaagcaacggagacaagggcaacggaccagggctgagagcccttaaaaccaccacacctccactgcctcacggacgagaacgcaggaaggatggcggacggcaccgacgtgtcgccggagtcggaggcgacggcggcagccgggaagggcggggagatctggggaacgctggaggagctgctcctggcgtgcgccgtgacgcggcacggcacggcgagctgggactcggtggccatggaggtgcagacacggatccccgtggcggcgcggcccggcctaacgccgcacagctgccgcctccgcttccgccacctccaccgccgcttctccaccgtcggcagcggcggggtcgaggaggccgaggaggatcccgacgcctccgctgccgagggatgggtggacgagctccggcgactgcgcgtcgccgagctccgtcgcgacgtcgagcgatgcgatctctctatcgggacgctgcagtcaaaagtgaaacggctgaaagcggagcgggagcagagagcctccggcgaggctgtgagcgaccacgatcgcctctcaagcgaggagcccgggtgctcatgcagggagtcgaactccacagatctgaagccgcccaaacatcccagccagctaggcgacgggtctaaggaggagaaggttgcgaaacaggaagcgtccgttgagtcggcggtcgattccaaagacagcagcgaagtgcggagctcggcgagcttgtgccgccgccgccgtggaagcgggaacgctgaagaggaggaggcggcggaggcggaggcatccaagtcctctccgctcactttcctgctcgacgcggtcttggccaagctcggttgcgtgctggaccggctacgcgaaaacgacagcgaggaatctgccatgtaccggggcacgatcaggcgccatgtggacttggagactctgcggcgtcggctgaacgcgtcggccggctcgcgcgccgacgatgacagccactcctctgcgcacgagctctatcgcgacctgctgctgctctgcaccaacatcgtggtcttcttcccgggtggcacccccgagaactccgcggccgtcgaggcccgcgcgctcgtcaccgggcacgcatcggcggtgctccacaagccgaagcaggagaacgtggctgtggctgtggctgcgccggcaccggcaagcgccgacatcgttggttcgctgatcgagaaggggaagccgctgattgtgtgccgcaagcggagctccatcgcgaaggccgcagcgtctgcgagaaaggaggagagcacgatgaagggtgagacggcggaagagacggaggacgagaagaaatccgtggctgcggcgaccaaggacaagacgtggggggtgaggacgaagaagagccgcggtggcaagaactccgcgggtccaggccgaaacctagcggacggtgctgacgggccgaggaagggcgccggtgctggcactgacgggctcgccaagaagcggaacgccgtagacttcctaaagcgcctgaaccagtcgccccccaggaagcgggggtcggggtcccacctgggtacgacgcgaaagcggccggcggcgatggacgagcagacgactaaacgcaagagaggaaccggacggaaggagggcaccggacgcggtggatccaggaggggcggcaaggctgccggggcgaagagaggcgtcgggcggccgcagaaacgaggcctagcaccagccactccgccaccgtccaagaggaccaagacgaacagcagcaggtcggagaagtctttgggaacgggaaagcgtggcgggagaaggcaggtaggatgaggatgacggtggaaagacctcataagcggtgatagcaagtgaagccgtagtttcagtttcagctgtgtaaattacgtaggttgtggtaggtagaggagccgagcttacacgctgtttgtgcgacagacagatcttgtgtttctggttgtgtttgaactgatagctctggtcgtgcaacaaaaaaaaaaaaaaaagcaaaaggtaattttttcttaaaaaaaaaaaaaaa

SEQ ID NO: 7622 - DNA, 1282 bp, Zea mays
ataagaacaacacgttcaaaaatatcatagcgtcatcaggcctcaaaaagatcaggccagatattatacatacgctccacaagggaccaatgtctgtagtagacaatccatatgaaagccgagctactgcaacaaccaaatacaagagctcctcgtatggagcagtttaacgtactgcccctagacagattcacgggagatcattattggcctgtccgggaatcagcgagctaaaactagaccgacacgcatcacgcaaaaaggatagagccagccaactctccgatccagacgtccaggcaccgctttgctgtggtccagtactccgggacctcgaggcgagatcggcacggaatggcttgagctgccgctttgctgcaccatcagcttccttgtcttctggttgaacgcgtggcgcgtctcactggagctgctgagtcctctacaacaggatctctggttttctttgcccttaaccgtgacatgcctttgctaacaggttgtgcggattgaatctcttcaccgccaccttctgattctgtaagtggggctgttgtctgagaattctcagcactagtattgacactgcattctggcgtgttctccatatgttccgtgctgctatccacagaaggatcaactacctcgctagtttcatcttcagcagaattcccactgttctcactaacttccttagtaaccagaaattcatcaagcgaatcaattctctgtctgtgtgcctcagcattttttgttgtttcctcctgctctttcttttcctgatgaaccttgctaagtttctcctcaaattcctcaatgcaaatttttagctcaggtttcgcaaacttcttgcactttgatattacgcttctgaagtggttcatcacagaatcttcagataatgcatgttcaaacatcttaaaattatcaatgagttttttcaggcccttttcagtgaaggttagctgagaaaggcaataagaaatatactcccactgtctgacatcgtttactccagcaaacctattgcacagcttatccacaagagcttccatttgtttgtccttcttaattgagttgattaagaactgcataatattgcaaaatgtttcttctttgaggtgttgattgcatagtctacccaagatatccggaagaagattataaattgggttgcttcctttctttgacaactcgtgaaagaagagttgattgcatagtctacccaagatatccggaagaagattataaattgggttgctcctttctttgacaactcgtg

SEQ ID NO: 7623 - DNA, 2614 bp, Zea mays
ctcgaggccggccggggctgctttgtagaaggtggctggttaagaaatgcctttaggtggagagaatctattggtccatgggaagagagacctggacacttcggggatgtttggaattactggactgatgatggccttggatactatgaatttcttcagcttgcggaggacctgggtactgaaccaatctgggtattcaacaatggagtcagccaccctcgcgtccgtgatactgttgctattgctccttttgtaaaggatgtattggacagtatagaatttgcaagggggagtgcaaattcaacatggggctctgttagggctgcaatgggccaccctgcaaccattcccagtgaaatatgttgcaattggaaatgaagattgtgggaaaaaattttaccgcggtaactacctcaagttctacaatgctataagacaggcctatccagacattcaaatgatttcaaactgcgatggttcatctacaccacttgatcatcctgctgatttatacgacttccatgtctataatgattctaagactttgttcaacatgaagagcacatttgacagaacatctcgtagtggacccaaggcttttgtaagtgagtacgctgtttggagaggtgatgcaggtagaggaagtcttcttgcttcattggcagaagctgctttccttactggactggagaagaatagtgacattgtttccatggcaagttacgcgccactattcgtaaacgacaatgaccagacgtggaacccagacgcaatcgtcttcaactcctggcagcattacggcactcccagttactggatgcagacgcttttccgcgagtctagtggtgctatgttccatccaacgacaatcagctccagctactcaggttcacttgcagcgtctgcgattacctggcaggactccgagaacagcttcctaagagtaaaggtcataaacttcgggtcagatgctgtgaccctgacaatctccacaagtgggctccaggccagtatcaacgctctgggatcaaccgccactgttctcacatcagcagatgtgatggatgaaaactccttcagcaacccaaccaaggttgtgccggtaaagagcgatctgagcaatgctgcagagcagatgcaggtcacgctggctcctcgctccttcagctcgttcgatctcgccctggctcagtccaagcttgtagcggagatgtgagctaggctggtacactagtatacaatacaacgtgtgaagtgtggtacacaaataccagcaaccacaggggttgccaagctgttgttagcatcttgaacacatggctttgtattgtgtataatgacatgatgctgatactaatctctattatataaagcactagtttctaaaaaaaaaaaaaaaaaaaaaaacaaaacagaaccccgctaaaattatacacaaatggatattcaaactatggttgttgactctaaacccttattcgcgctcacctagcaaggtccaacatgcgagcaatctggcagtgaataaataaaaatcacatcaggttggtttgctttgcttgcgacgtcgacgccctaggagatagttttttttttttttttcagtttgtcattattattattattctgaaaaaggcagttccagactgccagtacaacaacattttctgcctacatactgcacgaagaagcctattcatctagcatacaccgtgcgcaacagcgcgacagcgagcttggcgagcttgaacacttgctggttctccgccatcaccggcgacgccaccttgctcctctggaacccgtcctcgcactcctcagcagctgacgcgacttcctccaagcacctggtggcctcacccttcctgacgccccggacggcagccgcgcagccagtctgcctccgttccatgtcgccgtacaacgcttgacaggaccggagacagcgcgtcgtggcctcgtcggcggagccgccgctcttccggagcaggccgttgatcttggccgccgtagcggtgaggttggccgcgaggaggtcagcggcaatggcggagtagacctggtagtcgaggcagtggtcgacgctccggccatcggagccgagtgccgccaggcagaactgcacgtcgaagaaccggctcccgccacccaccgtcttgcatacggggagtatgcatgggacattcgcgtgagcgccggcgaagaagagagccaagagcaagatggcattcgcggtggcggctgccatggccatttttctagtactatgtgagatggggatgggtggtagaaggattttatatagaaagactgacttcaattgtgtcagctgtcaactagaatttaatggtgcaattcactaattgcccatttatgagcacacatttttatatgcatttgatatctgaaaacaggggtcgatcgcaataggtggtagaaggcgttgaccagttggttagcatgcaacggtggaacggccacctgtaactgcctccggcagctcagcatgtggtcatagatgtacaaaatatgcaacaaacttagggcctgtttgtttaccccacagattatataatctggattaaataatcctaagagtcaaacaaacagtcca

SEQ ID NO: 7624 - DNA, 878 bp, Zea mays
ctgtgcggcgctcgagccggccgggttgcgtactcagctcaggcgagcagcggagccgagcagagcctcgagatcccgcccaccatttgccctccggccgacgcggagccgatcgcttcaccggcagcgaggacgatgggttccgtcgcggaggactccaccgcggcagcggcagcagcggcgtcggtagtgttccgctccaagctacccgacatcgagatcccgcggcacctctcgctgcaggcctactgcttcgagcggctccccgaggtgtcctcccgcccctgcctcatcgacgggcagacgggcgccgtgcacacctacgccgaggtggaccgcctgtcgcgctccgcggcggcggcgctgcgcgggctcggggtgggcaggggcgacgtggtgatggcgctgctccgcaactgccccgagttcgccttggtcttcctcggcgcggcgcggctgggcgccgccaccaccacggccaacccgttctacaccccgcacgagatccaccgccaggcggccgcggcgggggccagggtggtcgtcaccgaggcctgcgccgtcgacaaggtgcgcgggttcgccgccgagcgcggcgtgccggtggtcgccgtcgacggcgccttcgacgggtgtctggagctgcgggccctggtggacgccgccgagccgctcgccgccgacgaggaggtcggccccgacgacgtcgtcgcgctgccctactcctccggcaccaccgggatgcccaagggcgtcatgctcacgcatcgcagcctcgtcaccagcgtcgcgcagcaggtggacggcgagaaccccgaacctgtacttcagcaaggatgacgtggtgctgtgcgtgctgccgctgttccacatctact

SEQ ID NO: 7625 - DNA, 801 bp, Zea mays
gccggccggttcgggatgcactcccattcaccacccccaccaggccaccaccaagaagaaatctataagacgcggtccctctcaccaagtgcggagagttccaaggaaagaggccatggccaggaggtgctgcggtctgtcgacgcctgtaaacagctagctagaccgcgcgctatggccttgagagcggtcgtgtgtgcacagacgggcatgattttgtgaggggtgttataccagcgagcataataaagagggtcactgactggaaggagattaggagaaggactgcattgcagctctggtgaagtgcgagcaagatcttggagaggttgtggcatgtgggactgagggctgtaaacaaggcctccctccctggcagtgagaaatgttaaaggacggtagcaaggagaaatgttaaggcggagatgggtaagaagggaaattggttcactgcgctcaagaaggccttcacctcaagccccaaggagaagccaacaaatgtgcatcagctggtagcgcagtacccgtctactcacgcgcacggctgggagaagaagcgatggggaggcttcgggcggtcgcggccgcacgcggagccggcgtccccggcggcgggcgcgctgatcaacatcccgctgtaccgcgagccgagcagcatcgagaagatcctcggcgacgcggagatggaccagcagcgccagtactacgccgccaccagggcgcagtaccagatcacgcccgcgaggcccaccaccgccgtcgccggtagtgctgcttctgctgctgccgtgccgctgccgc

SEQ ID NO: 7626 - DNA, 1228 bp, Zea mays
cacatgaatgcatattgacaggaataccacaagcctaaatagtgctacgcgatagcgaattaaatacctagcggcggggcgttgaacaatttcatacggaggcactaattatcgatgtacgactaagcacaataattacgcttctctagcctattcaaaggtattttatataccacaaaacaatagtatatatatttattcacgctctactttcttttatgatttatttacagaatcatattactacatatatttttaccaaacatattttaaacaacatatcatcacaccaatcactggataagaaaatcgtcgatcatctcctacttcaacattatcgatcacaaacctagacaatactaactactagtgcaggacatcgacttcagcctacgtgcattgaacaccattagcattgatagagctatcgacaaaagcataaaatcctgaatttaacctacgcgtcaccaaaatactatattctacaaaatagaactagttcgaatatattcgaccactaaacccctcgaagcacacctcgcctcacgggtatttctaattttaacttcctacgcaaactaagcgtcttatttcacgatcataaaatccatattaaaaatagtgatttggctcaccgttatcaacttgattcagtgttggcgggaacgacgatagttcttcgattgaagtcttcgatcgagcagctgacgagtatagcacgaagcttcactttctcttctatccacaattcttggaatcttttcatattaagtagaactccgtataaacggtgatgattcttgttctggcctttcgccgaccacttgaacattgatcaaaggcttgcttctctatatcttcttgggattcttttgtcggcgtgaacccacgtcggagatgtcacgtagggactgacatcaagacgagacgacgaaaccatcgagtgcgctggagaacgacgacgggccaagcagaggagtttgcgcgcggccaacagatagcttgggcgcagggacttcacggcgcggtggagctgagcgcagaaatcaggggcgagcgccgagagcaagcttgagcaggagcttgcagccggcacaggagcttcgacaggctgggcagagggcgctcggccgtggatgaggcgaggagccgaggcgagctgcagtggcgcggcacaggaaaatggacagagcagaactgaagcaccactacgcgcagtgaagagcca

SEQ ID NO: 7627 - DNA, 1020 bp, Zea mays
actcctatgggcgacttgggttccctggcgccgccccggccccatccccatccccatccaagaaatactacgcccatcggatccaccgccgaggcaggcagaggagcacacaccccaggagctgaggaccggtttcgccatggccgccaagaagctggtgctcaagctggacctgcacgacgacaaggacaagcagaaggtgctcaaggcggtctccaccctccacggtatcgactccatctccgtggacatgaagggctcgaatctgacggtggtcggcctggcggaccccgtcgacgtcgtggccaggctgcgcaaggtcgccgccgccgaaatcgtctccgtcgggccagccaaggaggacaagaaggagggcgacaagaaggagggggacaagaagaaggacgacgagaagaagcagcaggtcctgtggtacccgcacccgtggcacgccgccgccgccgccgctgccgcagcgcagcagtaccacccccacccgtacccgccccagtacgccgtccacagcgccgaggaggaccccaactcctgcgccatctgctgatccgaatacccggtcccgtcttctttttgtacatctagctcgcctgcctacctacctacctacctacctacctcaggctcgatccaccacgtcgtcggtgatcgccgggataggggccagaccgccagagcggctgtgttggttgcctgctgctctgctcatctctatcctgcgggcgtgggcggtgggccgtggggttggtcgttggcccgtccacaggtcgttatacgatggctcgtgcaaaatcatacacgcgaccccacaaccatccaagagtagctagctgttggggtttttctcttttcaggctgttgttcatcagcgtcgttgtatagtgtgcagtgcatataatatatgtggtttgtgtccttgctatttaggtgtttgtggcacgaaactatatatagagagaaattttctctcgtttataaaggttaacctttttatgtaaaaaaaaa

SEQ ID NO: 7628 - DNA, 1078 bp, Zea mays
actcctaagggcgattgggtacctcgaggccggccggggccccatccccatccccatccccatccaagaaatactacgcccatcggatccaccgccgaggcaggcagaggagcacacaccccaggagctgaggaccggtttcgccatggccgccaagaagctggtgctcaagctggacctgcacgacgacaaggacaagcagaaggtgctcaaggcggtctccaccctccacggtatcgactccatctccgtggacatgaagggctcgaatctgacggtggtcggcctggcggaccccgtcgacgtcgtggccaggctgcgcaaggtcgccgccgccgaaatcgtctccgtcgggccagccaaggaggacaagaaggagggcgacaagaaggagggggacaagaagaagaaggacgacgagaagaagcagcaggtcctgtggtacccgcacccgtggcacgccgccgccgcagcgcagcagtaccacccccacccgtacccgccccagtacgccgtccacagcgccgaggaggaccccaactcctgcgccatctgctgatccgaatacccggtcccgtcttctttttgtacatctagctcgcctgcctacctacctacctacctacctacctacctcaggctcgatccaccacgtcgtcggtgatcgccgggataggggccagaccgccagagcggctgtgttggttgcctgctgctctgctcatctctatcctgcgggcgtgggcggtgggccgtggggttggtcgttggcccgtccacaggtcgttatacgatggctcgtgcaaaatcatacacgcgaccccccaaccataaccatccaagagtagctagctgttggggtttttcacttttcaggctgttgctcatcagtgtcgttgtatagtgtgcagtgcatataatatatgtggtttgtgtccttgctatttaggtgtttgtggcacgaaacatatatatatagagaaattttctctcgtttataaatgttaccttgttatgtaaatcatacgctttcacttcttttatttcaagtgcatattttttaaaaaaaaaaaaaaaa

SEQ ID NO: 7629 - DNA, 3566 bp, Zea mays
gcacgagggaaggaaggaaggcggttttttcggacgtggcgtgtccactcatcttctcacctctttcttcacgctgttttgtcctctccggcccgggcccggccccatccatctcggcatctcgctcgtcgtcctcctctcccctccataaaatccgatcggcagctcctggccgctgcccactcctccccgctctggctcttcctcgcgcctcgcgcgcccacccaccttcacgcgctctcccagctagatcgaccccactggcaatcgcgcaggctcccctatcccttcctgttccttcaaaaagactggactggatcttcccagagttcccgttcggagagccgccggatcttcttcgacgaggcttcgatctgctgctctccgtcggcgtgttggggacttgcaccttatccgaagatgtcttttcggagcatggttcgtgatataagggaaagttttgggaatatatcgaggcggaactttgaggtgagaattcaccacagagggaagtctcttgggtcttcaggtgacttgcaagacaggcctgctgaagttcagcaaagcaggtgggctagccttcctcctgagttgctctgcgatgtgatgaaaaggttggaggaagatgacagtagctggccggatcgcaaggatgttgtttcctgtgcatctgtttgtacaacctggagggatatgtgtaaggatattgttagaagtccagaacattgtgcaaagctcacatttccagtatctcttaagcagcctggaccccgagacggggtaatccaatgtttcataaaaagggacaaatcaaagctaacgtaccggctctacttgtcccttagctctggtgtgcttgatgagaacgggaagttcctgctagcagcgaaaaggagccgcaggatggcgcacacggagtatgcaatttttatggactcgaggaatttctcccgatcgagcactggctacattgggaagctaaggtcaaatttccttggaactaaatttatcatctacgacacacaggctccgtacaatggcgggagagtttgcacacaggaacgtgcccccagccgtcggttgtcttccaggaaagtttcaccaagagttccaagcggcagctaccccgtcgctcaggtgaactacgagctgaatgtgctgggaacccgagggcccaggcggatgcagtgcgctatgcattccatccccgcatcagcggtggagcccggcggcgtggtgcctgggcaaccgaaagagctcctcccgaggctgttcgacgagtccttccgcagcaccgcaacttcctctttctccaagtactccgtcgcggacagctccatggacctgggcagctgcccgttctccgaggtcgaggtgggcgggggaagtctgcgagaaggtgacgagtcggagaaggagaggccactggttctgcgcaacaaggcgccgaggtggcacgagcagctgcagtgctggtgcctcaactttcgcgggcgcgtcaccgtggcctcggtcaagaacttccagctgatagctcctgcaaagacgcagccgcagccgcaggcctccggccccccgccgccgccgccgccgtcgtcgtcgtcgtaccatgacccggtgatcctgcagttcggcaaggtcgggagggacatgttcaccatggactaccggtacccgctgtcggccttccaggccttcgccatatgtctgacgagcttcgacaccaagctggcctgtgaatgaatgaatgaatgaatgaatgaacgaacgaacggtgagagagtcgttcgttttatgtgttccaaagtgataagcattctgagccttggcatgtaaataatttaagaagtaggtgtttgattcaagtattgtattgtttcgtgagacaagacaatgttgcttctgaaacctaaaagtgtttcttggtcagtgaagcaaatctactaaactagctgcctgcaattatttattcttgtcctgtttaattttcagttcagtgagaggattaggattattttagtgtatacctgcactgcagtatgcacatagcaggcttgcagatgtaacctgtaggcgaaggaagatgatcggacacatacatggcaagtgagccctgctagatggacctacacgatccgtagtgtttctgcaggtgcacgattcatatagtaccgatacgatataggcctagtgctgtgtttggttcaccagtcccacaagataggctagcacgagcacggtacaatacgattaaatggtccgcacgattagatacaacttagattactcatgggtatatatatgattgtggtgtgtatatgtgattgtaaattgttataattttaaacataataaattcacgatataatatatatatatatatataaagatcttttatatttttttgatattttaaactaaaatagtgatattacgtattatagtgtagtgtcaatagtgcggacacgacatgattattaatagtgtcgtgtttaatagtaccatgtctaatcatgctattcagggacgtctacccatttagctatctatacatacacattccatctgagccgcacctgtcagagctgacccagcaccgattccctttgtcctgtcaaggaagctgcattcagcaaccaagccaatcaaacgtcacgagacttttgacttggtttacacgatcggaaagaaaaaatttcggcccgcagcgaaaaacaggaaatttccgaaatttcggaaattctaattcaaaaatcaaatagatttaatttttttaaaacaaaaataatataatttatattaaaaacgccaatttcggaaacatatgtattttcggaccccaccgaaatcaagtaaatttcgaaaattcctgtacgaaattgtaaagccctcgcccgaggtgcgggaggcagcaaagaacctcgtgcacctgtgtcactccatcaaggaagggctccacccgctggagcgccagagtccgggagatgttccactggattgtgcacacccgcaccgaaatccttgactgcttgatggtccttaattaagtttagttaaaaaatgaatagaaatataattcgattctaatcgatttgattcttaaattttgtagtgtaaaatctagatattgcaagcccgttcatgatgtcgcttcacgaagcatttttgtcaaatgctgcagtggtagattttatctgcattagcaactactgcaccatatacatgtgtcttcattagaccaactccagcagtgtgcctctccgtatccctaaaacgcgcggccgacacattctctctcctctccgtatccggctccgtttccagcaacactccccatcccactccgcatgcagtctatgacacctgggccccgccagcaggcgcgcgcgcacgcagagagttgcggagaggagagagaaagtgtggaaatggggagcgcagggacacggcgtccattttgcggagagtgatacggagtctgctggagcgcgcaacagtgcctcagaccgcgcaaaatggggatgcggagtcggatacggagtcttgctggagttggtcttagaggc

SEQ ID NO: 7630 - DNA, 1336 bp, Zea mays
cggccggcgcgacgcaacttcccattccgatccacatcagccccgtcgctgtctctccaggatctggagaccctacccgcctgagccctcagccggccgcgcggtgcggcaccgcaccaccgccaccgagccacgaacccgccggagtaccgacccgcctgcgccctccgctggccgtgcggcgtggcagcgcaccacctacggcgggctgcggcaccgccccggccctcgcaccagttccgcggcgacgtggtccagcagcaccgccaggccgcctacggccatttcactcgcggcttctgagcatctacctgcacttcttcaattacctgcagctttcatcgtatttcctttgcattgcataccgtgcagccacctctgcacatgatgtttcggatgttatcttattattaaaaaactagatttactcatgtttttcttcctctgtcattattgctgatttggtaactaatctttctgtggggtttatgcactgttaatttttccctgtcattttaggtctaatttgtattcgacactctcatcgtagtaactgcctcataggttttgtgccctctgtatacatctctatcggctccatgtccaaggcactgcaccacccttttgttatcaggttttaaacccgcttttggatatgtacacatggatcagtttgtgggagtggaaattagagcagatttctgtgcttttttttttccagcacatctgccagactagtatcatcagcaattgtccatcgcagcacagatctctttctcatcgtcaatggaggtgggtatagtaccagacaacatggcaacgacagacatgccaagctccggcatcctgctgacgcctgctggggccatcagcctgttctcgtcgggtcctccgctccagatgccgcttcacttggcctccatggacagggaggctagggtgctgaggtacagggagaagaagaagagcaggaagtttgagaagaccatacggtatgccacgaggaagacgtacgcagaagcacggccgaggatcaagggacgcttcgcgaaaagatcgtctgatatggatgtcgaagtggatcagatgttctcagctgcggctctgtcgtctgatggtagctatggtaccgttccatggttctgaaggaactttagtgagacattacttatgtatcatacagtataataattgtaacatgcgttgaccatatatagtggtaaggtcaagtacaagtagttctaggaaaccgatggtaatgagtgatattgtgtttgttttgaaagataaatgaacaaatatcttagcatttgagttttggtttgtaattgcatgc

SEQ ID NO: 7631 - DNA, 1304 bp, Zea mays
  misc_feature (883)..(883): n is a, c, g, or t
ctgttaaaaaaaagatcgcggctttttccatgtgcagcagaattaacgtccataaattaaacctcgtctactacatatcattgcagggtctatgacacctgcaacccccttacgattcgcatatttcagtgaccatttgccgattccatctcagatctctttctcatcgtcaatggaggtgggtatagtaccagacaacatggcaacgacagacatgccaagctccggcatcctgctgacgcctgctggggccatcagcctgttctcgtcgggtcctccgctccagatgccgcttcacttggcctccatggacagggaggccagggtgctgaggtacagggagaagaagaagagcaggaagtttgagaagaccatacggtatgcaacgaggaagacgtacgcagaagcacggccgaggatcaagggacgcttcgcgaaaagatcgtctgatatggatgtcgaagtggatcagatgttctcagctgcggctctgtcgtctgatggtagctatggtaccgttccatggttctgaaggaactttagtgagacattatatgtatcatacagtataataattgtaacatgcgttgaccatatatagtggtaaggtcaagtacaagtagttctaggaaaccgatggtaatgagtgatattgtgtttgttttgaaagataaatgaacaaatatcttagcatttgagttttggtttgtaattgcatgcacatatcaggtctatacagaattttcagtcacttaaacatttttcactgaacagatgattctttgttgccatggattagcaacagcatatagcagtataatgctatgggacagagacatgatttcgtgattcggaacactagcatggatgtctcagttgtacnatgagtggtcactgatcatcagcaccatctgatgtactctcttgatttttatgtctgtttaaatgaatgatgataaatatagacatgtatataaaacaaatacattaattattctaaaatgaattttaaaatttgaaagtacctagaccattaatatattcaaaaagcacctcacattgtttcccgaagaaacgagagaatatatgagaaagcgctttctcatgctctgtgcattatatattcctctttaactagcaaatagtgcacgaatcctggcgactttatttctcgagtgctacgggtggaatggaatgttcaccaaatatctgaggcatctcgggacactgatcgcttatacagcttatcatctctggctaaacttagatgttcgtgaccacagatctagggcactaacgaatca

SEQ ID NO: 7632 - DNA, 669 bp, Zea mays
ctataataggtctctcttagcggttgctctcgccagtagttgattgtctaggtggtttagagggtgaggcgaaggtagaggccttcactcaaaggtgcgagtgttggagtggtcgtaattgttaccacttttggcgtgagtttagtagttagcttcttcttcgtgtatttttttatggtccatgtttgtcttgcagaagtttttgcaggtcttcataaagttcttatagtgttgcttgttggttctcgagcacagtgtgatgtgcatttgtcccatatgagaccttttgatggttgctatgatggccacgtcatcttgtacatcgggtacttgcgctttgatttgaatgaacgtttgttcctggccgacgatcgggtagagaagacaacttgacgcctaacaccatctcattgttaccggcgacatgaaccgtccacgtgacaaggcgacagatgagccatggcaatgagattgaagacggcaatgaagtgatcgagcatccatgtagagtgcttcccaaaacctttatttaccctctcctgatacaagatctctgggggcaatagttttggagacctgctctcttgtttgtcggtgcacgcgaacgattaggaagaagtatcatacgcccgacgctgtaggcaggaagcagggacgaaactagatcta

SEQ ID NO: 7633 - DNA, 1533 bp, Zea mays
  misc_feature (6)..(6): n is a, c, g, or t
tcttgncgcgtgggcggccgcgtgggcggggggggccgggcccgcttgggcgggcgcgtggggcgggggcaatggatcgctatgggacagataggcctgatctccggttcgattgggagctgaaagagttagtgatgtatttttggggagtagcttcaaggtttttgctgatacatggggaagtggaggcgtaataaaggcgctgggtgttcctggtggtgccactgttttttcaaacactgacctgaagaaaggaactgtttacactgaagcttccaaagctggagccaagggcttgcctttcctcaaagttatggagaatggggagcttgaaggaatcggtccactgttatcgagtctgaaacctgaaaagaaagaccagctcatggaacttctggacacaaagacgggtgaccttatcctgtttgcactgggtgaacaatcatcagctaatcagattcttggacggttaagattatttattgctcataagctagaggtgatagacacgtctgcacattcagttctttgggtgacagattttccaatgtttcaatggaacagtgatgagcaaagatacgaggccctacatcatcctttcactgcaccaaatcccgaggatatggacgatctaccatcagctcgtgctctggcttatgacatgatttacaatggtgtggagattggagggggaagtttgagaatctacaaaagtgatgtacaacaaagaatttttgagatcattggtatctcgcctgaacaggcagaggagaaatttggctaccttttagaatgcttcgacatgggtgctcctccacatggaggcattgcctatggattggatcggttggtgatgcttttggcgggtgagagctcgatccgagatgtgattgctttccccaagaccacgactgctcagtgtgcactcaccaaagcaccatcagctgtagaaccacagcaactgaaggatctcgccttccccaaacctacttcgtgagacgctgttcaagtgttcatgacaaaaattccgtgctctcaaggacagctatagtttgcttctagttttcgagtgtattggcctattctatttttgcatagtatagaatgcgcagtttttggaccgtaataaatttatagaagatgcttaacacgccaaagttctggaagagcattgttttaattttgccgtagcgaaaatcataagtagtgctcagaagattgggaaggagtaggcccggtttatcttgttcattcatgattccccttgtggagtgaagtggaatgctaaagatagaaaagtgccccgtaggatctcgtcttagcccattgacaaaactagtccaagaaacccagattgctaagtctcgagtatgtcaatcaagccctaatgtttccattccgccggaccaactagcctaacctttcatagaatttatcatttatgcccaagggacaagaggttttgaactctctagtagttccaagtatgctcatttccttggatgtgtattcactaatgttgtgactggaagg

SEQ ID NO: 7634 - DNA, 3379 bp, Zea mays
  misc_feature (2118)..(2118): n is a, c, g, or t
aggagcagagcaaacgccgttagattaccgggctcgcttcgaatccttttcaccgtccgattcaaatccgtccgttggccgttacgcatcgcgacgtcgcaacgccggccgcaccacaccactacaccagccagccgtttcccactccccccccccccccggtgaccccgtccacgtaaaaacacggaacaggggatagagaaagagacacggctcgaatttcgaatccgccgaggcaaaccgccgccccattcccagtccccataaaaccaccgggtcaaagcgccgtactcccactgatccgcgggcccactgactctcgacctccccacatgccatacagctggagaaaaacgacaagcgcaggcgggtacggcagcctgaggtggctccgggcctcgcgacgcggctgttgggtgccagctgtgttgccggtcaggtgatcaggtcaccgcccgccgcgccgctataagtacggacccgccgctccaccgtcactattgctctccaaccaaacctcgtctcgtcttctctccgctaccaccaccactgctcgttttacagaaaccggaaggaaccaaacgcctttccgccccgggccgccgctacccaagcccagcaaccaccactcgttgtcgtcgactactaggcggcaagcaggcgtcctgttttttttttttggtcctcgtcgtcgtccggactccggacaggacaggacatgggcgcggaggcggcggagcgcgacagaatcaggggcccgtggagccccgaggaggacgaggcgctgcggcggctggtggagcggcacggcgcgcgcaactggacggcgatcgggcgcggcgtcccgggccggtcgggcaagtcgtgccgcctgcggtggtgcaaccagctgtcgccaagggtggcgcgccgccccttcacggccgacgaggacgcggccatcgcccgcgcccacgcccgcctcggcaaccgctgggccgccatcgcgcgcctgctccccggccgcaccgacaacgccgtcaagaaccactggaactgctccctcaagcgcaagctcggcgccgccgccgccgcgtccggttcggcggtttccgctgacgactccgccgccgccgccgagaccgaggcgcgccggggcaagatgatgatgatgagcatctcgccgcccgacagcccctcggggtcggggtcggggtccgaccgtagcgacctcagcagccacggcgccgggtccgggtccgggtccgggtccggccagatttaccgccccgtggccgcgcgctccggcgggttcgagccggcggactgcgccatgagccgtccgcaggaggaggacccgctcaccgccctcagcctctcgcttcccggcacggaccagcggtttcaccaccacagcgccgccgccgacagccacttccaggagctcccgccgtcgccctcctcacccgcgccctcggcctacccgttcagccccgagttcgcggcggcgatgcagcagctgatccgcaccgaggtgcagcggtacatggcgagcgcgggcctgcgcgccggctgcggcgccgttggcgcgaccgacctctgcatgccgcagctggtggacggcgtcatgcgcgctgccgccgaacaggtcggccggatgcagtagccccgcgcccccggcgggggcatcaaaccgtcagtgctcccaaatcgtcgtctagctagggcgaccgcaacgcaacggttgttggagtagcaaacttggttttaaggtggagggaaaaattggctgggctgaaagcagaaagccttgtaatgtacatgaaagaaacggaacggatggcgcgctacaatctgagctcgccattgccgcatatatctgctttaagagagcattgcgctgccttgcctaatcgaaacgaaacgacacgaaatgttgcctgcaagtttttgaacgtgtgggtgagtaaatcgcacggttgggtaccagtactgcgaggaaataataatgcagccagccagtcagtgcaaatccggcgccttccattttccaacgaacccaccacatcccgcaagccgacgacgatctagatcgcagcaccaacgcattttggcgccgagttgctgtcgcgtgacacncatcttggcagcagcaccaacgccggcactcctcctccaaatccggcgccagaacaaccgtacttccacgcggcggcaagcatctataggtgccgtgccgagctccatttgacaggtgagtggacaggagacatcgagtagacgcgagtagtacgacgacggatcgaccatcggtggattcgttggtgaccgatctggtcctctcgagtctcgacccactgtgtcgtgcgcggaaagagagttgctgctaaacgacaggcgtctgaggttagtttgtttttttaacttttagacgatacataatttattcatctaatgcgaataatacgtcgttcaaaattcgaatattttttttagaaaaaaatctttaggaccgaacgtctttccctcttttgagtcttttctcctgcaggtctatcttcgtttttttgcagacgcatgtggcgctcgaaaaaggtactacgcgtgtggagtggagccaagtcgaaagcgtggtgctggggtctggcacttctgcttgtcggcaggccagaaatggacaagggaggggatctggttgctcgtgtcttgtcacctgatcttttcgctgcagaggcctgggcatgccgctcaaggcccctggcctcaagcacccagcttccgccaagaatttggccattcgtcactggcggttggctaagctatgttctcgggtttggcggatcctcttttatcaagaaagtctaccattgagacagttagatctgagaaagggcgtggcaccaccaccacgacgacgacgacggtggagactgttagctttaaatagtacagatacagaagaagagatatgtgttcaactgaaatgaactggactaacataaaacgacgaggctagtacaatataaaagcaagtttggcccaacagtagcccactattaaaaagcagcaaaacgccggcgactgaactgttgtatggcgggaaggcaatttgacccaacaacagcccaatacaagcacacgaagagtgatgggaaatgatcgcatgggccgggttgctaccattcggacgaggggctcgtcctagtttgggagtcacaaaagtgtaggaaattgtcacaaaagtgtaggaaattgaagcgtttaaaatcctctttttatttaattttaaataagtagtagattttaacctttctaagagcaactccaaaagaatgctaaaaatgtttccttaaaaatgattattaggggtaatctaaaatatcttagaagcgaattatag

SEQ ID NO: 7635 - DNA, 4700 bp, Zea mays
  misc_feature (1291)..(1291): n is a, c, g, or t
  misc_feature (1936)..(1936): n is a, c, g, or t
  misc_feature (2264)..(2264): n is a, c, g, or t
tggcgcgtttgctcgggggcatgagacttgctctgcttcatcgagtatctctgcatcacaagactgttcaagttcttcttggctgtcatactcgtcctcgtcggtgagtcgccaacacccctacattttccataatggagttgtgtgagaggaacaggacgacgcatgcgttctttcctctctctctctctatatatatctttctaaaaaatgcatgtgttctcaagttgtaacccccctccaccaactccgagcagtgctctacgcctgttatatcctatgccggccgggcgtccggccgggagtctgccgccaagaactcctgcaaggcacgaggcatgcccttctggggctgctgccgcgtgctctgccacctctggcgcaaggtgcgagacaccgagcgagtgtaccgcggccggcgccagcccggcgacatcgaggcgggggatctcagcacgagaagctatggctacagtggctcgtcgtcgccgtcctcctcctccgattacagtggccaccgtgggcgcgccgtagcggccaggtccaaatgggactcgtcgtcgtcggcgcgggagaggaggaaggacaggcttcggcagtccctgcgcacgaggagggccaactccaaggtggagcacgccatgagaatgagccgtgagagtgaaagagaacgccggcacccccatcatccccattcgatcggggccaggaggaaggaggcttcgtcccttcacgaacatggctcggcacctcgtgaccatgctcatgcgcaccgccgtacatgaaaggcaacctttgccgattccgcctgacattggcactgctagtgtacagtagagtacctgtagtaagtttgtatcccatcaattgattatatccttacacagggatcatacaaaaataatactttgattttggtagcgcatttagtacggcctgctagaatatttctatgaatttgatcagaattaaacaagcttgacctacaacaccaaaacatcctaaatttaaaacaaaggagatactccctccgtcttaaaaataaacacacatctcattcccaaagagtcagagtttttttagtttgactgggatcatagaaaataatatcaacatatatatcttcaaacgggtttaatatgaaattacattccatgcttagtctgatatttgatcaaactataaaaaggtttaaatccttcgaaagttagatatgcatttattttagaaagggtaaagcatattaaaatctaaagtatgaaatagatacactataaaaatattttatatngtcttacttgatgttatagatatttatgcattttatataaacttgatcaagaataggcaagtttgatttagaaaaaacatgccaatttttaaaaatggagggcgtaatatactaagggcatattggatcgcatatggattattataacaaaactaataataatctaagttttttagctcctaggttgaaacctcctatcaagcgggtcaacaaagtgaagcatttgaaatacataacttgtgagatgtattactgaaggctaagttttcaagcaatggaatatgttaaagggccaatcaaccattgatatggatccaactgaaaggcatacccatgtcaaggccataaatatggttgaaaaagagcttggtttggtcaatgacaaataagaggaaccgaaagtggaatggaaagaagaggatgagatcgaggactatgattagttttatgtacattttaaaactatcatgtacttttatttttaattattatacacattgtaattttcaaaaaaaatatagtatgtcgtgtgatttctaagcgttgcaacaaatatgcgaaaattacttaattctgaaatacaaaagctgatatgcccctgggttaatgctatagactggtgcatgctttgcactaaaacagtanggccgagagtggagtcgatagctgacatgatagaggcaagaggagatggagtgcactagcctttaggctgtctccaacaattactctatctcatctcatattctaaactttggaaacagcgttatctataatgtaaatttcttattttacatgatatgttgtggacaaactttgtacggatcagaaataacgcatgctccgtttggatgtcgatattagagggcatgaaattgaattggtccaatatcaaatcaaccatagtattgaaatgagatgtaaatacaattttattgtttggatgtcacgaaattatagtttagactaaagntaagagttacaagtcgaacactgtactatcagaaaaagagtaacaaactactaccgtcttccatgtttcgctttattttgcttatagtatgaatggcttgccaaactatacaaagggattgatttctatcccggtggttcctacaaattgctaactaacaaagaacgctggaattccctcacagaagcttataataccattggaacaaaaaaaaaaacatcctccgatgcatatcaggtacgcatccttaatttgctttccaggttattctgttgatgcagattcggaggacccagacagtgaaaacctattgaatcaaggaatttgtaaatactcgtcaaatatgcatcattgagttgtttctcagcattcttttgctattgatgccgacctggtcacctgggggtgccaactactgaaaaaatccattggcaactgccaagcgtgtactgacacggctggttcatgatcaactactccggtccaaatagtaatcatgtattgacagccggtcaaaagcatcaaaatttgccttcaaaccaacaaactgacttccaagctgtgcacacggagcatctggccatctgcacccttctcttgtgcggaaggggcagagtgattcgcaaaaatggtccgccggtgcatccgaggccaagccacgagacaccccactcgagacagctccgattcttcaccagcgagactcccaaaaccttgatcctctgtcctgcccccgccagcagtagcgacaccttcaggaagggagtgacgtcggggacgccaccgccgtcggtccgaaatggacggggctttcgcccatggaaggcagtgctgagaagcacgacgccctcaacaggggaagcgacgcccaggggcgtcaccgtcgtcaaggcttttgcccaagaaaaccccagcacaatgccaagcgagggccccgggacaaaagcaagctacctccgccgccgccgccctgacgcacaaaccccgcagctaccgccggggccactgctgcccacttgttgttgccacacaccaccaccggggagccagatccgacggtcggcctcgccgtacccacaaagaggccacagcacacctcacctcctccgctcctcactgccgcaccaccatggggagctcgcccgccggcgctccacaaccagcatcggcctcagggacggcaaatccggccaccggacctccagatctgactgccgccccaaggccaatctgctgcggccaccgaccgccccgacttgggccaccggcagcggccaactccatgccccacgaacagaggcagcttcgacgctcgcgcgggcccacagcccacggagcatgcgcgccaccggatctggttccaagcgcggcggccaagccaagcaggggacgcggggggcgaggtcccgcggccatggccccgctgccgccatcctcgcatctgcacggactcccggctgtctgctctggcgacggcgaggctggaggaaggaggaagcggcgggtgttgtggtggtggcggagtcgccgcccgccccacccgcggagttgcagcattctccctttgagcacttcgggctgtgactagagctatactattaatacgtttctccctctgcaggtattgtttcatagattccaatttcaatttgatatcttttgccctccacttagcaatatcctttgcatgtccattccatggtaaaaaggaaaaatataaggcatatctgatacacataggccattttgaactgaatgttataatagttctctcctatgttagttaagcttcaaccaagaatttgctttgtccttcaatcttgtttaatagaagtttctaaacaactaccaaatttaacaaataatatatggccttgtgtaccacaataaaatggtcacaacaaaataaataaaatgcaatgctataaataattaccttcgttgtatctgcatattttttattcatagcatgccactgggattcaagatcacacctttgggctgattggttggccggctgtgcgaagccgggcaggcgcgagcctggccagccgcatacgcagatttcgggcgtaccggcggatatagaaaaatagcagtaaaataaattattttgtatctactcgtgcagctcacgtctgtcacatacaggtaaccaaacaggtgcttgcataaagtcaatgcatacaatagctcaggatcaaatggtgcaggtaaccaatcacatggcttgtgactcaatggggcatgtccacctcaaaaaaaaactagggccagagtgttgggacaagtgctgcagcagggggcaatagtgcaccattatggattatagtgctcatggaagctgccgccagaagctctcagattagccaaatgtgaccacatgcaacgacaggagattgtgacaccagattgctccctttctcgttcacttcc

SEQ ID NO: 7636 - DNA, 3823 bp, Zea mays
gctttaaaagggctggatataatgaatatcaagtcatttctcattcaatatatttgcaagcgatggacccgagaagctcatagtgaaactgtacaaaacaatcaaggtcaaaacacataatagagaatccaagattagattgtatgattcgttgcaaatatatgactcgcaagtttctcaatttagcatagagttgctagctatgcaagctacaccttatttttttgaacataatggcaggagctctgcctctcaattaagaagaatagaattgatccagttttaaggaaaaccggacccaaaacctacacagggcgcacggtagaaaaaccggtgaaggccctaacaaaccacctagacaacagcagcctcacacacacaaacacatctagagtcattgttgccaagctcaaacacaagggacgagcagctccgactccccaagacgagccgcacactgccaaagcaactcgacgacgcctaaatccagacaccgacgcaaggaataagatcacggcgcgccatcgttgccaagcctcgcacaccccacacgaggcagctccgattcttcgccacgagcaaagatccacaacgccgaactccgggagaaaacagacgcctaaagcgacaatggccccgacaccaccgagccaagcggagtgacaaagagcctccacaacgccgacgaacacacaaactagaggtcttctgggccgcgccttcaagaaggagagacgacagtcgaaaagtcgtcgccgcccgcctggtaccaaccaagcaaagtttcctccgaagacctcctgtcgtccgccgacccaccaacccagcagccccaaccttcagagccccaacgtcggacgagcaccagcgaaagtccccaagaaggccgaggcgagggttcccgcattgtggtgagaggtccaaggacagcaccctcaatagggcaggggtggcgcccgcgggcgtcaccgctgtccgcccgcaagcgggcatggctttcgccagaggccctcccaccacacgccccaacgcacggagctagccgcccctgcagaaggcgccgcagacagctgcagatccggcgacggccaacgccccaaccaaggcaagtacaggcaagccacgccgccaccacagcgggccagccgcacgcgtgggtgccgacgccgcagaccagctacgaccacgcgagcgcgcaggcaccgccgcagcagccgcaaggccacccgcccaagccagcaacagggaggagcggcggaaggcgaccagccccccagatccgggcagacagcccgcagatccgaccaacccaacgcagatcaagacgccgaccacctcatcgtagacgcagacgagtggaggtcccgccaccgccaatccggtcgactgcgcaggcccaccgacgcaccacgccgaacaccaccccggcacatgcccgggaccagcctgtcgacgcctccgaaggctggcacgcggaggccgcgaaccccacgcgcactagattccagacctccacgcgcggcgccgctccctgccctgggggcgccagacagcaccttctccgcgcctgcgacccacggccggccgcatgcccccctgctgcgcgaacacccatccaggacccgcaacgcccggatgtgccatacgaacgtcgcgctcactgccgccaggatgccgccgaggctgagccgcgccggcgaagggtcgccgccccacacacgccgctgccacctcctggaacccgactagatccgggcagacgcgaccaaaccagagaaaaatcgcctcgccgccaccttccttggggccgcgcggacatccggcggcgccctctggtgacggcgaggtgggatggagtggagggagggggcggcggcgctagggtttcggccgcccgtgtagtaagttgacatccttagcaagcaagttgaggaagaaatcaataattgtagtagtacagtggatccaatcacttctccctcgaatgtcactctcccatgtaatttggttagtacaacacaactaaagaagaaggaggtggagacaaaaagctcaaagcggaaaaaagttaggttgaaaagatgcataagggctaaaaagggacataagaaaaggggaaaatgttcagtggtacgtcgcagactagaataatttgattgattttaattgtattagtgtctaattgtattacttatttcattctcttttataagaaggaacaaaaagctacaacggtgccattcggtgagagtgttccagcagtccaaaatatgtcccctagtacaacaactgtgcaattcgaagatggtgctgtagcagtccctagtactttttgctagaaggaaggggtgcctgaacatgtatggccatccataaattttctcggttgttgatggtaatatttaacaacgatgacataattattcagatgatatttcataataaaaagaattcaattgttgttctttcctcttgtagggaccaatcacctatgatcttactgctgaattttagtttaaaatcagcacagtttgtttttttgtacaacctcggatgtttgtctttgcagatggagaacaatataagcttttgtgttgcctttccactcgcagatggggaatagtatgagcttttgggtagcctctaaattatggatagcttttggttttttgtggctgaagtgtaaagccacttgagtgtttggttttctcaactgccatcactgagatgagatcatcaatatcagttgtataaattggagcatggtcattctggaatcaatactatctgaaacttgttcgctaatttcattcatatttcacaaactggtacaaacatcacaatagcaccagaatatcagtctagaattgatccacaatcatcatactcgatattgatccacaatctcaatctagaattgtttcctatctaatcagaatacatgtctctgtcgccctcctatgaagcaggtagagagcttcgtggctgtgctctcttgagtaaggtctgacggctctgcagctagtttgggcgtcaggggcatccaccgtattcgtgaggaagtcgagatctcacaacggaccgtcgctcgagcactccatggaggcagtctgcagatgaacgaagaacagtcatgcctgctttcggggggaaaaaaaaagaacagacatgccgacggtactgcgagacatggctgtcgctcttggacgggtcccgcagcatccgacatggtgatgccagaccgctatggcagcagttggcgacggggaagggaccttgggcggaagacgacggttaaggcgaaggagcgagtcgcctgcttgccatggcgatggaagcggcggccggcagaggatctcatcccgtagaagcgaaggaccgatgggaattagatgggccacctgtcccggcccatgagcgagtcatcgttggatttaaacgcatggtgcatggttaggatgagacgactgcatagacacgttagcttagacaaagtgtaacacaataaatatatatcatcatcagtttataaatatatagaataaaaaaaagtctaaatatttggtttgaatcggtaagcaggttcccgaatgacgtgccagccacagctagcccctttggtacccagattgacggccgtttgtacagtagtagaatcacttatgagactttaagaatttcgtcgttgaagcaagccttgttgtgacgtttgacattttagattttgagacgtgagactagaaagaaatgttaagactagaaactctgtttctcctggtgccaaaactaaataaatttgaagactgaacattcaaatcctgcg

SEQ ID NO: 7637 - DNA, 951 bp, Zea mays
  misc_feature (37)..(37): n is a, c, g, or t
ctgtccccggcagcttgagcgggaacgccagcatggnccgcgtcacggccagcacgtcgctctgcagccgcctcctcacatcgggccgcagcgtcctcccgatgagcatgtcgcagatggcctcgaatgttaggtccagcgcggcgtcgagcaccaccacggcccccagtgctgctgctccagtcgcgcttcatgagcctccgcgtgaggccgtcgaaggtggcggccagagacgccgtggcctgcgcgttgaagaggggcgccacggcgcgccgccagggcgcggtgggtggcgtgggaggcgcaaagcaggctgtgctcgccgaggagctccgccacggtgcgcacgtagcgcttcgagaagccggctggctcggcgcccaggagcgacctggcggcgtcggccgacgacacgaacacgtgggtggcgcccaagagcgaggtgcggaagcaggggccgggaccgtacctgcggtggcgagcctccacgaagtggtagaagcccctgccgctgctgttggcggacaggaaggccagcgtctccacgacggaccaccaccagcggctaccccttcccggtggtggtggtggtgctgctgctgctgcatcatcattcttcaccctcctcctcctcccttggaatttgatcaatcgtctgatgatcacgacgcagtagatgatggccgctgctaagaaaaagaagatgatgctgctgctgctgctgcggctttggcaggccggtggtgcttggagttggcggtgcatgtcgtccatggatggaaggaggagggataggagtcataggacagctcctgcccgtccccgacgcacccctgtaaaagagaagaagatgagcccgtcgtcggtcacattcgcaatcactcactccacttgccatcgcaatgcaacaggagcagccaccagctccggccggcctcgaggtacccaatg

SEQ ID NO: 7638 - DNA, 2638 bp, Zea mays
  misc_feature (1088)..(1089): n is a, c, g, or t
ctgcagaaggcgccgcagatccggcgacggccaacgccccgaccaaggcaagtacaggcaagccacgcaaccaccacagcgggccagccgcacgcgtgtgtgccgacgccgcagaccagctacggccacgcgagcgcgcgggcaccgccgctgccaccacggccacagcagccgcaaggccacccgcccaagccagcaacagggaggagcggcggaaggcgaccagccccccagatccgggcagccagcccgcgaatccgaccaacccaacgcggatcaggacgccgaccaccttatcgtagacgcagacgagtggaggtcccgccaccgccaatccggccgaccgcgcagcccaccaacgcaccacgccgaacaccaccccgacacatgcccgagaccagcctgctggcgcctccgaaggctggcacgcggaggtcgcgaaccccacgcgcaccagattccagacctccacgcgcggcgccgctccctacccttgggcgccagacaacaccttctccgcgcgtgcgacccacggccggccgcatgcccccctgctgcgcggacacccagccaggacccgcaacgcccggatgtgccaaacgaacgccgcgctcactgccgccatgatgccgccgaggctgagccgcgccggcgaagggtcgccgccccacacacgccgttgccacctcctagaacccgactagatccgggcagacgcgaccaaagcagagaaaaatcgccgcgtcgccaccttccttggggccgcgcggacatccggcggcgccctctggtgacggcgaggtgggatggagtggagggagggggcggcggcgctagggtttcggccgcccgtgtcgcccagcagaaggcgaccgagcggctttggttctgtcatgttagcatgctttgttctacacgtttaaggaagaaaaaaaaaccgatgaatggaacatcaaatccctatggatagtgcgtcctacatctaataaaattaaagcaaccaaaatgtttcgaactttatcgttggcactgactgaagttggtatcttgattctgatgcacttatgtgctctgcataggcttgggcnnttcgtttggcttcacgtgatgaccagttgaccttgaccactcatataaaacctaatacttgctttgtgatctcaccagtacctcatctgaccaaatcaatgggtacacagggccatatcctctcattggttgtggactacatctcctatagtaatattggaagggaggaatcactattttttatgtcactgtgacgtctctatcgtaagttttgttgactgaagaaggcaaaaaactagtctctaccgcctctctggctccctgtagtccagacaagagctgctcatctagtaatattgcagggaggaattgctattttttttaaatgtgaacagatgaatcaatgccggcgatgaccatgcctctatagcttctacgtaggacatataacttacatttcatgcatatgaccatgcccgtgctagtcatggtgtgctttcgtctactgctcttgctagcaattgcctttgtagtcacgcataatatatgctattttatttcatgttgctgtaagcgttgttgactgaaagggcaaacatgtctctaaagtctaacaatctttctgaacaagggaaaacagcctggttctcattctcattgatcacatggatggatccatttggcagtcatgtcatgtcttgatcccttcgttggctggtttatgctcgatgtctacaacactacatcaactgtatttgagtatcgttgaattttaagatgatccgcagtgtatatatgacaaatccttttgttccttttcgtgccatcgcaagctgtcttgactgaagcggggtggaatagtctctgcagtctacattgcgtcgagagcaggttttatgttaccgttttctacgcaatcgtttcttcgggcctgtttgttaattatataatctaggttataaattaaatacgcaccttataatctgcttatggattattataatctaggtatctaggttatataatccacctaataatatgtgttgcttgttaacctcttaacttatttaatctagattatataatctagagggtaaacaaaaaggttacctgcaaacaagatttaggagatttttttttaaaatcacatcattcctacttaatcaaatggcccagcaaattgcagatgctgtagttaatagtaaacgacgtgatatgaccggtatcaccctcgccggtccctaaacaaatcattcgcatcccgggatagtctcaaccctgcgcttatctgcaccaaaacgccaaataaaagacgcataagtacacttgaaaaacaggtgatttttgtctacagtgtgctacaaaagcaacatgtcagattattaggctaattcctcctagccaagttatcatttgttaaagttacacctcttttgaggtaccatataaaaacttttattttcaaaagtatcataagattataatgatccataaatatatcatcaggttcttattttagattatcgtttagctttttacctactaataacttatgtaatcaaacatctctaatgggattatataatatattttataggtggattatata

SEQ ID NO: 7639 - DNA, 2178 bp, Zea mays
actactatgggaataaaggaaaatcgcaaggagtgtcatcacaacaaacaactgtaagattgatgcagatgaaaatgatttaagattttgcttcagaataatctcacctgttaaggcatacacattacaggcagaatcaggggctgatcaaaaggactggatcccgcgaggcccgccgggtatcgcatcgctactaaattcaccattcccacagcagttgtcatatggtaatgtagcagcagagagtaacagatccacaagttctgttgattctttgtctattgaagataacaagagttcagagggacatgatgatatattcaaccttctgaggaatatccctggaaatgacagttgtgcagaatgtcgttcccctgatcctgattgggcatctctaaacttgggtattctgatttgcattgagtgctctggggctcataggaatcttggagtgcacatttcaaaggttcgatccttgagactagatgtgaaagtctgggagccagtaattatggatctcttccatgcactaggaaatgattacgctaattccatttgggaagccctgcttccaaaagaagatcaaggaatgaacgactcaaatggagctattctttttattgaaaagcctaaacctagtgatgctttctcaataaaggagaggtacatacaaacgaagtatgtggacaaactgctttttgccagagatcccgatcagaataccatttatattttggaagccataaggaaaaatgatgtgagagcagcatatcgaattcttgcaatagctgaagtcagtgctaacatgacatatgatgctttgagcaaagatgtccatcatgttcagccagtgacagacaagatgttacttgatccgatttcttgtgagataattcaggactctggaaaaccagaaggctgtctaccaggttgttctttattgcactttgcatgcgaatacggttatcctataatggtggagcttcttctactttttggcgcggatattaatatgcaggatttccatggccgaacaccattgcatcattgtgtccaaaagaaaaatgatgagctcaccaagcatctgctgaagaggggtgcgagaacgacaattaaagatggcggaggtctgactgctctggagagaagaatggaacttggagcgataactgatgaagacttattcatactatttgtgaggtgatgttgcaaacttgcaatacaggcctttggcaactagctgtttgtacctgatagcattgtattgtacccacctaatttagcttctggaaagaacatgatttctacacctgaagacaaatgccttttactgtaccacgatataacttatgggactgctgcgcttggctgtgttttaaaattccactggtcgacatgaccacatcgttggtttgtacaacaattataggcaatcacagtattcgattctttgagtatggttattgaggtctgagtttctgatgtcaagcatgtaaggaaagaacacacgataatcgtgcatgcatattaccgttgggcaattttctttctttttttattgcaattttacaactgtactgcatatggtcgacctgtaacaattattgaatttatgggtacgtgtatcctgcaagatatgaatcaacttgtaacagcatctccaagtatcgcttcaataaaaaagtgcaaatgcagcatagttttccccgtgaatttgttattcagtatactagcgtggcaaactgattaaggatgctaattcaggctctagggtacctagagatcaagcattgacatgatcggtacgtacataaggagtttgcaagccacatggtctacctaaataagctttgagaaatttgaccaaacttaacaaatggttaaaatttattggacaagcaacacaaatctaaatcaagttagtacttcatactaatatgaggcactaacttgaaaaatcagaaaaacaaatggaagtaggaatcatttttgtagtgttgtcaccaattactaaaaaggatgggattgaaagctctatatgttgttttggtagttgagacaattaggtgattaactattttatgagtgaaatgaatgagataggtttggagtccacaaagacgagcaggtactgtacaaggatgttgattgatagagtaaatcaaatgaggtgcatat

SEQ ID NO: 7640 - DNA, 2326 bp, Zea mays
  misc_feature (78)..(78): n is a, c, g, or t
aaaattaacctaccccgaacaaaacaacgcggcggcaccacactaaaaatccaccactcccgagcagcagcagcacgntgctacaaaaggcacgagcacaagcaaggcaaattggcgcgctggggcgtgctggctagccacaccagtgacaaagagtatactcgcccgatcccgccgcgcgccgcagctagagcctagagctaggaggtcgatctgatcgcatcggccggggtctgccgccctgcccatggccggcgccgccggggacaggtcgggggaggacgtcggcaccgactggccgttcggtggcgtcgacgccttcacggagtactcgtcctttttcgcggagcccggctggccgggcggcctagccggggagctcatcccggtgctggatctgcccgaggcagcagcaccgctgcccgcccaactgtccacggaggagccatcggaggagcctgcgcccgccaggtcgggggacgccggcgcgtcgtcgagctcgagcggggacggtgccgcgccggggaacggcgacggcgacgacgatcggaaggcggcgccggccgccgaggcagcgggtaggaaaccggcggcgaagaaggggcagaagcgggcgcggcagccgcggttcgcgttcatgaccaagaccgagctcgatcacctcgacgacggctacagatggaggaagtatggccagaaagctgtcaagaacagccctttcccaaggagttactacaggtgcaccaacagcaaatgcacagtgaagaagcgcgtggagaggtcctccgacgacccctccgtggtcatcaccacctacgagggccagcactgccacagcatcggtccattccagcgcggcggcggcgggggcgcagccgcggcgcggtaccacagcgcggcggccgtcgcgctggcggagcaaatgtattcgtcgtcgacgacgtcgtcgttcatcccagcagcgcggcagcagctcttcagcttgccgccgttgcacccgcagagctccccgccgtcctcggagacgacgccgccggtcgttagctcggtgactactacttcttttcagcgtgctaacgacggcgacgagctgtggcggacaggctacggctcgggggtgcccgtggcgcagtcgccgtcaacgccaccatcagtgcctccgccggccatttcggttcagaaggcggggctgctggacgacatggtgccccatggtggaaggcatggcaccccatgatcgatggtggcaaaatatggtaatttaaagaacctgagctaaatatgatactgacttgctgctttctatttggtgtgtacgacgtagtagggagtacgttgtataggagcaataataatggcacttcatgcatgctgccacacatatacgtatatatatgatcgtattcatgtctctgctggtacgtacacatgtggactcagtggcttaggatctttttcaacgacatatttcaattagtgcactacaaatactagatcgagtagttggcagactagagcacatttgtacatgtgtacagatctagcatatgcatatatatgcatgcatacatgtgatactcccaattaagtttagatttcttagggaatagttgtatgcgagttatttcatgtaccttattattattattatatcttctttatattgcatttccagctgccctggttagctttgacaaacagtcccccctctccacatgctcatgcatggctgaaagctactatagctactagctagggaatgctgaatgcaaaaatgcagcacatacataaatgtaacgccggccctatattcctttcaacgactagttggttttcgttggaatcctctaaaaaatcgttataaacaccaatcggaaaggaaagacgtacttgtgttttgcgttcatacttgtgcacatgtatatataggaccatttcctatcttatccttcagcgtatagagtgacttgacttgacttgacctggagtctgatcgatctaattcaggttctcacgttttttttcagacatatacctgtcggccgtaccagcaagaggcggataaagtgatcaaccagagctatagctagggttttctcctgctggattcatcagtagttagatttatctattactctaccagaccctgcatgcatatatatactcagcttatctgttcagatttgcttatattcagtgtcactctccaacaatctccattgcacctacatgtggatgtgtagcagtacttgtatttcttgtcggaaatcagagaggtatatctagaagcttcgcatgcaaaaaaaaaaaaaaaaaaaaaaaaaaa

SEQ ID NO: 7641 - DNA, 1190 bp, Zea mays
tggggctcgcgcccccccggcccgccatcttcccagctccgcctccttttcctgccttcctcctcactagtcgctcccccgcggctcgcgcaggcgggcgacacaacgaggctaaatccctatcgcgaggaggcgtgtgaggccagcggctttgcgatgacagcaccagcggacaaggggaagaaggccaagactgatgccgacggcggcgaggagaacgaacagatcgacggcgtcctcgtcctctccatcgagaagctccaggagatacaggacgagctcgagaaggtaaatgaggaagcaagtgacaaggttatggaggtggagcagaaatacagtgagatccgcagacctgtctatctcaagaggggtgacattatcaagaccatcccggacttttggctcacagcgtttatgagccatcctctattaagtgagcttctgactgaagaggaccagaagatattcaagtacttagactccattgatgtggatgattctgatgttaaggcaggatactccattcatcttaacttctctgagaacccgtactttgaggacacaaagcttgcaaagacctatatctttgctgatgatggaacaaccacaataaaagcttccgaaattaagtggaaggaaggaatgggacctgcaaatggaaatggtattaacaagaaggggagtaagcggccattagtagaggaaagtttttttagctggtttggtgatacagagctcaagagtcttgctgatggtgtgcaagatgaggtggcggagatcataaaggaagatttgtggcctaatcctttgaagtacttcaacaatgaggttgacgatgaatttgaaggagatgaagatgatgatgatttggatggtgatgatgacgatgaaggcgatgatttggagaactgagcccttgcgcttggttcagaatgttgtccgtggatgatgtggctgggcggaactgtgacccttttgggagattttttgttgttgttgtttgacttagctggaactcaacgtagggaactgtttaatgccttatgaagtcaaccaacttgaaaggagactgcttatatcataatctcggtatatctagcaacgcaatttgacctcccccaaaaaaaaaaaaaaaaatttttcccgcgctcgggcgcctaaagatgacgtattgccttcagtttgtgctc

SEQ ID NO: 7642 - DNA, 1153 bp, Zea mays
  misc_feature (1151)..(1151): n is a, c, g, or t
ggtaccattgggtacctcgaggccggccgggcttctcccagctccgcctccctttcctaccttcttccctccgtctcccagctcgcgcaggcaggcgacacagcgacgctaaaaaccctagagcgaggaggcgtgccaggccagcggtttgcgatgacggcaccggcggacaaggggaagaaggccaagaccgatgccgacggcggcgaggagaacgagcaaatcgacggcgcccttgtcttctccatcgagaagctccaggagattcaggacgagctcgagaaggttaatgaggaagcaagtgacaaggttatggaggtggagcagaaatacagtgagattcgcagacctgtctatctcaagaggggtgacattatcaagaccatcccggacttttggctcacagcgtttttgagccatcctctactaagtgagcttctgactgaagaggatcagaagatattcaagtacttggactccattgatgtcgatgattctgatgttaaggcaggatattccatttaccttaacttctctgagaacccgtactttgaagacacaaagcttacaaagacctattcctttgttgatgatggaacaaccacaataaaagcttctcaaattaagtggaaggatggaatgggacctgcaaatggaaatggtattaacaagaagggaaacaagcggccattagtagtggaaagttttttctcctggtttagtgatacagagctcaagagtcttgctgatggtgtgcaagatgaggtggcggagatcatcaaggaagacttgtggcctaatcctttgaagtacttcaacaatgaggttgaagatgaatttgaaggagatgaagaagatgatgacgacgacgacgacgatgataatttggatggtgatgacaatgacgatgatggggaccaggagaactgagccctcgcgtttaggcggggaattatgtgacccgtttgggggattttttttggttgtttgacttagctggaactcaacttagggaactgtttagtgccttatgaagtcaaccaacttgaaaggagactgctatatcataatctcggtatatctatcaacgcagtttgacctgtgattcaaaaaaaaaaaaaaaaaaaaaaaaaaaaacaaaaaaaaaaaanaa

SEQ ID NO: 7643 - DNA, 3023 bp, Zea mays
ctggggtaacactattagatgctctgaagcgagtattaaggctcccatctgtgtgttcaaaacgtttcttgaccactaaggttgataggtgtgtgacaggtcttgttgcacaacagcagacagttggtcctctccaactcccgcttgctgatgtggctgtgattgcacagacgtacacagacctaacaggtggtgcttgcagcattggagaacaaccaataaaggggttgcttaatcctaaggccatggccagacttgctgttggggaggccttgactaatcttgtttgggctaaggttacatcacttgctgatgtgaaagcaagcgggaactggatgtatgctgcaaagcttgatggtgaaggtgcagatatgtatgatgcagctgttgcattggctgactgtatgattgaacttggtattgcaatagatgggggaaaggacagtctttccatggcagctcaatgtgatggtgaagtcatcaaggctcctggaaatctggttatcagtacatacgtgacatgtcctgatataacattgacagtaacccctgatttgaagcttggtgaggatgggattcttctacatattgatctcgctaaaggaaatcgccgtcttggtggttctgctcttgcacaagcatttgatcaaattggaaatgactgcccggacattgatgatgttctgtacttgaagaaggtatttgaggccattcaagaattgctcagtcaacgtcttatttcagcaggccatgacataagtgatggtggccttattgtttgtgttcttgagatggcatttgctggtaactgtggttttaagcttgacatagacttagaagataggagccttattgaaggactttttgcagaggagcttggcctcattattgaagtacactcgaaatatctcaacattgtgaagcaaaagcttgaaatagcaggcatttctgctaatgttattggagaagttactaactcaccagaaatagaagtttttattgatggcaatctgcatctcaaggaaaaaacttcagatctcagggatctgtgggaggaaacaagcttccagcttgaggagttacaacgtctgaaatcttgtgtaaaacttgagaaagaaggattaaaatgcaggacatcaccatcatggtctctgtcttttaccccaaaattcacagatgggaaactgttgactgcttccttgaaaccaaaggttgccatcattcgtgaggaagggagcaatggggacagggaaatggctgctgcattccacgctgctggatttgaaccatgggatattacaatgtcagacctcttggctgggaagtcttctctcaaggagttccgtgggattgcatttgttggtggtttcagctatgcagatgtgctggattcagcgaaaggctgggctgcatcaatcaggtttaaccaacccctcattcagcaattccaggacttctaccataggccagacacgtttagccttggagtgtgcaatggttgtcagcttatggctcttcttggctgggtgccaggatcaggtgttggaggttctcttggtacaggtggagatatgtcccagccgaggtttattcacaatgaatctggtcgttttgagtgccggtttaccagtgtgtccattggcgattctcctgctattatgttcaaagggatggaaggttccaccttaggtgtttggagtgctcatgcgacagcaacggcgacagcaacggatgaaaatgttctagctactgttgtgaagtcaaatctggctcctgtgcggtattgtgatgattctaacaatattactgagacctatcccttcaaccctaatggttctccactgggtatagcagccctttgctcacctggcgggaggcacctggctatgatgccgcatccagagcgttgcttcatgatgtggcaatatccatggtatcccaaggaatggcaggttgagaagagtggccccagcccttggctgcgaatgttccagaatgctagagaatggtgttcatagtgcaggtaaatcaatctaatgaactgctttccacttctgtttgtgtcactcagaattcaattttagtagaacattagcttcctgtgacacagtgcactgtttcatttcagtataacagaggttgttatagaacggagaatgttattaacatgtcaagttccatttaatagagccttattctttccagccagtgttctgtcgaagaaccttactcttttttaaaaccacaccttttaacctttggatgctttagagaagcctgtatcggatggaactcttcaaatagattcggtgatccagttagcttggtttcagacagttacaagttagcaaaaccatcaattaattcaagatgcctgatacacttaagcttttattataacttcacttggctgctttgtgtatgattttaaatcttatttgcacttactgagcacattatgctctgactcgaagtgttttgttgcatctgttatactatgcgttttcttgctcgttgccactgttctgcctggtgcatctttccatattatgctgactagtttcttttttccaaacattatgattttgcagggaagcttcctgctgcaaggatgtagtcatccaggcaccggctgctacgagtatatggatgattggtggttgtatggcccaattgatgacccctttttggcagaataaatgtgttttgaccatcaatacattatcttgtaataatgtatcgaatttggaattttgaaaatggagaaccgtctggtttccgaagtcggaaggcctcagatatgactccactagtttaaaacatttactagtggaaaagaaatgagtgggttaattaataatgcaaaaggtacattgggaagacactgtacctagggatgaaaacggacggaaacggacggaaaaacccctctcccgttttcgtatccgtattttatcactggaaacgggatcgggtccggaatagtcgggaacggaaacgggagcgggataaacggaattgcg

SEQ ID NO: 7644 - DNA, 2269 bp, Zea mays
tctttcatggcagtccaatgtgatggtgaagtcgtcaaggctcctggaaatctggtcatcagtacttacgtgacatgtcctgatataacattgacagtaacccctgatttgaagcttggtaatgatggcatccttcttcatgttcccccggcttcggccgggcgccgtcttggtggttctgctcttgcacaagcatttgatcaaattggaaatgattgcccagacattgatgatgttctgtacctgaagaaggtatttgaggccattcaggaattgctcagtcagcgtcttatttcagcgggccatgacataagcgatggtggccttattgtgagtgttcttgagatggcatttgctggtaattgtggttttaagcttgacatagacttggaagataggagccttcttgaaggactttttgcagaggagcttggccttgttattgaagtgcactcgaaatatctcaatatcgtgaagcaaaaacttgaagcaacaggcatttctgctaatgtaattggagaagtcacttgctcaccagaaatagaagtttttgttgatggcaatctgcatctcaaggaaaaaacttcagatctcagggatctctgggaggaaacgagcttccagcttgaggagttacaacgactgaaatcttgtgtcaaacttgagaaagaaggattaaaatgcagaacatcgccatcgtggtctctgtcttttactcccaaattcacagatgagaaactgttgattgcttcctcgaaaccaaaggtcgctatcattcgtgaagaagggagcaatggggacagggaaatggctgctgcattccacgctgctggatttgaaccatgggatatcacaatgtcagacctcttggccgggaagtcttcgctaacagagttccgtgggattgcgtttgttggtggtttcagttatgcagatgtgctggattcagcaaaaggttgggctgcatcaatcaggtttaacaaacccctcattcagcaatttcaggaattctaccataggccagacacgttcagccttggagtatgtaatggttgtcaacttatggctcttcttggctgggtgccaggatctgatgttggaggttctcttagtaaaggtggagatataacccagcccaggtttattcacaatgaatccggtcgtttcgagtgccggtttactagtgtgtccattggggtttctcctgctatcatgttcaaagggatggaaggttctaccttgggtgtttggagtgctcatggcgagggaagagctttcttcccagatgaaaatgttctagctactgtagtgaagtctaatctggcacctgtgcgatattgcgatgattttaacaacataaccgagacctaccccttcaatcctaatggttctccactaggtattggagccctttgctcccctgatgggagacaccttgctatgatgccacatccggagcgttgcttcatgatgtggcaattcccatggtatcccaaggaatggcaggttgagaagagtggccccagcccttggctgcgtatgttccagaatgcaagggaatggtgttcatagtgcagggcagtgcccggctgtagcgatgcggatggttgttttcatctgatgaccccttccttttgcggaataaagaggtgttcgacccgcagcgcgttatccaagctgataacaaacgtgtcaaatttgaagttttatacatagaaaactgccaggtttttgcgtagcctatgccaaagatgcgtaaactgtcagccccatcagggcttgtttgggtaatcttagattggagtggattgaggtggtataaggtatattgaagtgtaatataaactaatttccctttaaatccctaaaatacatctcaatccacttcaatccctctttatccaaacaaagcctcagcgaatttcccaatcaacgtagagaatgcttgctgcgttactcaaatctgatgcttatgcaatggtcgtttttgtgctgtctgtctgatgatgagtaagtatgagttcattcgcaaccagacaagtcattagtatgaattcagtcgcaaccagacaagtcattgtaatagcttgagataattcatctggtgacgtggcaaattcttagagtcccatattttccgcatatatatacccagcactcctatcaacagacaagaactggcggttggggttttatggcgagaaaaaaaaaatctggtggctggggttccgtggcagaaaaaaagtggagtagcagggggatcctctag

SEQ ID NO: 7645 - DNA, 3934 bp, Zea mays
ggtccaacgtgaatttttttccgatgaaggatcaaaatgcaaaaaaatcagcccgccactcaagtactcaacagataacgtcttcggcgagtccagttcaccgtccctccctgtccttgccatggccatccccaccgcccccgccctcctcttcccctccgttctccctaactcattcccccgccggacaccctggcgacacctcgtccggcggcaaccgcgtcacctccgcgcgggccgcccgcgcctgcaggcgccggcgccggctcctcccccggtggcggaggtcgcggcggagcgggacgacacgcctccgctcaggctgctcgagccgccgcagagaggacgaccccttcccgcccgaggtcctcaccctcacgctttcctcgctcgcttacagacgccggtctcaccgccgaatttagaatcgctcgattgacggttatcgtctacgtacgtcatcgcattgtgtgtagatggagcccgcggaccctgatttctaccggataggatatgcgcggatgatgcgcgcctatgggatcgagttcctcgaaggccccgacgggatgggcgtctacgcttcccgggacgtggagccacttcgcagagctagagtgagacacttcattcaacaattctcctcttgtccaagtccaaccactagctaccgatcaatttgaggtttaaatctctgtctcattgcagctggacgtccatcaccacaccagttagtgtttggatgcagcacctgtgaatctgtgattgggtgggaaactcacatgagaataactggtcaaggacgttgttcgtgtgtagtaactgttagcttatatttacactatatttagtaggtagtatacattaccactggaagtcaatggcttatgttaattgcctaattgttatttgctacatacttgctgtcaccaaaaaatatggcatctatagttataacacatgtttgctcgcagtcgcattaagctcacgaaattgccagacccatgtgttgaattcttcatcttgatgcatgctatagacctgtagtacgatggtcttgttcaaaagaattatatgatattcttggcatgctgaaactgtttgtataacatatttggttcttttcgttcgcaatgatgagcaatgttattgaaagatgtgctgatgttgctttcttttccaggtgattatggagattccgttggagctgatgctgactataactcaaaagaaaccttggatgtttttccctgacattattccactaggccatcctatatttgatgttatcgagtcaacagatccagaggtaggtggatcaaatcttttgttgcaaagagaaaactgatctcttaaaattccgtcactagtttctattgaatgttcagcgaattagttaatagctttgtcacgctaatcattttgttaaccagttgttggttctcctatatttattttaggattcattacataacagccatctaattgacttgtgttgaagttgtatgggtgcaatttagcattcaatgttcatatagtacatttgagtttccatacagctaggatctgtgtaattgagaatttgagactgcagagcaatttatgtgcacattccatccatatggttgaagttatcgacccataagctcacagttgcattagagaggagtgataccactttcaaaaactcaatcatctgtcttttcttcaacaaatattaaagcgccaataaatgatctatgctggaagctgatgtaatttgtattactcttgcagacagattgggatctaagattagcatgtcttcttctatatgcatttgatatagaagacaacttttggcagttatattctgattttttgccaagtgttgatgaatgcactagtttgctgctggcaccaaaggtatcaaaaagctaacggaaagtatatacctctgctgtgtccttttcttaggaacctccttatacttgattctgctgtttgaatgaattcatatgcctgcctttctaggaagatctaatggaactagaagatgaagatcttgcttcacaaatgttaaaacaccaggaacgagcaattgacttttggcaaaagcattgggtatacttcttcattatgttactagcttaccttccttgaactcctctaactagcttgatgggtaatatccaggacaaaccaattcctctaaagctgaaacgccttgcacgtgaccatgagagatttctctgggcactgagtatagtacagtctcgttctgtcaacttgaagttgagaatgggagccttcatccaagatgcaaatgtgctagctccttatgctggtacttcttttctttttttggttttcgtgattgctgctccccctccccctctccgttgcgttatgcataggcacctaagtgaacaacaggatgctagcgttatgagcctgtaataatagtcacaaaaatatggttagctatgcatttcaactggacttctactctactctgttttgtagttttatatgccgatctgcttgttcatttactgttacacagatacaacattctaccatttgacttagtttgagtctttgagatgtgaaggacaggcttggtgcagtggtgagagctgtctcactgagtcactaggttgcgggttcaaaacagcatctccgcatttgtaggggcaaggcttgctttggtttatccctttcccagaccccactcatatgggagcctctagcatcgtgtctgctcaacttagtttgagacgcaagattaaactaatcctagataatctatataacaggaacaatgcctgtgcatcgtcgaactgttgagataaaaaccataaatatatctgtcatatttaacacaagatatttctcccattcatgcattataggcagctatctgcctcaaattattgttcagactgctagtgtagtccccaattatctgcttaggagtgctttatctaagtcatgatttgtcttttatccccagatatgttgaaccactcaccccaatgctaattgcttcctgcattggcgttttaaagaccgtatgcttgaagttatgattaaggctggacaagctatcaagaaaggagacgaggtattgtctaggatgtatgctcatcttaatttttccctgaccaccggattaattggtttgtgttgctagtgaagttaaatgtctctgtttaattacatggatttatcaccataataaatgatgcatgtgcgccttggttgcagtcctcacttttgttaacatcaggcttaaatacctgttaaaaaataatggatagtaaaaaaactctgaaaagcgcattcattaaaattatgcgtaaatgctagtagatcctttagcaaactttgtttctattattgtgcataattatatttagaccattctatttctccagtcccatacatgttggaaagttctctatcccatgtaccaatagaaataccgctgcacaaccttctaccagtctcagctaaaattgctatcctcacaaagtctattcttccaaaattttaagccaatttttttaatgtcactatttgacccatgcactcatgtacagatgacgatagattatatgagtggcgtcaacagcaaatttatggaaagatatgggttctcatcaccaacggtatgaccacacacttgtatcttgttgatgcttactttatggataatggtgtacaaaaagttttttttacttttgtcatttctttgatatcggaaaactgacagttagaattgtatctgtgaaattaaggtcctgcttctaggagactagtctagttttgaactattctgtgctgttcttataggcaccacaatgcagtgcctgttgaaaaattacaacgacataccatttttagactgacatcttatgttgcttgtgtgcgaaaccaattctgcaggcatgca

SEQ ID NO: 7646 - DNA, 1485 bp, Zea mays
agttcaccgtccctccctgtccttgccatggccatccccaccgcccccgccctcctcttcccctccgttctccctaactcattcccccgccggacaccctggcgacacctcgtccggcggcaaccgcgtcacctccgcgcgggccgcccgcgcctgcaggcgccggcgccggctcctcccccggtggcggaggtcgcggcggagcgggacgacacgcctccgctcaggctgctcgagccgccgcaggaggacgaccccttcccgcccgagatggagcccgcggaccctgatttctaccggataggatatgcgcggatgatgcgcgcctatgggatcgagttcctcgaaggccccgacgggatgggcgtctacgcttcccgggacgtggagccacttcgcagagctagagtgattatggagattccgttggagctgatgctgactataactcaaaagaaaccttggatgtttttccctgacattattccactaggccatcctatatttgatgttatcgagtcaacagatccagagacagattgggatctaagattagcatgtcttcttctatatgcatttgatatagaagacaacttttggcagttatattctgattttttgccaagtgttgatgaatgcactagtttgctgctggcaccaaaggaagatctaatggaactagaagatgaagatcttgcttcacaaatgttaaaacaccaggaacgagcaattgacttttggcaaaagcattgggacaaaccaattcctctaaagctgaaacgccttgcacgtgaccatgagagatttctctgggcactgagtatagtacagtctcgttctgtcaacttgaagttgagaatgggagccttcatccaagatgcaaatgtgctagctccttatgctgatatgttgaaccactcacccaatgctaattgcttcctgcattggcgttttaaagaccgtatgcttgaagttatgattaaggctggacaagctatcaagaaaggagacgagatgacgatagattatatgagtggcgtcaacagcaaatttatggaaagatatgggttctcatcaccaacgaatccttgggagctcataaatttctcgagtcctgcaacaattcacatggattccttcttatcggtcttcaatatcgctggcttgcatgatgagctgtaccacaattctgcattgacctcagtagtagaaaccgactttgtggacggagcagtcgtagcagcagccagagcattgccgacatggtcagatggtgatgttcctgcaattcctagtgtggagagaaaatctgctcaggcactgcaagaggagtgccgccaaatgttggattcattcccaactaccatcgaacaagaccagcagatcctagattccgatgcgcatatcagcaaaacccgagaaaaatgcgatcagtatcgtctgcaccggaagatgctcctacaaaaatcatggacgcactggaca

SEQ ID NO: 7647 - DNA, 1695 bp, Zea mays
cgacccagcgtccggttgatgttggtttccttcttgttgtacagggtgcggtgccgatccacacatgggtgctcatctccaacttcaagttggcgtacaacatgctccggcgggccgacggcaccttcgaccgcgacctcgccgagttcctcgaccgccgggtgccgcccgacgcacgggcccaggagggggtctcctcgtccgaccacgtcatcgacacgtccactggcctggaggtccgcatctaccgcgccgccactaacaacggcggcgcgggcgcggccgcggtcaccctgcccatccttgacttcctcggcggcgggccgtctccggacccgttcccggtgatcctcttcttccacggcggcagcttcgcccactcgtcctccggcacggccatctacgacaacctgtgccggcggttcgtgaagctgagcaagggcgtggtggtgtccgtgaactaccggcgcgcccccgagcaccggtacccgtgcgcctacgacgacggctgggccgcgctgaagtgggccacgtcgcagcccttcctccgcagcggcggggacgggcggccccgcgtgttcctgtcgggcgacagctcgggcggcaacatcgcccaccacgtggccgtccgcgccgccgacgccgggatcaacatatgcggcaacatcctgctgaacgccatgttcggcggcaccgagcgcaccgagtcggagcggcggctggacggcaagtacttcgtcacgctccaggacagggactggtactggaaggcgtacctgcccgaggacgccgaccgggaccatccggcgtgcaacccgttcgggccgaacgggcggcggctcagggggctccccttcaccaagagcctcatcatcgtgtcgggcctggacctcacctgcgatcggcagctggcgtacgccgagggcctccagcaagacggccaccatgtgaaggtcgtgtaccgtgagaaggccaccgtgggtttctacctgctgtccaacacggaccactaccacgaggtcatggaggagatcggcgacttcctcgcggctaacctctagcagcacatgcacacaaacttcacatgttatagcaagaagatgggtggtaagcttgactttatagttgtaccgatctgcatctgctgctgcttggggtggtggtggtgggctttgctgctgataaaactctctatctaggaaagaaaccacagtgactctttttttttttggtttcgtcgtcgggttgctgatcacaaagctgcttgatgatctgcgtcgtggttgatggagggaagcctataatttcgccgtcaatcatctaacattctgtgtacagtggtggactgatggaccaacaaggaggtggacggccttttttttgttgctgtgtctgatgtagtagtatttctcatctttttatggatcggatgggatggtgcctgcctttcattctatgatgaatcgtactgtctgtctatctatctatctacccaatgccgtcgtggaacatgtttccaatctagtactactactactaggctagatgcagaggcataagaaaatgtgctactacacctctactgctggtgtgtggcttttgtctcttttcttgtccatctctgtatacaatgctgaactgctgctaaatatattgttgtaaccttgaatgcctaaaaaaaataatagataaaac

SEQ ID NO: 7648 - DNA, 1000 bp, Zea mays
ggtacccccctggggccccccggggttcccctcatcactccctcgcctcccccgctgtgccggcctgcacacacagacacacacaccacagcctacagcgcttctgctgctccagctcctcgtactaccgcgcccgcgcgctgctcgttccccggcctctgcttgcttggctcgtcgagcccagaggttggtggagaggcggggcttattgccccagataggagatcggggacgcgggagggcgcgtcgcgctcgggccggtctcggttcagcgggatcacttggccgtggccgtggtcgggcctccggcgcccatgtggtgagccaagccaggcttttgttgcccggggggcagagatcttgcacttgcagcagtgaagccggcggtgcggtccggtccggtccggagccgagcggcgcccaccgccatggccggcagcgacgaggtcaaccgcaacgagtgcaagggggcggtgccgatccacacatgggtcctcatctccaacttcaagctggcgtacaacatgctccggcgggcggacggcaccttcgaccgcgacctggccgagttcctggaccggcgggtggcgcccgacgcgcgggcccaggagggggtctcctccttcgaccacgtgatcgacacgtcgaccggcctggaggtccgcatctaccgcgccgccgccaacaacaacggcggcggcggcgccaccctgcccatcctggacttcctcggcggcacgccggcggcggcggcggcgccgttcccggtcatcctcttcttccacggcggcagcttcgcacactcgtcgtccggcacggccatctacgacaacctgtgccggcggctggtgaggctgagcaagggcgtggtggtgtcggtgaactaccggcgcgccccggagcaccggtacccgtgcgcgtacgatgacgggtgggcggcgctcaagtgggcgacgtcgcagccgtccctcggcagcggctcgagcgggggcgcccgcgt

SEQ ID NO: 7649 - DNA, 2067 bp, Zea mays
gctattaccccccctcccctccttcctgttgccctccatctctccctcgccccctgtgcccccgcctcacacaccacagcctacagcgcttctgctccagcgcccgcctcgcctcgcctcttctcctcgttctgccgcccgcgcgcgccagcctggtgctcgttccccttcttggctcgtcgagcccagaggttggtggcgtcagggatttgtattggagcggaggagaagggggctttgccccgaggagatcggggacgcgggagggcgcggcgctcgagccgagctcggttcagcgggatcacttggcgtggccggtcctccggggcccatgccgtgagcaaagccaggctttgttgcccgggggagagatcttgcgcttgcaagcggcgcccgcccaccgccatggccggcagcgacgaggtcaaccgcaacgagtgcaagggtgcggtgccgatccacacatgggtgctcatctccaacttcaagttggcgtacaacatgctccggcgggccgacggcaccttcgaccgcgacctcgccgagttcctcgaccgccgggtgccgcccgacgcacgggcccaggagggggtctcctcgtccgaccacgtcatcgacacgtccactggcctggaggtccgcatctaccgcgccgccgctaacaacggcggcgcgggcgcgggcgcggcggcggtcaccctgcccatccttgacttcctcggcggcgggccgtctccggacccgttcccggtgatcctcttcttccacggcggcagcttcgcccactcgtcctccggcacggccatctacgacaacctgtgccggcggttcgtgaagctgagcaagggcgtggtggtgtccgtgaactaccggcgcgcccccgagcaccggtacccgtgcgcctacgacgacggctgggccgcgctgaagtgggccacgtcgcagcccttcctccgcagcggcggggacgggcggccccgcgtgttcctgtcgggcgacagctcgggcggcaacatcgcccaccacgtggccgtccgcgccgccgacgccgggatcaacatatgcggcaacatcctgctgaacgccatgttcggcggcaccgagcgcaccgagtcggagcggcggctggacggcaagtacttcgtcacgctccaggacagggactggtactggaaggcgtacctgcccgaggacgccgaccgggaccatccggcgtgcaacccgttcgggccgaacgggcggcggctcagggggctccccttcaccaagagcctcatcatcgtgtcgggcctggacctcacctgcgatcggcagctggcgtacgccgagggcctccagcaagacggccaccatgtgaaggtcgtgtaccgtgagaaggccaccgtgggtttctacctgctgtccaacacggaccactaccacgaggtcatggaggagatcggcgacttcctcgcggctaacctctagcagcacatgcacacaaacttcacatgttatagcaagatgggtggtaagcttgactttatagttgtaccgatctgctgctgcttgggggtggtggtgggctttgctgctgataaaactctctatctaggaaagaaaccacagtgacctttttttttttggtttcgtcgtcgggttgctgatcacaaagctgcttgatgatctgcgtcgtggttgatggagggaagcctataatttcgccgtcaatcatctaacattctgtgtacagtggtggactgatggaccaacaaggaggtggacggccttttttttgttgctgtgtctgatgtagtattttctcatctttttatggatcggatgggatggtgcctgcctttcattctatgatgaatcgtactgtctgtctatctatctatctacccaatgccgtcgtggaacatgtttccaatctagtactactactactaggctagatgcagaggcataagaaaatgtgctactacacctctactgctggtgtgtggcttttgtctcctttcttgtccatctctgtatacaatgctgaactgctgctaaatatattgttgtaaccttgaatgcctc

SEQ ID NO: 7650 - DNA, 1251 bp, Zea mays
cgaatcccactatccatccaaccaaatcccacgtgaagaaaacgactcccgtttcgcagttcacccctgccaggcccggcccggctgctctctctgcttctgctctgcctccctctatggctctatataaccattgggtccctcgaggccggccggggacttgtccccatatcctctccagctttccgctccgcccttgtcgctcgtccagccaccgtgcccgtgcccgtgccgccgagaattctatccagaagcaagcaacaagagcccacccccgcttcgcgcgctctttcgtgccaggcaaacacagagcacagctatctgctcgtgtcccggtccgtccaactcgctcgctcgctcaatccactgatgatggggatcccgctggtgtgctactgcctcgccgtgcccaagccggtcatcgccttctgcaggctgctcagcgccgtcagggacgccgccctgctgatgctggccgtggtggggctgtgccgcttcccgcccgacggcgcggtggacgccggccaccagcccggcgaggtgaaggcccggctccccgccgtggagtacggccagctcctggccgagcacgacgagcagcagcagtccggcgaccacgactgcgacggggacgccgcgtcgtcggattgcatcgtgtgcctcgagacgctggaggcggcggacgaggtgcggcggctgggcaactgcgcgcacgccttccaccgcgcctgcatcgaccgctggatcgacctcggccgcgcgacctgcccgctctgccgctccgacctcctgccgcgcgcgccgggctgggccagccggctcggcctgggccggctcacgcgcgttcggtgaggaggaccgtcttccagggcagtttttaatttgtctattggatgatggggcgcggacaggttagcgacggcgatcgcccgggtggtataacagctgctctgcctgccatcagccaaccgctaatctacgggggggcttcattagtacgtaaaaggcgcctcacacttggtatacgtaaaagatatactagttattaatacgttaaaggattgagtatacggcacctagatgtttcatttgtacacgattttaatttcagtctctcctcgaccatataatagtaattaaattagttcgtcaacttattgtgcaacttggtgagcttagcagcagcaagtttgcgcaactggcagtgatgaataatttagcaaccaacttgaatcctcttatcaatccgta

SEQ ID NO: 7651 - DNA, 1435 bp, Zea mays
cggacgcgtgggctaaaaaaaggcacgagaccattacctagaaccccctcgtctccgcatccgcagtcgcacacccgccattgcattcgcagcaccagcgccgcttctccttcctcgagctcacccctctcttctcttctcctattcgctcgcgtgctctctctctctctctctgctgcctcagccgccctcgctgtcgctgagccgacagattcattcggccggtcatggctgacgcgttgtgcaacggcgtcgtggcgtccccgtgcggccgggacgtcgccggcagggccaggggcgccggcagggccgcgctcgcggagtcccttcaggtcgccgggcacgccagcaagacctccttctccgccgggaggatgtcggtcaaggacagcaagccgaggcccctgtcgcgtagcctcgaggccgccgcgccaggacagatgaacctgtcgttccccaaggccatgcggtggtgggagaaggggctgcaccccaacatgcgcgaggtcgagtccgcgcaggacctcgccgactcgctgctcagcgccggcgacaaactcgtggtcgtcgacttcttctccccaggctgcggcggctgccgcgccctccaccccaagatcgcccagttcgccgagaagaacccgggcgtgcagttcctgcaggtgaactacgagacgcacaagtccatgtgctacagcctccgcgtccacgtcctccctttcttcaggttctaccggggagccgagggccgggtcagcagcttcagctgcaccaacgcaacgatcaacaagttcaaggacgcgctcgccaagcacggggctgagaggtgcagcctcgggcctgcgcgggggctggacgagtcggagctcatggctttggctgagaacagggacctgcacttcacctacgacaagccgggcggcctcgtccccctcgcggaagccattgccaaggaggctgccgcgccgggaggcccgtggcttcctctgcctgcgtccctgctcggccagggatcggccgataactcattgctgccgtctggaagatagaccgtgctccgtgctcggttggtttcattcattggaggtggctcctccgtcttgtacagatttcattcgttcgtagtggtctgatgatgctggagtgacagaaatattcagacgcgggatgcgcagtgactatcgcgggatgcgcagtgactatcgcgtctgtattgttgcatctagacctttgctgaaacatgaaaaaatccattgcttggcgaaccaaaaaaaaaaaaaagcgcgcccccctccgaggcggccgaggaggactcgttcctgcatggttgataatatgtattcatgcagcttgagctgcatttttttttctttccagtttgtcttgctgctgcaagacctgcctgcatcaacttttatctgtttgttactttatc

SEQ ID NO: 7652 - DNA, 1692 bp, Zea mays
ttgcagcagtaccgctggcgtggccggtggccccagaccccagcctcggtcttatccacaccactatatccattccagttatccgcttgcgcctttaaccgcacggttaaaacggcccgcaaggccgcaacggcaagcccaggccacgcgtcgcgcatcggacagtaggctagcgaggatccgacggccggaccccgcgcgcgcgaggggttacgggttcccgcacgcggaagccgttgcggcgggcggggtaaataaaaggtaaaaggcgtgggaagggtaaaaggcgtgcgccgtgcgccctctctttctgtcttgtgccctaaaaaaagggcccgctgctctgcttttctccccctcgtctccgcatccgcagtcgcacacccgccattgcattcgcagcaccagcgccgcttctccttcctcgagctcacccccctctcttctcctattcgctcgcgtgctctctctctctctctctccgctgcctcagccgccctcgctgtcgctgacccgagagattcatttggccggtcatggctgacgcgttgtgcaacggcgtcgtggcgtccccgtgcggccgggacgtcgccggccgggccaggggcgccgccagggccgcgctcgcggagtccctgcaggtcgccgggcacgccagcaagacctccttctccgccgggaggatgtcggtcaaggacagcaagccgaggcccctgtcgcgtagcctcgaggccgccgcgccaggacagatgaacccggcccggaattccccgaggccatgcccgcgcgtcgaagaggggctgcaccccaacatgcgcgaggtcgagtccgcgcaggacctggccgactcgctgctcagcgccggcgacaagctcgtggtcgtcgacttcttctccccaggctgcggcggctgccgcgccctccaccccaagatcgcccagttcgccgagaagaacccgggcgtgcagttcttgcaggtgaactacgagacgcacaagtccatgtgctacagcctccgcgtccacgtcctccctttcttcaggttctaccggggagccgagggccgggtcagcagcttcagctgcaccaacgcaacgatcaacaagttcaaggacgcgctcgccaagcacggggctgagaggtgtagcctcgggcctgcgcgggggctggacgagtcggagctcatggccttggctgagaacagggacctgcacttcacctacgacaagccgggcggcctcgtccccctcgccgaagctattgccaaggaggctgccgcaccgggaggcccgtggcttcctctgcctgcgtccctgctcggccagggatccgacaactcattgctgccctctggaagatagaccgtgctccgtgctcggttggtgtcattcattggaggtggctcctccgtcttgtacagatttgattcgttcgtagtggtctgatgatgctggattgacagaaatattcagatgcgggatgcgcaggctttaagcttttagtttgtaaaagtctgactattgcgtctgtattgttgcatctagacctttgctgaaacatgaaaaatccattgcttggcgaaccaggctggatcgttctcattcctctatgcaatgcagccgaggaggactcgttcctgcatggttgatttgataatatgtattcatgcagcttgagctgcctttttttttc

SEQ ID NO: 7653 - DNA, 2313 bp, Zea mays
tgcagtctaatctgtactgaagcactcttctggtggtgctgcgatttttttgtctgcttctgttgtagtgataaaatccactttctattgaagttgatctttcgttcttttttgttatgactgcattagagaaaatacctcttaatataccttattgtttctgatcccatctacccactttaaaaaataagaaacttatgtttgttttattagcttgatcatgtaaatttagacgaagtattatgtaactgcaagtaaatctagggttgatcgtccattcactctttatagggtctcctgagggacctatccaaatctcctgtacctcttcactctatacaacaatcagctccaattctaaatggtggtgtaagtttttcttttctctgctctttgcatatgttttctacctaagcttggtggggatcttgtttggttgagatgtgtcataaattgtaagtgaaaatcctttgctcagaatagtcgatttcttatctaattatttgactagtaatccaccttgcatgatctctgtcctagcgatggtacccaattctaacagatggatcttatcgcgttggcgttgtcaagtacagtaggtgcttgccatttacatctatcattttctctcttaagacttgaaactgaaaaagatatttattgctccactaaacaatagttattgctaatcttctctttccattactactggtgaattgttatctctttgcttggacttgagactagctcaaagtgatagggttcttcatagttcatagcattttagggaatagggaatgtataaaatggattatcttatcaccctcttacaatgcctcttacacacctcttccattgcctcttacacagcttccattactttctcctgccttgtttactttgataaacttgtatgccttcagtttctgaaataatcaactggttgacacttaagttgctgtctttttttttcttccagcaattctaaatggtggtcagaacggaagtgccatgtctgcgcttggctctgagctagagaatgctgcagcagccatggccaatggccacgagccataaggtagtggtgtttagccatgtgctaaagccacgagcatcatcgcgcaatgatctctgcagtaggcggtcagttggagcctgcttagatatatggaatcctgcgcctgtaggttttaagagctgcgacagtgttttgtcccgtgtagtcatgtttgcagccgtcgcagctatagcaagtttgtttcttgtcttgagtcgtgactgttaagaactgatgaagttcattacttacgtgcgtgtagttatacttagatatgagatgttctagccatgcagcaacgttttctatcaatgtcagtaattagggagcgagcgtttggcacatggattgggcctcgaaacaaagaatcgacgcccaggagctaaactacagaaacatttcagctagagtaggtctggaatgatggaagagaagacaacaatgcaaatgaaattgataaaataacttaatataatatgggacaactatggttcaaatgaaaaagtatggttgacttaaaaaaaaaaaaaaaaagatcttacatatataatggtcttgtttagaaagcttgctatacaaacagtgttaatggttttttactatgctgccttcaatatatgtttaatgttgttttagatcatgatataacttggaatgggcctttagagtgaagataggactgcacggcaagcgatggcttgcgctctgaagaaccatgactacaaagagggcacttgcatttagtcatcactaatcaaactagaggaaattatattatgagggggaacgaatcattattggatcatttgatagaacttagaagtgccatatccatttgaatttagtcttatatgttgaattggattaagtcacatgctcaagatggctatgctcaacaacaatcgaagttggcatcttctattgatgaagaatgaaagatatggcatggactcaaaaagcttaactcaagcagcttaaacttgagttggcaaccatatcgtactattaagagatactccctccgtcccataatataagacaaccactttttgttcttgtatcataatataagatatgttctctctaaacacatgtatatcgatgcaatggtatagagagaattaaatatgtttcttggtctttaaaccagagatagttacactttatatactgggacggagggagtatgcaacatgataataattaattgtatctaataatgtgtttggtttgaagtcaaagtaagatgaggcggc

SEQ ID NO: 7654 - DNA, 745 bp, Zea mays
cacttaggatgcagcgtaatagaggtcagtttacatcttcaaaaccaaagcctgatgaaatagcagcatcagaaatggcagctgcagatggctctctgaattgggcactagttgaaggccgacctccatctgctgctgaatgtcatcactgtggtattaatgcaacagctacaccaatgatgcgtcggggacctgatggaccaagaacactatgcaacgcttgtggcctcatgtgggcaaataagggtctcctgagggacctatccaaatctcctgtacctcttcactctatacaacaatcagctccaattctaaatggtggtcagaacggaagtgccatgtctgcgcttggctctgagctagagaatgctgcagcagccatgggcaatggccacgagccataaggtagtggtgtttagccatgtgctaaagccacgagcatcatcgcgcaatgatctctgcagtaggcggtcagttggagcctgcttagatatatggaatcctgcgcctgtaggttttaagagctgcgacagtgttttgtcccgtgtagtcatgtttgcagccgtcgcagctatagcaagtttgtttcttgtcttgagtcgtgactgttaagaactgatgaagttcattacttacgtgcgtgtagttatacttagatatgagatgttctagccatgcagcaacgttttctatcaatgtcagtaattagggagcgagcgtttggcacaaaaaaaaaaaaaaaaaa

SEQ ID NO: 7655 - DNA, 1387 bp, Zea mays
ctggcaacaagtacttacgtactactacggagcaccgtggctctggaaagatgcttagtttgtgctttgattatcttgaaacccatgctgtgagtgtgatgcgtgtgattcaaacaagcatggaaggggttcaggaaacgcctggagtggactaaagaagtatgaaccgtccgtgctttttttaggagcctgcaactttacgctcagatgccagtggggccttgaaaaaaacctttccagttcgtcgaaaagcgcgagtcccatgcccacctcgcaaatcaagagcacaaatcgcgccattggcataacagcagtcttaaaacttttttggcgggtggtgtgaactgtagtgaatagcgcgggcggcgggcacatgcccttcacggtacggtccagcgcgcgagagcgaggaggaattaaaggccggccgggcgggccggcgctaaagccggtcgtcgaaagcccaccaccacgatccgcgccacaaaatagtgcggcgcgcccagccctgtcggctcggctgcctccgcctccgctccgcgccgcgcatatatccggtacctcgaggtccggccgggagtcagtccgtccccgaggaggaggaacagctaggtgtggacaggcagctctcagtctcacactctgccactcccaatcccagcctgagttctgctctgctctgcttctagccatggtggcctcgcggatcttgctcccgctgctgctctccctcttcctaggctcgcattgctgtaccggagcggcggcggcgaagcggcagctgctgcaggcgcgtcgagccggggacccgagctcgcagtcgcaggtgaagttcgacttctccccgttcctgatcgagtacaagaacgggcgcgtgaagcggctgatgggcacgaacgtggtggccgcgtcgtcggacgcgctgacgggcgtcacctcccgcgacgtgaccatcgacgcttcgacgggcgtcgccgcgcggctctacctcccgagcttccgcgccagcgcccgggtgcccgtgctcgtctacttccacggcggcgcgttcgtggtggagtcggcgttcacgcccatctaccacgcctacctcaacacgctggccgccagggcgggcgtggtggccgtgtcggtgaactaccggctggcgccggagcacccgctcccggcggcgtacgacgactcctgggcggcgctcaggtgggtgctggcgagcgcggccgggtcggacccgtggctggcccagtacggcgacctgtcccgcctgttcctggccggcgacagcgccggcggcaacatcgcgcacaacctggcactgcgcgcggggggaaggaaagcctggacgccggcgcgcgggatcaagggcgtggcgctgctggacccctac

SEQ ID NO: 7656 - DNA, 2361 bp, Zea mays
  misc_feature (2008)..(2008): n is a, c, g, or t
  misc_feature (2062)..(2062): n is a, c, g, or t
  misc_feature (2072)..(2073): n is a, c, g, or t
  misc_feature (2342)..(2344): n is a, c, g, or t
  misc_feature (2361)..(2361): n is a, c, g, or t
agaatatgtttgtagtaccttttttgcgaatcaaatgttttgggtggcaatattgcgaagcacaatgattagagtcccaaatatgcaattgtctctactactacggagcaccatggctctggaaagatgcttagtttgtgctttgattatcttgaaacccatgctgtgagtgtgatgcgtgtgattcaaacaagcatggaaggggttcaagaaacgcatgcagcttttcttcgcagcgctcaaacgcctggagtggactaaagaagtatgaaccgtccgtgctttttttaggagcctgcaactttacgctcagatgccagtggggccttgaaaaaaacctttccagttcgtcgaacagcgcgagtcccatgccgaccacctcgcaaatcaagagcacaaatcgcgccattggcataacagcagtcttaaaacttttttggcgggtggtgtgaactgtagtgaatcgcgcgggcggcggtcacatgccctgcacggtacggtccagcgcgcgagagtgaggaggaattaaaggcccggccgggcgggccggcgctaaagcggtcgtcgaaagcccaccaccacgatccgcgccacaaaatagtgcggtgcgcccagccctgtcggctcggctgcctccgcctccgctccgcgccgcgcatataaccggaccccagttccgtgacggccgcagtcagtccccgaggaggaggaacagctaggtgcggaaaggcagctctcagtctcacactctgccaatcccagcctgagttctgctctgctctgcttctagccatggtggcctcgcggatcttgctcccgctgctgctctccctcttcctatgctcgcattgctgtaccggagcggcggcggcgaagcggcagctgctgcaggcgcagtcgcaggtgaagttcgacttctccccgttcctgatcgagtacaagaacgggcgcgtgaagcggctgatgggcaccaacgtggtgtccgcgtcgtcggacgcgctgacgggcgtcacctcccgcgacgtgaccatcgacgcttcgacgggcgtcgccgcgcggctctacctcccgagcttccgcgccagcgcccgggtgcccgtgctcgtctacttccacggcggcgcgttcgtggtggagtcggcgttcacgcccatctaccacgcctacctcaacacgctggccgccagggcgggcgtggtggccgtgtcggtgaactaccggctggcgccggagcacccgctcccggcggcgtacgacgactcctgggcggcgctcaggtgggtgctggcgagcgcggccgggtcggacccgtggctggcccagtacggcgacctgtcccgcctgttcctggccggcgacagcgccggcggcaacatcgcgcacaacctggcactgcgcgcgggggaggaaggcctggacggcggcgcgcggatcaagggcgtggcgctgctggacccctacttccagggccggagccccgtgggcgccgagtccgcggacccggcgtacctccagtccgcggcgcgcacctggagcttcatctgcgcggggaggtacccgatcaaccacccctacgcggacccgctcctgctgccggcctcctcgtggcagcacctcggcgcctcccgcgtgctggtcaccgtgtcggggcaggaccgcctcagcccctggcagcgcgggtactacgccgcgctcccagggcagcggctggcccggcgaggccgagctgtacgagacccccggcgagggccacgtctacttcctcaccaagcttggctcgccgcaggcgctcgccgagatggccaagctcgtcgccttcattaaccgcgactagcagccgccggagtaaatccggtacatgcaggccgctgcagtgccgcgacaacatcagcatacctatagtaactagcgagagcgaggtgattggtagtggtaattacattacatttttttgggtccttgatgatggttactgtgcgtcggaagaaaagaacagagttccctctcntcccagaaaccatcgtccagagacagagatagagaagagggaccggtgtggttnttgcgcaganngttgcagtagtcatatagactgcagtctacaggctaccgtgccgtgcactgttaactgcgtgtagcgcggtactgccagactgccagttacagtagtcttcagagtataatattttttagtatagaagcgtcactctactaccgacccaatgcatcgtgtaacttttgtggtactaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaannnaaaaaaaaaaaaaaaan

SEQ ID NO: 7657 - DNA, 1576 bp, Zea mays
gcaatattccagaacacagcctcagcaccttccttcttctccgtctcgtcgtccctttccatttcctctcccatttatgtccccgcttcaggtctgccaaataaacccccgaaaagcaggagagcgagacccggtagtggaagactagggttagggtcccagctccgccgttgtctgggcgagtcgagacatggccggccctgcccccgccgttgcagccagtgccgccgcctcacagtcgccgccgatgcagctgccgtcgccgttcgcggagctagtcaagggttcctccggcctcgagaagatcgtgcttcgcggcgctcgcaactgctgtgccgagatctatctttatggaggtcaagtaacatcatggaagaatgacaatggggaagagttgctttttctcagcagcaaggctattttcaaacctccaaaagctattcgtggtggtataccaatttgctttccccaatttggaacacatggaaatcttgagcaacatggatttgctaggaaccggttttggactatcgacaacaacccaccccctttaccagtaaaccctgctattaaggcttatgttgatctgattttgaagccttctgaagaggatttaaagatctggccccacagttttgaatttcgcttgagagtttctcttggaccttctggagatctgagtctcacatcccgaatcaggaataccaacacagatggaagacctttctcttatacatttgcatatcacacatacttctctgtctctgacataagcgaggtgcgtgtcgaagggctggaaacaatggactaccttgacaacttgaaggcaaaggagcgtttcacggagcaaggcgatgctattgtttttgaatcagaagttgataaagtttatcttgccgcaccctctaaaattgccatcattgatcatgagaagaaaagaacatttgtcgtgacaaaagaagggcttcctgatgctgttgtttggaacccttgggacaagaaggcaaaagcaatgcaagattttggggatgcagaatacaagagcatgctgtgtgtggagcctgcagctgttgagaggcctattactctgaaacctggggaagagtggaaaggaaggcttgtgctttcagctgttccttcgagttactgtagcggacagttagatccatcgaaggtccttcagggttgaaaatcctcactttctgcatcttgtacagaagttcattgcccttaatatttgatgctgggctggcgtcaacgccgcatgttccttttgccatttccaccccctatatttctggtcccttttgtatctagaatttgagtgataggttgattccgaataacagtctgtgatttgagcttaggattgggtcatctcatcgatgaatgataccgctggacaaaatgctggcgtacgtgtcagtttcataaatcattcttctcataaattctttagcatgtacttcgtagttgatcatgtttcaaaaaatggtggacccttttgttactttcttgtctgataaggtttcgatcggtggttaaaaaacaaacaaaaaaactcgctcgtgccgaa

SEQ ID NO: 7658 - DNA, 1501 bp, Zea mays
cattgggtacctcgaggccggccggactcagtggctccctcgcggccggcccccatttatttcctccgcttcagctcccattctccgccaaataaacccccgaaaagcaggagaggcgagacccggaagtggaaggctagggttagggtcccagctccccgttgcctgggcgagccgagtgatggccgcccctgccccctccggcgcagctagtgccgccgcctcaccgtccccgctgatgcagctgccgtcgccgttcgcggagctcgtcaagggcccctccggcctcgagaaggtcgtgcttcgcggcgctcgcaactgctgtgccgagatttatctttatggaggtcaagtaacatcatggaagaatgacaatggggaagacttgcttttcctcagcagcaaggctattttcaaacctccaaaagctattcgtggtggtataccaatctgctttccccaatttggatcacatggaaatcttgaacaacatggattcgctaggaaccggttttggactattgacaacaatccacctcctttaccattaaaccctgctattaaagcttttgttgatctgattctgaagccttctgaagaggatttaaagatctggccccacagttttgaatttcgtttgagagttgctcttggaccttctggagatttgagtctcacatcacgaatcaggaacaacaacccagatggaagacctttctcttatacatttgcatatcacacatacttctctgtttctgacataagtgaggtgcgtgtcgaaggactggaaactatggactaccttgacaacttaaaggcaaaggaacgtttcacagagcaaggcgatgctattgtttttgaatcagaagttgacaaagtttaccttgctgcaccctccaaaattgctatcattgatcatgagaagaaaagaacatttgtcgtgacaaaagaagggcttcctgatgctgttgtttggaacccttgggacaagaaggcaaaagcaatgcaagattttggggatgcagaatacaagagcatgctgtgtgtggagcctgcatctgttgagaggcctattactctgaaacctggtgaagagtggaaaggaaggcttgtgctctcagctgttccctcgagttactgtagtggacagttagatccattgaaggtccttcagggctgaaaatccttactttctgcctcttgtacagaagttcattgcccttactatttgatgctgggctagcgtctacgccgcatcgtccttttgccatttccaccacccgctatatctctggtcctttttgtatctagagtcttgagtgataggttgattccgaataacagtctgggctttgagcttagccttgggtcatctcatcggtgaatgctgaatggtacaaaatactggcatacgtgtcagttttataaatcatttctgggcagcacagattctttaaaaaaaaaaaaaaaagatccgccaaaaaaaaaaaaaaaagggcgg

SEQ ID NO: 7659 - DNA, 1276 bp, Zea mays
cctcgaggccggccgggccgggagttataaaataatgtcctactcctaccccgccgccccgccccgccagcacaagcccctctccgcccccagccagccctcctcagatctcaatcccggcgctccctccctccctcctcgcctcgggacagcgagcgccgccgtccgccgtccatggagcacgacgccgaggcgcgccgcgggttcgccaggatgggcttcgggtgcaagcactaccggaggcggtgccggatccgcgcgccctgctgcggcgacgtcttccactgccgccattgccacaacgagtccacgaaagacgggcacgagctggatcggcacgacgtccaatcggttatctgcctcgtctgtgacaccgagcagccgatcgcgcaggtgtgctgcaactgcggcgtctgcatgggggagtacttctgcgcagcctgcaacttcttggacgatgacgttgacaaggagcagttccattgccacgattgcggcatctgcagagtaggaggaaaggagaacttcttccactgccaaaagtgtggatcctgctactcgacgacccttcgcgacaggcactgctgcatcgagaactcgatgaagaacaactgccccatctgctacgaggcagtacctgttcgattcgctgagggagacgtcggtgctccgctgcggccacaccatgcacctgcagtgcttccacgagatgttgaagcacgacaagttctcgtgccccatatgcgccacgcccatcttcgacatggacaagttcttcaaggccctcgacgcagagatggaggcaagctacttgtacacgggaaagggatgggtcgtgtgcaacgactgcagggacacgacgcaggtcttctccggcgtggcgggccacaagtgctgccactgccagtcccacaacacctgccgggtggcaccccccgtccttccgtagccaccaccaacaccacatcattgttgttggaattggatgcagccagccaagatacccccccagcagctacgctattattaccagtagcgcctgcgcttttacacaccgctccgttccagtccatgatgaactgcataatttcgtgccatgcaggtatgtacgtacactgttattggagatcggaagatttatccgactcgggacgtattatttgtaccacaacaaaacacgtgttactattgtaataccagatccggatacgtacctttcttttggttgcttgaacgagtggtatttcccttggagtgtgtataacatttatttatt

SEQ ID NO: 7660 - DNA, 1421 bp, Zea mays
  misc_feature (1149)..(1149): n is a, c, g, or t
  misc_feature (1199)..(1199): n is a, c, g, or t
  misc_feature (1204)..(1204): n is a, c, g, or t
  misc_feature (1211)..(1211): n is a, c, g, or t
  misc_feature (1217)..(1217): n is a, c, g, or t
  misc_feature (1236)..(1236): n is a, c, g, or t
  misc_feature (1245)..(1245): n is a, c, g, or t
  misc_feature (1251)..(1251): n is a, c, g, or t
  misc_feature (1255)..(1255): n is a, c, g, or t
  misc_feature (1269)..(1269): n is a, c, g, or t
  misc_feature (1286)..(1286): n is a, c, g, or t
  misc_feature (1294)..(1294): n is a, c, g, or t
  misc_feature (1296)..(1296): n is a, c, g, or t
  misc_feature (1324)..(1324): n is a, c, g, or t
  misc_feature (1327)..(1327): n is a, c, g, or t
  misc_feature (1372)..(1372): n is a, c, g, or t
  misc_feature (1386)..(1387): n is a, c, g, or t
  misc_feature (1401)..(1401): n is a, c, g, or t
  misc_feature (1411)..(1411): n is a, c, g, or t
  misc_feature (1420)..(1420): n is a, c, g, or t
ctcggtacccctgccacgcgggcttcttccacgtccgtcccgcggacttcttagctttgcttgcatcgtcaaggtcgagcaccgtagaccgccattattgtctccgtggaaaacgtacgtaggacgacgacgtacgacgtgtgtgccaggctctgcggcgccggaggggtgacacgaccccatgcatgcaacttgatccagatggccgccttatagctgtggcgatcgagtgtggctagtgctagctagtagtcaacccggctggccgcccgcccgccgaacggtgcaacacacaccacgtccacatgcatgaatataatgcgtcttttttggagtctctctggacgcgggaaacgtaccagactggcaactctgggaggccgaggcgaggcgaggctcatcagacctcgatcggatgggacgtgcgtgtatgcgtcttgtgtgtatataaaggggaggccctggtcgctgccgcccggaccccaggctagtgagtgagagagagagagccagagagaacatcgatcgatcgatcgacgaccatggcgaggcaacgacaagttgcttccatgcttgcagctgctctgctcgttgcaacgacgttcgcgtccattcctacaaccgtgcactccatcggcgtctgctacggcacgctgggcaacaacctgccgtccagcagcgacgtggtgcagctctacaggtccaagggcatcaaaggcatgcgcatctactcccccgacgccaaagccctcgccgccctgcgcaactccggcatcgcgctcatcctcgacaccggcaacggcggcggcgtcctgggccagctcgccaggagcgcctcgttcgcggactcgtgggtgcagagcaacgtgcgcccctactaccccgccgtcggcatcaagtacgtcgcggtgggcaacgaggtgcagggcgacgacacgcgcagcctcctcccggcgatgcgcaacctggacgccgccctggcgcgcgccggcttcccgggcatcaagtgctccacgtcggtgcgcttcgacgtggtcgccaactcgttcccgccctccagcggctccttcgcgcagggctacatggccgacgtcgcgcgctacctggccggcaccggcgcgccgctgctcgccaacgtgtacccttacnttcgcgtacccgggacaacccgcgcgacatagcctgggctaccacttcanccggnacacctnaggganacgggacggcttaattcanaactgttanacctgngganaccttttcccgctnaaaagcgggcgccaaantaaggtcntnccaaacgtggcttggcggggtttgggcngtnaaaggcgaatcacaggatatgaactggcgggaccaaagacgcctngaacttttcttaannaacaagggtcccgnaaatgctttngaaaaaaant

SEQ ID NO: 7661 - DNA, 1905 bp, Zea mays
  misc_feature (83)..(83): n is a, c, g, or t
tcaagcagtagatttattagtatacatatatatatatatatatatatatataacttcatgcgtgtacgctagaggatatcgangaatcgttcggtctttcatcatccatccaactctctgctgcataaatcacgaatatatgcctaataattttgtttcgacacgtacgtattctcaccttctctccttccgtacgttgatcgccagataaacaactaattaatcaagcactccaaagatgatttgcagctagcgtgcatccgaatatatgcaaatattttgccaacatgtgctagctagtatatatgctccttcgcctcccccggccccgccggcgacgtttcattgcgtgcagccgtgcactccatcggcgtctgctacggcacgctgggcaacaacctgccgtccagcagcgacgtggtgcagctctacaggtccaagggcatcaaaggcatgcgcatctactcccccgacgccaaagccctcgccgccctgcgcaactccggcatcgcgctcatcctcgacaccggcaacggcggcggcgtcctgggccagctcgccaggagcgcctcgttcgcggactcgtgggtgcagagcaacgtgcggccctactaccccgccgtcggcatcaagtacgtcgcggtgggcaacgaggtgcagggcgacgacacgcgcagcctcctcccggcgatgcgcaacctggacgccgccctggcgcgcgccggcttcccgggcatcaagtgctccacgtcggtgcgcttcgacgtggtcgccaactcgttcccgccctccagcggctccttcgcgcagggctacatggcggacgtcgcgcgctacctggccggcaccggcgcgccgctgctcgccaacgtgtacccttacttcgcgtaccgggacaacccgcgcgacatcagcctgggctacgccacgttccagccgggcaccaccgtcagggacaacggcaacggcctcaactacaacaacctgttcgacgccatggtggacgccgtcgtcgccgcgctcgagaaggccggcgcgcccaacgtcagggtcgtcgtgtccgagagcggctggccctcggccggcggcttcggggccagcgtcgacaacgcgcggaaatacaaccagggactcatcgaccacgtcggccgcggcacgcccaagaggaccggcccgctggagaccttcgtcttcgccatgttcaacgagaaccagaagggcggcgatcccacggagaagaacttcggcctcttctacggcaacaagcagcccgtgtacccgatccggttcaactaattaagagtggcggatcggaggaataatacatcttcatcaatcaattaacctaataatatgctacatgaataagctgctgcgtgcatgtggccggccggacttgtggaggagcggtgcaattaacttgtatgcacgtactctatctatatatgatgaataaaaagagatagaattctgatgcattcaaaaaaaaaaaaaaagcgccaagctcccgcctgcgtttccttcgtgcttaatgcccaaaacaaatcaaaattatctgtggctcatgcatacacttacacacttgatatgaataatttcacaatgtatatatttacttttaagtggtataaattagtaacttagaaacacatatattcataagttatggctgttatactttttcatagtaaaatatgttggtaatttacatgtagatttgaggggacattttatttgtaaactagcatatgtgaataatttagtctgggggatttaacccttgaacaacggagtcaccaaagtcgaataacaagtcttaactaatacattatcagagttgcaaattattcttgttgctcagggggccttcgcctaaactcatgcaaaagagaacctttggaagcg

SEQ ID NO: 7662 - DNA, 1722 bp, Zea mays
  misc_feature (1538)..(1538): n is a, c, g, or t
gggaaacgtaccaggctggcaactctgggaggccgaggcgaggcgaggctcatcagacctcggatgggacgtgcgtgtatgcgtcttgtgtgtatataaattgggttcctcgaggccggccgggaagagagcaaactagtgagtgagagagagagagacagagagatcatcgatcgatcgatcgacgaccatggcgaggcaacgacaagttgcttccatgcttgcagctgctctgctcgttgcgacgttcgcgtccattcctacaaccgtgcactccatcggcgtctgctacggcacgctgggcaacaacctgccgtccagcagcgacgtggtgcagctctacaggtccaagggcatcaaaggcatgcgcatctactcccccgacgccaaagccctcgccgccctgcgcaactccggcatcgcgctcatcctcgacaccggcaacggcggcggcgtcctgggccagctcgccaggagcgcctcgttcgcggactcgtgggtgcagagcaacgtgcggccctactaccccgccgtcggcatcaagtacgtcgcggtgggcaacgaggtgcagggcgacgacacgcgcagcctcctcccggcgatgcgcaacctggacgccgccctggcgcgcgccggcttcccgggcatcaagtgctccacgtcggtgcgcttcgacgtggtcgccaactcgttcccgccctccagcggctccttcgcgcagggctacatggcggacgtcgcgcgctacctggccggcaccggcgcgccgctgctcgccaacgtgtacccttacttcgcgtaccgggacaacccgcgcgacatcagcctgggctacgccacgttccagccgggcaccaccgtcagggacaacggcaacggcctcaactacaacaacctgttcgacgccatggtggacgccgtcgtcgccgcgctcgagaaggccggcgcgcccaacgtcagggtcgtcgtgtccgagagcggctggccctcggccggcggcttcggggccagcgtcgacaacgcgcggaaatacaaccagggactcatcgaccacgtcggccgcggcacgcccaagaggaccggcccgctggagaccttcgtcttcgccatgttcaacgagaaccagaagggcggcgatcccacggagaagaacttcggcctcttctacggcaacaagcagcccgtgtacccgatccggttcaactaattaagagtggcggatcggaggaataatacatcttcatcaatcaattaacctaataatatgctacatgaataagctgctgcgtgcatgtatgtggccgccggacttgtggaagagcggtgcaattaactgtatgcacgtactctatctatatatgatgaataaaaagagatagaattctgatgcattcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaanaggggggcaccctttgaaggggtccaaaataacggccccggcgcaacaaacttaaatttttttttatggggcccccaaaataaaatcactgggccgggttttaaaaaccggggggcgggaaaaacccggggttccccaacaaaaaagacttggaaaaaaaccccctttttccaagtgggcaaaa

SEQ ID NO: 7663 - DNA, 1293 bp, Zea mays
ggcgggacggtaccctcgagggccggccgggaagagagcaaactagtgagtgagagagagagacagagagatcatcgatcgatcgacgaccatggcggggcaacgacaagttgcttccatgctgcttgcagctgctctgctcgttgcaacgtttgcgtccattcctacaaccgtgcactccatcggcgtctgctacggcacgctgggcaacaacctgccgtccagcagcgacgtggtgcagctctacaggtccaagggcatcaaaggcatgcgcatctactcccccgacgccaaagccctcgccgccctgcgcaactccggcatcgcgctcatcctcgacaccggcaacggcggcggcgtcctgggccagctcgccaggagcgcctcgttcgcggactcgtgggtgcagagcaacgtgcgcccctactaccccgccgtcggcatcaagtacgtcgcggtgggcaacgaggtgcagggcgacgacacgcgcagcctcctcccggcgatgcgcaacctggacgccgccctggcgcgcgccggcttcccgggcatcaagtgctccacgtcggtgcgcttcgacgtggtcgccaactcgttcccgccctccagcggctccttcgcgcagggctacatggcggacgtcgcgcgctacctggccggcaccggcgcgccgctgctcgccaacgtgtacccttacttcgcgtacagggacaacccgcgcgacatcagcctgggctacgccacgttccagcccggcaccaccgtcagggacaacggcaacggcctcaactacaacaacctgttcgacgccatgggtggacgccgtcgtcgccgcgctcgagaaggccggcgcgcccaacgtcagggtcgtcgtgtccgagagcggctggccctcggccggcggcttcggggccagcgtcgacaacgcgcggaaatacaaccagggactcatcgaccacgtcggccgcggcacgcccaagaggaccggcccgctggagaccttcgtcttcgccatgttcaacgagaaccagaagggcggcgatcccacggagaagaacttcggcctcttctacggcaacaagcagcccgtgtacccgatccggttcaactaattaagagtggcggatcggaggaataatacatcttcatcaatcaattaacctaataatatgctacatgaataagctgctgcgtgcatgtggccggacttgtggaggagcggtgcaattaacttgtatgcacgtactctatctatatatgatgaataaaaagagagagaattctgatgcatac

SEQ ID NO: 7664 - DNA, 777 bp, Zea mays
  misc_feature (744)..(744): n is a, c, g, or t
  misc_feature (747)..(747): n is a, c, g, or t
  misc_feature (755)..(755): n is a, c, g, or t
  misc_feature (760)..(760): n is a, c, g, or t
  misc_feature (771)..(777): n is a, c, g, or t
gggtcggaaaacctgcccaataaaaaattcttcggggccaaagtgtggcttaacacgggttccagaagaaacttggaccccgaacaagcgccaccaggggagtcgattatgatgtccacgccttccacaataacagttatctctcctgaaacatcaagtttctttcctctaagccactgcagagaaactctggcctcattaatctttccatcacttgcaagccacttaggtgactctggcaagtagtaacccaacaaagcaaagtagacgatggaaggagcaaagattgcaccaatcatgattctccagcttcaatagaaggtccattcaacaattcaaattctttttccatatgatgattagcttctgataatgctgcaaaatcccatccaagcaatgcatacccaatagaaacaacagctgctgaaaacactgttgacttcatctcatcaagtactatagcccttttgcaaacaattataaaacctgtgagcgtgcgagttcacgggagggaaccagctggtgcggggacggacggaggagaggcggagcgggtttggtcgccgctggcagcttagatgcggaggagcgacggcgtcagcgacaagcggcagcggcagcagggactagggagactggagacgatgatgattagtttcacagattagcagagatggagaccggggggggggggggggggggcccctgcagccccgggggatccacttgttatagagcggcccnccncccgcggnggagntcccagttttnnnnnnn

SEQ ID NO: 7665 - DNA, 890 bp, Zea mays
tgacttggcaatcggaccatggactacctacagagttcattcacttgatcgaacaatgtggacagctgattgtagttctgatggcacacatgcagctttcggttcggaccttggtgctggtctgatcgatttggaaacaaggggatcatcgtggttatgtcgttctaaaagcgacattctttccctgaaatttgtgcactcgggaaaagttgtgctatgtggtctacggaatgggagtatagcccctgttgatgtacggcaaaaacagcataatcagcctactggagtagcttcatctagcaatgctaggaggacagttcccatgctgcccacaaggcatcgtgggaagcaaagaaaccaggctagcaaggataaattttcaagagttatttctatgtcgtcagcagtttgtagcttggtttcactctcatcagatgagaactacttcttaggaagctccatggatggatctatcaaactcttcgatcttcgcctcattcagaagggaggtatacagtcgtatggggggcatgtcaactcacacacacatttaccacttgctgttgatccatctgagaccttacttatgtcaggtggggaggactgcactgttcgcatctggagcatcaaaacaggcgagctaatctttgcgcggagcatgggagacagtcccttcacggcatcttgttggcccgaaagcagccatggcttgtgcagtccttggctggttgatgtaaaccacagctggggagcttggttggggtcacgtgctgggctgttctatatgcatggtacttgagttattggagccttggagtctggagcaaaaaaaaaaaaaggtggctgtattctcaaggaacatgagaccactgagctctagagtgaatgaa

SEQ ID NO: 7666 - DNA, 1108 bp, Zea mays
gagcacaccgcgtcgctccatagcagaggacagaggaggagcaagcgagcaccgagcagaggcagagtgctatggaggcgcggaggacggggagagactcctcgcgagcttcgtgctcgcggcgttggccgcgcaggcattcgtggccgtggtcgagtccagggccagccgggcggagaaggctagccaaggcgacgacgtgaagaagccggactgcgtgccggggatggacccgcgctcgttcccgggaatcggcagcggcggccacggcggcggcatcacgcccgtgactccgtcgcacggaggctccaccgggacgccgtcccacggcggcggcggcggcggtggggacttgccgtcgccgtcgcacggagggacaacgctgccttccccgtcctacggcggcagcggtggggacttgccatcgccgtctcacggagggacaacgctgccttccccgtcccacggcggctccgggtccacgccgacatcgccctccaccgccgggctccccgtcccacggcggctccgggtcctcgccgacagccccctccaccggtggcggctacggtggctccccgtcccacggcggcggcgcgtacggtgggtctccgtccactcccggcagcggtggcgcctacggaggcgggtctccctcgccggcccatggtggcggcgcctacgggagctccccgacgcccgcgtacggcgacgccccctcgcacggcggcatagggacctcgtcgccgacgccgctcggcgacccccacagcttcggctctctcccgggctcctgcgactactggaggtcgcacccgatggagatctggtcggcgatcggcgggcggttcccgggcacgtcgtcgtcgatggggacgatgggccacttcttcggcgcggctggcagggtgggcgggacggacgtgagcatccaggacgcgctggcgaacacgcggtcggacggcgcgggcgcgctgctgcgcgagggcgccgccgcgctgctcaactccatgacccgttcgggcttcccctacacgacggagcaggtgcgcgacgcgttcgccgcggcggcggcggcggcggcgggcgggtccgacggcgcggccgc

SEQ ID NO: 7667 - DNA, 1181 bp, Zea mays
acacacacacatccatcaaagaaacaagcgcacaagatcaaatacctcgccgccaataatggcctccaggtcctccatcctgctcgccatggtgatgctggctgcgctattcgccgttggtttgtgcaccacccccctcaccttccaggtcggcaagggatccaagcctggccacctgatcctcacccccaatgttgccaccatatccgacgtggagatcaaagagcacggtggcgatgacttctcctttacgctcaaggagggcccgactggcacctggacgctcgacaccaaggccccgctcaagtaccccctttgcatccgctttgctgtcaagtccggcggctaccgcatcgccgacgacgtcatccctgccgatttcaaggccggcaccacctataagaccacactcagcatctaatcaatctctggtgatgaattagatgctgagtgtggtcttataggtggcggcgcctacgggagctccccgacgccggcttacggcgacgccccctcgcacggcggcatagggacctcgtcgccgacgccgttcgacccccacagcttcggctctctcccgggctcctgcgactactggaggtcgcacccgatggagatctggtcggcgatcggcgggcggttcccgggcacgtcgtcgtcgatggggacgatgggccacttcttcggcgcggctggcagggtaggcgggacggacgtgagcatccaggacgcgctggcgaacacgcggtcggacggcgcgggcgcgctgctgcgcgagggcgccgccgcgctgctcaactccatgacccgttcgggcttcccctacacgacggagcaggtgcgcgacacgttcgccgcggcggcggcggcggcggcgggcgggtccgacggcgcggccgcggcgcaggcggccgccttcaggatggccaacgaggggaaggcgtagagatcgagcatgtgtacgtacgtgcatggtaaactggagtgtgtgctccggagcacggtacattcttggctgctgctgttgctttcatgcatggctacgacgtaatacgtgccttggttgtgtgcgtttgtgtgtgtgtgtgtgtttgagtgtttcatcggtgaagaagacaccgagctagacctagcttattctggtgtgtagtcgctcgctcttgctattttttgtcgtttgg

SEQ ID NO: 7668 - DNA, 3326 bp, Zea mays
gctcaatagcaagcggaggcgctgcgctgcgtctattgtggaatcttaaagcgctcgaatgacatttgaaaattcaggctggagttggtatagccgcaacgaaaaatgatgtaaaaatgagttttgcattcgcgttcatgttaaaacttgctacgtgttctgttcaggtcgagcccgcctagcgtcacaccgtccgggaaaccacgacctagagcctagatcctagaggacggaagccctggatgagatggcaaacatcatctcgagactcatcaaccggctcacgaccgtcatcattcaggctgcacgcccttctcgataagctttgtgcctccgtgagtccatttttcaagaacagcccgggtcgctggcatggccggcgcccggcggagagcgtccatttttagcatggccggagagcatccattttttattagtagataagagcgagatcgcggggggccaacggctcggtgccaactgtcgccggtgtggcccgcacggcgcgaatcgcccgacaactcgggcgctgccgcggcccctctgtccccgtcgcatcccacccacttgccatgtcacgacggccgccagcgacagcgacgagctcgtcacagccttccgccgcgatcgcgacgccactgctgtggaatcgtcgaggcttgattcaccgcgcgcgcacggcacggacgtccggccgctgcagcgttttaactgcgcacgacacgggcccgggacgcaacccgatgaggtgaggaggcgcacgggcacaggcacaggcacgggcgaacaaattgacccgggagccgggacggcgacttccgtggtcagtcggtcctccacgtcgctcgttcgcgccgaagacccgcccaggccgccccacacggccacagctcaaatcattgggtacctcggagcccgccggggagaatcgcttcgtcccgacagccactactaggaattgccgagcgagcgagcttgcgccgtgcgcgatggagggtgacgagaagtcggcgggcggggcccctgcttactggggcctgggcgcgcggccctgcgacgcgtgcggcgccgaggcggcgcgcctctactgccgcgcggacgcggcgttcctgtgcgccgggtgcgatgcgcgggcgcacggcgccgggtcgcgccacgcgcgggtctggctctgcgaggtctgcgagcacgcgccggcggcggtcacgtgccgcgcggacgctgccgcgctctgcgcctcctgcgacgccgacatccactcggcgaacccgctcgcgcgccgccacgagcgcctccacgtggcacccttcttcggcgcgctggccgacgcgcccaagcccttcgcctcggcggcgccgcccaaagcaaccgacgacgacgggagcaacgaggacgaggcggcgtcgtggctcctccccgagcccgaccacgggcagaaagaaggcgccacgacggaggtgttcttcgcggactccgacccgtacctcgacctcgacttcgcgcgttccatggacgacatcaagaccatcggcgtccagcagagcgggccaccagagctcgacctcgccggcaccaagctcttctactccgatcactccgtgaaccacagtgtgtcatcgtcggaggcagcgggggcgcccgccgcggcgcctgccttcgctctacgcacgtcccagcactacttacttgaagttgaagttaagccatgacgtgacgtcctatatctcactctcagtgttctgaaaataaagacacggatacgattgcaggtgtcatcgtcggaggcagcggttgtgcccgacgcggcgtctggcatggcgcccatggtggcagtggtcagcaggggcctggagcgagaggcgcggctgatgcggtaccgggagaagcgcaagagcaggcggttcgagaagacgatccggtacgcgtcccgcaaggcgtacgcggagacgcggccgcgcatcaagggccggttcgccaagcgcacgcccggggctggggaggacacgctggaggagcacgaggagatgtactcctccgccgctgccgccgtggctgcgctcatggcccccggcggagccgatgcggactacggcgtcgtgcccacatattgatctatgcaattgcaacgccgacatgtacactagttggcctcgtgctctggggctgtaatttttgctgcatgcattgcatgcaaagctcttattgattgcctgtatgattaacggaagccattacaagcacggcctccctccctccctttcccttcctatgtttctttcttccctcactacgagctgctaatctgcatctttttattcttagtaattacttaaacaagatggtctttcttgagtgttctatttctatatatgcactctcagctgtcactggacagagagatgtgatgagtcaattgggatgtttttccgtaaattgggatgttgtaagcctccaggcaagaagcaaccaggacagcgattctgttctgcccctttacgcctaaacaaaatacgcgtttctagataaggtgagccagactatttcagctttttatacgacaccgtaccggactatttggcttgggtagtcttgtttatttcatcactcgtatcttcatcctcctctatatgtggcatccatctcattcacctctgacaggctccagctctaacacgaatacatgattggtcagtggtcgccctcgctctccttcacatccgatagtctgcggtctgtgagggagaaagatggtggatggagacaaatgcagtgaaacgatatggtagtagtattatggttgcctaattcttcaataagcactggaatatggcactctcactcacagagtactctcacttgacaatgcatctatattggtggaattgaggatgcatatgatatatagcggtcctattgatcatgtatgtcacttgaatctccaaaaccgcaaaagtgttgatgatttaatgcttgtgactttgtcactaccctatctgaactttagtctagcaaaatttatgtcttttatgacggtgcatgatgaatctacgatgttatggagttgtcaagttgaccagtattgttgttttgttgttcactatttgacctctggagccatctacatttttatattcatgtcttttgcgaacctttttgcaaagctgctaactgcatgcgtgcgtaagaagaatgttttactcagatgttatgaatgataaaacatatcctttcgtcgagctatttttagggtaaaacaggtggaattgcataaattatcaaagttactagagttggtgttttgaccccgagggtcctaccaactagag

SEQ ID NO: 7669 - DNA, 1402 bp, Zea mays
cacgtctctcgttcgcgccgaatcccgcccgggccgccccacacggccacagctcaaatcattgggtaccttcgagaccgccggggagaatcgcttcgtcccgacagccactactaggaattgccgagcgagcgagcttgcgccgtgcgcgatggagggtgacgagaagtcggcgggcggggcccctgcttactggggcctgggcgcgcggccctgcgacgcgtgcggcgccgaggcggcgcgcctctactgccgcgcggacgcggcgttcctgtgcgccgggtgcgatgcgcgggcgcacggcgccgggtcgcgccacgcgcgggtctggctctgcgaggtctgcgagcacgcgccggcggcggtcacgtgccgcgcggacgctgccgcgctctgcgcctcctgcgacgccgacatccactcggcgaacccgctcgcgcgccgccacgagcgcctccacgtggcgcccttcttcggcgcgctggccgacgcgcccaagcccttcgcctcggcggcgccgcccaaagcaaccgacgacgacgggagcaacgaggacgaggcggcgtcgtggctcctccccgagcccgaccacgggcagaaagaaggcgccacgacggaggtgttcttcgcggactccgacccgtacctcgacctcgacttcgcgcgttccatggacgacatcaagaccatcggcgtccagcagagcgggccaccagagctcgacctcgccggcaccaagctcttctactccgatcactccgtgaaccacagtgtgtcatcgtcggaggcagcggttgtgcccgacgcggcgtctggcatggcgcccatggtggcagtggtcagcaggggcctggagcgggaggcgcggctgatgcggtaccgggagaagcgcaagagcaggcggttcgagaagacgatccggtacgcgtcccgcaaggcgtacgcggagacgcggccgcgcatcaagggccggttcgccaagcgcacgcccggggctggggaggacacgctggaggagcacgaggagatgtactcctccgccgctgccgccgtggctgcgctcatggcccccggcggagccgatgcggactacggcgtcgtgcccacatattgatctatgcaattgcaacgccgacatgtacactagttagcctcgtgctctggggctgtaatttttgctgcatgcattgcatgcaaagctcttattgattgcctgtatgattaacggaagccattacaagcaaggacttcctccctccttttcaattcctatgtatattactatcatcactacggcccgagccgaattccgagttgacccgcgtctttttattcttagtaattacttaaacaagatggtctttcttgagtgttctatttctatatatgcactctcaagggt

SEQ ID NO: 7670 - DNA, 1440 bp, Zea mays
gcacgagcagcacagactgcaattgagctgccacgaccccgaaccaatcaacgaacccctctcacgcgcttgtcatttgtcgcgccccacagctcaggaatccccacagctcacacaggcacgcagctcctcttggcggcgcctctgacttctcctttttcgtcgcccttctcctttttcctcgccttcgatcggcggccgccaccctcctcgacttccgtcccttcaccgagccgccgccgccgccatgaagggacccggcctcttctccgacatcggcaagaaggccaaggatctactcagtaaggactacacttacgaccagaagctgaccatctccaccgccagcgcctctggactgggcctgacttccacagctgtgaagaaaggagggctttattctcttgatgtcagttcagtttacaagtacaagaataccactgttgatgttaaagtggacactgaatcaaatatctctactacattgaccgtgttggacgccttgccatgcacaaagcttgtcacttctgtgaagctgcctgactacaattatggaaaggtggagctgcaatacttccatgagaatgcaacttttgccactgttgttggcacgaagccttctccagtgattgatctttctgggacagtaggtgctcaaggagttgcatttggtgcagaagctgggtatgacactgctacgggaaaatttaccaagtacactgctgcaattggtgtaaccaagccagactaccatgctgcattcattctggcggacaaaggtgacaccattaaagtgtcaggtgtttatcaccttgatgagaaacagaaggcctcagctgtggctgagctaacccggaggctctcaacaaatcagaacacactcacagtcggtggactgtacacagttgatccccagacagctttgaaggcaagactcaataacactggaacgcttgccgcgcttcttcagcatgagcttaaacccaagtcgctcttgacaatctctggtgaattcgacacaaaggccctggacagatccccaaagtttgggttggcgcttgcactgaagccctgatcagatcatcccatgttgattggtggtgaatcttgaattcatttttttttttttgcaaagctgtagccaataattcgttccacgaaccttttctgttaatccggcaaatgtttggagcactgtgggtaggatccggatgggtcgcctacatgaaattttacctgtctgcccttattgttgaaagcatctggccgttggtaaatgtacattgtgcttgtttctttagcacctaggcctctctgctactgctactgagggcttgaggacagtaaccttttccatgtagaaattgcatgctgatcgtttgatttactgctcacataaggtttaccacttgtttggagcccaaaaaaaaaaaaaaaaaa

SEQ ID NO: 7671 - DNA, 387 bp, Zea mays
tacacagttgatccccagacagctttgaaggcaagactcaataacactggaacgcttgccgcgcttcttcagcatgagcttaaacccaagtcgctcttgacaatctctggtgaattcgacacaaaggccctggacagatccccaaagtttgggttggcgcttgcactgaagccctgatcagatcatcccatgttgattgatgattggtggtgaatcttgaattcatttttttttttgcaaagctgtagccaataattcgttccacgaaccttttctgttaatccggcaaatgtttggagcactgtgggtaggatccggatgggtcgcctacatgaaattttacctgtctgcccttattgttgaaagcatctggccgttggtaaatgt

SEQ ID NO: 7672 - DNA, 2906 bp, Zea mays
  misc_feature (994)..(994): n is a, c, g, or t
gctgttttgagttgttttcttttttaaaaaaacagcagcacacggaaaaagacacacttgccctcctctcacctaatcaatacaggcatcggatcctcctctgctctgccgctctggagagagtgaggcgtcgactctagctcgacgcagcaggcgccccctagtcgccacccctgccgctgccaaggagacctcccccgccctgcaaatcatctcacgaaggaggtaatccgcgcctcctctgctcctttttttcgattcgaaaatttctctagtggttcttcaacagtttctaaccctaggttcgaatgtttttggggtacatgctggccaatgctataggattcgagggctgatgcaacgggattcgagggctcatggttaggatggacgctcctgattccctacgaaggtatgatgcagtgggatttcttctcctcttgcatacattatgagcctcctggagctaatgaagaatggagatacttcaaaaatgggaatagaaatggtcaacctgaacaagatgtgtcagaacaacagcaggatgtgcatgtccctcctccacatattttgcctacaaatttccatgaccatgacactgaatgtgtacctacagatgaatctgttgttgtagcttcatcttatgtgcccattggtacttatgatagagatgacccaaaaataaagaaggggtctacatttgatgataagtctgtattcatcatgactttcaagcagttctgcattaagaacgaatttaagacattattgcaacatagtgattctgagcggtacagggcaaaatgcaagtttcctggttgtaggtggtcactgtatgcgaagaaatgcttggttgtgatcattcatggtttgttgtccatgtgtatatcattttttagttcttgctaacatttgctaacatttactaactttgcaggtggtttctattggccctaaacatgattgcgcaagcactagcaaggtgacaggaaangaagcttctgcagcttggattgccaatagagtgaagcctatgttgattaaagagccagggcttggtgcaagagaaatgcagtataggttggaggatcagttcacagtcactttgtcatataacaaggtctgggaagggagaaagttggcactaaaggaacttcatggtacatgggaggatagcttcaagttgctatggaattggaaagcagccgttgaggcaacttgtcctggaagtctcattgagattgattgcaagaaggtaaagggacagatgcacttctcaaagatgtttgtggctttacggccttgtgtcaatggatttcttatgggatgtcggccttatcttggagtagactcaactcatttgactggaaagtaccttggacagcttgcttcagcgacagccatagatggacataactggatgtatccagtagcatatgccatatttgacaaagaaacaaatttgaattggaaatggtttatgacactcctgaagagggctattggaacacccccaggtttgaccatacacactgatgcatgcaagggtcttgcatatggggtgtcacaagtgtttggtgatgcagctgaacatagggagtgttttagacacctcatggctaatttcaggaggaagtacaatggtgaggtgctgaaatacatgtggccttgcgcatgggcatgcacacatgagagacatcaagtacttatggataaaatttcagaaacttgtccaaacgctgtcgcatatcttagatatgaccacccacacttatggacaagagccaaattcaataaaatctgcaaggtggattacgttaataacaacatttcagaatgtttcaacaattggattaaaaatgtgaaggagttgcctgcagttgatctcatggacatgctcagggtgatgataatggagaagattgctacaagacagtccatagccaataaaatgcaaggccacatcctacctagtgtagttaatgatctgcatgagaagagtaggaatcttcgatataccatcactaaaagtgggtacatgaagggtgaggtttctggtgctagtagagatggtgttgcttggagatatggagtaaaccttgttactcaggcttgttcatgtggacagtgggatgtaactggaaaaccatgcactcatgccatagcattcataacttctcaacgaaatttgagaatcgaggactatgttggagaatgttattcggttcaaaggtttaaagatgcataccaatttgaggtgtatccaatgggagacaggttacagtggccgaaattggacccaggattcgaaatgaggccaccaaaacttgagggcaggcctgctggcagaccaagaaagaaaagaatcaagagtgctggagagccaggtaagagagggccatatcaatgcaagaggtgcttccagtatggccacattgaaaaaggatgcaaaaatccagtggtggagccacatgaagaccttccagacaaccatttgcagagaaagacaaaaaaaggcaccaaaaaaaggaagaaaagtgagccagaacagacttcaacttcacttgttcaaatatcgccatctagttctggaccaatgacaaggagaagggtggcgatgtccccaacctgcagctcaccttcagccagcaagcaaggagaagcaccggcttcaagcaaaaggagattaattatctagctgactgtgatggattgtatgtcatttgcatgtgtttgctacttatgcgatggacgtgtaagccatatattgtattttattgttagaatcaggcacccctgaattatattgttgcaaagtatcgattgggagagaggagggcaagagtgtcttttcccatgggctgctgggttaaaaaaaagaaaataattcaaaaaaaaaaaaaaaa

SEQ ID NO: 7673 - DNA, 1333 bp, Zea mays
  misc_feature (978)..(980): n is a, c, g, or t
  misc_feature (982)..(982): n is a, c, g, or t
  misc_feature (984)..(984): n is a, c, g, or t
  misc_feature (1000)..(1000): n is a, c, g, or t
  misc_feature (1082)..(1084): n is a, c, g, or t
  misc_feature (1100)..(1100): n is a, c, g, or t
  misc_feature (1163)..(1165): n is a, c, g, or t
  misc_feature (1168)..(1168): n is a, c, g, or t
  misc_feature (1185)..(1188): n is a, c, g, or t
  misc_feature (1204)..(1204): n is a, c, g, or t
  misc_feature (1207)..(1208): n is a, c, g, or t
gcgatgttgtcaagtgctcaccatgtggagatgacccccagtgatgctggctttcaggacaggtatgttgttccggaggtcatcaaagagatggcgaagaacaggccaattgatgccaaaggcaagagagcatttaaagtccttgtgttaaatgaggtcgacaagctctcacgagaagcccagcattccctccgcaggactatggaaaagtatagctcatcatgtagactgatcctatgctgtaacagctcctcaaaagtgacagaagctgtaagatcccgttgcttaaatgtgcgagtaaatgcacccagcgaagatcagattgtccaagttctagagttcattgggaagaaagaaaatctgcatcttccagctggatttgctgctcgtatcgccgcacaatcaaaccgtaatcttagacgggcaattctgttttttgagacttgcaaagtgcaacaatatccatttacatcaaatcaagtggcgcctcctcttgactgggagcaatatgtgtctgaaatagcaactgatatacttacagaacaaagccctaaaaggctatttgctgtacgccagaaattctatgaattactcgtcaattgtatcccacccgaaagtattttgaagaagttgttggcagaattactgaggaagttagatgcggatctgaaacatgagatctgtcactgggccgcacattatgaacacaagatgcgcctcggatcaaaggctatttttcatctagaagctttcgtggccaagttcatgagcgtttacaaggagttcctggtggcgacatttggttgagcaaaacctcaaggcattgggttgccacccgcgaagcgaagagaggatggcagcggctatcgcactgtatcaggcagtgtcttgcctgtgtagttttgtactgaagttgtgaacgattagcttcattgtgtctgtttaaacccccgtcaactcgggtcgcccttctgtgannngnanagagggaaaaagaaanagaagaaagaaaaaaaagggaggggggggggggggggaaaaaaaaaaaggagggaagggggggggggggggaagaaaaggannngggggccggaggggangccccaagggaagaaaagacacgggcggcgcgggggtaagaaaagcccccgcggggggggggnnnganacagcaaaacaaagggnnnnggggcgctcggcgggnggnncggggggggggggcgggggcggaggaggagggaggcagggagaggcggggggggacaggcggaggaggggccgcccggagagagagagagaggggggaaggcaggagaaggagagagagaggggg

SEQ ID NO: 7674 - DNA, 827 bp, Zea mays
gaccaagccttccgcggacccttggccggacccgtgcggttttttgagacttgcaaagtgcaacaatatccatttacatcaaatcaagtggcgcctcctcttgactgggagcaatatgtgtctgaaatagcaactgatatacttacagaacaaagccctaaaaggctatttgctgtacgccagaaattctatgaattactcgtcaattgtatcccacccgaaagtattttgaagaagttgttggcagaattactgaggaagttagatgcggatctgaaacatgagatctgtcactgggccgcacattatgaacacaagatgcgcctcggatcaaaggctatttttcatctagaagctttcgtggccaagttcatgagcgtttacaaggagttcctggtggcgacatttggttgagcaaaacctcaaggcattgggttgccacccgcgaagcgaagagaggatggcagcggctatcgcactgtatcaggcagtgtcttgcctgtgtagttttgtactgaagttgtgaacgattagcttcattgtgtctgtttaaaccaccgtcaactcgggtcgcccttctgtgagttcatcgcgtccgcctgcacgtggtcgttgatgacgacacgatcagaagttgtgaacgactagtagtttttgcttggttaagaaaaaacatcctgaaaagtaaaaaagtaacagtctgtgaacggaaccgtaacaagtaaaacgaaacaagcagatgccaatcatgctattgcaatttgcaagagtcgtcccagattaaaattcaaatagctgtatccattttacactaccacagtttgatt

SEQ ID NO: 7675 - DNA, 2781 bp, Zea mays
cgcacgcgttctctagcgccctccggccctgactggctgttgctgtttctgtggcgtgcaaggggaaacgatagcggtacctctccgaggacgacgtctggctcctcctacacaggtaccatccagggacgatcctgacggcgctgcaggaggtggcgcagcacgcggatggccggagcatagactggagggcggtggtggcgaagtcggccacggggatcacctccgcccgcgagtaccagatgctctggcgccacttcgcctatcatcacgacgtatacgagagcgtcgacgccgatgaccagcctgtggacgatgacagtgacctagaactggagcttgaacccgatcccaacctgaccaaggaagctttatgtgaggcctctgcattagccaaggcgctaatatctggatcttcacaagcctctggtcatcgtagtaacttgcatactcatgttctgaacacccgtaaatgaaaagatagtgcgggttccatctgagaaacagcttgctcaaagtcatcgtgtaacaaatgttgcaggtcctgtttccaattcaaagcagttagcccatataggaccctctgctggtcttttggatccaaatggaccttcaaaaaagaggaaaaagccaaaagcatggtataaagaggaatatgcagacgtgtcagctggtgtgcagaagtatggtgaaggaaattgggaggatattttgcataaatgtaacttcgatgaatacagagaacgccatgatcagctgttatcgcggagatgggctgctgaagcgtccaggaggatcaaccaagcctgctagcactaaacacgcctctgttggcttagaggaaagatcagcagccctcaaggcactttcattggctgtcggacctatgcgtggatcatctgcgctgagatcaggagcttatccacaaagcattcagcataagtctacagtgtttgctcctaagatgccagaactaagatctgcagtaaccccttcaccggcaccagcagtgccagtcccagttgctatgcctctgcgtgtggcagctcaagtacaggctccgcctcatcaagggcatcaagctcctgcccatgctgcaccaccaaaattgttaaatgcttcaaataagacacggaagaagcaagcagctcagccaaatcccaccatcagtccttcctcaatacaagcagctgcgattgctgctggtgggcgacttgccacagcctcaaccgccgcaaattttttagaccccccgctcgcccagaatgctgtgccataagatctctaggagcaacatctttgaaaccttccgcaagctttaaggcatcgattgtggttgagcatggaacacaacctgggggctcccagcacctagaacctctaaatgctagtgcagttcatgatgtttcaggagttgctgcagttaatcaatcagggccacttgctggggcatgttcagagactaagaaggcattgagtaccgcactagcacctgtcccatgcgacagcgaggaaaaggaggatgactcggaattttgtgtgattacgatagatgatctgttccctgaagatgcaaagcagccagaaactgtggataccaaggcaaagcaaccacaaaccacgggtctgaaggcaaatcagccagaaaacgcagatcccaaggtaatgcaacaagaaaccatggatcccaaatcaaagcagtcagatacagtagaggttgagatagttgatccgaaagataaagacatgctagagtttgatcaatatgttgcttctcaaggagggcacttaaacacggatgatctgaataaaagcaagtgtaccaacagtgtttcccaagcccaaggtcttgttggcagccagcaaaaactgattcctgcggatgggaaaggtagccctgtaactgtggttgggaaaggcaagcctgtaactgctggagtggcagcaactgggaggaagactaaattccctgtctcacatttggcagcagggaccccacgtggcattgttgacacagtcaacgccaacgccccaaataaaacgctagtaaggagggcagccatccctgcccctgtccctgctggttgccaagttaggaaggatgccatgaactcaaaaggtaaccaaatgacccctggcaatgccggttctggagtaccagccagcagtcagactagcgtggctgcacaagctgccagcaaagcaaatctaccatccagcagcagccaggccaagcccaataacatggtggtgaatggtggtaacaggctagtggttaatccaccgtccagcagccaagctagtgcggccgtgaacgacgctaacagggctgcgacaccacagtccagcaaccctgtcaacggtgccaacaacagagaggttaatccaccacccagcagccaggctagcacagccgtgaatggtgctgctaacaaggggaatgtgccagcagcagccaggcccccttaatacagtaaattttgtaatgattcccgtaggacttgtgtgcgtggaagaaatgtgtatagggcattaggcagaggtcatgtcattcttttcgccttgcatttgcagtttgcacccgtgaactggagaccactaggttggaatggttttttggctgctatctcctgctggccagttcccttgtgatgtaaatttttgatgcttgtgtttgtttacttgcgcccgagatgatggtgccaactttgtgcctgtctggacagatcattcgcatctcttaggggccgttcgtttccattggaataaacccggtttcgt

SEQ ID NO: 7676 - DNA, 2191 bp, Zea mays
  misc_feature (434)..(434): n is a, c, g, or t
tcgtcacaacgtacatgtagtagaatgcgaccaaagtagctcagaagacgaatcagcagaggtgtatgctgctgaaatggtttggccaaagcaggctaaatcttcggcttgtgcctccttacagccggttcaaaagaaacggcaagaggaggttaagtttacatttaatgttggtaagtgtgatagaatatttgatgaattacttaaaaatggcaacattaaaataaatcacactgttccatccgcagacgagctaaaacgtcgtgcatattgcaagtggcataactcattttctcatgccactaatgattgtaatgtattccgtcgacagattcaatcggccattaacgaaggacgattgaaatttcaggaaatgcaggtggatacagagccctttctgatgaacatgattgacttcgagggcaagaaagtcntagttcggtcaaacacaaccgataaagacaaaggcaaagagacaatcatcggcaatgctaaagaggccgatggggatcgtaaagtttcttgcaggaaagtggtggccgagaagactcccgatggaggggagaccctaaaggtgaccatcacagcctccagtactggggggcaagcgcagacagggagacagatgcaggagcccgtgctgcgtatcccggacggtccagcacgtaggcgcggacggtccgggaccccaccggacggtccggagagctccggcggacggtccggccgtactcaggattcacaacgtccacgtactttcaaaccacgacgaccagagataggtacgtgggaaaacaaatacatttaaagcagctggtcggttggttaaagccggcccaacttttgatcaattattgtctaaatacgtaaaaaagaaggccggccccagtgaccggccagcaaagcgaccccgctcacccattcatgagcagcgtcaggtcaggccgattggaccaccccaccaatcggaagaaatgaaaggtcatactatacaagtgagacctaacgtacctgcatggacacctccacctccatatccacctatgccatatccatacacatatttacctccgccatatgtcccaaatcaaatgtggggcatgccaccatatccatttgggatgccacagtaccccgcctggggggcaccccaaacatctgttttcgacaggttgacgccaccagtacaagaccgattgagcactgctcaatccggtcaccaggcacaaacccaacaggattgccggactactcggccttccaggccgaccaatccggcaggggggcatatgcctgcagcaactcaaagaacaacaaaaaaggacatcatcaaaataggcaccgcagatgttgtcatacagggagacaataaagggccgatgattttcggcgaatcggccaacacaaccgaaaaggatacggctaccatcaaaacagccgatccaaaatactccatgcctcgatggtgcccagcgggattgacacgatcccaaaagagaaaattacagcgcctaagagcaaaggagagccaggagaaggaggcggaaaagacatttaatgacacacatccattatacccgccaccgcaaaagaaatggagaccgaaggccgttgagaaaaaacaaacggccacagaaatagaaagtcaatctgcaccaagcgcggaccgtccggcccctacgcgcggaccgtccgccgttcaccaggaagtctctggacagcctgcaccaggcgcggaccgtccggccaccccacgcggaccgtccgccgttcaccaggaagcctccaccgacacgacaacatcaatggaggaggacgacctgctgggagaagacctggtcgactacgaggcttctccagaacacccaggtatggatgtaaatattattacattttctgccgattgtactattatcggcaacgatgaacctgttgtttcccagtttgattttggtcctaaagaagccgcctttactaaaccaaaagaatcggtaaatcatttaaagccgctcttcgtgcgcggccacattgatgggataccgattgctaagatgttggtagatggaggggcggctgtaaatctaatgccctattcattatacagaaaattaggtaaacaagatgacgaacttgtcaagaccaacatgaccctcagcggtgttgggactgatagttcgatcaaagccagggg

SEQ ID NO: 7677 - DNA, 2905 bp, Zea mays
ctcaaaataaagtgtttgtgccttgaaaaaaactcaaacattcggccaacgaagatcaatatacaaagtagtagcaactaacttgttggtatacttacagaaatacttggttcagatcttttttcagtagcaacaaacgaaagcactgcatctatgtcattcctcgtcagacttctgctgcttatgttgcttcatgggatcctaccggtatcaacttcgttcaattaggcgccaacaatagcgttctgcagtgagacgagccgacaagccttgctggaactgaaggccatcctaggctagctatcgagcaggttgtcctcttagaacagtagtggtagcctatgcctctggccaggtgtgacatgcagccgtaggcacgagggcacgatctcagtgcttgatctcagctctgtcggccttgcgggcaccatacccacgtccgggaccaacttgacatttctaacgagcctcaaccctgcaatgcattattgccatcggttgcatgtagttgcttccttcatccagcttcagcttcctatcctttagcaaccactctctttccatttgacatagctaactcccctaattactttcacttggattcactttgcacctcagtagcaatttcctgttgggtcaacatccacaaatctttcttatcaagatcacatagacagctccacatgcaagaagcatgtacatggcaatctcctagagcaaaatcagatcatccctttcaatacttgggtctgccttcatcataacaacaacacttgcctccagaacttcatcattgcgatcagtcaagacgacctctttgcagaaacagtttttaagtagcaggtcaccaaatttgcttgtacaggtatcaccaaacaagaaacaccaagccagatgccctgagcaaaagacatttgtcgaagcaaaactttaatgtttctttcaaacaccatcaataacatgagctaatttcagcaaacaatgtgtgcagtgttgataaaaacatctatgagtcgttgatcctggaatgagattgtgcaaagctcttttgtgcccatcattgagtttgtcgcagttctgttatattagtatacaaattttaagtacaagatattttttgtttgttaatattcaatttctattccaaataaattttggtagttacttatatatgttgagtcaacattaattggaaaaggtaatgtaaacttttcttggaaatgatataaacttctaaagttcacttaaagcatcaaatagattgtagactaccaatttcaaacagtggttatagattaagaaatttaccttgtggattatattgatgtctttcacaaagtgacaaaattcaactatgtttatgttatcgatgtcaagggaaaacaagaattggtttgtggtcatagaagacacagtgctaccatcttgattgttgatcagaacatgtgtggaagaccttgttaaaactaccaaggtctggatgtatcatcaattcctagctcccaaaacattgtaaaatctattaaggtattcatctaggtgggaaaggactgctttcagctacaatccaaaaggaaaatgaatacatgtaaatgcagttaggagaatgagaaacggatgccaaagtttgtttctgaacaacacaatttcacctgtaaacagcacatggcagaaaaatgcaagaatcctagtttttagcccaagtaaacaccaaaaatgtcaatttagaaagcatgctcaagtcatgtatggactgaatgttgctttcaaaatgaaaattctaaacctaaaccagatgaaaccatatatagaatctcttataatgtgccatacaaccccataggcaagctaagctaactccaccactaaaagaccctctttgtttatgcccctttataagccaaataaattcctaaatctcccttttgtgctttgacaatagtactgaatgagcatcaggcacacaaaatacagagctatatgccatttatgttccagcaaaaatcataactaatggacaacatggaatgtagatgtttatgttcattgaatgaaacacaaagcaatacaattgcaactaagtataatgacctatggcacaaggcaaaatactatttgccagactgtgatggaaaggttaatgaaaggtgagagtaacctaagaagatgtaagctttgacttatatatcttattcaaggaatcaactaagttgtcagcttcatctatgatgacaacactgttaattagattaaggacaagtgattatctagcataattgagtaacaaagattgataaggaagcacatattatagaactataaatctatagagcaagtgaaattggggtaaatctagggacttgtctatcatttttttcagacattcttcagaggatccacgcttttctcagtttgtttgaccgaattcaagcaaacaaaaaaacataattatgggtcataatccgaatgaataagctaaaaaatggattcagaaggaagaatcacttaagtgggaagagccttcaatcgggatggtcctaaatttagctggtatgtgaatcaatagtatggccagatactcggagcgccagcaatgggatgtactcaaatatcgcaagtcaaactctccagtgcctatcctcaatcatgtcgtaaggcttggcctccttgcggcgcatgagcatggggatggagcggtcgacgcagaggacgacgacgggagcgctgtgtaggggacgttgcagacgaggccgggcatatggaggagcgaggcaacaacggagagcaggcgtgggtgggacacgagcgcgtggaggtcccggtagatgggggagttgatgccagacttgagcacgattgcacgaatgagcccaccttcactgcctcgatggcgtggaggtccagg

SEQ ID NO: 7678 - DNA, 1510 bp, Zea mays
atgtgggcacgtttcctcttcttcgttctctcccggtcccccccatcccaatcgtgcgtgttcgtcactcctcagctccgaccttcacggggcccacggggcccgacgcccggcggctttactcagggcaccatggccttctcttcgtcactggcgccgttcttcccaccttctggaaccttccgagcccatcccgctaggaggctgcgggccgatgcacccgggagattcgtggcgtcctgcttgccccctcccgacgtcgtggtgacgcgcgagcagggaaagaacgccaggctcatctccgcgctggaaaagcataatgtacaccctctggaacttcctcttattaagcatgttgaaggccctgatacagataggctttcagatgtcctacgtaatgacaagttcgactggattattgtaacctctcctgaggcagctgcagtgttccttcagggatggaaggttgctggaagtcctaaggtgcgagtagctgttgttggagaaggaactgcaagggtttttcatgaagtatcagaatctgatgatcaatctctagagcttgcattttcaccttccaaagctttgggtagagtcttggcttcagagcttccaagaagcaacgggaactcatgtaaagtattgtaccctgcatctgcaaaggctggccatgaaattgaggatgtgctatcagaacgaggatttgacgtgacccgactgaatacatatacaactgttcctgtagaagatgtcgacccactgacattaaaccttgctatatcagctccagttgttgcggtagcttctccttctgcactgagggcatggctaaatcttatctcaaaatctgataactggaacaactccgtcgcctgcatcggtgagaccactgcgtctgcagcgaagaaactgggcctgaagagcatatattacccaacgacccctggacttgaggggtgggtcgagagcattctcgaggcgctcagagtccacaggacagcatcaaaagaggccccaaaacgttgaaaacgggcggatggcggagcttcttcttggcgttggtagccgtccgcagtgtcgaagaaattctttgcttctttgacgacaattgccccccgttgagggaggtggtggtgtcaagccatggctttccactggcccagtttgtaatggattcttgggccgaaaggcccatctctatatgtcttgactcgcaaggcgattgcatcagtccatccatccatttcatggagggttttagcagtgccgtctctgtttcgctaatcggtgatggcagccagccttgttgtactttgtgggtttgttgacgcagccggtcggattcttcttattgccggattggttgcgtaacgctaggtggttctgaatatcggcgacggcgaggctgtggaatctccgccctccaccgaagattccctgtcgtcgtttctgaatttaattaacaacatggcatgatgaccaatcaaagctcgcaaaaaaaaaaaaaaaa

SEQ ID NO: 7679 - DNA, 3785 bp, Zea mays
  misc_feature (387)..(387): n is a, c, g, or t
ctttatttgtaatcatttatttttgtaagacactttccgctatgtaataaagtttgtgacgtttatctctatacacttagtcataatatgttttgttcttatttggcgcacatatgagacgcactcgaggtttgccccttaaatctgggtgtgacagcaccgacgccgtcaagatcaagctatattgtataccgatgacacttttctcgatcgagttcccggccgacgaagcggggaagcacaactccatagttagggttagggattgaggagaacagagctaggggagaaaggggactagaaggaaacaacgagagaagagccatgaaggggcactttagtaaactcgtggcgacaccgacaacggactcgcagaaaacaggtacntagtactccttccgttcataaatatttaacaccgttgatttttttttaaaaaactttgaacacacgtcttattcaaaaaaattgagttattatttattattttatgatttgttttatcatttaaggtagtttgtgtttgacttaaaattttatatttttaaataaatattttaaataagacgagtgattaaagttttctagaaaaatcaacaattagtattaggagtgagtgtatcggtaggtttgaaaaagagtagtatgggaacaaatgtggaaaatgcgaggttggtggtccaattttcgtaataagctcactttgacataaaccccgcaagaccaactatgggtacaacagtacagtattggaggtaggggtggatatcgagctggcttggctcaactcgattcgagccggctcattaaaataacgagctgactcggctcgactcgttatgttaacgagctgaagatctaactcggctcgactcgtttggtaactcgagctgactcgttttgctcgcgagctagctcgataataccatgtctagtgtctacgaacgtatataaaaacatgtagcaaaagaaaagaaggtgatctatgtaggaaaaaagaatagagtttgcaacttaagatttcacactcaacaaagaacaagattaactatagtagagtataagattaactattttagatcggagattattataatttgataaattataaacgagtcgagtcgaatcgagtcactgttgagttgagtcgaacaaatgagctacaagtttttcgtacggcctaattggaggtagctggctcgcaaatgtctcgccttctcccacgccgccgtcacctctcctgcacctctactgcctcccttagtgaactcgcctccctcctcgacgccggccgcttccaccgcgcggtcgaccttgccaaatccctcctctcctcccatccccccgctgccaacgtccccgacctctaccaagctcttgccgccacagccgacaccaaggacgacccacgggcgcgcccccattccttcctctgcgacgcggcctccgccctcgttgtcgcctccgcgcgtctctgccaacctgacggcgcgctccgcctgctctccctcctcgccagcgcgggcgacggcgcctgcgccggcgaggtgtgctcgccgctgccgtccctatcgtcctgcaatctccttctcgagtctctcctattcgtaggtcgccacgctgatgtgcgcgccgcgttcggcctcctcgtggcggccggggcgcgcccggacaccttcgcgtggaacaaggtcgtccaggcttgcgttgcggcgggcgacctcgatgtggcactcgccatggtgcggcggatgggccgtagcgaaggcgccccacctcccgacgcgttctcgtacaacgtggtcatcgcagggctgtggaggtccgggaagggcagcgacgccctcaaggtgttcgatgaaatggtggacatgggagtcgtgcctaaccggatcacctacaacacgatgattgatgggcatgtcaagggtggggacctggaggctggtttcagactgcgggatcaaatgctacatgatggccctaagccaaatattgtcacttacaatgtgctgctatcagggctgtgccgcgctggcaggatggatgagacaagagtcttgatggatgagatggcatcacatagcatgtttccagatggtttcacatatagcatattgtttgatggtctcacaagaacgggagagtcacggaccatgctttctttgtttgcggagtctttgaagaagggtgtcatgcttggagcatacacttgcagtatcttgctgaatggtctatgcaaggatgggaaggtcgcaaaggcagaacaggtgttggagatgttggtacacacaggactggtcccaacaacagtgatctacaacactctaataaatggctattgtcaggttcgtgaccttcgaggagccttctgcatctttgagcaaatgaaatcacgccatattaggccagatcacatcacctacaatgcactcataaatggtttgtgcaagttggaaatggtcaccaaagcagaggatttggtgatggagatggagaagagcggagtggatccgagtgtggaaactttcaatacactgattgatgcttatgggacagcagggcaactcgaaaagtgtttcactgttctgtctgatatgcaacagaaggggataaagtcagatgttatctcttttggttcggttgtcaaggctttttgcaagaacggaaaaatcccagaagctgtagctatcttggatgatatgatatacaaagatgttgcaccaaatgcacaggtgtacaactcaatcattgatgcttatatagagtcaggtgacactgagcaggctttccttctggtggagaagatgaaaaatagtggagtatccgcaagtatagttacctataatttgctgctaaaaggtctttgcagaagttcacaaatagatgaagctgaagagttgatttacaccttaagaaatcaagggctgagacctgacgttgtcagctacaatactataatatcagcatgctgcaacaagggcgatactgataaagcattggagcttctccaagaaatgaacaagtatggcatcagacctacactgagaacgtaccatacacttgttagtgcattggctagtgcagggagagttcatgatatggaatgcctatatcagcaaatgttgcacaagaatgttgaaccgagcagtagcatatatggcatcatggttgatgcctatgtgagatgtgaaaatgattcaaaggtagcatctctgaaaaaagtaatgtcagagaaaggaatagcctttgatgacacgaagagaagtaaccatgagctagataggataatagcaagtccaatttgattggattgccttgaaatgaaaaggctggaaggttgccagttatgttaatatcaaaaacaaaatttcagatttagagttcaattgtacagacatgaaacataattgggggtatgcgggtataaagatggtagcggctaaatgtttggtataattcgtattgaaccttttgccactgccaagaaccatgtcatcagtttcttctttaatctgccctagggtagtggggatgggtccaatttttttattactgtattttcaaaaacttgggtgccagtgccatgctccttcaaccttcattacctcccaggttgcaaggacgatagagagcattgttttgaaatgtttattgttgcacatgaagggcataatagtatagttgatcaatttttttcttaactcagtgtggttctccaatttgctgtatcatatggaattcaccgtgcttcatgattttgtctatttatcagcactatcttt

SEQ ID NO: 7680 - DNA, 1280 bp, Zea mays
  misc_feature (1262)..(1262): n is a, c, g, or t
gcgtccaaacatgtactctaattcccttgcgtccaaacatgccaaagtgaataaactctctctgttgatagtggcggcaaagagagcaggatcgcaggaataaatcaacagacaagccacttgagtggatcgatcgcgagaacccccaccgccctccatcagactcagagcctgcgctgtcggattcgccgccagctaggcgagatggctgcgccgttgcctctttccgcggaggacatgctgcgcgtcaacggcagccgtcgcttcgccgccgcgatggcggccgcctcccccttcgcgtccctcgcagacgccctcctcgccgctcgccgcatctggctcgatgaggtggatgtcaacggatggctcgaggccttcgcggcgcacccggcaatcggaaccacctccccatctgtctccaagtggagcaaggaggagcaatcagcagcgctctccacagccacggactcgacggcccaggagctagcagagtggaatgccagatacagggagaagtttggcttcgtcttcatgatttgcgcttctgggaggactgcagctgaggtcttggctgagcttaagaggcgttacacgaacaggccaattgtcgaacttgaggctgcggcacaggaagaactcaagataactgaactacgtctcacgaagcttttctcattggagcctactgttccctccactacaattgaaggccccaccgtccaatcagataaagcagcaggtagctccaaccgaagtcgtccgcctattacaacccatgtgctggacattgcccgtggatcgcctgcatctggaatcgaagttcacctggagatgtggaaggattgttcagctcctccatcattcaacaacaaagatttcagcggatgggaaactctaggctattccgttacaaacaatgatggacgcagtggccagctgatggacattgtcgataatattgctcctggtttctaccgcataagcttcaacactggcaagtatacccctgcagggttcttcccttatgtcagcatcatattcgagatcaaggagaaccagacggcagagcattttcatgttcctctcttgcattcccctttctcgttcaccacttaccgtggaagctaagttttcaacttacgtgccattacctctgttgggatgttcgaagcaacttgtaaacttgacacttccgttgtgataataatctggttccatgtaaaaaaaaaaaaaaaaaaaaaaaaaaaaaaaaaaaacccaancaaaaaaaaaaaaaaaaa

SEQ ID NO: 7681 - DNA, 1316 bp, Zea mays
agttctgtcatttgtttctctctcaattctcatttgccactgagtatacttcaacacatcagactcagagcctgcgctgtcggattcgccgccagctaggcgagatggctgcgccgttgcctctttccgcggaggacatgctgcgcgtcaacggcagccgccgcttcgccgccgcgatggcggccgcctcccccttcgcgtccctcgcagacgccctcctcgccgctcggcgcatctggctcgacgaggtggatgtcaacggatggctcgaggccttcgcggcgcacccggcaatcggaaccacctccccatctgtctccaagtggagcaaggaggagcaatcagcagcgctctccacagccacggactcgacggcccaggagctagcagagtggaatgccagatacagggagaagtttggcttcgtcttcatgatttgcgcttctgggaggactgcagctgaggtcttggctgagcttaagaggcgttacacgaacaggccaattgtcgaacttgaggctgcggcacaggaagaactcaagataactgaactacgtctcacgaagcttttctcattggagcctactgttccctccactacaattgaaggccccaccgtccaatcagataaagcagcagatcgcatacggattattggagcacatcttggagctcaacctcagccttgtgccaataaagctcctgaaattacaggtagctcgaaccgaagtcgtccgcctattacaacgcatgtgctggacattgcccgtggatcgcctgcatctggaatcgaagttcacctggagatgtggaaggattgttcagctcctccatcattcaacaacaaagatttcagcggatgggaaactctaggctattccgttacaaacaatgatggacgcagtggccagctgatggacattgtcgataatattgctcctggtttctaccgcataagcttcaacactggcaagtatgcccctgcagggttcttcccttatgtcagcatcatattcgagatcaaggagaaccaggcggcagagcattttcatgttcctctcttgcattcccctttctcgttcaccacttaccgtggaagctaagttttcaacttacgtgccattacctctgttgggatgttcgaagcaacttgtaaacttgacacttccgttgtgataataatctggttccatgtaagcaggctttatactttaataacaagtagtattatggaagacaaatcttgtgatagtcttgcgcccctgggccctaaattcttagcagcaaccatattcagaaaaaaaaaaaaaaaaaaa

SEQ ID NO: 7682 - DNA, 1619 bp, Zea mays
aagtgaataaactctctctgttgatagtggcggcaaagagagcaggatcgcaggaataaatcaacagacaagccacttgagtggatcgatcgcgagaacccccaccgccctccatcagactcagagcctgcgctgtcggattcgccgccagctaggcgagatggctgcgccgttgcctctttccgcggaggacatgctgcgcgtcaacggcagccgccgcttcgccgccgcgatggcggccgcctcccccttcgcgtccctcgcagacgccctcctcgccgctcggcgcatctggctcgacgaggtggatgtcaacggatggctcgaggccttcgcggcgcacccggcaatcggaaccacctccccatctgtctccaagtcggtgaagtgcattgccctctcaacatccactcaattcgtccgcttaattttcagttgtcgttttgctgttgtcgatcgcgcctcgctcgggtcgctgtggctgtctgtggattttgtatataccagtactaatcaatagatgacacggaaccaatcacatgacctggctgcgcgtcatggcgagttcaagtgttgaaatcagtaaaatcaaactggcgaaccgtttcaggacaaaccatatggcgctagtaactgtgttggtaatctctgtttcctttctggtttaggtggagcaaggaggagcaatcagcagcgctctccacagccacggactcgacggcccaggagctagcagagtggaatgccagatacagggagaagtttggcttcgtcttcatgatttgcgcttctgggaggactgcagctgaggtcttggctgagcttaagaggcgttacacgaacaggccaattgtcgaacttgaggctgcggcacaggaagaactcaagataactgaactacgtctcacgaagcttttctcattggagcctactgttccctccactacaattgaaggccccaccgtccaatcagataaagcagcaggtagctcgaaccgaagtcgtccgcctattacaacgcatgtgctggacattgcccgtggatcgcctgcatctggaatcgaagttcacctggagatgtggaaggattgttcagctcctccatcattcaacaacaaagatttcagcggatgggaaactctaggctattccgttacaaacaatgatggacgcagtggccagctgatggacattgtcgataatattgctcctggtttctaccgcataagcttcaacactggcaagtatacccctgcagggttcttcccttatgtcagcatcatattcgagatcaaggagaaccaggcggcagagcattttcatgttcctctcttgcattcccctttctcgttcaccacttaccgtggaagctaagttttcaacttacgtgccattacctctgttgggatgttcgaagcaacttgtaaacttgacacttccgttgtgataataatctggttccatgtaagcaggctttatactttaataacaagtagtattatggaagtcaaatcttgtgatagtcttgctgatttgttcactaaattcttagcagcaaccatattcaaaaaaaaaaaaaaggggggcccccgaataaggaccctggccacccgggaatt

SEQ ID NO: 7683 - DNA, 1702 bp, Zea mays
  misc_feature (1662)..(1662): n is a, c, g, or t
  misc_feature (1671)..(1671): n is a, c, g, or t
ccggccggggacccccttccccctgacgcctcgcgaagccatcatcttccaaaccctcgccgcagccgcagccacccttgcttccgcacgatagtgcccgggaccagccatctatggcggcgtcgctgctcctccgcgctgtgcgccgaagggagctcgcgtcccctctcggatccctgggtgccaacttacagtcaacatgtgctgccaacatatgctcaaaatggggaaattttgcaagaccttttagtgcaaaagctgctggaaatgaggttattgggattgatttggggacaactaactcttgtgttgctgttatggaaggaaagaacccaaaagttattgagaatgctgaaggtgcgagaacaacaccatctgttgtcgcatttactcagaagggtgaaagacttgttggtactccagccaagcgccaggcagtaaccaatccccagaatactttctttggaacaaagaggatgattgggcgacgctttgatgatccacagacacagaaagagatgtagatggggccctacaaaatcgtgaaggctccaaatggtgatgcttgggttgagccaacagatggccagcagtactcaccaagtcaggtcggtgcatttgtgctgaccaagatgaaggagacagctgaatcttaccttggcaagtctatctcaaaggcagtgattactgttccagcttatttcaatgatgctcagcgtcaggccacaaaggatgcaggccgcattgctggccttgatgttgaaaggatcatcaatgaacctacagcagccgctctgtcttatggaatgaacaacaaggaaggcttgatagcggtatttgatcttggaggaggaacttttgatatctctattctggagatctcaaatggagtttttgaggtcaaagcaacaaatggtgatactttcttgggtggtgaagattttgataatacactattggagttcttggtgagtgatttcaagaaaactgagggcatagatctgtcgaaagatagattggccctgcaaaggcttcgtgaagctgctgagaaggcaaaggttgaactttcgtcgacttctcagacagaaatcaatctgccattcataacagctgatgcttcaggggcaaaacatttgaacatcacactgacaaggtcaaaatttgaatctcttgtacacaatctgattgagaggactagagatccatgcaagaactgcttgaaggatgccggaatatctactaaagaggtggatgaagtacttcttgttggtggaatgactagggttccaaaggtgcaggaggtagtctctgaaatcttcggaaagagcccaagcaaaggagtgaacccagatgaagctgtggccatgggtgctgccattcagggtggcattctccgtggagatgttaaggagcttcttcttcttgatgttactcccctgtcactaggtattgagacactcggtggtatcttcaccagattgatcaacagaaacactacaatccctacaaagaaaagtcaggtgttctcaactgctgctgacaatcagacccaagtgggtatccgtgtgttgcaaggtgagcgtgaaatggcagcagacaacaagcttcttggtgaatttgacctcgtgggcattccacctgccccccaaggcttgcctaaantggaggttncattccacatcgatgccaatggaattccgga

SEQ ID NO: 7684 - DNA, 3392 bp, Zea mays
  misc_feature (493)..(493): n is a, c, g, or t
  misc_feature (650)..(650): n is a, c, g, or t
tcttccttacgatttgtttgtactcatttagcgaagctactagcccatcatgacaaggtatattaaaatacttgtcactatccctaccattactactatcactgttttatacctttcgatcactcttatccataagacacatacatgtcgaggatgattataattattgtggaggaagagaagcaccaacaaaaagctcgaacaccttctcttagaaatatgagaccgttcgcaacggatgcctctacgccgcgcccttgccggcataggggtgatagtagcccacaaggagcagcgacgacgcccccacacgaccctgcccctacacggcagaagacctcccccattcctgttatgcactctaacaccatttgcctatcaatttatgtgtccacgagtaattgttagtggatgaaaaattgacaacgagtgaaaatgtagggctaggaaatgatattttatggtcgtagtggagtatagatagagtatttanagtgaaacgctgcagaagatggaaacgtaaaataaactgttgcgaacaatttgaaacacttgatgattcagtataagtgaaacaatcaccaataatataagccatgtagtatctatgtgatgtgaccgtctagtaatacctcaatcttgtttcgtanatccgtataattcaggttagatggaaataaaaatttagcactgttgtaatacaacagacacaataactgatgttggacaattacataaactaatcttttctaatagtagttcttttcttattatatctgagaacataaaatactcactcactccgttctaaaaaaaatgtcgtttcgtttgacttttttgacattaaattttatcgtcacatcttattcaaaatatttatgaaaatgtaaaaaaatgtagttcatagctgtaaattatataataaactaaatgaaaataaagatagacgataattataagtcggtcaaactttataaaaaaagccaaacgacatctttgtgttacggagggagtggctcttttgcggatgcattggcagttctgcttgccttcgtcgcaccgcacgcactgattggtccagcagccctccagcggatcgtcccttcggaacccgcaaccaacctctcatccaaccgtccatcattctgccgatcggaccgtccattggactcacacgcggatcgacgggcccacccacacggattgggacgttgggtacccccgggccggccgggactcatacatttcgactctcaactcccaaggtccctttttttttctcgatctggaagcgccgcagtagcagccatggacgtgagcggagcaggcggtaaggcgaagaagggcgcggcggggcgcaaggccggcgggccgacgaagaagtcggtgtcgcggtcctccagggccgggctgcagttccccgtcagccgcgtcgggcggtacctcaaaaagggccggtacgcgcagcgtgtaggcacgggtgcccccgtctacctcgccgccgtcctggagtacctcgcggccgaggtgctcgagctcgccggcaacgcggcaagggacaacaagaagacgcgcatcatcccgcgccacgtgctcctcgccatccgcaacgacgaggagctcggcaagctgctggccggcgtcaccatcgcccacggcggcgtcctccccaacatccacactgtgctcctccccaagaaggtggccgagaaggcggccaaggagcccaagaaggccgccaagtcccccaagaaggcgtagagtgatctcctgtcttagaacaatattaccattagcaatcgtgcagttagactagatcatgtttagtgtagatccgcaatgttcttgtccctgcagccatctggaacggtttatctagtacatccgtgcactttccttgctaattgcaaaaaaagcggtctaatcttttgtttcaaaaaaaaaaaaaaaaaacgaattatgctcgttaatacacttattaatatcacaagaaggggaagaaaaggaagactgtcatgcgtgtgttgcataactggagcacgatctgcatcaacgaaagaggcatccatcactcgttaatgcagatcgtgcttgaaattggcaaccgtctgcatgacacatgaaagagacatgctgctgaagatgtaatcgctcaaattattcagttggatatcaaacctcccttttgatgcgaaaataaaggaatgggtgattggttaagagaatacagccgcaaaagaatcctattttctctctctagcgtgtaggagatctgcgttgcaatagggcatcttcactgatttactatcaaaattggatggaaagtggaatatgattcttgtgggtgctgaaaatggttttaactgcttaattccaaccagaaggcgcaactcaggtttagttccattttttggtaacattttaattaaggatggggtaggcagcttgatgaatccatgaactgcatcttgattcgctgggtatgaatttcactgctggttatactggcccataagaatgtattggtctctagccttgggtgatgattctgtaatgtgcgaaggcccagtaatatagctctctctctctcgtttcaaatctgtctagaattcaagccagatggggtggatgatgcaaagctgctgttgcattcagttttgcatggcgtcgagccacggttgcggctgcggctggcgcggccggcacgacgtggctttggctggcgtgactgcgacgggctatgtcgatggtggtcgtggctgggtgccaccgtctctggccgttctggcctggagaggctggagaggctggagcgggacctcatctcgtctacactagcatcggctagtggctcggactagcgcagcatcgccccaaaatcatcattgtgcgggacgatgggtccgcggcgacgacggaggcagcttgctgtgtctcgaggtttcggccagacgctgtgctgagggctcttgggcgaaagtctcggcgacggtgacgcacatgggcgccgcttcccctgttgagggcatcgcatccccaacactatcttccttgggtgaaagcccggtccatcacggacaggcgacagtggcgtcacgctgacgtcgctcccttcccgtaggcgtcgcttctgaagttcgtctcggccacggctttgccttcggctattgcttcgcttctcgacgcctggtatgcgggtggaggtggggttttgcaacgtgaagttggagctgctatgtcaggggatgtggctcaacaataacatgaggcgaacctcccttctttgtggtccagaatgtttcgaaggtcgggcaaaaaccggaggcagagcggagggtcaagattagaagtcggagctgctctgtgccttgagtccggcaacaatgacctgt

SEQ ID NO: 7685 - DNA, 751 bp, Zea mays
tcgattcggcgcgaccgactctcaactcccaaggtccctttttttttctcgatctggaagcgccgcagtagcagccatggacgtgagcggagcaggcggtaaggcgaagaagggcgcggcggggcgcaaggccggcgggccgacgaagaagtcggtgtcgcggtcctccagggccgggctgcagttccccgtcagccgcgtcgggcggtacctcaaaaagggccggtacgcgcagcgtgtaggcacgggtgcccccgtctacctcgccgccgtcctggagtacctcgcggccgaggtgctcgagctcgccggcaacgccgcaagggacaacaagaagacgcgcatcattccgcgccacgtgctcctcgccatccgcaacgacgaggagctcggcaagctgctggccggcgtcaccatcgcccacggcggcgtcctccccaacatccacactgtgctcctccccaagaaggtggccgagaaggcggcaaaggagcccaagaaggccgccaagtcccccaagaaggcgtagagtgatctcctctcttagagggggcgggattctccattagaacactattaccattagcgatcgtgcagttagactagaccatgtttagtgtagatccgtaatgttcttgtccctgctgccatctggaacggtttatctagtacatccgtgcattttccttgctaattgcaaaaaagtgtcctaatcttttgtttaaaaaaaaaaaaaaaaaactaaaaaaaa

SEQ ID NO: 7686 - DNA, 404 bp, Zea mays
  misc_feature (404)..(404): n is a, c, g, or t
gacgcctcgcgaacgcatcatcttccaaaccctcgccgcagccgcagccgcagccgcagctcacccttgcttccgcacgatagtgcccgggaccagccttctatggcggcgtcgctgctcctccgcgctgtgcgccgaagggagctcgcgtcccctctcggatccattcttataatccctctaggattcaaatgggacctgaagtctccgaatgtacttgtttcagctgggtgccaacttacagtcaacatgtgctgccaacatatgctcaaaatggggaaattttgcaagaccttttagtgcaaaagcctgctggaaatgaggttattttgggattgatgtgacatcctatcgtttcgatgtgttttgtggaagtgttgttgcaagatttcaacagtcaaaan

SEQ ID NO: 7687 - DNA, 809 bp, Zea mays
ttgggtaccccttcgaggggccggccgggaaaaaaaaaaaaaaaaaaaaaaactcccttacattttccgactctcaaactcccaaggtccctttttttttctcgatctggaagcgccgcagtagcagccatggacgtgagcggagcaggcgggaaggcgaagaagggcgcggccgggcgcaaggccggcgggccgacgaagaagtcggtgtcgcggtcctccagggccgggctgcagttccccgtcagccgcgtcgggcggtacctcaaaaagggccggtacgcgcagcgtgtaggcacgggtgcccccgtctacctcgccgccgtcctggagtacctcgcggccgaggtgctcgagctcgccggcaacgcggcaagggacaacaagaagacgcgcatcatcccgcgccacgtgctcctcgccatccgcaacgacgaggagctcggcaagctgctggccggcgtcaccatcgcccacggcggcgtcctccccaacatccacactgtgctcctccccaagaaggtggccgagaaggcggccaaggagcccaagaaggccgccaagtcccccaagaaggcgtagagtgatctcctgtcttagaacaatattaccattagcggccgtgcagttagactagatcatgtttagtgtagatccgcaatgttcttgtccctgctgccatctggaacggtttatctagtacatccgtgcactttccttgctaattgcaaaaaaagcggtctaatcttttgtttcgtttcttgcgtacatttgcgatttatgctcgttaatacacttattaacatctc

SEQ ID NO: 7688 - DNA, 3377 bp, Zea mays
ggcgggatcatttggaacatattcgcgttgtctttaatatcttggacaagcaccagttcaaagtaaatctatcaaaatgttaatttgctcaaaccagcctgcattacctcggtcacataatcagtcaagaaggtgtggccactgacccggagaaaatatcagcagttaaatcttggcctacatctcgttcagtcaaggacattcgaagttttttgggacttgccggatactatcataaatttgtaaaaaactttggcattatgagtcgccctctcacctctctcctaaaaaaaggccaattgtttgtttggaccgaggaccatgatcaggcttttcaagctctgaaaaccgctttagtctcggctcctgtgcttgccctgccggatttcgctaaaacatttgagattgaaactgacgcttgcgattcaggcattggggctgttctccaccaagctggccaccctatcgcttttgttagcaagacattgggtcctagacatcaaaccttatcaacatatgaaaaggaatgtctagcaattctcatggctgttgatcactggcgatcttacttgatttgtggacagtttgtgatacacactgatcagaaaagtcttacccatcttgatgaccaaagactaacaacaccatggcagcaaaaagctttgactaaactgcttggtttgcagtacaaaatttgctacaagcaaggtacctcgaatcgagtagcagatgccttgtctagactctcaagtgagcagatgttggccttatcagtgatacaacagtcgtggcttcaggatttagcagataaatatagttcttatcctgatacagcaccaattctccaggccttgtccctaaaatctccttccggcccttaccagattacacaaggcattattcgatatcacaacagaatcttggttccagcaacatctgaattccctctcaaaattttcactgcactccatgctgctccaattggtgggcattctggtttcttggtcacgtaccataagatcaaaaagcagtttgtctggcgaggcatgaaaaagatgatcgctacttggtgcagccactgttcaatctgtcaacaggctcaaccagaaagagtaaaatacccaggcttattacaaccaatccaagttcctgcagccgcatggcaagttatctccatggattttatcgaaggcctacccacatctgataagtataattgcattatggttgtcgtcgacaaattttcgaagtacagccattttgttccacttcgtcatccgttcactgccctgaaggtagctactcaattcatggaccatgtttttaaacttcatggatttcctcaggccattataactgacagagaccggctgttcacaagtgccttttggaaagaactattcaagcttgctggtgtggatcttaggatgactacagcttatcaccctcaatcggatggtcaaacagaacgtgtgaaccaatgtttggaaacgtacctccgttgcttcatccaagcttgcccaacaaaatggaaaaagtggttatccttagcggaatattggtataacaccagttaccattcctctcttcaaagaacaccttttgaagtgctctatggccatattccgcggcagctgggcattgacctccctgggcaatgtgatgttccttcactggctgattggctgcatgaaagaaagctgatgcttcaactggttcagcagcaactcatcagagctcaacagcggcagaaacatcaggccgataagctacgttccgaaagagtattccaagttggcgattgggtctatttgaaattgcaaccttacgtccaatcttccttggtgaaacgcgccaaccacaagcttgcgtttaagtttttcggtcccttccaaatcgtggcacgcatcggacctgttgcttataaattgcaattgccagctacatccgctatacatcctgtgttccatgtctccttgctcaagaaagcagtgggctctactgatcaggttagctctgttttaccttccatttcagactccttacaatggccagagcagattttgcagcgtcgagtcgtccacaccccctccggcgatgttccacaagtgctcatcaagtggtctgcatggccagaagaactcgctacatgggaagatgaaccagtggtcaagcaacgctttcctgaagctgaggcttcaaggaggggagaatgtcaggaccatggtgtcaagcaaacaacagatgaaggagaagcgagtcgttcggcccaacagccgtgtctttgggccagattggacccagtaggcttccagccttgtattgtttctggtggcctgttggtcgttttctgtcgtgttaataagggagactgaaccgtatgcaagagagggaggaggagaggacggaagtgttaggagcgaacggcggctgtgtcggccggtactggcttgaactcctgtaaaccccaactctggatctagtgaatacttcgtgagaggtggagagcaccgggagtggtgctcgcgatctcaaattctggtgttggtacgttacaattggtattgggagccgtcgatcctggcagatccgccggaattagtgctgcggccgcagtacaaaacccgcggccaacgtcaagtggaagcgatggagaagaacatttcagatctgactactatcctgcagtccttgcaagcccaaaatgagtccatcaagctggcgttggaggacaacacagcggcagttcgggatcttacggtctggaaaccccaaatggaagccacggtcggatccctacgcagagatgttggccgactgtcagaaacagtggatacattggtggccttccgggaccaagtgcatcctgcattcaaggtgtttgacaaaaagtctcaagatagttcaaccgtgtcgttggctaatttggatgcaaatcttcaacatcaccaagggggattctctggtcttcatacgggcattcccaaccggagtgatggatttggggttgtcactaccctaactccacctccggtcacagactccttacaatggccagagcagattttgcagcgtcgagtcgtccacacctccttcggcgatgttccacaagtgctcatcaagtggtctgcatggcccgaagaactcgttacatgggaagatgaaccagtggtcaagcaacgttttcctgaagctgaggcttggggacaagcctccactcaaggaggggagaatgtcaggaccatggcgtcaagcaaacaacagatgaaggagaagcgagtcgtgcggcccaacagccgtgtttttgggccagattggacccagtaggcttcctgccttgtattgtttctgttgacctgttggtcgctatcgtatta

SEQ ID NO: 7689 - DNA, 879 bp, Zea mays
  misc_feature (24)..(24): n is a, c, g, or t
ttgggaccctcgaggccggccggngaaccggcccgcgagagtccggcccattgcagcgctgtcagcctgtcactgagactacctgtgtccggacgcccggtctagcaactagcaagcgccgcatccctcgcctcttcccgacttgccccctcgattcgatccgagcttacttctagggttcttggccccgctccaccgtcgcccatggcagacgatgccaaccgagcggccttcatggagctgcagtcccggatgatagataccaccgcgaagatcaagcagttacaaacccaaatgcgttctaaagaaggggaaaagaagcgtgcctaccttactttggaggaacttcgccagttgccagatgataccaacacctacaagactgtcggaaaagtgtttattctggagccgaagtcagttctgttcaatgagcaggagcaaaagcttaatgacagtgagagtgcgatagcttcaatgcagacatccaaagactaccttgagaaacagcagggcgaagtggagaacaatattagggagctgcttcaacaggacccaggacttgcgcgtcagatcctctcaatgaccgttcaatgagagttgtttttctctccatttaattttttagataatttgtaatgtcgcagtttgatcagtcatgctgtggtcttgccttatctgtgagacatgtgcggtctgtaatttctgaggtgtttggctggtggaatgatgtggtccatcattatctcactctagtgctttgtttggtttgtggaatagattgagttaattcatcatcaaaaaaaaaaaaaaaaaaaaacaattaaagcaaataatagcataaggaatgggttatttccactgaggttagtttcagcggcc

SEQ ID NO: 7690 - DNA, 661 bp, Zea mays
gccgcatccctcgcctcttcccgacttcccccctcgattcgatccgagctcacttctagggttcttggccccgctccaccgtcgcccatggcagacgatgccaaccgagcggccttcatggagctgcagtcccggatgatagataccaccgcgaagatcaagcagttacaaacccaaatgcgttctaaagaaggggaaaagaagcgtgcctaccttactttggaggaacttcgccagttgccagatgataccaacacctacaagactgtcggaaaagtgtttattctggggcccgaaagttcagttctgttcaatgagcaggagcaaaagcttaatgacagtgagagtgcgatagcttcaatgcagacatccaaagactaccttgagaaacggcaggggcggaagtggagaacaatatttagggagctgcttcaacaggacccaggacttgcgcgtcagatcctcctcaatgaccgttcaatgagagttgtttttctctccatttaatttttttagataatttgtaatgtcgcagtttgatcagtcatgctgtgatcttgccttagagcatctccaagagctctccataaaacgactccctcaaaatcagttttaagggacatctaaataataagtgggggtaaattttaatcctttctac

SEQ ID NO: 7691 - DNA, 10183 bp, Zea mays
  misc_feature (5948)..(5948): n is a, c, g, or t
  misc_feature (6157)..(6157): n is a, c, g, or t
gcagcgaacggggaagatcggcaggcggcggcggcggcggcggcggaagaggagatcgtactggagatgcccgtcaagccggcgccaccgccgccgctgacgtcgccgccggtgaaagtttctccggcgtgggagacggcggcgctgccgtcgagcatggtggcggtgcaggtgttcacggtggtgatgctgttcctctccaagctggccctcaacaccggcatgcgcccctgcgtcctcatcgtctaccgcaacctcgtcgccgccgccgccgtcgcaccactcgccttcttcttcgagaggtgcgtacgtacagcgcaccacatgtatcatctagtcctactaccagctgctaaagttacaccacctcactctctctctctctcttttggcttcgtatgtgcaaacgattttgtttttgtccggcaagttataaattcttgtcatgcatttgcgtgcgtgttattgtcagttcctagcgcgcagctccttgatcactttctcattcgttacttcaaatacctagctcgttgcatgtgcacaggtatatataatagcaatatacagatcatgctaataatcgtccacaagatataaatactagtctagtaatcaagacaaataaattccttctcaatactattatattctcccatacatgcatagcaatatatagtatgtatgttgtgcatgcagcagctagcatcaacacactaatatataacaatagatcgacaaactgaagcacacatgaacatgaacttgttcatttcattttttttttctgcagacttttcttttttgcgtgcgtactgtgtctctctgtatgagcgcgcctcctctcccagtgtagtacacgtatacgtgtacgggtacgtcgctacgtatgtacgctttgcatgcaattctagtagttattactaattagcttctatatatacagtgctacacgtcttgttttatttaattttgatttggtattttgaaatgcatggcacttatatacatgtcaacagtacgtacgatcgtagtagtagtagtcatgcatcgtaataaagttttttttttcttcttatcttgaaatgacatgtcatggcaagctgacaacagccgtcgtacatgtagtgtatatgtacggaaaggcatagttgacaaatatatatcgcgcacatgaacaacatgcgggatttttttcccctgtatacgaacctggcaggtacatatagacatagtacgtattaaacactatttattactgtacagaattttgtccgtgcatgcacgttgctgatgatgtgcgtatatatatctcagatatacgagactagtccgtagtcaaatatatatattaccgtacgtccaagcgaaacaaatttgtatgtatatatatacacatatcacatatgatactttaatatagtttggatctttgaatgaagagacagatgattgtctgcatacgcaatcgcgcagcagtgtgtgttggctgccaactgtatatgtatactatgtgtcttaaattatttttaaagttttaattatttttttaaaaaaaagcatcaaaatttatgttaccaaattataattactatatatatataatgattttatcttatgttgcatatactgttagtttttataaagttagctaaatttaatatagttttacttataggaatgtaagagttgatttatttgaggattaaaaaaggattataatttataaggctgactccagtagatcatgtaaatggatatgttcagcactattttgtattgtatattcatatagtggagtttggaataaggagcgaagagatagcatttaaaattgattttatcggagacaagtgagcgtgtatcccctcaaccaatagacagcctgcatgcagtctgcatctccattgacccctggtgcgttcagattggactggaaccgcgaaatttcaaagcgatttgatctctttctttgtcctttcgggctagaccctagctacttgcttctaattctatgatgaacagggtagaaggatttagaggggcttgttgacgtgcctggctaccactaattccagtgctaatggataatgcatgcatggccatctgatgcagcactagtcactcagacagatgaatgcctttttgctgtctccatgaatcagctgtagccgcaagcagggagatcgatctaggtgctagctgccaacctcgattgattgattcctactgcacatcgtcatcgtgtgctgcctagcttttagttcagttcttaaacgagagaattggaaatcgattgttgggatctgttttgtatccagggagatgtggaagaaactgaacttggctgtgctgggttggatttgcctaaatgctacattcgggtgagcagtgagcactctcgggggcctaataattattagtaactaataacttgatgatctgctttggattggaggtaaaactaatatatatatatatatatatatatatatatatatatatatatatatatatatatatatatatatatatattgttactattacatatatagagcggtgttggcgatggggctctactactatggactgcaggccacaagcgccgcctactccgtcgtcttcctgaacctcatccccatcgtcaccttcgtcatcgccgtcttggtcaggtacgtacgtacgtacgcagacaaaccaaagcatgtattgctatatttatgtctcccatctgtgaatgcattcttcattcagagccgagaaggtggccgctggggaagtggcctggtaggctcaaggtcctgggcgccctgacgtgcgtgggcggcacgatggtcgtcagcctgctcaaaggccacctcctgcacctgtggcctacgcacctgctgaaagcctcccgcgcccccggtacgccggcggcgagcggcggccgtcaccgtgacatgctcaccggcacactgttcctgtgcggcagctgcctgggctacgccctgtggttcatcgtccaggtagactttttttttgcttggagaattggaatccacatctccctccctctacgataacgagtacgtgatggctccatcatatcatatcgatcatccaacgaacgacgacgacgacgacgacaggcaaggctggggaaggtgtttccgtcaaggtactgggtgacgacgctgacgtgcctgtcagcaagcatacaggctttcgtcgtcggcgtgttcctcagccatgacagggcagactggaggctcaagtgggacctgcagcttctcacagtggtctactcggtaattacatgtgtatatacacatactgattaattggcaactaatcgatcgaactagtacatctatcacaaattaataatcagggcgtgctcaacacgggcgtcaccttcgtcctcatctcgtgggcggtgagccgtcgcgggcccatctacccttccatgttcaactcgctgtcgctgatcatcaccacggtcatggactcgctgctgcttggcaccaaggtctacgttggagggtgagtacgtggcctgacgatcgacctgcttcaattctacgcatctttttttcatttcaggccttgatgcacggggcagggtgctgggggcgttgctgatcatcgtggggctgtacgcgttcctgtgggggaaaggcaaggagctgcaggctgcagcggcggcggcggcgaaaaagaagaagctggagcaagagcaggaggaggagaggcaattaggcggagtccagatgacctactagcttagctaattaagtctctaataagctgctagctagctgtacctacctgattaccaaattgtagcctaactatgtatcgatgatagattgaataccccaccgagagaagatatgctacaaatacatcaacacaaaacatgaagaggcaatttggcaggcattatttatatatgtatgcatgctgtacaatggcatagcagcaaatatatgcagaatgcatgtaattcaatacatctatatgacgtacttaaggttaagctatatctatatattcaattgcaatggagcctgcattcagggtggacgtatctccctccatgccatcttcaaatgtcattgttctgttctcctgttttcaagaaatactttcatttggcacaaattgccaaaaaccataataggatgtttggtttgaggaataaattagtctatcatctttttactcctcatttttttttctttagtttataaaatggaatgagttgattcattactgcctcatatttaatagttagttaggaatgagatcatcccaccaaatttgagaaatggactcacgatgtaccaatctcatctttgatgaagtgattcctcgaacaaattaacatcctctaagttacattacataatccctgttattcactgttccctttacttgtagacaagatagatagagatattgttgtattgaattgataataacatacactgcattgcttggtcgagcaaaaaaaaaggttgttcttttttaaaaaaaacgtattcaaatcgagaaagggagaatatatgataaggatgatccatcgtcgtggatcaattgatctgtgatgatacatacatgaatatataggatgggagggcaaataactactactcagtagaagttgctggatccctggtaggagagtccagtggaccaccaggcggggatggcgtcgccgacgacgatggtcttctgcggcgcgctgtagctggtcatcctgacgacgaggccctgcgcgttgccgagcgcggcgaacacctggtgcgtgatgccccagttgtgcgacgcgggcacgtagctgcagtccggctcgccggccctcttcacggcgaggtcggagacgtcgccgctgccggccacgttcatcacgtacagcaggagccagtagtagttgccctgcacgtagaaccggacccctcccgagcgctggcacggcacgcggcggaactgcacggggacgatgccggccacccgctccgcgagcagcaggaaggagggcggcgccaggtcgaagtgctgccgcggcgggttgcaccacccgccgttgtcgctcgggaggtaccagttgggcgggcagaggttggtgcccgtcaccacgacggacggcgagcccgggttgcaccaccgggagttgacgcagcgcagctcgtagcactgcccgcacccggcgccgcccgcgaacagcggcgtgctcagcgccgccgtgcgcgtcgagtagagcgactggatgtcgttggcgccgtagccgcacgcgccgcctgcgtgcagatgcaactgcctctcagtctcaggtttacgaaccgccggtgccgatcgatatgtaaatgtaatgcatcctgcaaaagtaatcggcggcaacgtacgtaccgaagtctgcgccgaggccggagccgtctccgtagaacgtggcgctgccgtcttgccagctcgacgacgtgaagggcgcggcgaccgggtaatagccgctgccgctcgcgaggcgtgccgccgccatgatcacggccgcgacgacgacgatcaccggagctctcgacgccatggtatatatagtatactcgcaccgtaatgtaatgtatcgatgtatgaatagaacagaggtagcaagctcgccgccgtacgtacgtccggccggccgatgacgacccttagcttgttggtcgtcggatggagatggatatgaacgggttgttgacgtcgtttataaagaagcagctacacgttaactagcgggattgcccggccgggcggtacgacgtgttggacagcacgttgagatcgaggcgagggaggatggagggatgtgcctgcacagcatgcacagctcgtcttcgtctccgcgagagttcgttgttgggcgcacgatatacgtacagcaggttttgcagctagctggttgctggtcaaactttgtcgtgtccatgnccgggcccggggcgccgggcgaggtgatctgctctgctccccaagaatgcatatgcttcccattacagcaaaacatgctaggcccccgcactgcatgtcagctaacagctatcaacacggagtactattctactccatcgtcacttcgtcaggtggccgcctgctattcattttttatctcttttttcttctttttctatttatttatngtcgtcgttgacatcttttgttaacttttgtttggtcatggagactaaaatttagcatgtgtcagttagatgttttattgtcgagtaaaattaattacatagttgaagactaaatgatacaataaatttattaagcttaattaatacttctttcgttctaatttataatttgtttgactttttttataagttgaccgacttgttttatacaattttcttgcaattttttttaaaaaaattaagtgatcatgattcaagtatattatatgctagacgatatcacactagagataaagaatatttacgacgagtcgaccaaacttggggtaaaaaagttaaacaagttataaattgaaaagggggagtatatagttagcaaatgtttattataatatcacatgagcaaatcattgactaattagtcttaagaccgtgtccagcagttcactcatatgattacttaaaacattttttgcactatacactgcattgttcgtagagtaatgtttaaatatgggtatgaggatgagtaatctgctgaaaatagcctaatagattcatcttatcgtttagtcctcatgtgtgaaattagttttgtaattagattatatttaatacttataactaacattaaatcattcgatatagcgaggagtaaagtttagtccgagtaaccaaacacccccttatactaattacctatacgatggtatcaatttatactaatatatgtaaatcttgtaaccaataacttaaccctaaataattttaaattgaaaccttttaactaaaaactatcatttaggcaatcactatataccactataaaattcatcagtttaacatttacaaataaccacgaccaacccaatcaaatcactcgcacacctataaactccactaaatcacaaacaaattacacctagaattaacaacatggataactctctcacttattaaaatcagatgaacaatattatttggatcatttccctcccctcccatgaccacctaacctccctcttccccgccctcgccgtcccctccctctcacttgcggcgttgccgtcgtcaacccccctcctcgcgcctgccaccgccattgaccctttcactcccctgaatcatagcgttagcacggactatatagtagtatatataagtttaccaactacaaagtttcagatgtagtcaagttttataattttgaccttttaaccttttttaaaaaatatatgaatttattaatgacgcgaataattttaaggttagtcaaccacctttaaaaattaagttttagggacggttagcaaccatccctaaaatcatagttccaggagtgattttcttaaactgattgtctagatctatgtttagtgacggctggctagaaatggtttgataagtaaaccatacttccaagaaatagagggcgtctaaaattttactagtgactgtctttctcttgccactggtggattggatccaacgacgaggagtacggatcatacggatccatggcggcggcaagccggcgacgcgcaccatcttctacggtgcctcacgctagaagagaagacaaggtagagcagtgaaatagcgggtcggtgcagatcgattgcacaacggagggtgctgatcagtggctagcactgagcgacatgccgaccagataatcatgcctcatgctctatcatttttatgtccgatccagtgataatacttgaaaaaaaaatctgatgtcatttcggatattcttaactgcagcatttgaatggaaacgggaaaaaatgtgtacagccataaaaaaaaacatttaatcacttatcatatacataacatgtggtcgtcaagaactagtagattacagtaaatggatcaaagaaggactgtccgtttgtcatgaagcggtggttgagctcgccgggcctggccgtcttctgccacatctggtcctgcagcatctcgtcggtgaggccgaacgccctgagctcgtcgggcgtgtggtgcacgaggaggctgtacctgccgccttctccagtctgcatgacgagctcgccgccgttggcgaggttctcgaggccctcgaactggcggacggtccacttgtaccagcgcatgaggaagacgcggagggtgaggccgtgggagacgagcacgatgttcatgtctccgctggtgctgcggtggcccgggggctggaagcggccgaggacgatgtcggagagcagggtctcccggaagccggtgatgcggtcgtacacgtccgccgccgactcgccgttggggaagcggtagaagaagcggccgtagcgttgccggatctccttctccacccgcatctgctcccggtcctggaagttgcctggcccatcccatgcatgcgttgggccgccggatccacggccccggtataatacgttcgttagagcatctcccagagctctccataaaacgacttctcaaaaacagttttaagggatatgtaaataataagtgagataaattttaatcctttctccaacaggtcccttaaagcagcagtttgtttctggggagcccaaaaaacccctcatttgtagctacaaatgagggagttttaagggctatgaaaaaattaggggcgctttaggggaactgttggagacatgcttttgtgtttttcccaaaaaaaatagatttaggggaaacttctgggaagcttttagagatgctcttaccatgaggatttctcggatgcgctgacgggtggggatcatgtggataagaaaacaagacaagaaagatggtaccgtaccgaagtcctgctcgcggaggcggggctcctcgcggacgccggcgatgcggtggggctcgaaggcgtggccgatgccgcgcagggtctccaggctgcggcggtacggcgacgcgtagaagtagaccttccagtcgtcctggtcgcgggatccggaggagaagaggtcgcgcaggcggcggccgcagtcgtcggcctcgcgccagcccttggcggtgagcccgatcctggggtccgggacgcgcgtgtatgcagcctcgtccacgttgccctcgctctcgccgtgccgcaccagcacgatccgccggggcctcggcggcggcgccgcggcgggggcggtcgtcgccgcaggtgcctgctgcttcaggtgcagctgcggctgcagccggcggcgcgggacgcccagcgtgtcctcgcagcaccggcaccgcagctggcgccgaggggcccccggcggtgccaccaccagcgctgccgccgacgggcggcacttgctgggcgccgccaccatcgtcgtcgacgacgacacgtacggctcggcaaggggcacctgatgctagtatgcaagctagctaaccgccaactgagagcgaaacgacgaagatgacgacgacgatcgagctactagtagtaggcagtagcgaacggtttggatggctttgcttgcgggaaatggcggcgtggcgttcgtgaggcagttcgttgcctctgtctggtgcacatgagcgagagaagacagatagatggtatgctgacgttgcacgtatcagtgtctgtgcagtgtcgatgcattgcaccgccacgcgcgcggcgaggcgaggcgaggcgtcgagcttgacctgcacattctgtggcgaacagcgcatgagcacgcttgatatgtcgtactatgtgcctcgtgtactcgcaccgacagtggtgggcaggtggggatggcgtgcgtgcgtgcgtcgcgacatcgacatgccgctgtccgtccgtccgggcgcaatcgatgcacggcgcctgtactggatggaatattccattccattgtagtcggcaggctttaccagctctaccattccagcccaatgggctggtaaatgggctccataaattttctttcattgtggcccatgtgcctccaaatgcgacgaacgcacaaattgagcccgttcggagtatcaaccagtccacaacagggacgggcgctgtctgtcttgcaactaggcagcgacccccttttttag

SEQ ID NO: 7692 - DNA, 1299 bp, Zea mays
gcggaaatctcgcccgcccgcgagatctcctcgtcccggcgccctcccacgctcatcctcccctcgctcgcatatgacgtcgtgcaacccggcacgctcggccgcctcacggcgctgcagctgctcagcctgcgctccaacaacctgttgggcccgctccccgccgacctcctgcgcctgcccgcgctcgcgggcctccacctccaccgcaacgccttctccggcgcgctcccgcccgggctcgcggggctcgccgcgctccaggcgctcgacctctcctccaacggcttcggcggcggcatcccggacgccgcattcgtgggaaactacctgacgcgcccgcccgccgccgccgccgcgcggaggcggcgggtcaggctcagcgaggcggccatcctcgccgtcgccgtcggcagctgcgtcctcgcgttcgccgtcgccgcggtgctgctcctcgcattttgcaacagggagggccgcgacgacgacacgggaggggccggcggcagcgcgggtgtcgggaagggcagggagaagaaggggagggagtcgccggagtccaaggccgtcatcggcaaggccggggagggcaaccggatggtcttctttgatggcctggcgctggcgttcgacctggaggacctgctccgcgcctccgccgaggtcctcgacaagggcgcgttcgggacggcgtgccgggccgtgctggaggacgccaccacggtcgtcgtcaagcggctcagcaaggaggttagcgccgggcgccgcgacttcgagcagcagatggagctggtcggccggattcgccatcgcaacgtcgtcgagctccgcgcctactactactccaaggacgagaagctgcttgtgtacgattactacaccagcggaagtgtatccaacatgcttcatgtgctcaatttggaattacgggcttcataactacaagcgtcagcctgtttgtgcgttagaattttagcaatcatgatagcgagacagacgtggcgattttgaaaggaaaggaagaaactttgtaacgtctgattgataccatggtgacctggagatgcaatgttgcttgttgtttggaaagatgctcatgggttgatatgctaactggttgtttagtgcaagcaacaaccttcttaaggagaagatgaactttagcgctctgtgcttggttcaccggaagtccggatgtagcatgtgctgcccatttcttgcttatttttttgtttgctaacttgctgtcatgtattgaatctcatgtgttcatttaagttctcaaaaaaaaaaaaaaaa

SEQ ID NO: 7693 - DNA, 2987 bp, Zea mays
ctgtcttggcttgggggccttgtgcatggcgtggggacgtggggtgctctcgttcgttcagttcaaagtttgaattcaaaaaaaaaatgaacttggcaggaaaaaggtgcaaagcgaaagaaagccaagtccttgccgtgctgcgtgcaaagcaatcatcgtcgcccacacactgcagtgaagtcatttcacggcccatcgctttcctcattcccgccggcctaacccaagtgtcggctgacgagactgtgtgagagttggagagctgcggatggatccgtcggtcaaccgctgcctgtaataattaacaagttttctaattcctaataaagtgccgctacaattcgattgccagaagaggctcacatgggaattgaaggcgcagatcgctgaccgcgccgccgtcacttgccgagcacgcaccgcggtagtagccgacaccgccgcgcaccacgttccgttcgtctcccctcgaaccagtcctcccaccaaaaacgcactcccgaacccgactctcctcttgctcgctctcggtggcgtctccgcctccgcagtccgcactcgcgcacgcttcccttcccttcctcgcccacgcggacgcggccacggccgctccaagctagcagcagagcgagagcagccaatttggcgcacctctctcactctccctccctccgttcagcagcgttcgtttcgttgctcactcagatccagccattcaggtgagagagtaggggcagcgatgcccacgccgccgctccgtggggcggggctcctgctccgtatctgcctcttcctctgcctctcactccgcccccgcctggcctcctccgagcccgacgccgacaaggcggcgctgctggcgttcctctccggcgtgggccgcggcgccaccgcccgcgcgcgcatcaactggtccaccacccacctcgcctgcagcgccgacggccccggccccggctggacgggggtcacctgcagcgcggacggcgcgcgcgtcgtggcgctgcacctcccggggctgggcctctcgggcgccgtgccgccgggcacgctcggccgcctcaccgcgctgcagctgctcagcctgcgctccaacgacctctccggcccgctccccgccgacctcctgcgcctgcccgcgctcgagggcctccacctccaccgcaacgccttctccggcgcgctccccgccgccctcgcggggctgaccgcgctccaggtgctcgacctctctttcaacgccttcgacggcgccgtccccggcgcgctcgccaacctcacccgcctcgtcgcgctcgacctctccaacaactcgctgtccggccgcgtcccggacctcggcctccccgcgctccggttcctcaacctctccaacaaccgcctcgacgggaccgtgccggcgtccctcctccgcttccccgacgccgccttcgccggcaacagcctcacgcgcccggctccggctcaggcgccgccggttgttgtcgctccgcctcctggcctcgctgcgcctccccccgcgaggcggcggcccaggctcagcgaggcggccatcctcgccattgccgtgggagggtgcgtcctcgggttcgccgtcgcggcgctgctgctcctcgcattctgcaacagcagcagggagggccgcgatgaagagacagtaggcggcggcgcggctgcagggcagggcggggagaagaaggggagggaatcgcccgagtccaaggcggtcatcggcaaggccggggacggcaaccggatggtcttctttgaggccccgtcgctggcgttcgacctggaggacctgctccgcgcctccgccgaggtcctgggcaagggcgcgttcgggacggcgtaccgggccgtgctggaggacgccaccacggtcgtcgtcaagaggctcaaggaggtgaacgccgggcggcgcgacttcgagcagcagatggagctgctcgggcggatccgccacgacaacgtcgtcgagctccgcgcctactactactccaaggacgagaagctgctcgtgtacgattactacagccggggaagcgtgtccaacatgctccatgggaagaggggagaggacagaacaccattggactggggaaaccaggctaaagatcgccctggggagcagcacgaggagtggcacacatcccacaccgagaacaacgggaggtccgttcacggcaacatcaaggcctccaacgtgttcatcaacaagcacgagcgcggctgcgtctcggaccacggcctggcgtcgctgatgaacccggtcacggcgaggtcccgttctctcgggtactgcgcgccggaggtcgctgacacgaggaaggcgtcccagtcctcggacgtctacagcttcggcgtcttcgtgctggagctcctcacggggaagtcgcccgtccagataaccggcggcggcggcggcgacgtggtccacctggtgagatgggtgcagtcggttgtgcgggaggagtggaccgccgaggtgttcgacggcgagctgctgcggtaccccaacatcgaggaggagatggtagagatgctccaggtcgcgatggcgtgcgtgtcgaggtcccccgagcggcgtcccaggatggcggacgtggtgaggaccatcgaggaggtgcgtcggagcggcagcgggaccgcgaccgggacggggacgcggccgtccaccgaggcctccaccccggccaccgccgctgaagcggcccagagcagggcggaggagggcggctcgtcggcggtggcgcagtgaccggacgcgacgcaggccgagctgcttgctggtggctcgtagcttggatgatcctgtgctttattttggcgggtgctgtaccattcgttctttcgtgttacgaaatcgtaacagaatgtcacgtggacgtggacacggtggtcggatttttggcagcaactgctcgctgctgactattgattgactctttgtacaagtgtgaaggaagaaaaaagggcccaaa

SEQ ID NO: 7694 - DNA, 3002 bp, Zea mays
gcacgagaccattaccccgacctgcctcatcgaaggagccccatcatactcattcatattataaggcgcgaatctatccatctatctaatctacttacgcacgaacatgcgtaacatcggcatgctgcgggcgctggtcctggcgctcgcggtggccgccgccgccgccgccgagaagaggaggacgtacatcgtccacatggccaagtcggcgatgccggccgagtacgcggaccacgccgagtggtacggcgcatcgctgcgctccgtgtccgcctcagcctccgccgccaagatgctctacgcgtacgacaccgtcctgcacggtttctccgcgcgcctcacgccgcaggaggccagcgacctggcgtccgccgagggggtgctcgccgtcaacccggaggcgcggtacgagctgcacaccacgcggacgcccgagttcctgggcatcgccggccagggactgtccccgcagtccggcacggcgggcgacgtcgtcgtcggcgtgctcgacacgggcgtctggcccgagagcaagagctacgacgacgccggcctcgccgaggtgcccgcgtggtggaagggccagtgcgaggcgggacccggcttcgacgcctccaccgcctgcaaccgcaagctcgtcggcgccaggttcttcaacaagggctacgaggccgccatgggccccatggacaccgaccgggagtcccggtccccgctcgacgacgacggccacggcacgcacaccagctccacggccgccggcgccgccgtgccgggcgccagcctcttcggcttcgccgcgggcacggcgcgcggcatggcgccccgggcgcgcgtcgccgcctacaaggtgtgttggctcggcggctgcttcagctccgacatcctcgcgggcatggacgccgccgtcgccgacggctgcggcgtgctctcgctctcgctgggcgggggcgccgccgactactcgcgcgacagcgtcgccatcggcgccttcgccgccacggagcagaacgtcctcgtctcctgctcggccgggaacgccggtcccgggagctccacgctgtccaacgtggcgccgtggatcaccaccgtgggcgccggcacgctcgaccgcgacttcccggcgtacgtcgtgctcggcgacgggaagaactacacgggcgtctcgctctacgccgggaagccgctgcccagcgccccgatccccatcgtgtacgcggccaacgcctccaactccaccgcggggaacctgtgcatgcccggcaccctcgtgccggagaaggtggccggcaagatcgtcgtgtgcgaccgcggcgtcagcgcgcgcgtccagaagggcctcgtcgtgcgcgacgcgggcggcgccggcatggtgctgtccaacacggccgccaacggccaggagctcgtcgccgacgcgcacctcctgcccgccgccggcgtcggcgagacggaaggcacggcgatcaagtcgtacgtggcctccgccccgaaccccacggcgacggtcgtggtcgccgggacggaggtgggcgtgcgcccctcgccggtggtggcggcgttctcgtcgcgcgggcccaacatggtgacgccggagatcctgaagccggacatgatcgcgccgggggtgaacatcctggcgtcgtggacgggcaaggccgggccgacgggcctcgccgccgacacccgccgcgtgggcttcaacatcatctccggcacgtccatgtcgtgcccgcacgtgagcgggctggcggcgctgctccggagcgcgcacccggagtggagccccgccgccgtgcgctcggcgctcatgaccacggcctacgccagctactccggcgggtcgtcgctgctggacgcggcgacgggcgggatggccacgccgttcgactacggcgcggggcacgtggaccccgcgcgggcgctggacccggggctcgtctacgatctgggcacccgcgactacgtggacttcctgtgcgcgctcaagtacagctccaccatgatcgccgccgtggcgcggagccgggagtacgcgtgcgccgagaacaagacctactccgtgggcgccctcaactacccgtccttctcggtggcctactcgacggccaacggcgacggcggcggggactcggccaccgtgacacacacgcggacgctgaccaacgtgggcggggcgggcacgtacaaggcgtccacgtcgctcgccgctgccaagggcgtggccgtggacgtggagccggcggagctggagttcacgtcggtgggggagaagaagagctacacggtgaggttcacgtccaagtcgcagccgtcgggcaccgccggtttcgggcggctcgtgtggtcggacgggaagcacagcgtggccagcccgatagcgttcacgtggacctgaacctgatggacggatggattataccatacgacagtggtttttggcgcctcagcctcaaagaaaggcccataatccatcatccatgtgacggcctcgttccctacactacgcagtcaaaagggccgaagtgtagggtgggaaggtttggagggggtacggtgcaaattggaggtttcttctgtgttgctattattactactaataaggtcattaatcctatcagcgtccgtaggttgtgatttttggatggaaatgggatcggggtggacggttggatggagattgatggtgcttggttgattggaatggaattattagagaggagaaggttttataggttgaggcttgcaagttgggactggaccagagtgtgactgtgcgagggcaggagcagtttcgcagtgactgattggaacctgctgtagtgctgtggggaactgtcgcctcgcctatcagaaatggtctccacaaatgttttccgttctacctttttgaaaagtctcaaattattacaaaaaaatggctttacctgaaattgtggaaatgtaataacacgcttgtttttttatcctatgataaaaaaaaaaaaaaaaaagcggcc

SEQ ID NO: 7695 - DNA, 6258 bp, Zea mays
  misc_feature (2525)..(2525): n is a, c, g, or t
agtgggcaaacaattaatttggatatatttggagccttgactaataaatatgtaaaacatagtaaatagtttgttcaatccgactatccgtgcatgacagtagagaatggaaagaatccaataggggtagggaatagggatcatcttttttttaatgatcaattagcacatataacatgatcaaatagttaatgagtaaatattttactagccctctcactaacaattagccaatttattagccaactcatttagagtctaaagcgctaaaattagctgagaaactatttgagcctctaaagtaggactgatacagagaaatttttgagacagttcctaaaacttaggatgatgactaaaaaaccaaaacccactaactctacgatcactcatattctaagagagtagtaataaaaaacagtctttttgaatctcaaaataaagaaaatgaggtaaaaggagttatcaccatgaaatgacttaataattttaaattattttgtgatctttataagtcattttagagtacgtgatcaagggctgagctggccgtgaaaggtcatgaatgagcctcgcacatggttcggtcttctcggatcgtacacgggtttggtaggacaaacgttacaggagcaggccgcacatggtcaggtcttactgtcaatgctccttgagatccatgtcccaaatctccgtgacaaagaagatatataccacccctcaagtaaaacaaaacattcatacagttgcagcggatgtccagatcttgatctggttcatttgattaatccactaaattttccgttggcatcagaaatgtgcgtcatcgtccggtccacgttgcgtccatgatcagtcaagccccctgattgtttaatttatctgatcaatccaaaggaacggatgacctgcagtcgtgcacgatcaagcctgatccagttggatcaattttccgttgccatcagaaaggcgcatcatcgttcagagggatccagttgcgatgaggatgcagcttcagcgttcagaggcggatcagcaacagcaataacaaactgcggcgctctcggttttcaaaaccctggccaattcatctatagtctaggacttttatccctaatccatgttttcatatgcttcctattttgtatggattcccacaattgaaaatgttaagttacaacaatctagactttggcattagctagtacttcctctgctccgagttataagcacttttagcttttctagatgtgttattatcttctatttcagtgaattggcactgctgctgacattttctagccaataaaagtatatggccaaaagcgagcaacagcgtcatatttcaaatgtgcaaaaaaaaacatcaagcttatcagccagaagtaaccaactaaacaaccaaagcagagcaaacagggattcaaatccttaatgagttcataactactcatagagcaatcttgttgaaaaaacggtacacaattcttcagattcaagctttaaatagcaagctctagttaaggaatgataacttaaaacaacatcatgcctatgaaacatcagcaaaaacccagcaagtaatatgactgtacaaactagtaagatataagtgtgattatggccgcttaaaaatctcaacacatagcctctgtaacaagggcgtccaactaatgttcatgagcaggcatgtcgtccaaaagctattagcagacagtttatccaaatcataacacaaagaaataagtagctacagacaatttctccaaacttcataacagataaaaatacgtagcaatagagagatggcattttcgtcacctttactacctaaatcataacagtgaagtaaatgtcgagcagcacaagctaaaaaaatcaaacaagataagaaacagttcgtcataaattattctttagaaaaaaaattgcttggaactgtacaagcactcctacaattagcaacctttgaagaattgtacaaattaacgtttacgtgtacccatgacaacatcacacattagacccttggaagaagacatagcatgcttccaaatattaggttgaatgtctgaataaaagaataaaatattattttctccaacaatacagcagcaagtcatcaatctatgaaaactaaaaacagcagcaaaacacagtaacaagaggctgtaacatgatatggttatttcctactttaagttgcactttagggtttaggaattgatgctgaagacaaagatgatgacgtgttgacttaacaaaaccagtggcataagcaccagtttattttatcttaatatgatttatagctattcaaaatttcataggggtttgacccgccctttcatagtactttactgcagaataactatcagaatgcaattccagttcaaatggaaaatggcagaaaagttgcaaagccatggataattttgtattacattaccaatataaagcatcaaagatgtcagtggtaaaaattaatcctttcgccgttcggctgctcggtttcgcaacaacanctgctgctagctgctgcggtggaaagtttgcagccagaatgctggtgaaacttgcagccaaacagctagccaccaaatgaagatgcaacaccaggatacagtgtggagtacttgacttgacacattgcaataatcagtaaagtttgaaacatatggcagaagacagaaaaatcttaatgtatgcttaggtaaatttagtgagcagtatcaaccatggaagataagaaaggtagcagctaaatagagaacgactagtctactaacatatgcacaaactccacatatcagtaatgcatgttccacaagaacctagaacaaaaaatagaaatggcatagagtacaaaagcgagactatttccatcagatttgagcttctatcatgttcaaccacgataataaacaaagcttgcaatctctagctgtcacataacaataaagattggtgaacgaaaaagaaaaagagagagagcaagagagtggaaactagaacaaccatgtcccccatatcacaaaatgctctgaccttgttgatagccaaagcaagtatgcaattgccaaaccaccaactctcatctgaactttcaggaaattgtagatattttggccttcatatctaagttctccacatcattaattggtctagttgtctgatccctgaatctcttgatcttggggctttccagccccttgtgtgagaaaccatatagccgaagcacctggttgtcggcaaaattaaacgctcgctccatgctcctgaggcagcgctccactgggtaatccccatagctcccacatggcttgcacccaacaaagtgagtcacgaaaggccaccgctcgtcgccgaggcctgggtggtgattctccatcatctcctcatacttatccaccaacccagcccagaagccatgcaagtagtaggaattctcaatgaacaccttgtccatccacttgtccttttgcgagagcaagaggtaaatcagtgccgactggtcgtcggcctcaaatgctggccggcccttgaggtttgccgtgagtaccttgcccgcctgatcgcggatgaaccccttgggtcccatgggcgcccacgcgtccaggaggtcaagcgaccactggcaattcctgaagaggaagctgccggtgttgagtgcaatccaggagtgcttctcgaagaggaggtcctggtagccgtggatgatgaggttgtggccgtcgtagcgtgacaggggcagctcgaacgacatgtcggtgaagagcgcgtcgctgtccatccaccagatccactcgacctccgggtgggagagcatgaggcggcggagcagcggcaatttggcccagtatccggcgagctcgttgtcaaggtgcgcgaggttgtggacgatctcgatgccatggaggcggcagtaatcgatcttattcttggtagtcttgagcaggtagtggtcgccgagcgggttgtcgcagggccccggctgcgagccggttacgagcataatcctgggcttgcccccggcaagggtggccgggaagccagggttctgggccagccaccgtcggcgctgcgcgtcccagtcggagatcttgggcccgagcgcgtatttgccgaccgcggccgcgtacgcggcggcggcctcggtggcgctgagcgcggtggcgttgaagccagaggcggcgccgaagtcgccctcgtcgtcggggtcggggccggagtcggagcggatctcgcggaggatgcggtcgatgtcctcgacggccttggcgtccgcgagcgcttcggcgtcggagggctgcgaggggagggagaggttgaggccgatggtgccccggaggacgaggatggtgacgaggccgcagagcacggtaatcttgaggttgttgaaagtgcggtggatcttgcgcgaccggctgtggtggagcggcgacgcgccccgcggccgcggcgccgtcatcggcagccctcccccgccgccgccgcctcctcctccccccttgctgttgtaccccatcccctcctggcccatccccgccacagaggacggaatcctcggttttttattgcccactcctggttccccccgcccggcgccgcggattggggtctcggactgctgactgtggggggcggggcgcgactcgcgtcacatgggcggggagagcagcaccgcgcggcgcgctggagctggagtgcgacctgcgtcgacggcgagtggggacgggaattgatatgggatcgcaggatgcgagggtgttaccgtgtgagtggtgtcgggaataggggaaagaggaagcggggtgtgtgtttatgtgagcggtgagccggtgaatccccccgccggctgggcttcgtctctcttatgagtctggacaatgggctgtcggctgttgacccgggtttggtttcgcggcttcggccggccggaccgccgggaaattttggggcgggcgttggggaggagggcgccggagaagtggtggacgtgcggtgccgtgccgtttggcgtgcgggcgtcgcgtttgccactccgcctggggttgttggatggaggcctggaccgtgtgtgcgtactgcgtgctcgcacgtcttccgggccggcaaaccgggcggccatctcgttcttgtccaggcccggcgtgtaaccttcccagtattctttattattctttatttattccaatactgtacgctactggagttttattcatggtctgattgatggtcacggtgatttcaactctccactgttgatgagttcttgggatacgggaccgagataaatgcggcacggcgagtcttcctatgtgcagagactgcacggctttcacggcgcgtatacagtaggttattttgattatttttactcgtggtactactatccacgtggacgagattaagccatataattatagaaaaattggaacgtagcattcttggtaaattgcagaaacgaaagttgccgttccttttggagaggacaaccgagctttgcctctagttgagaattaatgactcgttgttttccctctgctaaacacatcgaatatttagatacgaggtacaagtattaaattataatttaataataaaactaattataaaactaaaccacaagacgaatctagtaaacctaactattctatgatttactaatatgatgctacagtaaatatttactaattatagattagttaggttttaaatttttgtctcatctttacctatataaatacttttataattaaattatatttaatgcttatatttgacatataaatatttgataggacacataataaaactttagttcctacaaacgtaaataagtgtttttcacatattctctctaacatgtaagtgtttaaatatgacatgtatactactacttttgtcttaaaatattagtcgttttagcacttgttttttatgtctatatttaaatggacgatgatgaatctagacacgtgagtaaaacacacatcaaatattatatggatttattaattatctaaaacgaattttaatttaggatagagagagtatttattagaaatatgaatagttcgtttctcgctctctagttctaacacattatcatgtatgaatagctcgttattccttcgtaattactgactgaccatttgcatgtgctttgctacgattgttatatatcatataaataagtattgagatatttattcaaatataattattgtttatttgtaaatattaagatacgtg

SEQ ID NO: 7696 - DNA, 3765 bp, Zea mays
atggtgtttggcccatccagcggtcgacttggacttctccgcgactgtgctgttctgtgcagccgtgcagggacgccaacgactccgagctctcctccatccaactctcatggcgggctaccgcgggggctcctccgtctccgcctccaccggcggcgggggcagcgcggtggccgcagccttctccacccggctgctgctactcctcacgctgctgccgctcgcgctcgccgccttcgccttcgcgctccagtggcgcggcggtatgcgggacccggcaggtgcagcctggcccgccgacgcgcagcgcttcccgggcatggagaacagccccctctcctcctcccacggaggcgcaggctcctacttcgccgtctcctcctcctcctcctccccgggagccgactgcgccgagatccttggccggagcgccgcgtcctccaatggaatctcgctctaccgcgggtggagcttcgactccgaatctgctataacccccaagatctgtatcacgggaagcacatctgctagcctacaccagattcttccatggttctcgtaccgcttctcatgctgctgaattatctgccgacactgtgacccgagtatcctgtacacctgcctgctgagctaatgtgctgcgcgtttcatgccctgggaatttcttattttcaaacaccagcttagctcgaccacactgtttctctatagcatactgtgtgtatgtagtggtgtgcaggcctgcttgtgatgcacatcaatacatacttatgtactgctacattttactaagaccatggaaataactcaaagtaactagcagctgctctatgtttggcaaattgggcaatgcggaccacagcttacaagtgatagtttccttgcatgtacagccatagttcaagtacatggagaaattcccctttttatgtacaaccatgatcacacgatatggagatcttgtatggtcacactcatacaaacaagagtttaggcaacggcatgaatccaagtatctttgtttaccctgttattaagacagcatgaatactgtgtcttggactgcagatctgtatcacgggaagcacatctgctagcctacaccagattcttccatggttgtattatcacaaggtcattggcgtttcccatttctttctttttgttgaaggagaggctgcaaagccagctgtcacctctgttcttgaatctattcgggtaaataaatcacctctatcccattcctgtgtactatttctttgcattaactaagcactgactttctgtgtccctgctttagggtgtaaaaattatttacagaactaaagaactgaaagagaaacaggagaaaaggtatgtcaatgacataacagttccatgagaatcttttcaaccttaaaatacccattccatgtaaagaatgatttaactggaaatttggtttgcagctattgtttgataattctgattttagtaagctatgtaactaaaatgtgttgatcaatgctaaattatgatagtacttgcttcaaactatattgtagtggtatgccaagttacttgctctcatcacaatgctgccatgatcaattctgaacattgattctgaagtgctgctgattggatcctataggctatatctccatgttcctgacttatgtatttctgaagtattttgttgattgttctgttggctaaagcttctgttgcaaccattttataatttcagccgcatttggaatgagacgtggctagcaggtttcttttacaagccgtgtaattacgaactatttgtcaagcaatcactaaacatggaaatggctattattatggcaagggtatgaactgttccttgcatctgtttttagcatcgatttaaactgtaatcttgactttacatattcctttcgacagagtgttgtaattgctgtccaagtctatattcacataccagcacacttcatattatttaattttcagtcaccctttcctcactattgggaattatgattatcataattatctggcagtcttgttttgagctctgcagcgcacatattgatatatgacatcaacagtggaattcaacatgttgagttattgattgtgtagcagtgtagctatacaatttatagtaatgcgagagaaagctataatgaaaataatgtcagttccaaaacgtttgtcaacattttcctgccccacatccttttctcacttccctgacacaacttttatgacgagtactaaacgatgtaaaagtttatggaaacttcatagaattaaaagacatgtaacagagtctctcattagtagaaatatagaattatagacctgtaagtacttttacttgctttctgtataaactgggttgatcctgcatcatagaaagtagatatacagaactctgtccttagtttaatgtaaacattatcctaggtgatacaactactaactaaaatccaagatgttctaatcatcgcacttttctgcaatggtcccatgctctgccaacgtcaagtgatatgatttttcatcgttcatagcaaacatatacaagactaatggatctaactatggagccattttattagctgtcatttagattttgaaaaggccttgtatttagttgtgagattgatgtgaatgtcccttttttttattgtcacaggatgctggaatggattggatcattcacctcgatactgatgagttgattcatccagctggtgcccgagagtactccctgaggcgattgcttttagatgttcctgacaatgttgacatggttatcttccccaattatgtgagttgcagaagtaacatgtttgttgaatatggtaatgtgtttcacatctgattactgtatatattttttttttcaggagagcagcattgaacgtgatgacattaaggatccttttactgaggtataggagctactgttatctgtaacatatatgcaaaataaagggggaaatggctctgtgtcctattgatgatccaccgactcacttgggaaacaaaactggatagtctcactgtttagaaaaaaacactatagtttagcaaacactgcacagaactactcattattgcattgcagaaaatgataggactggtcagattatcgttggctgtatttgataggttgcatcatttataaattcttttgtgcctgcaggttcccatgtttaagaaaaattatgaccatcttccaaaggatacatactttggcctgtacaaagaagcaacacgtggtaatccaaactacttccttacttatggtaatgggaaatctgttccaccaacaccaagcattccaagagaaagccagtttaaccatccctggcttgcccctgccaactgttcatcgcttcgaggacttcctggactatgagtatctatggaagatttcaccaatgattcctgccagtgatcagtgaagtgttaccatagataacacccaaaaaacaaggcaaatacattcttattaaacaagaatataggactatgtcaccatagttatgctgaaaatgtgaaagctgagcaactaaagctatatagcttccaaaattgcatgcattagataaacatgatgttaaattactttctacacccaaaaaataccatgatgctcctggttcagtctcacttaaagaacatatacatgacatgcaatttgataggccttaaaggcaagtgccttcgatcagttttttaagcagctcacagcaattgacttgcaacagtttttttcagcag

SEQ ID NO: 7697 - DNA, 892 bp, Zea mays
ctcttggactattgtatgaagcagagatctttggatagctccaaaaccgacagctatgtgaagagcatgcagatggaaggcaggagcacgagattagcgcgttgatgtacttagtactgcgaaatcaaacaggaggaggctgcaattctgcattacacctacaaaaaattctcaaacctaacctcaagaagggatagatgtggctgcaaaccaactaaagaagatgtgaagcaatgttttatcttggaatttgaccgtttggtaccgggaacatgttgcatggaccgatagagacaccaacttgaaacttttaaggaaggatgtattaacacatatatatgtgcccatggcattcatcggtggcctcaaggaatccgacgtctatcaatgcaataacatcagcgaaagcacaataaaaaacaaagtcatcaaacatgggtctcggaaacaaggaccacatccggctaaactgaactgctggtcagtccaaattggaaggcggtcacgggaaggtgcaggtaagcgtcagaaagatcctagaaatggttgatgcctaggaaggagcagcgatgccgccaatgtcgcccccaggttttcttgagctggctgaaagcaccactgccttttcatgacattatgtgaggcattgtttgagtattgactgaggttggtttaaccatgcgtgatacatgcagccttgagcatacagataatataggcttgtttgttcttcctgtggttgtttatgatgtatccagtgagtcactcaacaactttggcgaaagcccagatgttttcttgcaatttttgaaaaatattccgcgccctgatttcaaaaaaaaaaaaaaaaaaaaaaaaaaaaaaaagggcagacgatctaaaagatccaaac

SEQ ID NO: 7698 - DNA, 2106 bp, Zea mays
agtgtttggccctcccgccgcccgccggccgacttggacttctccgcgactgtgctgttctgtgcagccgtgcagggacgccaacgactccgagctctcctccatccaactcccatggcgggctaccgcgggagctcctccgtctccgcctccaccggcggcgggggcagcgcggtggccgcagccttctccacccggctgctgctactcctcacgctgctgccgctcgcgctcgccgccttcgccttcgcgctccagtggcgcggcggtatgcgggacccggcaggtgcagcctggcccgccgacgcgcagcgcttcccgggcatggagaacagccccctctcctcctcccacggaggcgcaggctcctacttcgccgtctcctcctcctcctcctccccgggagccgactgcgccgagatccttggccggagcgccgcgtcctccaatggaatctcgctctaccgcgggtggagcttcgactccgaatctgctataacccccaagatctgtatcacgggaagcacatctgctagcctacaccagattcttccatggttgtattatcacaaggtcattggcgtttcccatttctttctttttgttgaaggagaggctgcaaagccagctgtcacctctgttcttgaatctattcggggtgtaaaaattatttacagaactaaagaactgaaagagaaacaggagaaaagccgcatttggaatgagacgtggctagcaggtttcttttacaagccgtgtaattacgaactatttgtcaagcaatcactaaacatggaaatggctattattatggcaagggatgctggaatggattggatcattcacctcgatactgatgagttgattcatccagctggtgcccgagagtactccctgaggcgattgcttttagatgttcctgacaatgttgacatggttatcttccccaattatgagagcagcattgaacgtgatgacattaaggatccttttactgaggtttccatgtttaagaaaaattatgaccatcttccaaaggatacatactttggcctgtacaaagaagcaacacgtggtaatccaaactacttccttacttatggtaatgggaaatcagctgcaagggttcaggagcatttgcgaccgaacggtgctcatagatggcataattacatgaaatccccaaatgaaatcaaattggaggaggctgctattctgcattacacctacacaaagttctcagacctaacctcaaggagggatagatgcggctgcaaaccaactaaagaagatgtgaagcgatgttttatcttggaatttgaccgtttggcctttataattgcatcaacagctactgaggaggagatgaggaactggtacaaggaacatgttgtatggaccgatagagacaccaatttgaaacttttaaggaagagtgtcttgacacgcatatatgcgcccatggctattatccgtggcctcaaggaatctggcgtctttaccaatgcagtaacatcagcgaaagcacagtcaaaaacgaagtcatcaaacatgggtctcggaaacaaggatcctatccagccaaacggaactgctggtcagtccacactggaaggcagtcatggaaagttgcaggcaaccgtgagaaagatcctggaaatggttgacacacaggaagaagcagcgatgccaccaatgtcgcccccgggttttcttgagctgactgaaagtgtcactgccttttcatgacgctttggtttaaccatgcgtgatgcatgcagccttgagcatacgaatagcattggcttgtttggtcgtcgtcgtatcttgcaaccccagaatgaccagatgtatcgtgctgatgtaaaattgctagttatcaccatgcaaagagctttaaatcaacttcagaaggtattataaagttggtgcaaattataacaaaaaaaaaaaaaaaaaaccccgggccttaggccaggggcatgttaacttgttgggggtgattagttgttttttcgttggtcttcgtagggtggccaaccattccctctaaaaaaaaaaaaaaaaaaaaaaaaaaaaaggaaaaaaaaaaaaaaaaaagcggcc

SEQ ID NO: 7699 - DNA, 1253 bp, Zea mays
aattttatgaccgtcgaaaaccaaaatttagataggccacccaaatccaggtgcaaatcccaacctccctccctcccaggccccctccccacctccacctccaggcaccactggtcccacctcctcacctgcgaggatgctgctcgtgagtcaggcagcgaacggctccctctccgcgcggcggctgccgtcgaagccgccggggccgtccaccaccaacccctacccgctcttcgccaaccctcgcctcctgcgccgccgcctggcgctctccggcgctggcgccgaccaagccccgcgccgcgccgcgccgaccccagccgccgcgggcgagggcccctccgcctcctccaccgaggacccggtccttgtccgcgtcgccgacgacggcgtgccgctcgagggcgtcatccagattgagaagcccggggatgcggccgccgagtccaagctcgtctcctacgcgaagctgggtcttctggccggcggggacgtgttctgccttctgctgttctctgcgattggaaggttcagccatggcctgcccgtcctcgacgccgagacgttcaagacggccgaccccttcattgctgggtggctgctgagcgcctaccttcttggcggatttggcgatgatgccaaagggcgcaatggcgtcggaagcgcggttatcaccgcagctaaatcatgggctgttgggataccgttgggacttgctatccgagcagtgacgtctggtcatcttccaccaactccttttatcttggtaaccatgggaagtacaggggtcttgttaactgcatggcgtgctttggtatcacaactgttttccaaccagcaaaagcagcaggatgatgtctaccggcgtggaagtccttttgagctttttgagctactcacatcgctggtgcggaggtggtgacatctgaaggctgaagcctatagaaggtaagaagggcattgttccgctctggtatccgcaatcatcaggttcagccatctgtgtctattgtgtaagtacaattttgaaggtgaagaagagcaggctaaaacctagtttggagcatttgccgaacccaaaaaaaatgtttggcaataacacgcccgcgatgttggtttagtatattatattatattcataagatgtactcatattcctgatcttccacttgtaaaattgtatccagcttaacaaatcctaatcgataagaccgttgcctcttgttcaaaaaaaaaaaaaaaaaaaaaaaaaa

SEQ ID NO: 7700 - DNA, 3977 bp, Zea mays
  misc_feature (2482)..(2482): n is a, c, g, or t
  misc_feature (2516)..(2516): n is a, c, g, or t
  misc_feature (2627)..(2627): n is a, c, g, or t
  misc_feature (2638)..(2638): n is a, c, g, or t
gtttagtttaaaaatgaactagcgagcgacaaatatttaagaacgaagttagtatcatataccttcactgcaactgcaatggattggcattattaacttatgatacacattatttataataacaatactttttactaaggccctgtttggatcacctagtttcttataagctgttttttaaaagttgaaaggtctccaaatagattagttttttattcagtttcttaaaaactaagaagctggtcttcccagctaaaactagctaagaaactaggtggatccaaacatattctcctagttttttctaaaaatcagtttctacaagccagatctagaaactagtttttaaaaaattagagtgatctaaacacagcctaagttatgagacataattcagttacctataactaggaatgttggaaacataactagaatggtgacaacaggcaactagtcttccttaaacaaagaggcatttttgtccacgacgccctgcctcgcggcctgagctggcacatctccactcctcgccctctctactgtcctgtctcctcactccaccggtccaacccaacaaccagccccgccgaattccaaggtctattcttctgcccctcgggcgttcccgagatcgcatttccgagttcctgatcacgggaaacccttctggggacccgggaattcctccctcagatccgcgctttccttggaggcgtcgctgaatagctcggttctttgcgcaggtttcccgcgtgcggcggcgagcggggcgggacgtgccggggacggtggttgggttggattggattggatcggatcggtgccgcccgttgaccagagcgtaaaccagagatgggcaagggcggcggctgcgtccccagcaagaagcgccagccgccggccgccgcgccttcttcgtcgtccgccgcggcggcggtgccgcgcgaggcgcccgaggaggaggcggccgccgcggtcgggcgaaagctgcggctctacatcgtgttctactcgatgtacgggcacgtggagtccctggcacggcgcgcagcggctggcgccggcgcagtggacggcctggaggccgtgctgcggcgggtccccgagacgctcccgccggaggtgctggagaagatgcaggcgccggtcaaggaccccgcggtccccgtgatcgcgtcggccgcgggcctgcaggaggctgacggagtgttgtttggcttcccgacgaggtacggcgccatggctgcgcaaatgaaggccttcttcgactccaccggctcgctctgggaggcgcagaagctcgctgggaagcccgccgggttcttcgtcagcaccggaacgcagggcggggggcaggagaccacggcgtaagaatctctttactattctttcaggtttcttttatttaatacctgttacatgatcttgaaggaagaattgaatttttgcattggaacacttgctattctgttgataggccgttactgaaaacagaccttacttcttgagattaattattatactttgctgctatacaggtgtttaactgaaatacatatctatggcgatactataaccctgatcagttaactggcattaaggatttgtaacgttttcactgcccgttggtttaggcttcatgtgtgagataatgaagtcatggattaccttagcactgcacacatttttctgctttgtttgaagttgtttgtgttccttctccccaattttcagaattacctatttttattgtatgtttgatcattttctcttccatttcatccaccgttttccatggaaagaggaggggtgtccccgtaccaccacgcacgcgtgcgcgtgcacacatataacgaggaaccattactaaaatgagcggcaacacttgtaactgaagctgagatgctattattattttgacaactttccataattcactatcaactgcttctaaaggaagttgaaatgcatgtgtcatggtaatgctgataacaatttggttgtttggaaataagaaattgaagtaccatattcgtagcaatttatatttcgtcgcactattttcttcattattgatgatgatggtgctgtacagttactatgaacaactacacagggtggtcacagatgaatttaaggacatcggatatgatctgtacaaaaagactcttttgagttaatgccatagcccgtagtgcaattaggtgtacctgatcgatatctgctgcaatgcacatcaaactgcagtgtgtggtacaggcctaagcatgggcagttaattcaagatctttaagatcaggacgaactaatacagatgcatgggtgagaagttcctgggagaaattaaaattgccaatttttaaattcttgcatccaaaccaagcctaactaaaactactacttgctgaaaacattatcccttgttctctcaagggattttggatgtttttgcttgtaggtaaatgctcattgttccagtttntatgcttttaagtttcttcacttgaatgagctanagtataccttgttaattgcttttatagcctgcttaaggaaaaactatgcaaagaaaatgcacaaatcttaaagcataaataataaccatcacttacttttagtacgaagtngttacataatncctatagaatcataattctctagtacaaggctgagaatagtgatcatgtaagaatctaaattctaaaagcattggaatccttatgccttggttttattctccctacttgtttgcaacttgtaatttttctcgatataatctctgtagctgaattgaagtatctgttttcaccatgcctaagctattcctgatcagtgaccatgctttatttattgtagttggacgaccatcacccagctagctcaccatggaatgcttttcgtcccaattggctacacctttggttcaggcatgttcgacatggatggtatcagaggaggcagcccctatggcgcgggggtatttgctggcgatggcagcagacaacccagtgagactgaactcgcccttgcagagcaccagggcaagtacatggcctccatagtgaaaaagctagctctccatgcttgagacagccacccctgtgcagtagaagtcacatggtcaccttcctccggtgctcggcttctcctattgtttccggatacatccggcccgtcgtatatgtgcacagcttgccctatcgtttgtgaaagtagccacccctaaattaaggttcatttgtacattgtcggcatattcatattgttgtccatttgaacaataagagtgtcataataaacatcatatcatattggttttggtgtttgttttgttgcacggaactgttcttatactataaaagaagagtaattttgttctgatgtttttcttgtctgcttcaatctacctatgggtgtgtgaagctgctatattagagttactttttgtctaaagtctgaacaatttcaaagaatctgaatatctgaagtttcatgtatagggtagaacattgcttggttatacccgtaattttgatctgatttgttttttttagataaaaaagtgaagcagtctgttgatatttgatactctgctctgccaatcagtcctggttttattgtcaggaacaaagtagtagaattgagtttggcttgtttgctcttgctaggtgaaaaacaagaagatggaaaatacaagcacactgtggatctcctgaaaacaacatttgagctgagagcgaattctgtacagcgggagctagagctccaaaaattatgggatgataatcaggttttgaaaagggtttctaaaaggaacactggggtgagttgatatattcaagtatgtaactttaaattattaaacactaatattttattaaataattcgtatgccgtcgcaacgcgcgggtacgagactttatgcatatgttttttgcattgaaaatatattttcttcaagtttgcgatcatgctac

SEQ ID NO: 7701 - DNA, 1039 bp, Zea mays
  misc_feature (899)..(899): n is a, c, g, or t
gcggtcgggcgaaagctgcgcctccccgccgtgttctactcgttgtacgggcacgtggagtccctggcacggcgcgcagcggctggcgccggcgcggccgacggcctggaggccgtgctgcggcgggtccccgagacgctcccgccggaggtgctggagaagatgcaggcgccggtcaaggaccccgcggtccccgtgatcgcgtcggccgcggagctgcaggaggctgacggagtgttgtttggcttcccgacgaggtacggcgccatggctgcgcaaatgaaggccttcttcgactccaccggctcgctctgggaggcgcagaagctcgctgggaagcccgccgggttcttcgtcagcaccggaacgcagggcggggggcaggagaccacggcttggacggccatcacccagctagctcaccatggaatgcttttcgtcccaattggctacacctttggttcaggcatgttcgacatggatggtatcagaggaggcagcccctatggcgcgggggtatttgctggcgatggcagcagacaacccagtgagactgaactcgcccttgcagagcaccagggcaagtacatggcctccatagtgaaaaagctagctctccatgcttgagacagccacccctgtgcagtggaagtcacatggtcaccttcctccggtgctcggcttctcctattgtttccggatacatccggcccgtcgtatatgtgcacagcttgccctatcgtttgtgaaagtagccacccctaaattaaggttcatttgtacattgtcggcatattcatattgttgtccatttgaacaataagagtgtcataataaacatcatatgtcatattggattttggtgtttgttttgttgcaatataataaaaaaaataatnattattataaaaaaaaaaaaaggaaaaaaaaaaaaaaaaacactcgaggggggggcccgggtacccaatccgcccaatagggaggcgaattacaattcactgggccgccgtttttaaaagcggcgtgacggggaaaaccc

SEQ ID NO: 7702 - DNA, 2003 bp, Zea mays
ggccgcttttttttttttttttttgtcatgtctaaagagttgcgtttcttattgagagagaaattagtttatttttctctgaacatccttcaattccgaagggggattgagtttccaaagtaggcctaagagtttagatgcaaatatggtctgtagatttcgcatttccatgcgtggtaaccggtaatgacggtttcggcgaatctgaaaccgtggagccacacatgaatgagagggacagagtccaggaaacgatggtggacttccccatctccacctgcagctagcctcctcaagatattagcctctgatttaaggagctgacagaagattcttcgtctaccagtgtatgaaccgcacttgactcattgtcattggcttctccaccgaggtggtcatccgatgccatcagaaggtcctttcgagcacgctccctgtctcgggggtacgtgtagtacaggaaggtgtaggtcaggcaacagatggccatgggcacggcgatctccgtgtagacagcctttgccaatgcggcagcattctccctgtccgtgtccacgctcgtgtcggacgagaccggcttatagccgaacacgcgctctgcaagaacaccgacgatgggagacgcaaacgacgcgaacactgcttcgaaacacttgtccagtgcgtagaccgtcgtcctcgccttctccggcacaatctccgcgaagatgggattgttggtcgacgatgcgttccaggagatggcgaaccccatgacgaagaatgtaacggcgtgcgccacaccggtggacgggtcattgggcaacgccagcagcaggatggcgccgagtgggagcgcggacgctgagcttatctgcgtcagggcgatcctaccagtgttggggaaccgtctggcgacagggtctccgacgaggcccccaaagagcgcgccgagagcggtggcgaacaggtacagccccgtgatgacgctggtctgccaattcgtgaacccgacgagctccagccacatggcggagaagttgagcgcggaccacgggatggagccggcgatcccctgcgccacgatgatctggaacgtggtcaccccgaggacgcgcctggcgtgctggagcagctctttggcctcctcccccgcggaggccgcggtcttgcacttggcggccgggctcgggtccgcggcgaagagccacatgagcacgcccagcgcgacgctgatcacggccacggagtggaaggcgagccgccaccctgcgacgccgaggaaggtgactggcgcgagcagcacgccgaaagagccccccaggatggagccgaggttgcaggtcatctgcagccacccgaaggccgcgccacgggtgtggtcatcggtgtagtcggcgacgagcgagctgatcgccgggaggaccagcgcgagaccgatgccgttgaggccccgcgagatcgccatctggaggaagctgccggagacggcgacgaggaaggtggcggcggcccagaggaaggctcccacggcgacgacacgggcccgatcgtggcgcgcggaggcgtaggcggcgagcgggtagcaggcggcctggacgagcgcgcggcagagggtgagggagcccagcgcggtcggagaagcgcccagcgccgtgcccacctccttgtacacggcgggcagcaacacctcgtctgccttctccagcaccgacgccatgttcaccagcaccagcgtccaccgccggcgcgacgccgcctccgcatccctcatttcccgccgcggctcctagttagtagtagcaggctcagcgcctcacctgtctgccagattgccaaggattgcgcgtcgactagcaggaggcaggagcgtccagggcgaatcgaagtggatttctagagatgggagcccggccgggcctccaggtacccaagcgggcggttttatcaagctcgagcggggatttgaccaattgacctaggactcaggatgtgtccacctcacggcatgtacacccggccgg

SEQ ID NO: 7703 - DNA, 1154 bp, Zea mays
  misc_feature (79)..(79): n is a, c, g, or t
  misc_feature (125)..(125): n is a, c, g, or t
  misc_feature (176)..(177): n is a, c, g, or t
  misc_feature (200)..(200): n is a, c, g, or t
agcacggaggaagggcgcagagggggaacggcccgcggaaaggagccccaccaggagggagcgggggggcaaggacacngacagccacccgaaggccgccccacggggggggccaaggggtaggnggagacggagcgagcagaccgacgggaggaccagcgcgaggccgaagccgnngagcccccgcgagatcgccatcnggaggaagctgccggagacggcgacgaggaaggtggcggcggcccagaggaaggctcccccgccgacgacacgggcccgatcgtggcgcgcggaggcgtaggcggcgagcgggtagcaggcggcctggacgagcgcgcggcagagggtgagggagcccagcgcggtcggagaagcgcccagcgccgtgcccacctccttgtacacggcgggcagcaacacctcgtctgccttctccagcaccgacgccatgttcaccagcaccagcgtccaccgccggcgcgacgccgcctccgcatccctcatttcccgccgcggctcctagttagtagtagcaggctcagcgcctcacctgtctgccagattgccaaggattgcgcgtcgactagcaggaggcaggagcgtccagggcgaatcgaagtggatttctagatgggagcagagacaggcagacagccttgcgtgttttatcaagctcgagcggggatttgaccaattgacctaggactcaggattgtaccacctcacggcatgtacagtgatgtcttgggatgtttaagggtgtgtttataaaaaaaattcccggccgcgtctatccgttatcggtggataacccatctgcctagtaatccaaggacgaattcgtcgtttgttctatcgatacaatactggacaaacacatttacctctatatttattaactaggtgagtgcccgtgcgttgcaacgacggcaacatataatatcgtaatgaattatgtacaaatgtgtgtttcattgttatagtactatgttcgtgctttgcacataatcatacttgatatccataaaaatatatgttctatacacatttaaatctcgagatgtcccattccctccaacgaaataagtccacccttattggagctcacaattcatgcacctaaaaaataacagggtacaaaaatgattttgcag

SEQ ID NO: 7704 - DNA, 6697 bp, Zea mays
  misc_feature (2227)..(2227): n is a, c, g, or t
  misc_feature (3292)..(3292): n is a, c, g, or t
tgtgtttgagtcgaaaaaccgactcataacctaatttttgccttctacaaacttaacccggcgtttaaacaggaatagactgattagaccatgttaaacgactcatatcctaactttgatctaatccgaacttgacccattgtttgaacaactatagatcgatccgcacctctgcgtcgcagatggaggtggtagctaggacaacaactaatatgcaatcagaccttatatgcaagtgtgcaagtgaacatgttggtttgttagatcatgattcaaaatttcaaccgtagatataatcatggtttgttaggggattttttataaatctacataaatcggtggtggaaaggtttaaatgttaaatatgatatatggttggatcatgaactaaggtagtgtttggttgaggagccaaatagaacggagccgttctatccctgattctaggaacggagccgctctgttctgtgtttggtaatctggaacggagcggttctgttttttgtctcgcttgcatgacttatataagatctgattgtataagaaccgaagaacccagtgcaacgcgtaaacccgcaaagtgtataaaagccatataatcacactgtcaagtcggcccgaacccagttgtccccactgaacagttacagaagttccacacgagcgtcgaacctcgatacgggaccgggcctaaaacaaaacccaggcgcccgagcgaccgggcccaatccccaggcgaaaaagaacgtccgagaaaaacagaagggataaaaaaaaggcccggaaggcggaggaggcttgctgccttcctctgctcgtccctcgtcgtgatcgtggtcgtggagcaaagcaaccctgggagccgagccgtgccgaggtggtcccgcgaggcaacgaatcccactaaccaacactgccaggtgggccacgcactggggccgcctggacccaccacccaccccctctcgacgctcacttcataaaaccactccacctcctgtctcccctttaaacacaccgatacagcacaccgtccatctctcccctccccctcgcaccgccgcgcggacacgaacacgcgagccaccgaacgggtccgggcccgatcgcaccgaccagccgcgcccgcggggcggggaggtggatccagtccaggggtgggctcctcttcaccgccgccgatggacttgggcctcagcgtcgcgggtaggaccggcagcggaggaggaagagggggctggagagggagcgggggcggcgcgtccgcggcggcgtggacccggctcgtcagctctggcgtggaggacgagctggtggccgcgtcgggaggaggaggaggaggaggtggtggacgcgctggggcgagagccggaggcctgccgctgggccactttttggaggcctgcttcctctgccggaagcccctccccagcaaccgcgacatatttatgtacaggttcgccactctgccgccgccatggctacggctaccgctagcgctagcgctaccgctacctggccctgtgccgctcgtcttgctttacgctctctgttgggagggatggttttgggaatttctgcggcgggtcccgtggtatggacgtttccgacgtctttggaaggtgtattttcccttggaagagcagggaatttgactgccgaatcgtctgccggaaaaagtgggaggcggacgtattatttctcataactttccttttcttccgcggtttagttcgaacgtccaggccagattaaaaagaaaagtatactagtggcacgaaaaaattggtgagagctgagagctccttttcctctttccgatgtggtgttggtgggatggttttgtcgcccttgatgtgtttgttcaggttgcttttgcgcgtgaatcaattaaattcctgggaccctaaattggtgcgcttatttatggccatgccgtgagctcctgccaatttaccacggaataccctctctcgtttgttcttttatatatggaagttggtaatcggaaaaaagcttcgctgctaagcacgggagctttattggtttggtacctgtgaggcggtaaggcagtagtatagtattcctgaatgacgcgttgtggctatcgccagttccatgaatatgtgggcatgttgaagctactctgccatgggtctcgtatacccctttttaatttcatctataacactgattcaatggttttgttgcacgagtacaagtggtncacatttttctcttttcaaaaaaaggtggtgcaggcatccaaagatatctattcatgacatcccaattcccaagcctgttaatctggattaatcttatatgggtgcccctgtgtctcttgtgcagaggtgacatcccgttctgcaccgaggattgcaggagggagcagatcgaaatggacgaggagatggagcggaaggagagcaaacccaagaacgtggcgccgagaggagctccatcccccaaggacgtggactccccgccgaggcctcccaaggcccgggccgggtcaatccttgccggctaacaccgtgaagaagaaaaaaaaaagctcacaaacgagctctcacgtatgcgcgctccccctccccaaaaccaagagatcagaccccctcttaccaccacgaactaccaccgctacagttacgtatatgggtttgtgctttttgtttaaaccccttgcgccattggtggcgccgtgacctgctcagtgtcagtgcctgcctacctgtatggctgtgatgatgtatagagatgggggaggggaggggaggggaggagagcgcgctggtgtttaggaccgcatgcagctcttattgcgctgctgtgtcgttcgttgtatcatgtgtgggtgtttctgcctccgtttacaggggatttttgtgaaatttctgtgtgctacgtagtagtagtagtagtcggtaatgatggttttaggcttatggtttcccgtaatgatgacgacggaaaatggaaaacatatgtctacagaaagaaatagacatcaagtacatgactagctcctgtgccatcgtggatgatcctgatttccttttttttaaagtaccttctgattggcaacaagtgtgtactgttcttggtcgatacatccaatgttttgttttttattagtggcgctgtgcaagtgctaagcgtgcgtggcatgtaccatctattgttgttttgtttgttcaatacgacgagagaccacttagcttaacacttcgcacttgttcttcgtttggctgctgcttcaccccaagaacgccagccccgaaaattgctntcaaagctggtcgagatgtaataagcgagcaaaaacacatcaagaacgcttaacagcgatgtacagtgacggtgctcgggtcttctactactagtagtgcgtaggaattgactaggaacatggaggcttttgctttctttttttttaaaccctttggcacaccgtacacagaggcgtcagcgagaaacggcgcgggaagcaaaagctagaggaggaaagtcgattcgtacagacgggtacagtcctcgccgaatccacagcagatgtactcgcgccgcaggctaaacgacaggaacttgcaacttcgccgagccatggcggccctatagcggtatatataaaaccccacgcaggggcagggacgcaggcttccctccggccacgacgcgagtcaggcaggctagagcattgtagaagaacagcagtacagtgtacaacgctgcaattgaatgccaatttgacgccagagtggaggagcaggtgaggagccagtactgttgaacactgacgggagcttccaggagcggttattgccccacgaagcacgccggttatatgcaaaaaaaagggcccgcccgtcagcctccgccgacgtctccgcagtccgcaccgcatcgcgggcccagctgccagtccctcgagtcactgcgcggtgccgcagagaagactcgcgcgcgctgcaacctgcacggacctgtctcctcttgtcttcgtcaaggaccgcaccggcagcgcttggaaggaaagtttgcggtgcgagaaaagaaaaggcgcgggcgcacgccgacgggcgacggccatgtgctccttccctcttcgtcctcgtcggtcgtcacggctctttcgcgccgttggtttgacgtgagtgagctcgatcgggcgcccgggagaggcaagtcggaggaaaggcgcacggcgcgtgcccagctggtgggaggagttcgcagggaagggaagggaaggactgtggtcgtgctgactgcctgccagcccactactcggcgtccgctgccaaaagcgaccaacgaaccaacccccaaaaggctgccctcgccttgcgtcatctgcccggctttctctgtttggggtggttgggcaaatgggcaggcaggcaggggcacgcggcacgcaggggggagttgctttcacagtagcgcgcagccttcgcagggtgcctgaacacagtgtcacctcagacctcacctcacctcacccacgggctacagaaaactagtcaaaattttggaaaaaaagaaaagtcatatacgccgcccaagtcctttgggctgcagcctgatgctcggtcagcccagcgttgatggaccaggtccaatgtaatactgtaggaacaaagttccttcatatgggctcaacaaagcgatgccgcctagcccgagtctactctcgccgatggtttgggctgtccgatccgcttcttccgtcaaggaacaatccacatacgtgccccttcactgctgagggggaaggatggctaccatggaaacaagaggagctcgacgggaatggtacagtgcaagaaactgtacatagcctcatgaaattcctggtcatacatgcgtgacagacacaatagggagaggcttcgcaattcaagtatcttcaagaggaagcttgatgactccgaccttgtttgtttggctttaatctctaccgacttctactagtatttttgtttctacagattacagctgcagcagtctaaacaacagcctttaatctgaagcgaactagaagcaaaagaagtcagattggagctgaggctcaaaaggttccttttctcctgcactttcctggatatatggggatgcattggtgacactgaaaatggagttgtagcagtctgcggtagtgcggtttcaaatggttctgagtcgtcaattttcttttctactagatctttaggtatagccagctcgttacattctactaggtcttcaggcttgtgaggctcggttgtgtactcgtatagtcgtatgaatgaaatcatttttttttttgcctactagtatcgtatgaatgaaaacatgttctagtgcctccgtttcaatgctcatgtaatcccaggctgcagttggagcttgggaggagagtccgtcgtctcccgtcccaccggcatgttgcggtcccggcgtgtcacatgtggggctctgatcacgcgaggaaattcatcgctgattctcggcggttccgacatttgaacgacgtcgacgggccatcacacgtgcccgttctgacgaggggaccgggaggtccgctccgcaaaccgcaaccgccccgcgctagagccgctgaaactgaactcctgacatggccaggccagcacgcaaagccctgataggcgcgccctccgccgcgcgctcgcgcggcctacggaggcacgcgtttccaagatctgctgtcgctctcttcctcgccctcctcgtcgcgctgtccttggcggtgctataccgtgccgccgtctcgcgctcgctggggacgtcctggtcctgggggtgggactcgctggcgctgccctcgttcgccacatcccaggaggaggagggcgcggaaggcgacgatctggtgagcctgcttgcttccaccttcgattaatgctttcggtttagccatttcgctacgtgttcctaaattttcactgtggcgttggtacgggactggactgtgctgatgattttgcggttcactgttccgtatgtttgagagttctatagcattatactagcattctgagttattgggcaatcgaagttcattgttgagcggtcgcgtcatatgtttgttcacttgatgtctgggaaccggaaggcttaccttgggatggagcaactgaaagaaacctgtacgtggtggttttagatcagccagtacaatagaagtaacatctctccatctaaagtaacaccttctgatacaacactcgtctagtcgtctcattctactgtattttcggtctcagtttcagtgtatatccatctggaacaaaattaccgtctcttctaggaatactgttgaattagatactttagttgaatcttgataaataagtttaagtctattaatgtttgctgctggccatttttgtcattcgctcttttttcaagtatggattgataatatttttgcatcctcgataagccaaacaatttagcaacgcatgctgcgaaccttatatatgtaatagttatgctcgtcttccaggtaatcacaaactgatggtggttgttcacatggaaaatgctgattgtgatggcaaatgaaattgtgaactaggcttacgagaacttactaagtagcgatcatgctgaagtcttgctacttgtatcagtattcattgtaatatcttgtttgatttttgctgcctgtactatgcatttcctcgtcctg

SEQ ID NO: 7705 - DNA, 2803 bp, Zea mays
tacccctggaaagcccgtcatcttgtcaggttacaagtcctttaaaaaatatattcgttggctgttgcttacagttttcgagcttaattaggattacagtcaatcttacggaaacctgacatgtgagcagccaaatttatgcccagaactccgttgagttatgtgtgcttggattgctctttcatggttgggatcaagagaaactgaattgtttttctattacagttactttttgtatgcaaacatatgaaaaaaaaactcgaccaaatttattcctacctagttttgtgaaatcaaatttaataagggttaggttgaaaactcaaacgctcttttttatcatgtctaaagagttgcgtttcttattgagagagaaattagtttatttttctctgaacatccttcaattccgaagggggttgagtttccaaagtaggcctaagagtttagatgcaaatatggtctgtagatttcgcatttccatgcgtggtaaccggtaatgacggtttcggcgaatctgaaaccgtggagccacacatgaatgagagggacagagtccaggaaacgatggtggacttccccatctccacctgcagctagcctcctcaagatattagcctctgatttaaggagctgacagaagattcttcgtctaccagtgtatgaaccgcacttgactcattgtcattggcttctccaccgaggtggtcatccgatgccatcagaaggtcctttcgagcacgctccctgtctcgggggtacgtgcagtacaggaaggtgtaggtcaggcaacatatggccatgggcacggcgatctccgtgtagacagcctttgccaatgcggcagcattctccctgtccgtgtccacgctcgtgtcggacgagaccggcttatagccgaacacgcgctctgcaagaacaccgacgatgggagacgcaaacgacgcgaacactgcttcgaaacacttgtccagtgcgtagaccgtcgtcctcgccttctccggcacaatctccgcgaagatgggactgcattgcggcaggtagaaaaggcaatggacaatgagaaaggcagtgcaacacaagcaggctacaaaatgcctaagacaagcatcgatcatatacttgttggtcgacgatgcgttccaggagatggcgaaccccatgacgaagaatgtaacggcgtgcgccaccccggtggacgggtcattgggcaacgccagcagcaggatggcgccgagtgggagcgcggacgctgagcttatctgcgccagggcgatcctaccagtgttggggaaccgtctggcgacagggtctccgacgaggcccccaaagagcgcgccgagagcggtggcgaacaggtacagccccgtgatgacgctggtctgccaattcgtgaacccgacgagctccagccacatggcggagaagttgagcgcggaccacgggatggagccggcgatcccctgcgccacgatgatctggaacgtggtcaccccgaggacgcgcctggcgtgctggagcagctctttggcctcctcccccgcggaggccgcggtcttgcacttggcggccgggctcgggtccgcggcgaagagccacatgagcacgcccagcgcgacgctgatcacggccacggagtggaaggcgagccgccaccctgcgacgccgaggaaggtgactggcgcgagcagcacgccgaaagagccccccaggatggagccgaggttgcaggtcatctgcagccacccgaaggccgcgccacgggtgtggtcatcggtgtagtcggcgacgagcgagctgatcgccgggaggaccagcgcgagaccgatgccgttgaggccccgcgagatcgccatctgcgcagtgcgtatgcgtatgcgtatgcgagcgcgcgagccacaggttgctagtcagtggatgggcccacgtgtcagagatgcaccaaaatatcaccgaccatcttttattttgtgttgcgaaattgaaatagaatattcggataaccgctacgtttggtggtaggtaggtgccagtgcaatgccaaccacgtgctgcgggagaaacgtggagcagtgggtccgccacgtcagcgacaggaggaagagggaaagagttgggaggaaatcggggagacggacggacctggaggaagctgccggagacggcgacgaggaaggtggcggcggcccagaggaaggctcccacggcgacgacacgggcccgatcgtggcgcgcggaggcgtaggcggcgagcgggtagcaggcggcctggacgagcgcgcggcagagggtgagggagcccagcgcggtcggagaagcgcccagcgccgtgcccacctccttgtacacggcgggcagcaacacctcgtctgccttctccagcaccgacgccatgttcaccagcaccagcgtccaccgccggcgcgacgccgcctccgcatccctcatttcccgccgcggctcctagttagtagtagcaggctcagcgcctcacctgtctgccagattgccaaggattgcgcgtcgactagcaggaggcaggagcgtccagggcgaatcgaagtggatttctagatcagcaacgtgtctggcccgcccccccccgcgtgttatcaagctcgagcggggatttgaccaattgacctaggactcaggattgtaccacctcacggcatgtacagtgatgtcttgggatgtttaagggtgtgtttataaaaaaaattggtgaagtcgtctatccgttatcggtggataacccatctgcctagtaatccaaggacgaattcgtcgtttgttctatcga

SEQ ID NO: 7706 - DNA, 3964 bp, Zea mays
  misc_feature (2196)..(2196): n is a, c, g, or t
  misc_feature (2639)..(2639): n is a, c, g, or t
tgtggaggttacaggcataaagagcatcatctgtgccctaaaatttttactgaggtagatagagggcagtcagtagtaaatgctcaatcagtgaaaggatcgatgcagtgcgcaacagccacaagtaatacaggtgcaatcaagtatacagaagatgagagcactagccatacaagaagtgcaattttcaagtttcaaaacgacagaagatgttgctcaggatatgataaacctgttattcggtcacctattgagtaaacctgttgccaacacagagaagtctgatcctgtagaatcaacgactagaactgtaaatcaggtgccagaggggagaggctggcacagcgaagtaccaaggcaggaggaacctgtgaagaaaccagagcctgtagtagaatcaatgcctacgactataaatcatgtgccagagaagaaagactggcgtagcgagttaacaaagctgggtgaacctgtggcaaagaagaagagcagcctcagggacaaggtggccttgtttctttgactgcatcagatgagatttgggcagtagattgtgattcgtatgggaccgtgtctgctggttctgagcgtgtcccagtcccacggcattgtttttgcatgtagttatacctttggttaataagctgtcctctttaaatctagcaagccagccctcactgttgctagatggtattcctgtgtataaaggatgcatggtgcattttctgttggttgaagtacgactgtatgaagtatcggtgttcctcaacgcgacaactacactagagggaagcggtttaaacatcgtagagttattaggcatggaggagcccagctatctccttactcgccatggagcctttgcagaagttgctggagactgacacagctgagagtggcctgttcccaatcatttacagtgctgcaaaactatggatcagtatgggcgctgatgatgcagccatcttcgtaaaagtggtaatggatcgttgtctatctttgggaggtttggttgctaataaacaagcagaagtccaatctaatgtgatgaccttaacacgattgatattatgaagtggttaatgtccaattaagtggtaatgtgaagcttctcaacgaagctggccgagtgaaactgctaaactaagtgtataggatcagaagaggtttcctttggacaagctctggcgatcggcagatgcaaaaatttgggggggcattgagtgtcagacctggatgtgcacaaattgccactcccagtaatgctgttgacaggcagttagttcatcaaggccaacaccatcctcactcttggggatgaggaataccaatggacatgggtgtcgaacttctacgccgcatgcaacaagaacagaacggtcagggacgttttgcacggagtatgtttcttgaatacgaaaacagtgacagggatggcagaattgttatgctatgggactttctcagtaacagaaagacctgacgagaatgaaaccggttagctctggcaccacaaccggaagagccgcgacaaaagccgtgggcggggcttgtgccttgtggggaggagtcctgtcaaacgagtttggctccggagcggggctcctgtctttatgtactcccctgttccaaaatagttgttttagccttttaacaaattcattcaataattaatatatttgttttgtatatgtgtctagatttattatcatattttaaatatagacataaaaatgaagctaaaacgatactaggggagtacacaatctagttatgacactcagggtagtgtttggttgaggagccaagtagaacggagccgttccatccctgattctaggaacggagccgctctgttctgtgtttggtaatctggaacggagcggttctgttttttgtttggttgcagagtgaacggaacggagcgtgactgtgagagcgggattggaacggagcggctccgtcccattgattttttggagcggaatggttccggatctgaggagaatattccctaattggagtcattccgttctagttactttgtaaccaaacaacaacataactgggacagaacggttccgttctacttagctcttcaaccaaacactaccttagagctagtataataacatactgtgtaagtaggctaaatcctgacatggaggggagagagaagtacattgtgtaaagtgnaaacttacatccggtttaaacacagagagcaaaaaaactcagactatgatgctgttgatggaactttttttcatacaatacatttttacgggaacgtattgcatggaccctttacgagaacgtattctatgcacatgcacaggaccctttttcatatacatacataaatttaatctctttgttcaacagccagctgttggacaaacaagacattttttgtaaaaaaaattgcagttaaacacaggacagaagagcgcggaaggtgttttttataaaacatgttagccgttagttgaacgaatgatccacattaaatttgtacatatatacatgaatgaggtcttgtgtataggatacgtttcccatttttacaactacctaaaatcatgtttgcgaaaattgttgtcataggatctgagtcatgactgcttgtaaaaggtacnggtacttgtgcatcgaagtatgatattttaaaaatctttggtcggacgcgaatatatcaaagtgaatggcgatatggttgtgcaagaaattaaaaataaacaatatatacataatacatctatcaccgtgtagcaccagagcgtggagtaacagatagagggagagagagttagaagcaaacacgcgcagatagatgatcgtgttaaacctaggcacaagtagaagccaacatgtgtcttagattaagacagtagctatatctcaaacactagtgaacatcgaggccttctagctatgcatcatctattcatagtgatggaagccctaacctaaaagttataatatgtatctatgtactactataaagcatcagtttcaatggtcgtcctgcattacgggcatagatccatttctctcgtctactagtgggtcgttgccttatagacaagccgtgaaaaccatcaaaacctctattagtggaccgttacctcacagatgggccatgagaaatcagttaagcccaacacgataggaagtcacacctagcacaatgctcctgcatagtatcaccatgctaactaaaggatgacgagcgaccgaacgagatataaaaaagtcagactccttttcaacccatacattttctaggccttttggctaagataaagtaaatatgtgctcttgtgtgtcgtcacaacgtatgaacattgtactcgtttatgtatatgtgtcatgtgcatagtaaacattcacttgtataataatgataatcctaaatctataccactatataattcatcaactttaactttgtaaaacccacccaaccaaattacctcatacttataacatccactaaatccatcaaacaaattacacccagacttaacaaaccatcaaaaccaacagctcagattaccgaataacccactctctcttactcactcaaatccaatgaacaatattatttggatcatccctcgttcctctccttcatctgcccccgccgccccttttcccctccccatcactcacgccaccgctgtcgatcccccctcctctcctcgagatggtaacgttagcacgggctatatgctagtttacctttacgtttgtcctttatgtagggtgaattctaccaatctaaaacatatcccctaaatgttactatgtccctctcttttataatacaagagaggaaacatgaacctcatattcctgtggttaagacatatttaccctattattatcatgttatttgagttgtaccagggccacaccctcgatcgtggcaaagtgtaagagatattcttttcctagagat

SEQ ID NO: 7707 - DNA, 1603 bp, Zea mays
  misc_feature (20)..(20): n is a, c, g, or t
  misc_feature (127)..(127): n is a, c, g, or t
  misc_feature (137)..(138): n is a, c, g, or t
  misc_feature (166)..(166): n is a, c, g, or t
  misc_feature (238)..(239): n is a, c, g, or t
  misc_feature (248)..(249): n is a, c, g, or t
gcgttcggccatatccaggnactttcagcattgggtgttggtgcaatgctctaaatctaagccgtttcattcggttaaaggcttatgggtgaaccttgagaaggaccagctattttgtcttcttggntcccaatggnnagctggaaaaacaactacaatcagttgntctgacttggaatcacaccaattacaggaggtgatgcattcatttatggtcactctgttcgaagcactgtgnnggaatgtcnnaaacatccgtaggatgatcggagtctgcccacagtttgatatcctgtgggctccactaacagctaaagagcacatggaattgtttgccagcatcaagggattgcatccagcagcaatcacattagtagcagaagagtcattagccaaagtaaagctcagccaagtaactaatgctcgagcaggcagctacagcggaggaatgaagcgccggctaagtgttgcgatcgcactgattggtgacccaaaattggtttttctcgatgaacctactactggcatggatccaataacaaggaggcatgtctgggacatcatagaggaggccaagaaaggaagagctattgtcttgaccacccattccatggaggaggctgatattcttggtgaccggatagctataatggcaaaggggaaactgcggtgcatcgggacatcaataaggctgaagtcgaaatttggaacaggatacattgctaatgttaatttctctggaaatggccacatgcagagccccaacatcaacagcaacactgaggctccggttaatccgaacatagaagctgtcaaatggttcttcaaggaacggcttgatgttaatccaaaagaggagagcaggacattcttgacatttgtcatccctcatcacaaagaaccacttctgacgagattctttggagagttgcaagacagggaaggggagtttggaatatcagacattcaactcggtctgacaacacttgaagaggtgttcctgaacattgcaaagcaggcagagctggagacctctactgctgaaggtaccctggtgactctcaacctgtcatcaggaacaacaattcagattcccaagggggctcgtttcgttggtattcctggaactgagacagaggagcatccaagaggcatcatggttgaggtgtactgggatcaggatgaaaatggatcgctctgcatttctgggcactctgacgagatgcccgtgccagttcatgctgagctgaggaggcctccgtcactttctcgtagggcctcaatggaccgtggacgtccagttgggtatatgattgacctgaaccaggtcccatgaaaaaaaagatgagtccaggtgcaacgtttagattggttttgatgcagattatctggtacatatagtatataggaatcttgtattcgtgtctttgtattagaagtcgtaaccttgtattgcagtagtaattggtaaagacatgctttgtaaaatatcctatagtgtaacacagtattttctgttgtgtggcaaacaaaggctcgaaaaatgacgcaatagaattacatggtaactaaaaaaaagaaaaaaaaaaaaaaaaaagcggcc

SEQ ID NO: 7708 - DNA, 1290 bp, Zea mays
ccgggacttcgtctatttgcggttctcggcgcaatacatttcccaacacagcgccgtacgcacagcacagtcacggtactccaccgctaaaaccttcggaaagaatccccaaatctcgcacacctcgaagccttcgaggcccgaaaccctagctcctcggcctccccgccgcttccacccatggctccaggactgcagcgcttcactgacattgccgacgacggcacgccccagctcgacgccgcgtccggcgaggagctggtccgtgtggaccgcaccgtggctgtcgcccttggcccccgctcgccggagtccccggggactctgttcgtcaccaccaggagggtgatttggctcagcgaagcggagaagggcaagggctacgcggtggacttcctcgccatctcgcttcacgctgtgtcgcgcgacctcgaggcgtacccctcgccctgtatctacactcagattgaggcagcagttggtacagaagaggaggctggggaatcaaatcctgaagcaaatgaactagagctatctagagtatctgaaatgaggctcatactagcggaccccggtcaactggatgcactttttgatgtcctctgtcattgtgctgaactgaatcctgaccctaatgctgagtgcaatggggagaatggctggatccgtggtgaagatatgtctaatggtgactggattcgtgatgatgtggacatggttgatgaaaatgtcccgcagtttttcaatgccaatccgataggtcaaaatggtggatatgaccttagtcgttcagtatttgagcttcaaatcaacgaccaacgttttgaggatgcagaggaggaacaggagagccatgaaaataatggacattagaaacagagacatgttcctcgagagcatcatgtgatttattttgttgtaaatcactaccgatgcagctcggtttgcctactgtttcatctacactttctcttcctttttccttgatgttataggattaacatcactgggtgactttctggaattgcatcgatggttccttttggtgagaaaaggtcttgctgctggtcaagaatgtaacttgtagagcatgatgttgaatcgtgtgaaattagttcagtacttttgatctaacaaatagaaggtcgaattgggaaaggagatatattatcttttcccttgtatatcatggcaccgttatgttacgtctgcttagaattaaattcagtttgggtgttgcagggaccaaaaaaaaaaaaaaaaaaaaaaaaaaaaaaactcgactcgtgc

SEQ ID NO: 7709 - DNA, 834 bp, Zea mays
  misc_feature (731)..(731): n is a, c, g, or t
  misc_feature (801)..(801): n is a, c, g, or t
cattgggtacctcgaggccggccgggatcccatcctctccttctcccgctcggcaaagcacggtctagctatgaagatgagcacgagaggccagccagcagagggtcacctgtggctggtcttcaccatgctgttcgtcacttctgcggtgcgcagcgtgggggcgagcagctttgctcctccaccgtctgtctccgtatcatccccagcgtacgatcctgttatcaaggtggtagggaaggtgtactgctacagatgcttcgatgaggcgcacccagatgaatcgcatgggaagaagcacctgcaaggagccatggtgaaggttacttgccaggcagatgaccaagcgctagtggcattcggctacaccagaagcaacggcaaatacagcgtggtcctcaagggactgccgattagtagcagcagcagcagcaactacggggctgctgactcgtgtaaggtcgagctacacggagcgccaggaggatcggactgcaacgtgccgatcgagctaaacctgtcagggctcagcgtctactcccgatcaagcgaggaggtggtcttcaaagcgaaccagataatggcgttcgcgtccaagaacgcgtttggctgttcatcgaaaccacagacgcagtcgtcatcaccgccggttcatccctactacagctccccgccactcatccctcaccaggacccctcgcctccccggtgccggcgggctacccacaggntctccaccaccaccaccacctgctggctaaccagcttccatccgcagcgtaccagtacatttcgccacgncttaccagcagcagcagtcaatgcttcccatag

SEQ ID NO: 7710 - DNA, 1090 bp, Zea mays
ccacgcgtccgcaaaactgattgtggaagtcagtttaccaacaagctggagggaatgttcaaggacattgaattatccaaagaaataaatgattcattcagacaatcatctcaagctaggacaaagcttccctctggcattgaaatgagtgtccatgtgcttacaacaggctattggcctacatatccgccaatggacgtgaaactcccacacgaactgaatgtgtatcaggatatatttaaagagttctatttaagcaagtacagtggaaggcgtttaatgtggcagaattctttgggacactgtgtcttgaaagcagactttcccaaaggcaaaaaggaacttgcagtatcattgttccagagcgtggttttgatgttgttcaatgacgcacaaaagttaagcttcattgacatcaaagattccactggtatcgaggataaagaattgagacgaacattgcaatctcttgcatgtggtaaagttcgggttctccaaaagataccaaaagggagagatgtagaagataaggatgaatttgtattcaatgaagattttagtgctcccctctaccgcataaaggtaaatgcaattcaaatgaaagagacggtagaagaaaacacgagcaccactgagagagtgttccaggatcggcagtatcaggttgacgcggccatagttcgaataatgaagacgcggaaggtcctcagccacacccttctaataaccgagctttaccagcagctcaagttccctgttaagccagctgatatcaagaaaagaatagagagcttgatcgaccgggagtacctggagcgcgacaggagtaacccccagatctacaactatctggcttgacaacgttttggcggaccgtgaaagagatcgttcccatttcattactatcagaaaaaggcactgtaaattaatttattttccggtttcttgttctttcctgcttttcttctctgggaggaagttgtagttgtagctgctgcaacgtgtttatatagaacgattttttcggcatcagtataaaatcaggttccttaaagctcaaaaaaaaaaaaaactcgagagtactctaaac

SEQ ID NO: 7711 - DNA, 2778 bp, Zea mays
ccggccgggaggcgaaacccttctctcccccgccccaacccgatctctcgctgcctgcctccctccggtcccccgtggccccgtcccctcttcgccaccgcaccgactcgctcacaaaatcctcacgccggactcctccgccgcctccgccgcgccatgcccgtcggcgcctgattcatgtctcagccccacgccgccgccacgggcgggggccgaacgaacggcgaggaggatgcggaaatggtgctcgtggaccaagatgagctccccgcgcccagcgcgcccgcctccgcgggcgttgccgccaacctcttccgaaagaaggccacgcttccgcagccgtcgacctccgcccgcaagcccctccgcatcagaataggtcaaccaaaactgccaaaaaacttcgaagaggatacatggacgattttgaaggatgctatcacagctatttttctcaagcagaaactttcttgtgatgttgagaaactctatcaggctgctggtgatctttgtctacacaagctaggggcaaacctatacgaacgaatcaagaaagaatgtgaaatacacatagctgaaaagatatcagcattagtgggccaaagcccagatttggttgtatttttgtctctggtccaaagaacatggcaagatttttgtgatcagatgttgattattcgcggtattgctttacttcttgatgtaaaatatgtcaagaatgtagcaaatatttgttcagtatgggatatggggctgcagctgtttcgcaagcatctatcactatccccagagattgaacacaaaactgtaactggccttctcagattgattgagagtgagaggcttggtgaagcaatagataggacattacttagtcatcttttgaagatgcttaccgctcttggaatgtattctgagagttttgaaaagccctttcttgagtgcacttctgaattttatgctacggaaggtgttaaatatatgcaacaatctgatattccagactacctgaagcatgtagagtcgaggttgcaagaagaacatgaaaggtgcattctgtatttggaagctaacacgaggaagccactgatcgcaactactgaaacgcaattgctagaacgtcatacatctgcaattattgagaaggggttcgctatgctcatggatgcaaatcgtataaatgacctcttgaggatgtacaaccttttccagagggttaatgctgttgagctgctaaaacaagcacttagttcatatatccgggctacaggccagggcattattatggatgaagaaaaggacagagagttagttccatttcttcttgattttaaggcatccctcgacaaaatattggaagaaagttttgctaagaatgaggctttctccaataccatgaaagattcgtttgagcaccttatcaatctaagacagaaccgtcctgcggaattgattgcaaagtttcttgatgagaaacttcgagctggcaataaagggacatcagaagaagagctggagggcatacttgataaagttttggtcatgtttcggtttatacaaggtaaagatgtatttgaggcattctacaagaaagatctagctaagaggttgctgcttgggaagagcgcatcaatagatgctgaaaaatcgatgatcacaaaactcaaaactgagtgtggaagtcagtttaccaataagctggagggaatgttcaaggacattgaattatccaaagaaataaacgattcattcaggcaatcatctcaagctaggacaaagcttccctcaggcattgaaatgagtgttcatgtgcttacaacaggctattggcctacatatccaccaatggacgtgaaactcccacacgaactgaatgtgtatcaggatatatttaaagagttctatttgagcaagtacagtggaaggcgtttaatgtggcagaattctttgggacactgtgtcttgaaagcagactttcccaaaggcaaaaaggaactcgcggtgtcattgtttcagagtgtggttttgatgttgttcaatgacgcacaaaaattaagcttccttgacatcaaagattccactggtatcgaggataaagaattgagacggacactgcaatctcttgcatgtggtaaagttcgggttctccaaaagataccaaaagggagagatgtagaagataaggatgactttgtattcaatgaagattttagtgctcccctctatcgcataaaggtaaatgcaattcaaatgaaggagacggtagaagaaaacacgagcaccactgagagagtgttccaggatcggcagtatcaggttgatgcggccatagttcgaataatgaagacgcggaaggtcctgagccacacccttctaataaccgagctttaccagcagcttaagttccctgttaagccagctgatatcaagaaaagaatagagagcttaatagaccgggagtacctggagcgggacaggagtaacccccagatctacaactatctggcttgacagagctttggaggatcattaaagagaccgctcactttattatcagaaaagacactgtaaattggtttgttttccagttccttgttctttcctgtttttcttctctgggagggagttgtaactgttgcaacgtgtctgtatacgagaacgtttttttttcagtatcagtataaaatgtataagcataatgcatgtatctgtttacattacatgtatgcttgtcagttcgtgtcgtcaaaaaaaaagaaaaaagaacgcccggtaccc

SEQ ID NO: 7712 - DNA, 1661 bp, Zea mays
tggcttctcctccccctccggttcgggttcgggttcgtgaggttctccggggttcggtttcgtgggtgggccgcacgacccgcgttcctacgatctccccggctgggaggggcctcacaagcggatgcgcctgggcgaggcgccaccgttcgatccgtacgactttgtgcctccaccgccgccaggaagggcttctgtggagggcgatcggctgctcggcctgatccgggaccatggccgcaatccacttcccggttgtctacctgacggcggctctggcggggatttaggtagattatatccccggcaaggatgtgattttgcggatttcgaccaaaagttgccacctcccatgctgaatgataatggcttcggacaaggttttgtgccagacgaaggccctcaccgaaagtattttgacggtgccaatcaccatttccatcagttccacccagagccattgcctggtgcgccgctgcacccttcactgcctcgctatcctgatccccatggttcacatgcttggcatgttgaggcaggtgctgtgccacggccagcagagcctccattcccctctaaccatgattaccgtgctgcaccgccacggctgactgcaaattcatcattgtttcctgtcctttctggttcgccaacaacggaaaattttccatcaacggccggtaccttgcctccagcccatcccatgccaaacaaaaaccgtcatgacggacacatcaacgatgaggggccaggtttcatttatcgaccacaatcagagcataacttgatagatggaaggctgaccagtgcacattattctctggaaaattccaatgtcacggtcatcaatgcttgtgatttgttcaagcagccgcttcgtggttcacgccctgaccatattgttgtcatcctcagagggcttccaggtagtggaaagagttatctggcaaaggcattgcgcgatcttgaagttgagaatggtgcaaatgcgcctaggatacactccatggatgattatttcatgatttgaagttgagaagaaagtggaagacactgaaggccctaaatcttctagtgcatcaaaagggaggaggcagttgacttagaaagtaattgagtattgttatgagccagaaatggaggagactttacaggtcaagcatgttgaaggcattttcaaagacccttgatgaaggaaattttacatttgtgattgtggatgaccgcaatctgcgggtagctgattttgctcaattttgggcaactgcgaagaaatcaggctatgaggtgtacttgctggaggcaccatacaaggatccaacgggctgtgctgcaaggaatgtgcatggatttacattggatgagataaaaaagatggcagcggactgggaggaggctccaccattatatctgcagctagatatacattcattattccatgatgataaccttcgtggccattctatacaagaggtagatatggacactgaggatgttgatgatgctaatgacgcaactagcatcattgctgagagctcgcagaaggctgtacaggatccaccaaacgaaggcttctcaaagccaggggaggagtggaactcagaagtagaagatggcctggatagtttaaaagaactaggacagagtaaatggtcaaaaga

SEQ ID NO: 7713 - DNA, 1656 bp, Zea mays
tgctattgagctgctgttggcttctgttcgtgttctctttgattggtgcgaccatagttctacttggcctgaatcaactattgcactgctgaagaaagcaatgattgctggtttcgtggtctgaaatgtatttgttttgcatttttagtataacttgttgagtgttatttttgtgaaagctcttcagattataatatttcagtagattaatcttgtttttgtcagacaatattgatttttcaggagctactcttgcatgctatttagaatttgatttcattttaattaatgtctcatctcatttcatagtgaaatcatcctgatagtgttctgattgctagtttctctttttcagaaatcaggctatgaggtgtacttgctggaggcaccatacaaggatccaacgggctgtgctgcaaggaatgtgcatggatttacattggatgagataaaaaagatggcagcggactgggaggaggctccaccattatatctgcagctagatatacattcattattccatgatgataaccttcgtggccattctatacaagaggtagatatggacactgaggatgttgatgatgctaatgacgcaactagcatcattgctgagagctcgcagaaggctgtacaggatccaccaaacgaaggcttctcaaagccaggggaggagtggaactcagaagtagaagatggcctggatagtttaaaagaactaggacagagtaaatggtcaaaagattttgaggatgaaaccacaaagtccgagaatacagaggaaaacacacatgctctttctggcctggcccggacatatagcacaggacgcaaaaatgtcagttggggtgatcggcttgaaaagggtgggttttccatttatgcaactaaaagaaaacttacttcgtcactaatcatagggcctggatcagggtacaatttggtatccaaccccttggctgaagatagttccacaggtacaaaagggaagacgaataacgagaccaaaaaacggttcagtgaacaacttcgtgacgaaggtgaatccttcagggcagtttttgacaagacaaagcagcacattggagtttttgagaatggagatgaggaataatccttgactagaggttcttttagttgtttgcccttaagcgttttggatgctcaggatgatacttcacacttacggaggggactagtgcagacagcttggagtcactttttcccccttccgcttgtcatcctgcagcaagtcacaatattgagccattcagtgaatcgtgggatcaatattctttagtccaatcgccttcatcaagcgcaatgagcaatagttccaatgtgccgttcaatgaaagcaatgcggatttttttggttcatgggcttgttgtccttgtaaaggcaactcacacatgccacaaagatgtactgtacctatgtatcaggcacgcacactgaatagtggccatcagtttttacatgtttctgttatatatgtgttgttgttaccacgagaaactattcggctctcgtctcttactactgtgacgagtaaactgtctgaatctgaacaattgttttcttaaagagttgtacttaagtaggattggacacaaaagtctagctgccacagcagcgatgtcgttcggcctgca

SEQ ID NO: 7714 - DNA, 1407 bp, Zea mays
ttttttttttttttttccagtagtgaattattatacacaaacaccgataaaatgagcaaaatctaaacaccaaatcacaaaatacagaaatcacagtgtcaaatgctgtttcaccagaacagaaaaaaaaagtatgaacttcagattaaatctacgagtgattattcagtatagcaattatatcattagcgtattaatgggcaaaatggcatggcgtccttgtccatgtggctaggaatggagaagtgccggagcctgctagcttcctctttcaggtacggctcacacaagaatgccctggcgaagctctcctcggtagtgtcatccacgccgtggaccagcacgtcggtttccccagtccccgggcgccgcgccctagccgccaccgcggccgtgtagatcgctccaggcaccggggcgttcaccatgatcacgtcccactccgcctcgtagaacgtttccggtagcccgcgcggcgccagcgtgcacggagattgctctaggtggtccacggtgagaggtttcggcggggaggcagcgcagtcgggggagttgcggagagccaggagatcgtcggacggcgtcatggcctcttgttggagagcgacggggtgggcctggaggtcgatcccggccgagtgcgcggcgcgggccgaggcgatccggccggcgtccgcctcgaggaagagcgtgcggccgccgtggttgagtgccgcccagagcgcgctgtcgggtcccagccccagcaccaggaggctacacggcgcacgccgcgccagcacgcgcgcggcggccccggcctccgccaccgtctggtgcggcgtctcgttggacgtcgcgtagtggaccagcgcctctgcgacggacgacggcaccttggcgcactcttgatggtggtgctgctccagctggtcggcgtggtcggcggcgacggacgctggagacgtggaggcaatggcagcggcaacggtggcagcggcgcttgctctggcgctgcgtgacgcggcagagtggagggtgcggagggtgaataggaggaggaaggcggaggtagcggcggcagccagcaggacgacgcgacgcggggtgacgttgtgcttgagcttcgctttggcggagatgaagtgggtcttgagcttagccttccgcgcgtgcatggggctcgtcatccttctcaagagcacagtggctactcagctactgacgagttttgttgtgttttctttagcctttttggcctttcaagtgcctgccaagggttgtgcgttgggatggcaatactttaggtttggacttttggttgatgcttcaagattcagcaaaacgttcgtaacatcagcagcgggtgggaggtgggtgatgaggactgggagcctaatgcttggtgcggccttgtgggttagttag

SEQ ID NO: 7715 - DNA, 1587 bp, Zea mays
tgggtacccctctgtaggccggccggggaatgacctatgcgtgtcactgcaggcggacctacaagctctttggaggagtagagacttccagccatcccttctacgctctccccgttcccgtgtcgtcctcccgacaaagagggagccgctagggtttagcggcttccgcttctgggcgagggcttacccgcgagggacggcgcgacgcggcggcacttgagctagggtttccctccgatcccgttcctttcccggcgaggcgatggacgaggcggcgattgacgacttgatccggcggctcctcgaggcccgcggcgggcgcaccccgcgcaacgcgcaggtgactgacgccgagatccggcgcctctgcgccaccgccaaggacgttttcctctcccagcccaacctcctggagctcgaggcccccattaagatatgcggggatgtccatggccagtattcagacctccttcgattatttgagtatggtggctatccaccagatgcaaattatctgttcctgggtgactatgttgatcgggggaaacagagcatagaaacaatatgccttctcttggcgtacaagataaagtacccagaaaacttctttcttctcaggggaaaccatgaatgtgcctcgatcaaccggatatatgggttttttgatgagtgtaagaggagattcaatgtgcgtatctggaagatattcactgagtgttttaactgcctcccagtggctgcacttattgacgataagatcttttgcatgcatggggggttgtctcctgagctaaagaacatggatcaaatacgtaacatttctcgtcctgtggatgttcctgacgttggtcttctatgtgatctgttatggtcggaccctgataaagagattgttgggtggggtgagaatgacaggggtgtttcctacacctttggagctgacatagttgctgagtttcttcagaaacatgatctagatttgatctgcagggctcaccaggtcgtagaggatggctatgagtttttcgcaaatcgccagcttgtaacaatattctcagcaccgaactactgtggagagtttgacaatgctggtgcactgatgagcatcgacgactccctagtatgctcgttccagatactcaagccttctgaaaagaaaagaaaagcaggagctgagaacatgccaaagcccggtacacctcccaggaagataaaaataagtgttacccgcatttagccagattctcgttatcaaactggatttgagaagttgtgattaaatgctccccaaacttgttatggtaggttttttggtgagcttaacacggtgttaaactgtggagtgtggaccaccgtgcttatgtcttgctgatctgaagtcatgcaaatgtatcctggcgttttgccaaacaaaaaagatcatgctaacagaaacttctggattttttttttattgtggacctctgttcttattccccaacagatgcaacatgtttatgaatgggtagcattgcttgcattggagattgtgctttcttttgtactacttaataaatacttaatagcaaaaaaaaaaaaaaaaaaaaa

SEQ ID NO: 7716 - DNA, 1573 bp, Zea mays
aacaatcccataaaccaccgacttccaggagtacttccagcgacccagcaccccaccacaaatacacaatcccctcttcggtacctttctccgagtcgtcttcccgtcgatcggcaaagagactttaagcgagagccgctagggttttagcggcttccatttctgagcgagggtttatccgccaggggcggcgcgacgcggcggcagttgagctgggatttccctcccatcccgttcctttccaggcgaggcgatggacgaggcggcggtcgacgacctcatccggcggctcctcgaggcccgcggcgggcgcaccccgcgcaacgcgcaggtgactgatgctgagatccggcgcctctgcgccgccgccaaggatgtgttcctctcccagcccaacctcctggagctcgaggcccccatcaagatatgcggggatgtccatggtcagtattcagaccttcttcgattatttgagtatggtggctatccaccagatgcaaattatctgttcctcggtgactatgttgatagggggaaacagagcatagaaacaatatgccttctcttggcatacaagataaagtacccagaaaacttctttcttctcaggggaaaccatgaatgcgcctcaatcaaccgaatatatgggttttttgatgagtgtaagaggagattcaatgttcgtatctggaagatattcaccgagtgttttaactgcctcccagtggctgcgcttattgatgacaagatcttttgcatgcatggagggttgtctcctgatctaaagagcatggaccaaatacgtaacattcctcgtcctgtggatgttcctgatgttggtctcctatgtgatctgttatggtcggaccctgataaggagattgataggtggggtgagaatgacaggggtgtttcctacacctttggagctgacgtagttgccgagtttcttcagaaacatgatctagatttgatctgcagggcccaccaggtcgtagaggatggttatgaatttttcgcaaaacgccagcttgtaacaatattctcagcaccgaactactgtggagagttcgacaatgctggtgcactgatgagcattgacaactccctagtatgctcgttccagatactcaagccttctgagaagaaaggaaaagcaggaaatgggaacatgccaaagcccggtacacctcccaggaagataaaaataagtgttacccatatttagccaggttctcgctatcaatctgcatttgcgaagttgtgattaagtgctcccccaaacttgtggtaggttttttttttggtgagcttaacacgattttaaactgtggaccatcgtgcctcatgtctttctgatctgaagtctgatgcaaatgtatcctgacattttgccaaccaagagagatcatgctaacataaactccaggattttttttattgtggacttatgttcttactccccgacaaatgcaacatgtttatgaatgggtaggggaaatgctaacaagcaactaatgctctttacttattttgatgcacgactgaaatcactggaagtatcccattttcc

SEQ ID NO: 7717 - DNA, 1371 bp, Zea mays
  misc_feature (1364)..(1364): n is a, c, g, or t
ccggccgggaaagccccagaaaccaccgacttccaggagtacttccagcgacccagcaccccaccacaaaggcacaaatccacaatcccctcttcggtacctttctccgagtcgtcttcccgttgatcggcaaagagactttagggttttagcggcttctatttctgagcgagggtttatccgccaggggcggcgcgacgcggcggcagttgagctgggatttccttcccatcccgttcccttccaggcgaggcgatggacgaggcggcggtcgacgacctcatccggcggctcctcgaggcccgcggcgggcgcaccccgcgcaacgcgcaggtgaccgacgctgagatccggcgcctctgcgccgccgccaaggatgtgttcctctcccagcccaacctcctggagctcgaggcccccatcaagatatgcggggatgtccatggtcagtattcagaccttcttcgattatttgagtatggtggctatccaccagatgcaaattatctgttcctcggtgactatgttgatagggggaaacagagcatagaaacaatatgccttctcttggcatacaagataaagtacccagaaaacttctttcttctcaggggaaaccatgaatgcgcctcaatcaaccgaatatatgggttttttgatgagtgtaagaggagattcaatgttcgtatctggaagatattcaccgagtgttttaactgcctcccagtggctgcgcttattgatgacaagatcttttgcatgcatggagggttgtctcctgagctaaagagcatggaccaaatacgtaacatttctcgtcctgtggatgttcctgatgttggtctcctatgtgatctgttatggtcggaccctgataaggagattgataggtggggtgagaatgacaggggtgtttcctacacctttggagctgacgtagttgccgagtttcttcagaaacatgatctagatttgatctgcagggcccaccaggtcgtagaggatggttatgaatttttcgcaaaacgccagcttgtaacaatattctcagctccgaactactgtggagagttcgacaatgctggtgcactgatgagcattgacaactccctagtatgctcgttccagatactcaagccttctgagaagaaaggaaaagcaggaaatgggaacatgccaaagcccggtacacctcccaggaagataaaaataagtgttacccatatttagccaggttctcgctatcaatctgcatttgcgaagttgtgattaagtgctcccccaaacttgtggtagtttttttttttggtgagcttaacacgattttaaattgtggaccaaaaaaaaaaaaaaaaaaagaaaanaaaaaaa

SEQ ID NO: 7718 - DNA, 3641 bp, Zea mays
taatttaatcataaaactaattatatatataaactaaatcacaagacaaatttattaaatctaattagtccatgattcgctaatatgatgctacagtaagcatttgctaattatgaattaattaggattaaaaattattatccacgtgtgttaaagtaaatcagagtataaattagtttaagttatactctaattcatcttaattcacgcggattgagctgaaggccgtagggccgtagggtgatgcccagtcccagtctcggccggccagctctcttttagtagagacactctgccacagcgtagcctagcatagcgtccactagctagctagctagctagcatcagtcatggaggatggcgccgagaaggcgacgacaccggattcttcttcttcgcaagcggcaccgccagcgctgagcgcggtgtacgtgaacaggcgcctcgtggcgggcaaccgcgccatggccgccgtccacgtcgcgctggtcgccacggtcatcggccagcgcgccctggcgctgctctctgctggaaccagcagcgcgtcgcccgcgtcccggtccctgcaggtgcagcacgtggccatggcgctggccgacctgacgctgctgttcgtgtgggcgctgtcgcagtcggggctgtggcgtcccgtgacgcgcgccgcgttcccgggccggctgctggcggcggtgccccgcggcgcgctcccgcgcgtggacgtgctggtggtgacggccgacccggacaaggagccgcctctcggggtggtgaacacggtggtgtcggcgatggcgctggactaccccggcggcaagctgagcgtgtacctgtcggacgacgccgggtcgccgctcacgctgctcgccgcccgtaaggcctacgccttcgctgccagggcctgggtgcccttctgcaggaggcactccgtgcagtgcccctggccggacaggtacttcgccggcgacgacgacgacgctgacggcgatcggcggcgggaggagctcgcggaggagagggcaagagtcagggtacatgtctgtctgtctgtctctagtgttttgcttttgattagactattttttttcttttccggtccctctgggcgtgacgtgtgtgatgacgtcaaagtggcacatcgggatggagtctccaacacactccaaagtccaaactccaaagtgccgtaatcagtgtcacgtggaagtggaacaaccattttcgtcctcatgcattgcatgcatggtaacgaaaatagaaaaaaaacacgagggtggggtagtggcctgacgtggacaggtaactggattagggctggttttgtgtggcctgctgatttatttatttatttttcagaaactatacgagaagttgaaagcggatatagaggcggctaagaatgacgagactatttctgggagctggtcaaaagacaaacgtcagaatcacgatgcttacgtggaggtaaaacttgttactcactcccttctaatgaccgaggaaaattaagagtgagattggttgaagactcaattagaccgaaaagactttattctagtttttaagaatagagttattttattatgtgttttgtaagtaaatcaaatatctagaaaatagaaataaagtttctcagcttctttcttattaaataccgacgcaccataagagcatccgatccgtggcagatcatcgaagacggcgacggcgttgaggagattccggcgctggtgtacgtagcccgcgagaagcggagagcgtggcctcaccacttcaaggccggcgctctcaacgccctggtacattataggcacagattttgtagtaatctggtctgggactggaacacccacaacaacatataataataatggatcatgcatgcatgcacctgcgagtgtcgggcgtggtgagcaacgcgccctacgtgctggtcctcgactgtgacatggcctgcaacagccgcgcctccgccctggacgccatgtgcttcctcctcgaccgcaggccgccgccggacagcctcgccttcgtgcagttcccgcagctgttccacaacctcagccacaaggacatctacgccaacgagctcagatacatcttcggggtatatatatactagctagctacctaccatgcatcttaatttgcttattgcttgtcgttaaccccgccgccgatcgtccgtccgtccgtatcagacccgatggttcggcctggacggcgtccggggccctcccctctccggctccggcttctacgtcaggagagacgcgctttacggggccacaccgaccgcggacttcatgcccgatgccaccgccgtcgccgagctcaagacaaggttcggccactccgaccgtctcgtggcatccttacgcagccccggcgttccaccagaagcagaagcgatgatgtcccttgcggcgctggcctcctgcgcatacgaggccggcaccgcctggggcgccggcgtcggcttcatgtaccagtcggtggtggaggactacttcacggggttccagcgcttcttcgcccgggggtggacctccgcctactgctacccggagccgcgcccggcgttcctcggcagcgtgcccaccaacctcaacgacgtgctggtccagaacaagcgctggatgtccggcatgctcgccgtcggcgtctccaggcgccactccccgctcgcctgccgcccgctcctccgggcctccctgctccaggccatggcctacgcctacttcggcttcgccgcgctctgcgccgtccccgtgctctgctacgccaccctgccgcagctctgcctcctccggggcgtcccgctattcccctgccccgccgccaccgcggcggcgttcgcgtcctcgcttctgcagcacatggcggaggtgtgcgtgtccaggcggggtaggctggacctgcgcacgtggtggaacgagcagaggttctgggtgctcaacgccctcacagcccagctcttcggctgcgtcagcgccgcccaggagctgctcggcgcacgcgccttggacttcgacctcaccagcaaggccgccgtcgacgggagcctgtaccaggacggcgtgttcgacttcacgggctgctccgcgctgctgctccctgccaccacgctctccgtgctcaacgccgctgcgatcgtcgccggcacctggaagatgtcgtcgtcgtcgtcgtcatcgagcggcggcttccacttcgccccgcagctgttcctcatgtgctacggcgcggcgctcagctacccgctactggaggggatgttcctcaggcgggatcctgcgagggttccgccacgcatcaccgcactctcggtcgcattggcagccgtgctgcttgccgccatgcttggatgaacatcaaccgagagatgcacggcctgcttcaactcttgtctactgttctagatatactgtacttttaattactattcccactgtattcccaccgttgaagcacaacaacgcactgaactaaacgacgaacgagaagaagcccaaggttaattagaactaatttatgatatacgttcggactaattattctacacgtcaaagatatttatgtaatgcggtataatatatataatttgtttactattgcatacgcataaattagaaaggacg

SEQ ID NO: 7719 - DNA, 2014 bp, Zea mays
  misc_feature (15)..(15): n is a, c, g, or t
cattgggtacctcgnagccggccgggaccggatctcacgacaacgccgccttctcctcccccgcctccgcccgcccggccgggaagccgaagccggaccaaatacacgctcccgtctcatccgatggctcctctcctttccccgccgctgctcgcggacagcgtcaccaagttccatgcggcctcaacgccagtctcgtgctccggtagcccacaacgctacgtcatcacagggttggctggggccggaaggggagagcacgactggcgtcggaggacgtggggaagaacgaacctgagggtgaaagcggtggcggcagagtcccgcagctcggaggggggaatcgctgaagattattacgctgttcttggcgttatgccagatgcaacgccgaagcagatcaagaaagcatactacaactgcatgaaatcgtgccatcctgatctcagtgggaatgaccctgacgtgacaaatttctgcatgttcatcaatgaagtttacacggtgcttaccgatcccatccagcgagcagtgtatgatgagatacatgggtatgccgcgacggcaaccaatcctttcttggatggcagcgcaccccgggatcacgtgtttgttgatgagttcagctgcataggatgcaagaactgtgctaacgtgtgttctaaggtcttcgaaatcgaggaagatttcgggcgggcaagagtttatgaccaatcaggcagcacagaactgattcaagaagctattgatagttgcccagttgactgcattcactggacttcagctgcgcaactgtcgctccttgaggatgaaatgcgcagagtggagagagtaaatgttggattaatgcttgctgggatgggaggctcaattgatgtgtttcggatggcaagttcacgctgggagaaaagacaagccaaagtcctggagaaggtcagaaggcggatgagccaagatgattccagaaagggtggctcatggagtgacatctggggggcaccaacaagatacgagaagaacgaagaggaggtgaaggagagagcaaagcgagccgcggctgcagcaaggaggtggcgggagtactcacggaaaggcgccgacaagcctccaacattcaagcttccggaggcagtgcccagcaaggagtgagaacccaacacagtcagagatcgtatggaacactgcagagatacttagcccccccattcacttcgtgtatagcctgatcatttacagagagccgtaagcctgtatagtatctgctctctgactccacatggtatacctgtaaatcctctgttagtgatagctcgggtcgattacccatagagtttctcagattgcagacgcaaaacaagtgtacacagaaagccttaatccatagaacacgggcacatacttttacaggatggcattatgtcaaatgagtcggttgtctttatctgagcctcgagtgatcatacctgaaaggcgaactgcattaaccacaatgatccgcgcctctgcctcctcgacgcatttgggagcctggcaagggcgaccgctggtcgtcttgttggtttctgccgaatcttgcggctcttctgcgcaatcgctctgcagcgacctggtggccttcagggtacgttgggacgccgtcgtcgaaatccagaagggcatccagagagaacatggcgttcgcagtcgcaccgtactcgttagaaggaaacattggtgccatgtcaccatccccattgaacattgcactagtcccgccgccttgatgagaccccaccaccagtgatccgccgtagatgtccggtgctcccaactccacctggacttggttcccagttggcgctgcgggatcctgtggcgctggcaccagcgccatgaatggtgtaccattgccgccattcgcatccgtcaccatgaatggtccagcgttgtagttgccgctgctgccaagtgctgctgctgcttgcatacctgctaactcgtctgtagccggggccatgagtgcttcggcgctgca

SEQ ID NO: 7720 - DNA, 1266 bp, Zea mays
cacggtcgacgagtactccaaggcgatgtatcccctgtacctgaaaaggtggcaaaacgcaaaaccgcttccgggagtgaagaggcttgtgtaagcatcttcacaagaacggagtgccactcgcacttgcttctaactccattaggagaaatgttgatcacaaacttccgaaactagaacatgggggaaagtgtttttctgttattcttggtggagatcaagtcccaaatggaaaaccttcccctgacatatttttggaggctgcaaagaggcttggtgcaaatccatcgtcttgcttggttatagaagattctgtcgttggagtcaagggtgccaaggcttctggggcaaaggcagttgcagtaccatcacttcaaaatcagaggaaccactattacattgctgatgtcatcctatattcgcttttggactttcaacctgagatgtggggtcttcctccatttgaagatcgcattcaaggtgttctgccaattgatcccttactttcaaatgcccggataggtggtaaaattttgaacaacattcattgggtaatttcagatgactgtgcctacgagtatattcctgaccaaatatcaggaatttttttgggttgggccaagtccaaagtgcatggattctccaaggtgatcgtagctactgggtgggacttctcacagcagaccgtcgagagagtgatgcatgtacattttcttgattgctctggcacggttgaaacagagcctgtgaagctgctcataattggttacatccggaagctccaaagtgcagatgatatattgcaagcattaagcgtaactgacgaagacaggagaattgcaagggatgcattggatctcccaactttctctgaatatgctaatgaccttcatcttgcctgagtccggctttgtcattgcaagctctcacctcactacctcacgtttgtatttgttattgttaacaagcaaacatgatgatgccagctgcgttttcttctatgaagacttcatatggaatgcacttcttgctcggagaagattagagaagagaagggcggaaggcatgaagcttgtctttcatttagaggtccatcgatgttatcgtatgctgtaaaattttcacgtttaatttttatatactctcttcatccacaaatctagctcaagctaagtttgtagtaaagaatgttagcacttacatataaaattaaagttattataacaatatattttataactaatataatggtacttattatgtatt

SEQ ID NO: 7721 - DNA, 2315 bp, Zea mays
ctgtagagtcgacctgcagcggggtaccctagtttctttataaggccataaaggaattttgttctccgctataatgaaaaagagagaaaagaaataggaaatctccatttccctgtggtcctcgaagccggccgggattcatttgatttggcagccactgagcagtgaccaccagcagctgacacgaggacacaacagagataaggcccgctccgcccgcagtcgtccccagctcgcgcgacatggcgcccgccgcccggtggtccacgtcccctgtgctcttcctcctgctgctgctcgcggcggccacggcgacgaccactacggcaaagcatgggcatccgtcgccgacgccgtggccggagcgtttccacgcggtgctgttcacgaacctgaccaactacacggaagcctccacgtacgggcccgccgctgcgcgtgacggacctctactacgactggccgcggcggcggaacctgaacctggtgcggcaccagctgtcggacgacccgctgtacgacgtggagtggaacaacggcaccggcttctacttcgactccaaggcgtgccgcgtggagcagttccccgtgggcgtgctgccgccgtggtggctctccggcggcggcgccgagtacgtgggccgccgcgtcgcgggcgggatcgactgccacgtgtggggcaaggccggcttcatcttctactacgaggaggcgcgcacggggcggcccgtgcgctgggacttcgtcgacggtactgtactgtacactgtactgcaacgattttttatttatttatttttagggttgatttgtttgccatgaatgagtatatctgcactgcagtgacggggatccagcagttcgtgatgagcttcgagcccggagctgcgctggaggacgacgcgcagtggcaggcacctgcatactgcttcccggacgacgacgatgccgcaaggagcagtggtgaggaggaagctggggatgggcttgaggcggcgagcagattactcaggaagctagcaggagctgcagcaacctattgactgtgttgtgttgtactgtaggatttatgtaccgtattaatttcgagcacaacagatatacttatgttcttgtagtactacctaattgcctagtttcctattgctggcttgctgctcctgttgtaaacaaacagatatacttagtaaattatgaaatcgtgctgtcggcttccggatctccacacacactactttagtttcagaatatatgggcacagctcatacaaaaagaatctctatatcatcccacctattcagcatagcatagattattgcaggggtatgacaattgtgccactgttatcaacctaataatacataacagcagggatttatcccagatttacaaggctgttcttctgttcagtccgcagatgagaaggtgtccagccctcagaaccggcaaagtagcgacctggggttcaccctcctctccttgacgcccgacgcagcggaagccttcttcatctccttgctgctcctgagagaggacctcggccccaggccccctccgcggcgggccgcaaagtcgacggctggcatagacctcctcacggactcgccgccgccgctcgtggcggtgtaggccttcttggcgacgcggcgcttggacagctcgacggcgacacaggggtccttcgccatcgcctcaggttctaccgagtacgtggacgcaaactcatcagagtagtagtagtaggggaagccctgcttgcgcttgagccgctcgttgcggcgcgccgagtaggcgtcgtacagcctgccgcgcacgaagagcgggccgccgtccggcgtgcccgctgccctggcgatcgccgcgaggttcagcgccactagctcgtcgtgggcgtccgcgccggccgggaggaggttctcctcctcgaaacccgacctagctgccgggggcgtcggcggtggcgccgcggcgggaaggaagttctccttctcgcccgcctccctcgctgggggcgacgacgacgcggccacgacgtgcgtcgggggctggagcgcggaggtcacgcgcgcgcgcatcgggtttggttcgccgcggaccagcgacgggagggcggagattgaagcgcgcaccggcgaagggatcgcgcagacggacgcgcgcatcgggaccgccgcctgcttcttcgatcctggagagtgagcagcgcgcgtcagatcgggaagcattgaatcggcgcaccaaggggggaggatgggtcttccttctccccaccatagctacgctgacaatggggggtcagccggtcgtacctgcag

SEQ ID NO: 7722 - DNA, 1019 bp, Zea mays
attttgatttggcagccactgagcagtgaccaccagcagctgacacgaggacacaacagagataaggcccgctccgcccgcagtcgtccccagctcgcgcgatatggcgcccgccgcccggtggtccacgtcccctgtgctcttcctcctgctgctgctcgcggcggccacggcgacgacgacgacgacgaccactacagcaaagcatgagcatccgtcgccgacgccgtggccggagcgtttccacgcggtgctgttcacgaacctgaccaactacacggaagcctccacgggcccgccgctgcgcgtgacggacctctactacgactggccgcggcggcggaacctgaacctggtgcggcaccagctgtcggccgacccgctgtacgacgtggagtggaacaacggcaccggcttctacttcgactccaaggcgtgccgcgtggagcagttccccgtgggcgtgctgccgccgtggtggctctccggcggcggcgccgagtacgtgggccgccgcgtcgctggcgggatcgactgccacgtgtggggcaaggccggcttcatcttctactacgaggaggcgcgcacggggcggcccgtgcgctgggacttcgtcgacgtgacggggatccagcagttcgtgatgagcttcgagcccggagctgcgctggaggacgacgcgcagtggcaggcacctgcatactgcttcccggacgacgacgacgccgcaaggagcagtggtgaggaggaagctggggatgggcttgaggcggcgaccagattactcaggaagctagcaggagctgcagcaacgcattgactgtgttgtgttgtagtaataattactatgcgacatgtaccgtattaatttcgagcacaacagatatacttatgttcttgtagtactacctaattgcctagtttcctattgctgctcctgttgaaaacaaacagatatatgatccaaataatatatatatatggccacagctaccttagtttcaaaaaaaaaaaaaaaa

SEQ ID NO: 7723 - DNA, 834 bp, Zea mays
  misc_feature (784)..(784): n is a, c, g, or t
  misc_feature (787)..(788): n is a, c, g, or t
  misc_feature (792)..(792): n is a, c, g, or t
  misc_feature (795)..(795): n is a, c, g, or t
gccggccgggtcggggacacaacagagataaggcccgctccccccgcgcccgccgccagctcgcgcgacatggcgcccgccgcccggtggtccacgtcccctgtgctcttcctcctgctgctgctcgcggcggccacggcgacgaccactacggcaaagcatgggcatccgtcgccgacgccgtggccggagcgtttccacgcggtgctgttcacgaacctgaccaactacacggaagcctccacgtacgggcccgccgctgcgcgtgacggacctctactacgactggccgcggcggcggaacctgaacctggtgcggcaccagctgtcggacgacccgctgtacgacgtggagtggaacaacggcaccggcttctacttcgactccaaggcgtgccgcgtggagcagttccccgtgggcgtgctgccgccgtggtggctctccggcggcggcgccgagtacgtgggccgccgcgtcgcgggcgggatcgactgccacgtgtggggcaaggccggcttcatcttctactacgaggaggcgcgcacggggcggcccgtgcgctgggacttcgtcgacgtgacggggatccagcagttcgtgatgagcttcgagcccggagctgcgctggaggacgacgcgcagtggcaggcacctgcatactgcttcccggacgacgacgacgccgcaaggagcagtggtgaggaggaagctggggatgggcttgaggcggcgaccagattactcaggaagctagcaggagctgcagcaacgcattgactgggntgnngtgnagnaaatattactatgcgacatgtaccgtattaatttcgagc

SEQ ID NO: 7724 - DNA, 1299 bp, Zea mays
gtgtcaatccatacgatcgtatctaaagatgccagttgcgtctgtctccctccattcttgcccatctctacctgacacggcgacagatcgtcagttcgtcaccgcccaatcagtctcccagcatttaccggctcctccgcacctgctgctccagttccagctctcccaacaccaacatgctcggcctccggcgcctccccgctgtctccggccgcctcgcgccggaggtcacctccgtctctgcggcctcctcccacagcgccgtcttctttcgcaccctccaaatcctcgtccagcaggggcccgtccgcctccaaaagctctctgctccggacaccgggatcgtggagctgaggctggagcggccggaggccaagaatgccatagggaaggagatgctccaggggctgcggagcgcgatccaggaggtggaggccgacacggctgcaaacgtcgtcttggtgacgagctcggtgcccaaggttttctgcgcgggcgctgatctcaaggaaaggaggttgatgggtcctagtgaagttcgggacttcgttaattccttaaggtctacattttcatcctttgaggcactgtctattcctacaattgctgttgtcgaaggggttgcttttggtggcgggttagaattggctctgtcatgtgatcttcgcatatgtggcaaggatgcaaaattcagtttgccagagactggccttgctattatcccaggtgctggaggaacacagcgccttcctaggattgttggaaggtcaagagcaaaagaactaatattcactggtcgtagattcgatgcggtggaggctgtaactatgggagtagtaaactactgtgttcctgccggcgacgcttatcaaaaggctcttgaacttgcgcgggagataaaccagaaaggcccgttagcagtaaaaatggctaagaaggccatcgatcaaggggcagaggtagacttgccctcagcattggccgttgaagaagaatgctaccagcaagtcctgcacactgaggatcgtcttgagggtctagccgcattcgccgagaaaagaaagcctatatataaagggaagtagggccgtgtatggtcttagattcataataatagaaagtcgcattaacatgccatccaataatagtggcatgattgcatgacattgatatgtgcaaattcatgtctctctgtaactttcaggaaataagataagatgtatcagcgctgccaaaaaaaaaaaaaaaagttctgaacgaggtgaatttggctgcggctttagacttaagatagacagg

SEQ ID NO: 7725 - DNA, 2857 bp, Zea mays
gccggccgggctgcgagcggccccgccggcgccgccccgggcgcaaaaggcgtcccaaaacaaatgccactatgcggctgctagagcgtcgtctcctttcctcccccaatccgccctttggcttcgctggcggcggcggcggctggggaaggcaggaatcccggcctttgcttgcgcgccactccgggcaccggctgcagctcgcagaaatggttagccagtagtatgtatgtgcattctgtatatatacaagagagcaatcatttctttggaaaatggcacttccactctgagtgttaaatagggtgccttaccctgtggaaaggggttgaactgtatctgtaatctgacactccacatctccagctgaacaaaatggcctccaatggtaatggaaatctcaaagctgatattcaacaagtagagtcaacagcttcagataatgttcaaggcgcaacaggcgtcaacactcttgccactcagggtgtttcacgaaatgaaaagcggtggagcgggtttagggatttctggaatcgcctttgtactggccccaagttaaagaagcttggtccctccacttcgttcaagtttcaacagatcgcacttcaacgtgatgagttctcacgttcgatccattcggacaaccatgttagccacgagcatttccagtttatccggaagattaattgggaacaactgtgggtgatggctaggaactggataaaagagcctatgaatatggccctttttgtttggattgcttgtgttgctgtatccggtgcaattctcttccttgttatgactggaatgctgaatcgtgttttgcctagcaaatcaaaaagagacacctggtttgaagtgaacaaccagatcctgaacgcattattcacgctcatgtgcctctatcaacatcctcaacggatctacaactttgtgcttctttgtcgatgggagcagcaggacatcttaaggcttaggaagatatattgcaaaaatggaacatataaacctaacgagtggatgcacatgatggtggttgtgatcctccttaatctgaactgctttgctcagtatgccctgtgtggtctaaacgtagggtaccgcagatctgaacgccccgctatcggtgttggtctcactatttctgttgcaattggggctgcagcatttgctggtctgtacaatataatcagccctcttgggaaggattacgacacagagcatgcagataccgatcaagaagcacaaatccatgccacctcaaccgagagtggcagaccaacttcacggcttcagtcattcgagaggagatactctttcatccagagcgatgaacgccgtttcgtggagagaaggcctcagtgggttggcgggctaatggatttctgggaccagatatccattgcgtacttgtcacttttctgcagctgctgtgtctttggctggaacatgcagaggcttgggttcggtaacatgtacgtccacatcgcaacgtttctgctcttctgcctggcgccattcttcatcttcgtcctcgcagccggcaacgttgacaacggatccgttcaggtggcgttggtgctcaccggacttttcctgtgctttttcggtctactgtatggcggcttctggaggatccagatgaggaagagattcaacctccccgaaaacagcttctgctgccacaacccggacgcgtcggactgtttccactggttattctgctgctcgtgctcgcttgcccaggaagtcagaactgcggattactacgatatcacagaggacaggtcgcacacagggcaggtagttggtgaaagccaccgcataatgtccccgttgcagcgcgaagacggtctgcctcttttcaagtcgagcccaagctcgccgtacaggagcggcaacgctagtccgtcgatcttcatcctggagagcccgtcaccgtcggccccacgtaggtcgtctggttcgtcgcctcagggtggtggttcaccgacgatgggccatagggcgatgaaggcgccagttccatctgttcttcaaagagagagtggaccagatcatgcacaggggtgatccaatgaagcagctaccgcttgccagtccaatgagatatgtatatttttgtaaaggagatacatcgtcggcagatattttttttctgtgctgtctttcttgttcgtaagaaatgtatagaccttcgagttctgttgtgcatttgagctccgtcatgcatggttgcttctgatgtgaggcacgattattgaagagacctctcgtttgctgctcggtatctgccgatgtgttcatgataacagaagtgtgctggtgctgatagtcttactcaacaaatagtacaagagccggggccagtagtctaggataatgcacaggagattgccaggatatatctctgacgagttcgacatcgccacccacccaagggaagtatttgattcatagaaaaatcgttacctgggacctggtatatgatctttggtgggttttacattctttagtggcaaagctgtttactttagagcagactagatcaactgctatcgttgttaataataaactagtctactgagagattgccttgttttcttgcgagaacttcggaacttcctctattctactagcatgagttgcctgaggatgttgtagattcttttgttggaaggcattatgctaggcgccagatttagtttgttaagaagtaaagttaggcaataattaaggaggcttatcctcccgggagagttatcttattccctagaaaatctgtaatatggttaggcacctaagctataaaggtggccttagattgtactaggagattatcaaagaagttgtgcct

SEQ ID NO: 7726 - DNA, 1549 bp, Zea mays
cgaaattggttgagtggttacaaaaaaccaaacactttccagcatatgcatgcaagggacgaaattagttaccagttaccaacactttcagcatatgcacgcaagggacgagattgattacccattaccaaaccaacagtttccagttcagcggtaggaacaggccgtcacggcgtcatccgccaaaggacaatccatttgctcacacaggcacaaacgctgagcgcctgagcctgctctcgcggtctaggagatggcgttgatcacgaatgtctctgactatgaggagcttgcaaagcagaagctgcctaagatggtttatgacttctatgccgggggtgcagaagaccagtggacactcaaggagaataaggaggcattctccaagattctgtttcgaccacgggtgctgattgatgtgtctcatattgacatgtctacaagtatattgggttacaaaatttccatgcctattatggtggctcccactgctttgcacaaactagcccaccaagaaggagaggttgcttctgcccaggcagcagctgctgcaggaactataatgacgttgtcttcatggtcatcttgcagcattgaggaagttagctcaattgcaccaggactccgtttcttccaactttcagtattcaaggatagggatatcgtgcaacagcttgtcagaagggctgaaaatgctggctataaggcaatcgccgtcactgtcgacgctccacgccttggtcgcagggaagccgatgtcaggaacagattcaggctgcctgaaaatgtggtgttgaagtgctttgaaggactggatctcagcaagatggacaagactaagggttcaggccttgctgcttacgccactagccagattgacagctctctttcttggaaggatatcaagtggctacagacgattaccgggctgcctatcttagtgaaaggagtcataacagcagaagatgctcgaattgctatcgaatgcggtgtcgccggcattatcgtgtccaaccacgggggccgccagctagactatcttcctgcaaccatcagctgcctggaagaggttgtgagagaagcgaagggccgccgtgtgcctgtgttcctcgacggcggcatccgccgtggcactgacgtgttcaaggccttggcgctgggagcctcaggagtgtttattggaaggcccgtactgttcgccctcgccgtggacggcagggcaggggtgaggaatgcgctgcggatgctgagggatgagctcgagatcaccatggcgctgagcggctgcgcgtcgctgaaagatatcacccgcgatcgcgttatcactgagcgcgacatgatccgtcgctctcggatataggcttcgattcgtttgctgttgtgttgtgcggggctgaaagtctgttgttgccctggcatgactgtcatattcgaaactgaccggaccatcagattggttttgacttttgacctattggctaacgatgtgctaggttttctcaaaaaaaaaaaaaaaaaaaaaaaaacacgagggggggcccggtaccca

SEQ ID NO: 7727 - DNA, 975 bp, Zea mays
cagtgcggccctcgaggccgcccgcgcaaccccaagcccaaccccgagctcagatccctcgcctcgtgtcgtgtctccggtcgacgacgaccaacagccagtgtgggccagacggacaccgccgagctatagcgcttggtgatagcaagggacgaccggcggccggaccggagcacgtacgtaccgcagcgatggctcggcagcaaagcgtgcaggccttgtgtgtgctggcggcgcttctcttcgccgcctccctgccgtcgccggccgccgcgggggtgcacctctcctcgctgcccaaagcgctcgacgtcaccacctccgccaaacccggccaagtcctgcacgccggcgtggactcgctgacggtgacgtggagcctgaacgccacggagccggccggcgccgacgccgggtacaagggcgtgaaggtgaagctgtgctacgcgccggcgagccagaaggaccgcgggtggcgcaagtccgaggacgacatcagcaaggacaaggcgtgccagttcaaggtcaccgagcaggcgtacgcggcggcggcgcccggcagcttccagtacgccgtcgcccgcgacgtcccctcgggctcctactacctgcgcgccttcgccacggacgccgtcgggcgcccgaggtggcctacggccagacggcgcccaccgccgccttcgacgtcgccggcatcaccggcatccacgcctccctcaagatcgccgccggcgtcttctcggccttctccgtcgtcgcgctcgccttcttcttcgtcatcgagacccgcaagaagaacaagtagaacgagttgcggctgcgcgccatacatgcatacatgtaaatcgtcggcggcgatgagtggctgtcgttgctgattcattggtgcgcgcgactattttggtgtatcatgtaagttacttttctgcagtgtgtgcgtcaaaattaccaaataataacttaagtttctctgct

SEQ ID NO: 7728 - DNA, 1715 bp, Zea mays
gctagttttaatttaattcatctgatgattgatacgcaacaaacgcgaattgttttggtctgggttgcggcgacggaaagagtgaccaatgtaatgtcaaatgctagactagctagggggggatcgatgcggtctgaaattgatgcacaagctatatatattcttgcatcgccatgtatatataattggttagatcgtggttccaggttccaaacgaaaaaaaaaacatcttcattttccatgtaacagaaacggcgcatctaacggttgatttcaacaccccaactacctgtcgctttaatttccactcctctcgatgtcatgcacctagcgcctctctctcttctctctctctctctctctctcttctctctctctctctctctctctctctctctccccggcccccctcttctgtatatatatagccaggctgtgtttacccctttgcaaaaggcattcgttcgttcataaacatcgcctgaacaccaaagtcaccctccagcagtttcgctttcttgcttcaccctgcgatcgagatcgagctcaacaaccatggaggatttagtgagtagcccatctttcaggagcgtcctcagcagcagtagcgaagggcaggctcagtcaggagagagttcttggacggattacttcgtggatttcatgttatccgaggaggagaggaagagacaggcagatgctagctcatactcatactgcgctaccgaagacgaaggcggcagcaaatacggtggcgatggaagcaaccgcgatgaggaggaggaggaagaggaggagtccatggtctccgatgccgcctctcatgcccctacgactgcaggcgccaccgcactgataccagctggcaggtacaaggagctgaagaagctcaagaaaaagcctttcggcaaagccctggaccatgacggttccctggaggatactgcgagctctccggtgaatagcccaaaggttagttgttacatctcgtttctctttctgctgttagctaggctgcttgtgatgctaatttggctctttttggggggttccttcttcaaggtcagtgttgtgtcacagctggaattgagtgctaaaaggaggtgcaacatcagggacctcaccaaggtatgctggaaattaattaatccatctctttttttatagaagaaataaagatatagctagcccatgctgatcagttgatcagctgtatacaataaacaggagtacttgtttggtcattactacgcactatttgttgcttgtagagcatccatcaatttatttcttggtttctttttgttattatacataaaagattctcttttaatttgcttgcatgaagggagtcgttggaattggcgatgatcacggcggggggggggatggacgtctgtacagatgcaacgaccacggaaggagcgaggcttggtgatcagtaccacacgagcatagctccatgtgcggagctgaaggacaaggggatttgtttgttccccttttccgtgctgctgcactaccatgggccaaactgaggaaaaaaacaatatgcgaatgaacagcatatgtagtgtttcgcaacttacactctatgcgcgcatgcatgtgtggtatgaacgaatgcaagaagaatgtgatactgtggatatatatatgtttttccttaatgaatatatgtgaatattactatgaaattgttactcgtaacataa

SEQ ID NO: 7729 - DNA, 1005 bp, Zea mays
cgaggctcggccgggtatatagcgcacggcgacgccggccgcgcgggaaaaggcattcgttcgttcataaacatcgcctgaacaccaaagtcaccctccagcagtttcgctttcttgcttcaccctgcgatcgagatcgagctcaacaaccatggaggatttagtgagtagcccatctttcaggagcgtcctcagcagcagtagcgaagggcaggctcagtcaggagagagttcttggacggaatacttcgtggatttcatgttatccgaggaggagaggaagagacaggcagatgctagctcatactcatactgcgctaccgaagacgaaggcggcagcaaatacggtggcgatggaagcaaccgcgatgaggaggaggaggaagaggaggagtccatggtctccgatgccgcctctcatgcccctacgactgcaggcgccaccgcactgataccagctggcaggtacaaggagctgaagaagctcaagaaaaagcctttcggcaaagccctggaccatgacggttccctggaggatactgcgagctctccggtgaatagcccaaaggtcagtgttgtgtcacagctggaattgagtcctaaaaggaggtgcaacatcagggacctcaccaagggagtcgttggaattggcgatgatcacggcggggaggggatggacgtctgtacagatgcaacgaccacggaaggagcgaggcttggtgatcagtaccacacgagcatagctccatgtgcggagctgaaggacaaggggatttgtttgttccccttttccgtgctgctgcactaccatgggccaaactgaggaaaaaaacaatatgcgaatgaacagcatatgtagtgtttcgcaacttacactctatgcgcgcatgcatgtgtggtatgaacgaatgcaagaagaatgtgatactgtggatatatatatgtttttccttaatgaatatatgtgaatattactatgaaaaaaaaaaaaaaaaaaaagcggcc

SEQ ID NO: 7730 - DNA, 1350 bp, Zea mays
acaaaggcgttcagtttcgttccgtttgggttggtctgtttagtgcggcggcgacagcgacagcggaggagagcggggacgggaggggccatggcggacgcggcggcggacagggagagggacaagggcaaggacgaccgccgccgctgggcggctcgctgcggtttcgccgtcctcggcatcatgagcaccctcctcgtctacggcgtcctgcaggagaagatcatgagggttccgtacggagcggacaaggagttcttcagatactcgctattccttgttttctgcaaccgtatcaccacatccatggtgtctgcaatggtgttactggcaagtaagaaatccttggaccctgtggctcctctacacaaatatggcgttgtctccatatcaaacatattgaccacaacctgccagtatgaggccctcaagtatgtcagcttccctgtccaaacactcgccaaatgtgccaagatgatacctgtcatgatctggggcacaataataatgagaaagaagtatggtggaaaagattacttctttgctgtcatcgtgactctgggctgcgcattgttcattctatatccggcaatgatggatgtgagcccatttaatagaggcagagaaagcactatttggggtgtttcactcatgtttggttatcttggttttgatgggttcacaagcacgttccaagataaactcttcaaagggtatgacatggaaatacacaaccaaatattctacacgacagtgtgctcttgtcttcttagtttaagtgggctgattctccagaatcatctgattccagctgtggattttatgtttcatcacccagattgcttctctgatgttctaatcctgtccagcgttgcaacagctagtcagttctttatatcctacaccatccgaacatttggggctctcacatttgctaccataatgacaactagacagctggtaagtatattgctgtcctgcatctggtttgcacatcctctcagctggatgcagtgggttggcgcagccattgttttcggagctatatacgcaaagagcttcttgaggactaaaccgcagaagacagcggtggcaagcccgtcgcatggctctagcccgaaccctgctaacagtagttgacgattgatgacatgataacattaggaaacaatggacttgttgcggtaccgggacgaagtctctgtgtttgagatcagtggcgccatagcgccatggtgaggtaactggacaaatgggtcccagatgtagctgtgtaaactgctcctgacctggaggtgatggaggtggtctccctttttagtggaaaaaaaccaaggtagtcctgatgtt

SEQ ID NO: 7731 - DNA, 1863 bp, Zea mays
actgcttccacacccaccctcgctctctctctttcgctgtcacgcggggcccacccgccgtgcgtgcgccccatccaccaccgacccggcgccgtcgcctccatcgaagcgtttcgtttggtttgggtttcgaggagtggtgccgcggcggggtcgggactcgggagaggaggggccatggcggacgaggcggcgccgaggctgctgccggtggcggcagacagggacaaggacgaccgccgccgctgggcggcccgctgcggcttcgccgtcctcggcatcatgagtaccctcctcgtctacggcgtcctccaggagaagatcatgagggtcccgtatggagtggagaaggagttcttcagatactcgcttttccttgttttctgtaaccgcatcaccacatccatggtgtctgcaatggtgttactggcaagtaagaaatccttggaccctgtggctccgctacacaaatatggtgttgtctccatatcaaatatactgaccactacctgccagtatgaggccctcaagtatgtaagcttccctgtccaaacgcttgccaaatgcgccaagatgatacctgtcatgatctggggcacaataataatgagaaagaagtatgttgcaaaagattacttctttgctgtcgttgtgactatgggttgcgcattgttcattctatatccggcatcgatggatgtgagtccgtttaataaaggcagagaaagcactatttggggtgtttcactcatgctcggttatcttggttttgatgggttcacaagcacattccaagataaactcttcaaagggtatgacatggaaatacacaaccaaatattctacacaacagtctgctcttgtcttcttagtttaagcgggctgattctccagaatcatctgattccagctgtggattttatgttccgtcacccagattgcttctccgatgttgtaatcctgtccagcgttgcaacagcgagtcagttcttcatatcctacaccattcggacatttggcgctctcacatttgctaccataatgacaactagacagcttgtgagcatattgctgtcctgcatctggtttgtacatcctctcagctggatgcagtgggttggcgcggccattgtgttcgtagccctatacacaaagagcttcctgaggagtaaaccgcagaagctagcggggtcaagcccgccacgtggttccagtccgaaccctgttagcaatagttgacaattggtgacataataacataggaaacaatggacttgttgcggtgtaacgggacgaagtctccgtgtctgagatcaatggcaccatggctgcatatgcaaggcgaggtaactggacagataggttccagatgttgctgtgttactgctccctgacattttttcaaggtcatgaaggtggccattttttcaagctagtcgaccctagtgttagtttagtgtccagagacccaattttgtagcccagtgagctgtgttaccaattttgtagccccaaaaaaaaaaaaagtgtgtgtgtgtgtgtatttgtcgagcgttggcgactgagagttgaagaagtcacagcagaccatctgcaaaaactcaaaaaaaaaaaaaaaatgcgatgcgtaacaaattgcaaaacacaggagattgtcagctaacagctgtggtccgatgtaaagatcagcagataacaactgaaggcctgtttaccatggtttttgagtataccgtagtattttataccaaaagacatttggaagcgcatataaaaactctattttaaaccatgttttatcaataccttttggtttcaaccaaagtggtttagtttttgacttatacgcagctgcaggcatgc

SEQ ID NO: 7732 - DNA, 2042 bp, Zea mays
  misc_feature (1432)..(1432): n is a, c, g, or t
aaaaggcgttcagtttcgttccgtttgggttggtctgtttagtgcggcggcgacagcgacagcggaggagagcggggacgggaggggccatggcggacgcggcggcggacagggagagggacaagggcaaggacgaccgccgccgctgggcggctcgctgcggtttcgccgtcctcggcatcatgagcaccctcctcgtctacggcgtcctgcaggagaagatcatgagggttccgtacggagcggacaaggagttcttcagatactcgctattccttgttttctgcaaccgtatcaccacatccatggtgtctgcaatggtgttactggcaagtaagaaatccttggaccctgtggctcctctacacaaatatggcgttgtctccatatcaaacatactgaccacaacctgccagtatgagatctggggcacaataataatgagaaagaagtatggtggaaaagattacttctttgctgtcatcgtgactctgggctgcgcattgttcattctatatccggcaatgatggatgtgagcccatttaataaaggcagagaaagcactatttggggtgtttcactcatgtttggttatcttggttttgatgggttcacaagcacgttccaagataaactcttcaaagggtatgacatggaaatacacaaccaaatattctacacgacagtgtgctcttgtcttcttagtttaagtgggctgattctccagaatcatctgattccagctgtggattttatgtttcatcacccagattgcttctctgatgttctaatcctgtccagcgttgcaacagctagtcagttctttatatcctacaccattcgaacatttggggctctcacatttgctaccataatgacaactagacagctggtaagtatattgctgtcctgcatctggtttgcacatcctctcagctggatgcagtgggttggcgcagccattgttttcggagctatatacgcaaagagcttcttgaggagtaaaccgcagaagacagcagtggcaagcctgccgcatggctctagcccgaaccctgctaacagtagttgacgattgatgacatgataacattaggaaacaatggacttgttgcggtaccgggacgaagatcaatggcgccatagcgccatggtgaggtaactggacaaatgggttccagatgtagctgtgtaaactgctcctgacctggaggtgatggaggtgatctccctttttagtggaaaaaaaccaaggtagtcctgatgttagtttagtatccactatccagagaccaatttttcagccatcccaggctgtgctatgttttttttctcgaactcgcaagagaattaagtgtcaaaataataagggaaggaaaagagtacaaaaaacaggggtaaaccctgccacactagagattacattattanagctctaaacacgcaagagacaactccatgagctctctggcatgcctgcagcacttcacatagtaaactctatggagatgaactgtagcgccaaattaactgtaggttgaagtccattaaaaaggcaactatttctaagcttccatagcttctaagcaagaagaataataatagaatccattcctttcctttcttctttaggaatcttcttcattgttctgctccaccagaatgaaaaatagtcatccgtgggctgtggcaccaaagataagggacccaacttctgaacggcagcagcccacacttgtctatcaaagacacaagaaagcagaacatgttggatagtttcagctttctgatcataaaaaggacatgccgaagggtggggaacacctcgttttgcaagtctatcagctgtccaatatttatttttttatcaccattcacgtaaaaaactttattttggggggggggggggggcccaagttttccaaaccattttccaaggagcaaaattgattgctccctggaaaaatgtcgtatatgctgagtggcttaaatatgttccatattgatcaagtctctatcgatgttgatcttcaacctcggg

SEQ ID NO: 7733 - DNA, 934 bp, Zea mays
ttgggtacctcgagggccggccggaaacagtgggtacctcgcgcccggccgggccaattaaccactactccgcatctactgacgccgccgccgccgccgccgcgctctctccgtcggactagtcagaggatccgtcatggcgaagaaccccaaggtgttcttcgacatcctcatcggcaagtccaaggccgggcgggtcgtgatggagctcttcgccgacaaggtgcccaagacggccgagaacttccgctgcctgtgcacgggcgagaagggcctgggctccgcggggaagccgctgcactacaagggctcggccttccaccgcgtcatcccgggcttcatgtgccagggcggcgacttcacccggggcaacggcacgggcggcgagtccatctacggcgccaggttcgccgacgagaacttcaagctgcgccacacgggacccggcgtgctctccatggccaacgcggggcccgacaccaacggctcccagttcttcatctgcaccgcgcagacgccctggcttgacggcaagcacgtcgtcttcggcaaggtcgtcgatggctacgccgtcgtggacaagatggaggctgtcggttctcagtcaggtgccacggccgagagcgtacgcatcgaggactgcggccagcttgccgacgactgagggcctcgctgtgtccgattgtaaccaaatgaatgatcaataaatttctttctttcattcttttgtttctgtggagatggataccggcctgtagttaattaaccaatataaactatggatggatggggcggtgatttgatcaagacatctgtatttgttactcttatctgacttatctggctattgtatttagaaatatttggaaaaccgttttctaggtttatatacccagaaatgtttgaaaaaaaagcggcccccaacctccgcttt

SEQ ID NO: 7734 - DNA, 732 bp, Zea mays
gtggcggcccgctcggaccctcgagcccggccgggccgggaacactactccgcatctactgacgccgccgccgccgccgccgcgctctctccgtcggactagtcagaggatccgtcatggcgaagaaccccaaggtgttcttcgacatcctcatcggcaagtccaaggccgggcgggtcgtgatggagctcttcgccgacaaggtgcccaagacggccgagaacttccgctgcctgtgcacgggcgagaagggcctgggctccgcggggaagccgctgcactacaagggctcggccttccaccgcgtcatcccgggcttcatgtgccagggcggcgacttcacccggggcaacggcacgggcggcgagtccatctacggcgccaggttcgccgacgagaacttcaagctgcgccacacgggacccggcgtgctctccatggccaacgcggggcccgacaccaacggctcccagttcttcatctgcaccgcgcagacgccctggcttgacggcaagcacgtcgtcttcggcaaggtcgtcgatggctacgccgtcgtggacaagatggaggctgtcggttctcagtcaggtgccacggccgagagcgtacgcatcgaggactgcggccagcttgccgacgactgagggcctcgctgtgtccgattgtaaccaaatgaatgatcaataaatttctttctttcaaaaaaaaaaaaaaaaaaagcccccgggcccc

SEQ ID NO: 7735 - DNA, 1346 bp, Zea mays
tacccctgaaatattgcagaacttttttgacctcgagaaataccctgttatgacagaactgattcatcgatttcaagtaagattattccaccattttcactttactcctcagtcatctctcctatcaatttgattagttgaggtttttgaacactccttgatgcattattggaagcttgtgatgtctaaacatggcttagaatgaatttttgtttttaaaatcaacttctacagggtttcagagaaaggctgttggcagaccctaaattccttcaaagattagccattgaagaggtcatatcaataacaaccactctactagcgcagtatgaaaggcggaaagggaggttctttgaagaaattgactatgtcctcacagatactattagagggtctgttgttgatttctttacagtgtggcttcctgctcctactatttcagtccttcagtatgctgatgatggttctggtccgagtttggagtttgtcaaaggccttctcggacccgggcccgtgggtgcattccaaaagaacatcttgggccaggattggagtatcaagcaaagaattgcagcagtgttggttggtggtctgaaacttgccagtgttggtttcatttctagtgttggggctggggtttcctcagatctcatctatgctgcccgaggaattgtgaaaccttcagaaaatgtggaaacgggaaggaagagatctcccatctggaagtcagcagctgtttatagttgctttcttggaacatcagcaaatttgcggtatcagattattgctggtctagtggagtatcgactaggagagagcctggtgacatactacaaccaaccccttattgctggtttgttgtcattcgcggctaggacactgaactcatactggggaacacagcaatgggttgatcttgcgcggtacactgggttacagagaagcgaggaaaagcctcctgctgaggccactatgccacctgattcagcacacttggagggttgtacgacggaaggacatgattttgatgacagcagcaataacaccaacaaatcgactggtccgagctagtgatttgattacttcacggtggctgcagatcacatggcctattttcatagacaatgaaagtggctgccttcctgctcttgggatcacaaggaagcggaaatttgaggaaatattagtcacaaaaatttgttcagattctttttcagcgttaccacaagagtgcacatacagttctcgtttctattcgttagagtaaatattgttttgtacaatctacatctgtaagaactgcagcacctaaaggatgtgcagcaatgagggctttaacttgtcgc

SEQ ID NO: 7736 - DNA, 1232 bp, Zea mays
aacccgccgccccgccacgggcgcgcgcgcgaacactgggccccacctggcagcaattcgcccccggcccccatacaaatatccggcgcgtcgcggcgtcggcgtcggcgtcggcgtcgtttaccagtcttctcacccggtcgccggtcttgagcgaccgcctcgctacttcctcctaccggcgcaggcacacggtttccgcgccagcaaggggtgcccaccgcaaagatccgatcgatcagatcaaaagggaattcctgaaaaggagagaggagcacccttcctcgccatttccgtccaagtgttttcccgaggagtcgtgcgtgcctgctggcgctggggcggctggacgggagcattgctggccgcggcggagcccggcgctcgagtcccttctctcctctcctctcctctcctctgcggggggcagccttttatttgacaacggtataaagaaatcaagtacaaatgaagaggcacatctctgcccagtatttgatgactgaagataggtagcagtatggtagctgctacaattgcgggaatgtttcttgtgtgttttgagtccctctgcacctgttttggcacaaaaaggaaagatgaaagcgaagaccatgttcttgcagaacattccaattccttgagttcttatcaaatgaggtcggtttctgatagaatttctgcaagctcgcttcgagcacctgcaagtccatctagattttcattgtcttcgccaccaagcagaaatgaacctttaaacatcagtcttgaacatgtggttaaactgacacataacttcgctccgaccttgatgattggtgaaggttactttggaaaggtctacagagcgacactgcgagatgggcgtgtagtagctattaaaagggcaaagaaggaaaattttgtttctttacgtactgaattcagcaacgaagtcgcattactaaaaagtattgaacataagaacttggtccgattgcttggttatattgacaaacccaatgaacgaattctcataacagagtatgtaccaaatggcaatcttagggagcatttggatggtcaacatggcctagttttgggatttaatcagcggcttgaaatagctatagatgttgcccatgggttgacttatctgcatctctatgcaggtacactttgcgtacttagttcagcatcaggcaatttagtctttttaaatccaaatcatgttcatgcacttgtgctgcttc

SEQ ID NO: 7737 - DNA, 2837 bp, Zea mays
aaggaaagatgaaagcgaagaccatgttcttgcagaacattccaattcctgtaagtcataaagtgacgtttcactcatcatgttgaaacctgtcacaacagcaaagcaatggctaacctgtttgtgaggacaaagttcatactagaaaacaggagatgtgcttggtatttctggttgtataaaacactcaccgtcaattgtggcattgcttttgtttgttttcagtgagttcttatcaaatgaggtcggtttctgatagaatttctgcaagctcgcttcgagcacctgcaagtccatctagattttcattgtcttcgccaccaagcagaaatgaacctttaaacatcagtcttgaacatgtggttaaactgacacataacttcgctccgaccttgatgattggtgaaggttactttggaaaggtctacagagcgacactgcgagatgggcgtgtagtagctattaaaagggcaaagaaggtaacttattttggtccaggcaactattctagcaactgtcctagcatggtgccagtttttgtgagttgtattcaaacttatttgaactgtgaccttatcttctactctttcctttatatatacacacaattgctcatctgcactcgcgcacatttgtatgcattgcattgtggggaagcaagattgagctaagagtggcaaattcaggtttaagtatgttttagatttagacccattacttgatccatatttatagagcggtagatgggagctggatgatgaactatgaactcataattccattatttgctccagcagtccatgataatgtttatgtgctggtttttatttttcaatatgcttcttcataaacttccttttgcatgaacaattttcttgtagaccatactttgcggtattgattctgatatggttttatttggcaggaaaattttgtttctttacgtactgaattcagcaacgaagtcgcattactaaaaagtattgaacataagaacttggtccgattgcttggttatattgacaaacccaatgaacgaattctcataacagagtatgtaccaaatggcaatcttagggagcatttggatggtaaggtgtaaaccagattgctagttttttgtattccttccaaaatgattggtctgatattttggaatcatctttcaggtcaacatggcctagttttgggatttaatcagcggcttgaaatagctatagatgttgcccatgggttgacttatctgcatctctatgcaggtacactttgcgtacttagttcagcatcaggcaatttagtctttttaaatccaaatcatgttcatgcacttgtgctgcttcaaaactgcagtaaggaagtgaaccagtatgcttaggcactctttttaagataaaaagaattccttttgcatctaaagcttgttataggatgggacgatagaggtccagttccttatgattcagtctgaaatggaactaaatctgaatctgtagagcaaaccacccaatcaagtataagtagttgtgaccaaaactgtatttaatcaaacatcttttttccatgatgcaattccacatgtgaactagccccatggatatgtaacaatgtaactctcgtagtgaaaaataagtttccataacacatttatgttcttcagcttttaagtgatgaagtggtatgcacccagataacaagaagactttattttgtcattgttacaaaaaaaactgcatacatttttttccaattcatagtttgatgctattcctattttgcctttagagaagcccataatacatagggatgtgaagtcatcaaacattctactgacagaaggcttcatggccaaagtggctgacttcggatttgcaagaactggtcctactgagccaggccagtcacagattgagactgatgtgagaggaacagcagggtatttagatccagagtatctgagatcaaaccatcttacgatcaagagcgatgtgttctcttatggtgttttgcttctagaaatcctttcaggacgtcgtcctattgaggcaaggaggggtccaacagaaaggattacagtgagatgggccttctataagtacaacagaggaaatgttagggacatactggatccaatgttaacagaagcagtgaacgagaatatactgaatagaatctttgatctggcgttccagtgtgtcgctcctacccgcgaagacagaccatccatgaaagaagttgtggagaggctgtggaagataagaagggatcatacaaaaatacaaaggatagcagaattgactctctgaatccttgaaccagctgatcccggttgccgtttttgcttgagggaacatggatcagttcctagtgaagaccaaaggtcaccacataaaaataatgcaaattttgtggttgtgaacaactggaactttgtacagggttgcaaaattgttgttgtattatgttgtattgtacatggctctatgttcaagagatcaaggtgccgaacaatggcctgtgatcgatgatttccctgtgtagccactagcccgtttatcaacataagctgttcagtgatctgtaaggcacaatgtagcttctgtgtaacacctgcattgttggatgaggcttttaaaacagttagatatgaataaaatctttggctagtttcttctgtatatctatattacttattaaagctataagagatagactgccgttctgcgatctcaaccatctgttctacagttttataatctcagctgtccgatcccgcacagcagtccggctccccgaccccgtctcaacgcccgaagccatcatgcccccccccccccccc

SEQ ID NO: 7738 - DNA, 1646 bp, Zea mays
taccctacctcacaagtccaaatcagtttgtctgctccgcccgttgcccgtggcccgtcggtctctcttgcagtctcgccgctccccttcctcccccgcaggaatccgaatcagtaagtccggcgacctaggtctctcggcttgtccgcagcccgccggtcagtaatggcgcaggatgatccggttgtttctgctcagtggctgcacgagcacctagggatgcctgatgttaaggtaaaaaaaaaacatctagtttgcgtgttcatattcacttcagagacacttcagtaatgcttccttcatcgaagaagaaagttcagagatatacttcttctatcccctgcgttactggtatgtggagaatataacagtttggttgtctatcaatttgatattcccttttatgtgttgtgttcttattactcccagaaataattagagggttagggacatatgtgctttgtgacagttatcagcttgttttaggttttggatgcttcctggtacatgccggtagagaacagggatccatggaaagaatatcaggtggcacacatccccggtgcgctattcttcgacttagatggcatagttgatcggacaactgatttaccgcacatgctgccatcagaagaggcttttgcagcagcaatttctgagctggatataaaaaaccaggataaagttattgtctatgatggaaagggattcttcagtgcacctcgtgtttggtggatgtttagagtgtttgggcacaagaaagtctgggtactagacggcggtttgcctcagtggcaagcttctgggttcaacgtggaaaaggccagccctgacgatgacgcagttctgaaatcaatcgctgcaaacagggctgtcaaaagggtttataatggtgaacagacaaatacaatctcgtttcagactgaatttcagcctaatctattctgggcactggaaaaggtcgcacaaaacgtcactgctaagacgtaccaacagatagatgccagagcaaagggcagattcgacggcgtggcgccagagccacgggaaggggtaaggagtgggcatataccaggaagcgtctgcgttccgttccccgagatgttcgacggcgcaccaccgagccttctcctccccgccgacgagctgcggcggaagtttcagcacgcaggaatctccctggaccgacccatcgtcgtgacctgcggatccggcgtgactgcctgcatactcgctctggggctgtacaggatcggaaagcgtgatgtgccagtctacgatgggtcctggacggagtgggagggtcagtcggactccgattaccccaaagtcaccgctcctggtacagcttgagcgtctgggactgggagttggcagttttagactgccagcatgatggcattgtgtttgcgacaggctgaaccgattttatcgagcactggaagcattgtattcgctactggtaggcctgctaatggcaaaaattccaacccacgcccacccatacccaaatctaataacttgatattcatcccactcccacccaaaaatataagaagaaaattaaacctaacccatccaatgatattattgatccctaaaccaacccgtaattgggtggaaacccgtaaaaaaaaaaaaaaaaa

SEQ ID NO: 7739 - DNA, 1377 bp, Zea mays
  misc_feature (9)..(9): n is a, c, g, or t
  misc_feature (14)..(14): n is a, c, g, or t
  misc_feature (1043)..(1043): n is a, c, g, or t
  misc_feature (1163)..(1163): n is a, c, g, or t
  misc_feature (1165)..(1165): n is a, c, g, or t
  misc_feature (1173)..(1173): n is a, c, g, or t
  misc_feature (1191)..(1191): n is a, c, g, or t
  misc_feature (1196)..(1196): n is a, c, g, or t
  misc_feature (1205)..(1205): n is a, c, g, or t
  misc_feature (1245)..(1245): n is a, c, g, or t
  misc_feature (1270)..(1270): n is a, c, g, or t
  misc_feature (1308)..(1308): n is a, c, g, or t
ggtaccctngcggnccgggccccgcaccggccaagtccaaatcagtttgtctgctccgcccgttgcccgtggcccgtggcccgtcggtctctcttgcagtctcgccgctccccttcctcccccgcaggaatccgaatcagtaagtccggcgacctaggtctctcggcttgtccgcagcccgccggtcagtaatggcgcaggatgatccggttgtttctgctcagtggctgcacgagcacctagggatgcctgatgttaaggttttggatgcttcctggtacatgccggtagagaacagggatccatggaaagaatatcaggtggcacacatccccggtgcgctattcttcgacttagatggcatagttgatcggacaactgatttaccgcacatgctgccatcagaagaggcttttgcagcagcaatttctgagctggatataaaaaaccaggataaagttattgtctatgatggaaagggattcttcagtgcacctcgtgtttggtggatgtttagagtgtttgggcacaagaaagtctgggtactagacggcggtttgcctcagtggcaagcttctgggttcaacgtggaaaaggccagccctgacgatgacgcagttctgaaatcaatcgctgcaaacagggctgtcaaaagggtttataatggtgaacagacaaatacaatctcgtttcagactgaatttcagcctaatctattctgggcactggaaaaggtcgcacaaaacgtcactgctaagacgtaccaacagatagatgccagagcaaagggcagaattcgacggcgtggcgccagagccacgggaagggtaaggagtggcatataccaggaagcgtctgcgtcccgttccccgagatgttcgacggcggcgcaccaccaccgacgagccttctcctccccgccgacgagctgcggcggaagtttcagcacgcaggtctccccgttctaagttttgtaacagtcccgagacaagtaataacagtacacattggtgcgtttggtgcttcttcaggaatctccctgnaccgacccatcgtcgtgactgcggatccggcgtgactgcctgcatactcgccctggggctgtacaggatcggaaagcatgatgtgccagtttacgacgggtcctggacggagtgggaggngnagtcggantccgattacccaaaagtnaccgnttgagcgtntgggactgggagttggcagcatgatggcattgtgtttgcnacaggctgaaccgattttatggagnactggaagcattgtattctccatacagtattagtagtngcaaacatatgagggccccggtggagagaccagagagaggagcaggagcagagcagtagaagaaacaga

SEQ ID NO: 7740 - DNA, 1888 bp, Zea mays
  misc_feature (140)..(271): n is a, c, g, or t
  misc_feature (274)..(276): n is a, c, g, or t
ctcgaggcctggccgggaccgacgcggggcccatgcctcggctcccgcgttctacccgcgcgctgtggtgaggtctccgtgggagagaaccagctccgtggacccggtctgttttacacataggcggagcaggccacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggnnngcggtgcgggccgcggcgcctgctgttcagtgcggtgttagactatgcaccgggtccacggttcagatcccgcgggacgcagagaggaggaggctttggcccgattcgcgcggcccggccccggatcgaacgatttgggggaggaggtgttctattacacaaaagaggcaaaaaacaaaagccggtaacggaaaccctaatccccccaaatcccgaatccctctcgaatttctatttaatgttcctgttcttcccctccgatccgatgtccccaactgcgctcccgtcggcgatcaaacaccggatcgcggcactcgccgccgttgaggaggaggtttccggcgctgcttccagcgccttgccgtcagcaccatgaggaagaagctggacacgcgtttccccgctcctcggattaaaaagatcatgcaaacagatgaagacgtcggcaagattgctcaagctgtacctgttctagtgtccaaagcattggagctatttctgcaagatttatgtgataggacatatgatattacaattcggaagggggtcaagactgtgggttcttcccatttgaaacaatgcatacaaacgtacaacgtctatgacttcttgagggaagtagtcagcaaagttccagacattggtccttctgatgttattgctgatgataagcttggcaaaaggaggaaagccgaagaagatggaagtgaggaagaattgaagaggacaagaaatgagacagaaagctatacaagcaatggcagaggccgtgggagaggtcgtgggagaggtcgccgtggtgtacgtggagcttggcgggaggtggtcacaagtcctgagcaattcaaggaggagaatcaatctagcaaggtagccagcctaaaggtggaggtagcagatgaggtctcgaatgtaactgaagcaaaacaggacactacaccaatgagcaacgccaggccttccttaaggaacattgacttgaatttagatccaaccgatgaagaggatgaggttacagtgccaccccaaccccagctgtcagctccagcaactagttgcgatgcagccactgcagcacctggaccatctgttccacggttaagggaaggagcaaaactcaaggacttctttggtgcttgggaactggctgacatgaacaagatggagatggaccctgtccagtttgctctgtcaacaaaccatagattggaggaggacgaggattatgacaatgaagactagctccgccgttatatagcttcagagttgatgagtaggaatagcaggacaactgtaggttcagcttaactctgtagcagttctcatgtatcatatagccgccaaagctgccgatgtagcttataatgtcccagaggttaaggtcgtttgactagttgactgtaatgttctcaagttaggttctattagcagctattgctttcgcagatagtaccgtttgtacattccagttgctctccagttttatgttatctatccttctgctttcttggatagctgagacctgttggcggatgtatcatgtatggcaagttggcaacaaaaagcaagaaggctttcagattcaaaaaaaaaaaaaaaactattacagtgg

SEQ ID NO: 7741 - DNA, 5054 bp, Zea mays
ttataattatatatcagattcttcacatggttgttgaagtagccggtcattcagaacaccacgtccagacctttctcgtcaccagccaatgtgtactgatcgagaagaataacaccgatcggaagcgcgagataaaaatgaggccaacatgtatgggaattgggaaaggcggtgttggattcgtctgccacgggccacgacgccgcctgaggagcgtgtttgcacatgcaagagctgggcagtacgacgtttctacaacggatgtacggacattggctctggttgttcaccttttcttatgtgaatgaagccacatatttggcggggatcttcgttgtggggcggtgacgtgggagaaaagaggcgggacttacgcgtggaggacggaattggaccaaaccaatcagcacttaccacagtgtagatggtcacataggccggtaagggcccgaccgagagctatattttacttgtaaaatatatgttatatatatttacatagaatatttaaaacattttttttgacggagagctatattttacttgtaaaatatatgctatatatatttatatatattctttaatacattttaaaaaaatatatataggttagacatgtgccgatctaatgtgtcaaatatgttgttcagacacggcacaatcaccagatcggacggactggccacggacctagtgagcaacggattagtcttcgttcgtgcaggactatcgggtgtcgtcctttctaggcagctacatatgacaccaaatagattgggtgcaaagagaggttaaatagactcagcaccaccaaaagtcaatgtgcgattgtgttttgtccacatcttgcttgaatgcttgggtttgtgttagttttcccctcttggcctgcctgcagaggatttcgacggtgtgatgaacgaataatacgcaacacagaaaagaaagaaacgtttgtgttagttttcctctcaactaaccaaccaaacaaacgttttattgtaaactttctctaatatatatagcgtttttttgtcggtgctgttctcctttctgcaaagatccagtacgttttaaatggtgtggactgtggaggcgggcagtcgcaatcacataagggaggatttaatattaaagacgctcgacaaagctcgaaaagaaaagaaagaaagaaagaaaacggcatccatcgacaaagtcacaagctgacacgaccgacacacgccgatgggctagctttaccagaaggaatcccatccgtccagtccggatccatgcctgattgactgggccaggccaatcatccgtgtagaaatgttcgttcgttacttgacagaaacgccaagaccgtaaagacggctacttagccctcatacatataagggcaactaaatgaaggatgtattaagagatctgtaaggtcttgttaatgacagttctctctggacttttgatgcgcgtcttccagagagctcgggatgtttttttataatcttcataaaagtaaagtttaaaattgaagatgagacgttaatgaactagctactacgtgtaaacgaatggcaatcgacactttggtgctttgggtgatgtaccaggcctcctacagagttgcaaagctcaggacaaccgtgctcggcattagtagttagtaccctgccggacgagcgtacgacacaaaccgtttgacagcaagtgagcgaaagaagtcatccaatccaacgtgccagcagcactcattcgacaaacatgcccgggattcaacaaattttcgtacaaaaatcttttcaaaaatgcgatctcaaactccaagacgagagacatgggtcccctgtgcctgtggcctgcgccacacacacattcctctccaccgtccccactcgctgccgacactccagtgtccagtcgcccacgtacccggcaccccgctgccgtgcccgtgctccatcccgctccgtgtcccaccaccacgcggccttcgctccctactggccacggtgtctcccgccgcagcggatcccaagggaagttccctggcctttccgtgcgtcactgctcgctctccgcctccacctcttttagtgcggccgcctgcctgggtggctcccgcccggccggcagccagccaggcccaggagcgcgagttctgtgcctgtgcctctgctccacctcccctgcccctgcgccccaagtccacgtccaccactcagcactcacgctgctcgctcgctcgctcgtacacgcgcccgcttcgcgcaggtgcgtgtagaacgacggaggcattccatttccgactgagccgtgtgtgtttggatcggacaacccctgccaaaaccgcgtgagccagcgctgttctgcctctgatcgtgtgtgctgctgttggttttggttttggttttggtttggctagggaaggaaccgtggtggggggagcggacggacatgatgcacgccaagtcggagtcggacgtgacgagcctggcggcgtcgtcgccgccgcggtcgccgaagcggggcggcggcgccggcaacggcggctactacgtgcagagcccgtcgcgggagtcgcacgacggcggctacaagtcctcgtcgatgcagcccacgccggtctacaacagccccaacgagtcgccgtcgcacccctcctacggccgccactcccgctcctcctccgtcagccgcttctccggcaacctccgcaagggcgccgccggggaccgcaaggtgctcaacgacaaggggtggcccgagtgcaacgtcatcgaggaggagggcccgtacgaggacctcgccggcgatagcggcctctcccgccgctgccagatcatactcggcttcctcaccttcgtcctcctcttcaccgtcttctgcctcatcatctggggcgccgcccggccgtacgagcccgaggtcatcgtcaaggtatacacaattagttccacgtccacccctaaattggagtctgagcaacctcagttcacttcttcttcttcttcagtttatgggataatagtcgttcctcttcctctctgtttggttgtttcctatctaatccctaaaccgagtaattgaccgctagttactaaatttgactcatgtctgatgtcccacggttccagcggtaggcgagatgggttacatcaccatccaattgattggtggctcagttggacagtgatatgttggacactaatgaggaacaagacagcaatgcagattgggattttacaattgcaagctgggtgtgggtgtgattttggttttgttgctcagatattgcggttgcgagtaagtggtgaacccgggggggctaattttgcggtagcttgttaagctctagttggagtatagattggttcatgacttcgaattgtataagttcagttgatgctctttttactgtataataacagactggtttctttgtgccaacattttccagttcctctgaaaatgaaaccaatgtctgttttatatctgcagaatcataaactaattaataatgagatctgatggaatcataaacgaatatctgttttatatctccagttccccaggtcttaaacaatggacctcactgaagactgaataaaagtcaaatataccaagtctcattgcagattaataatgagatctctgatgggatgttgctggctggcagtggcactgcatttagcatgctgacttttggggctgcattttgcaagaaaacaaaatcgcttcgatgatcaacacgcgtttatgattcgcactatttggcatggcaaaacttcgtttccgtagatctgagcgtggtgtttgccacagccacagatttctggcctgaaccacgaacttctctcgcttgtgttttgtgcagagcttggtgatggacgacttctacgcgggtgaaggcacggaccacagcggcgttccaacaaaattggtcacaacaaactgctctctgcacatagctgtctacaaccctgccacaatgtttggaattcatgtcacttctggccccatccacctgatgtattcagagatcccaatagcagtcggtcaggtatatccatcctccgtcccttggcctatttaatagcccgctttttagtgctgtcctcgcattgactgatgatccggctctgcctcgtgtcgagagagtaaactgcgcgaggagccgaatctcttcctttttacctctctattaacttcgccattcatttaagagaaactccactagcgaaacatttctcatgtgcttcacctttctatccataattccatccatatttgtcccatccatcgcatcaaagcctcaaaggtcgtcaaagatctgactaacggatgcgtaattccttgtcaagttaatcgtacaaaatgcatgatcgagttgaaaagttttgtttgtggggacaaaagaataaagacagtatgtatactagggctgcttcagcaatagacagtgctaatagtccagcaaatgttgttgcatgaatccttcctttcatttctggacatctgtttgcatcagttgagtcaaaagccagaattgctggtaatagtcattgaatctgacgtggctactgtgactgcgatcactctcaggttcggaggtattaccagccgaggaagagccaccggatggtgacggcggtcatccacggcgagaaggtgccgctgtacggcgccgggggcagcctgatgctgtcgacaagcacgggcggggcggtgcccctgacgctggacttggacctgacctcgcggggctacgtgatcggcaagctcgtgcgggtgacgcacaaggtgcacgtgacgtgccccgtcgtcgtggacgccaagaagaccaagcccgtcaggttctccaagaaggcctgcgccgtgtacagggcctgaacttcaaatgcgttttcgtaggctgcgatccgacggcgcattagcaacgcgcgtaggatgccgtgcctgtatttagttatcgtattggtggtgaagaacaataagctgcacacacatatggtctgtttgagccttttggttctgccgataaaaaaaaaaaaaaaacgggtgtcctc

SEQ ID NO: 7742 - DNA, 5704 bp, Zea mays
  misc_feature (599)..(599): n is a, c, g, or t
tcataccctaatggagtaaatacccatcgggtatcgggtcgcgggtacccattgccatctctaaccgggcgccaccccggcgcggctccccacgccacgcgtccgctctctaccggaccacgggtgtctccgggccgcagcggatccggagggaggttgccccccggcctttctgtgctcgttactgctcgctctcgctctccccttccgcctcttttagtgctgcgctgccgatgcggtgcccagcgagccaggcacggaggaggcgcgtgctctgctccactccacctccccccccccccccccctgcgccactgacgccgctcgttcgcgcaggtacgtgcagatcactggaggccttccatttctgtctccgcagctccgcccgcgagcgccggcgccgttctgcttctgaccgtgttgctgctgtcagttttggtcttctggccagcagggcagggggggaacccgcgggagcgaggcgcgcgagcgagcgagcggagggaggaggaggatgatgcacgccaagtcggagtcggacgtgacgagcctggcggcgtcgtcgccgccgcggtcgccgaagcggggcgttgccgcgnccggcaccggcggcggcggcggcggctactacgtgcagagcccgtcgcgggagtcgcacgacggcggcggcggcgggtacaagtcgtcgtcgatgcaggccacgccggtgtacaacaacagccccagcgagtcgccgtcgcacccctcctacggccgccactcccgctcctcctccgtcagccgcttctccggcggcctccgcgggggcggcggcggcgggcgcaaggtgctcaacgacaagggctggcccgagtgcagcgtcatcgaggaggaagggccctacgagggcctcggcgccggggacagcggcctctcccgccgctgccagatcgtgctcggcttcctcaccttcgtcctcctcttcaccgtcttctgcctcgtcatctggggcgccgcccgcccgtacgagcccgaggtcgtcgtcaaggtatttgtactatagtacacgattagttacgcgtccatctccattcccatctgtagatcgagtaactgacgcctatagttactaaatttgactcatgtctcccacggttccagcggtaggcgagacatcatccagttggggaaaggtggttcagttagacagtgaaatgttggaaatttaaaattgcatagctgggttgttttagttttgttgctgctcacatattggttacatgtggttacaagtaaattgtaaatcaggaacctaatcttgctcacatattagtcacatattggttactagagtagattggttcaaggcttcaagttatagaagttcaactgatgctttctactgaaaataacagactggttaatttgtgctaacacttcccagttcatctgaaaattaagccaatcgtttattttacttctggtagaatctgaaatgagaataaatggtgtttgctacaaatccgtcttttaaaaccagcgaacctctctcgcttcttttttttttgggtgcagagccttggtgatggacgacttctacgctggtgaaggcacagaccacagcggcgttccgaccaaattggtcacgacgaactgttcgctgcacgtatcggtgtacaaccctgccacaatgtttgggatccatgtcacctccggccccatccgtctgatctattcagagatctcaatagcagtcggccaggtattgtccagcatccatgcatcgttgcctcactttgctgcctgacgttactgttcgctgcacgtatcggtgtacaaccctgccacaatgtttgggatccatgtcacctccggccccatccgtctgatctattcagagatctcaatagcagtcggccaggtccgcaggtactaccagccgaggaagagccaccggacggtgacggcggtgatccacggcgagaaggtgccgctgtacggcgccgggggcggcctgacgctgtccacgagcgcgggcgggggggcggtgcccctgacgctggacttcgacctcacctcccggggctacgtgatcggcaggctcgtgcgggtgacgcacagggcgcacgtgacgtgccccgtcgtcgtggacgccaggaggaccaagcctgtcaggttctccaagaaggcgtgcgccgtgtacaaggcctgagcttgagagctcgtgaaacctgtgatcgaccgagcgttagcaatgcgtgttcttgcaaagatgtagctattgtgttgatggtgaagaacaataagcgcacacgtatggtcttgtcgatatatcgcgctgtaaaggcctgttgttcttgtgtgtgtatccctttttcagggcatgatcgtagagatggaagatgacttaccatgacaattttcctatacctttataacttcaattttttttattcaaaaaaaaaaaacttagccgcccaacctatcacaataatatacaaaaaactgcaagtactccagcgactctctccaactagacatagcgtcgtgagggcatgcaccaccgttatccatcaccggccgatgatcatgtcagcttcagctggcttttggcgcggttggagtgacaccgttcacagtagtcccagaacaacgtagtagaccaagccgatgggaagagcgattagcatgccaaatatgaccctgaggaagaagaaggaaaaaaaaggatggaaacatgtgaaccacagctacgtttaatggagcaagcaaccctgcaaaccaactgaagaaaggggagctgcttgtgtccagtcttacccggtggaaagaatggtggcgtgcaggctgtactctctggcgaacacgaagggcacgatcccctgcggcagagcagcctgcccatcgcgcgcatgcatggtggtggtaatggcattcattattttgctttttggctggcggcccaatgcgtgtgtgtaaaaaaaccgaatgcttcaaggtcccctagtccttacctgaacgacggcgacgcgcaggagcgtgccgcggaggccgacggcggcggacgtggcggccatgacggcggggccgaggaagaagcggattgccatggtgacggccgcgacggtgttcccgcaggcgatgatcttgggctgcaaggccatgaagagccctgcgccgcagcacaagaattgttgcaggacagcactacacgctgaagtaagcttaaatatagacatgttgcactgggaagagaagaactcacctaagctaaacatggccatgcctagccctgcatcggagagtatcgtgatggagttcttcactatggctggcatcgcgaagtggaatctgcagacaatgcaacatctttgtaagctaaacatggccatgcctagccctgcaaagatggagttatttgaatgcaagatggatgcaccagatttaaaatgtacccctttaagcacaagatatgttcacttctgatgcagaaaacgcaaataatgcactaggcgactggcagcttgattttaccggaacgagatgagagaccaggtgaggccgacgacgctggcgtacgtgttggggttgcggatcagccgccgccataccatcgtcacgatcagccgcatcatcacgccggccggcgccgccgcctgctgctctccggcgccgccatctcttccgcaggcgtccttccgctcggcctccgtcgagccggattccagcttggccagaacgatgtcctgcccggcgtccgccgggtaccccgtaacgacgcgctcccccggccgcatcgctgaaacaaacagaacccgcgtacgtacggtgcgtgcaggcgctgacgaccatcacaccagtgcttgcacgtttatggatcactgacctctcggaggcgcctcggaggggacgagccggcggggatccatgccgcggtggatgtcgccgccgtggaacaccggcaagccgcgcacctcccacgtcgcggacgcaccggagctccactcgaacatgtgcgcgtccctggggtcgttgctgggcgccaccgcggcggcagacctggcccgcaccgcctgctcctcgaagctggacggccgcggcgtcgggtgcagggagaagaggtccgccgcgccgaagctcgacatgcgcagcgacgacgcgccgtgcggcggcggcgcggcggcgcagatggcgtccgcgtgcgcgatgccgctggaccccctgggcgtggcattgcgcgacgagctcaccgagtagatctccacgcccgccaggttggacgggcgcggcgtcgccagcgaccgccgcgacgccgacgtggaccgacgcacgacgaggcgcacccggccgtccggcgccacctcggcctccgcctccgcctggctgccgcacagggacacgacgtccgggtccacgcgcacgtcggcgatgcgcgccgcggcgccgtccgggcactgccccgcgatgagcacccgcgcggcgcggaactcgtagaggacgagcaggagcgtgtaccacacgatgcactggagcaccaccacctgcaccaggaggtcgcccgagtaccgcccgtacatggccacgacgagcggtatccccatgatgagcgtgttgggcagggtggacagggagaagagcgtgatggaccagtcgaacggctcccgcagcttcgtgccgccgccgcagccgcgcgcgggcgggaggtgcgaccagacggcgagcgcggcgaggacgaggaccttctgcagcgtgtcggcggcgatgaagcggaggttcatcacgtacgggttgctggcggagatgcagtggaaggagaggagcggcacggcgaagacggcgacgaagcggttgatgccggagcactggtccggcgtcagcacgccccaccactgcacggagccgtacgccaggatcatcgccacgtacagcggcaccaccgcgcacagcaccgtgtacaggtcgtgccacgagatcatggcggccgggtgcgtccggtcgatcgacggggatgtctcgatctgacgatactattgagtgtcgcaagagggagcgggaggtttgttgagtcttcttggccgagagagactgaacgagtcagtccattgcatgcgaagagccaggtagttttgtgatggaccgactactattagctttgtgctgccaagtcacttagagctgatttagtgaccagagatcacggggagatcggaggggattaattttccccttaatcttctccaatcctcccgtgaccccttatcatcaaatcaacccttacaagtatttgtttacatgagttagttacaattacggatacacgctacgtgtttctgctaaggagtcaggacttcccatgttatgaggagagcgagtcgaggcgtggtaatggatcatgatctaaatgcttcttcacaaaatggtaaggttctaaataatttttagtttaaaaatgaatagaaatagagtttgatcctaatctgatccgatacttaaatcttatagtgtaaaatttagagcccattatcacccctacatataccatgtacaactccattgtttttctcgaatgacacattcatagttttaggtgttttgataggcaaatagccctcaaataaataaccagaaactcgcacacacaagacaaacacagtgggtttggtgactggactgacttagccctttctgaatctctctctctctctctctctctttctctaggcaa

SEQ ID NO: 7743 - DNA, 1456 bp, Zea mays
cattgggtacctcgaggccggccgggactgtccagccagccatccaggcccaggagcgcgagttctgtgcctgtgcctctgctccacctcccctgcccctgcgccccaagtccacgtccaccactcagcactcacgctgctcgctcgctcgctcgtacacgcgcccgcttcgcgcagggaaggaaccgtggggggggagcggacggacatgatgcacgccaagtcggagtcggacgtgacgagcctggcggcgtcgtcgccgccgcggtcgccgaagcggggcggcggcgccggcaacggcggctactacgtgcagagcccgtcgcgggagtcgcacgacggcggctacaagtcctcgtcgatgcagcccacgccggtctacaacagccccaacgagtcgccgtcgcacccctcctacggccgccactcccgctcctcctccgtcagccgcttctccggcaacctccgcaagggcgccgccggggaccgcaaggtgctcaacgacaaggggtggcccgagtgcaacgtcatcgaggaggagggcccgtacgaggacctcgccggcgatagcggcctctcccgccgctgccagatcatactcggcttcctcaccttcgtcctcctcttcaccgtcttctgcctcatcatctggggcgccgcccggccgtacgagcccgaggtcatcgtcaagagcttggtgatggacgacttctacgcgggtgaaggcacggaccacagcggcgttccaacaaaattggtcacaacaaactgctctctgcacatagctgtctacaaccctgccacaatgtttggaattcatgtcacttctggccccatccacctgatgtattcagagatcccaatagcagtcggtcaggttcggaggtattaccagccgaggaagagccaccggatggtgacggcggtcatccacggcgagaaggtgccgctgtacggcgccgggggcagcctgatgctgtcgacgagcacgggcggggcggtgcccctgacgctggacttggacctgacctcgcggggctacgtgatcggcaagctcgtgcgggtgacgcacaaggtgcacgtgacgtgccccgtcgtcgtggacgccaagaagaccaagcccgtcaggttctccaagaaggcctgcgccgtgtacagggcctgaacttcaaatgcgttttcgtaaagctgcgatccgacggcgcattagcaacgcgcgtaggatgccgtgcctgtatttagctatcgtgttggtggtgaagaacaataagctgcacacacatatggtctgtttgagccttttggttctgtcgataaatcgcgctgtacggcgggtgtcctcttgttcttgctaaaaaaagagaaaatctttctgcggctccagggcgcgatcctagagacgggacggatggctatttttatttattattttcttaaagttagaaatattttactc

SEQ ID NO: 7744 - DNA, 1462 bp, Zea mays
ctcttttagtgctgcgctgccgatgcggtgcccagcgagccaggcacggaggaggcgcgtgctctgctccactccacctccccccccccccccccctgcgccactgacgccgctcgttcgcgcagttttggtcttctggccagcagggcagggggggaacccgcgggagcgaggcgcgcgagcgagcgagcggagggaggaggaggatgatgcacgccaagtcggagtcggacgtgacgagcctggcggcgtcgtcgccgccgcggtcgccgaagcggggcgttgccgcggccggcaccggcggcggcggcggcggctactacgtgcagagcccgtcgcgggagtcgcacgacggcggcggcggcgggtacaagtcgtcgtcgatgcaggccacgccggtgtacaacaacagccccagcgagtcgccgtcgcacccctcctacggccgccactcccgctcctcctccgtcagccgcttctccggcggcctccgcgggggcggcggcggcgggcgcaaggtgctcaacgacaagggctggcccgagtgcagcgtcatcgaggaggaagggccctacgagggcctcggcgccggggacagcggcctctcccgccgctgccagatcgtgctcggcttcctcaccttcgtcctcctcttcaccgtcttctgcctcgtcatctggggcgccgcccgcccgtacgagcccgaggtcgtcgtcaagagccttggtgatggacgacttctacgctggtgaaggcacagaccacagcggcgttccgaccaaattggtcacgacgaactgttcgctgcacgtatcggtgtacaaccctgccacaatgtttgggatccatgtcacctccggccccatccgtctgatctattcagagatctcaatagcagtcggccaggtccgcaggtactaccagccgaggaagagccaccggacggtgacggcggtgatccacggcgagaaggtgccgctgtacggcgccgggggcggcctgacgctgtccacgagcgcgggcgggggcgcggtgcccctgacgctggacttcgacctcacctcccggggctacgtgatcggcaggctcgtgcgggtgacgcacagggcgcacgtgacgtgccccgtcgtcgtggacgccaggaggaccaagcctgtcaggttctccaagaaggcgtgcgccgtgtacaaggcctgagcttgagagctcgtgaaacctgtgatcgacggagcgttagcgatgcgtgttcttgcaaagatgtagctattgtgttgatggtgaagaacaataagcgcacacgtatggtcttgtcgatatatcgcgctgtaaaggcctgttgttcttgtgtgtgtatccctttttcagggcatgatcgtagagatggaagatgacttaccatgacaattttcctataaaaaaaaaaaaaaaaaaaaaaaaaaactcgagaagaggccgcggtacc

SEQ ID NO: 7745 - DNA, 733 bp, Zea mays
cattgggtacctcgaggccggccggggtccagccagccatccaggcccaggagcgcgagttctgtgcctgtgcctctgctccacctcccctgcccctgcgccccaagtccacgtccaccacttagcactcacgctgctcgctcgctcgctcgtacacgcgcccgcttcgcgcaggtgcgtgtagaacgacgggggcctcccacgcccccccgagcccggccggtttggatcggatcggacaacccctgccaaaaccgcgtgtgccggcgctgttctgcctctgatcgtgtgtgtgctgctgttggttttggtttggctagggaaggaaccgtgggagggaagcggacggacatgatgcacgccaagtcggagtcggacgtgacgagcctggcggcgtcgtcgccgcctcggtcgccgaagcggggcggcggcggcgccggcaacggcggctactacgtgcagagcccgtcgcgggagtcgcacgacggcggctacaagtcctcgtcgatgcagcccacgccggtctacaacagccccaacgagtcgccgtcgcacccctcctacggccgccactcccgctcctcctccgtcagccgcttctccggcaacctccgcaagggcgccgccggggaccgcaaggtgctcaacgacaaggggtggcccgagtgcaacgtcatcgaggaggagggcccgtacgaggacctcgccggcgatagcggcctctcccgccgct

SEQ ID NO: 7746 - DNA, 824 bp, Zea mays
  misc_feature (772)..(772): n is a, c, g, or t
tggtcaatcaaactgttctctgccatagctgtctacaaccctgcccaatgtttggaattcatgtcacttctggccccatccacctgatgtattcagagatcccaatagcagtcggtcaggttcggaggtattaccaaccgaggaagagccaccggatggtgacggcggtcatccacggcgagaaggtgccgctgtacggcgccgggggcagcctgatgctgtcgacgagcacgggcggggcggtgcccctgacgctggacttggacctgacctcgcggggctacgtgatcggcaagctcgtgcgggtgacgcacaaggtgcacgtgacgtgccccgtcgtcgtggacgccaagaagaccaagcccgtcaggttctccaagaaggcctgcgccgtgtacagggcctgaacttcaaatgcgttttcgtaaagctgcgatccgacggcgcattagcaacgcgcgtaggatgccgtgcctgtatttagctatcgtgttggtcgtgaagaacaataagctgcacacacatatggtctgtttgagccttttggttctgtcgataaatcgcgctgtacggcgggtgtcctcttgttcttgcgtgtgtgtatctttcttttttcagggcgcgatcctagagacgggacggatggctatttttatttattattttcttaaagttagaaatattttactcaatgaacaatgagaacgacacttattttagaaccttggacatgggaattcaactctaaaaaacacctggtcctttgaataangggtttggatttttttttccctggcgaaaaaaaaaaaaaaaaaagcggccct

SEQ ID NO: 7747 - DNA, 1610 bp, Zea mays
agagcaccagctcaccgccccaccgattcaaaggcgctcggatcctctgacgtcgacgttccctgccagctcccggctgccgccctcgctccttccgccatctgcgctgctctgcggcgccagagccggcgcccgcccgctgccgccctcgacggaccgggacacggggccccaccgttctctttcctgcgctgcgctgcgcggcggctgtgctgctgatcagttaatgtgcctgtgaggctgtgacaggcggcgtcgagcgagtccgaggcgggctaactaaacccgccgtctctcgaggcggcgcccgcggagggccaggtggagggccgaggaaggtggaggcggtgaggcgatggggggcgccaaggcggaggacaagcccgccgccgccaccgctgaagacgattggtgttaccagtttggaaacaagaatgcgtttgactcgaaggccccgaaaaaatcaccacttgcattgagagtggttgtctttgccatgactgtgttatgtgggatatctatttggtcaatgtgtatgaagcagctagggagtgatggctggtcaagaatagtgaagatcgaagttgtggaacaaccatgtaataagtctacagttcctccttctgaggttcaatttgcgcattaccctcaaccgacaacttacagcagggtctcgtggcgaatcacgtggccgtagtggactacttcaatcgaagaggagtctctgcaatatttctcttcagaaggaatctgctccgccagttggtatcacagctagcgaataaccacgacagattcctgaagcagttaaacggaacacacaaggcgcatgtccacacagagcatgaggcccatatactcgcgagatacaagcccaggctgaacacgtcgtcgctaatacggaaactgaaacaggctgatgagtacactcgcgacgcccttgagaacctaaataacacccgccacatcactgtctactacgaggacatcgtccgcaacagaacaaggcttctcgacgccctggatttcctcggagtgccgaggagggagctggcgagtcggcacgtgaagatacacacgaagcccctgtcggagcagatcgagaactgggacgaagtctacagcgccctcaacggtacccagtacgagggcttcctgaatgccgctgactatacgtaatatgacgtcacggtctccacgtctcttgatgtagatgtaggtgtgtaggtatagcgccccagctgtgactccttttgttcttgttttcgagtagccggccggccttctgcgtgcctgcctggcaggagttttgatgcgggggatggaggcgctttgccatggttgcgttcgagctcctggctagcccacccactagctttcctcatgtccatgtaacgaccctcgagcttctctcatctttggccgtccgcttgtaatgcttgtcgtcagtgatctcacccatgtcatgccatgccatgccatgccttcgagggacaaagctgtgcacttgaacttgaggcttgtcttttcattgggtgtttgcggtgggcaagcaagacgctgcagttaaggattattggaaggtggaaggacttgttggagttgctctt

SEQ ID NO: 7748 - DNA, 2499 bp, Zea mays
  misc_feature (147)..(147): n is a, c, g, or t
aactgatgatgagatgaagattcgagtcgtacgataagtaataaccagtaaaaggctcatacttaagcggtgtttggtttttagttattaatttttaatcctctaatttattttattttagtctataaattatgaaaaataaaatanagttttagttttttattagataatttagagactaaaatataataaggagatgtttggtttttagagactaatttttagtccttatattatattctattttactctttaaattaccaaatacgaaaactaaaactctattatatatttagcaatttagggattaaataaaataaaataataaaactaaaaattagtccatataaatcaaacaccctctaaaataaaatgaaaggactaaaaattaagcttcttctccgaccaagtggaccatgcatgcttgcattgtatcgttcattcttactgcaaaagcgcccatatagcagcatgcaacctggcatccatgtgctcgagcacgcaagcacgtactcgtagtacttgcatatctactgatcgaggtgtgcatgcacagcacgaaataaatgcagatcgccaagaggatcaaaaattgaattcagcttgatccgatccgtctagacggacagcgtggattcgagtaatttcccatctacaaaaccggcgcccgagcatctcctttgtgaccaatgaataactcatgcgcggttcctgttcgttcgcgcctataaaagccatggcgcagcagggtcgatctcctccactacacacaaacacacaatggcaccagaaaggatgctcctcggcgtctgtgccgtgctgatggtggtcggcgtcacgaacgcggcggagggccaggtggcgtcggtcgtcgtgggcctggcgaggtgcgccgacagcacgaggaagaacatgaaggctgaggccggtttcaagggtaagcacgccgcatgcgtcgttactttacgcgcgcggtgtgctttctgctttgcatgcatgcaacacgcaatgcgatacattttcatgcatgccacggtttcgtctacctatgactgaaaagacacactagctagctagctagtatatgtactagctaggaccaaaattcgcaacacaccaatctcgatttaatatgaaaaaagagacgaggtaaaatgaattgatcacgtgttgtcgtctcgctcaggtggatcactagaagtagtataatagtaacaaggcatctggagtgtttttaattttatttatttatggtcctcaggtcttcaggtggcgatcaagtgcaagaacagcaacggcgagtacgagacaaaggccgtgagtgagatccaaagctccggagccttcagcgtcccactcgccgccgacctccacggcgccgactgccacgcgcagctccacagcgccgccaataacgcgccttgccctgggcaggagccgtccaggatcgcgcccatgtcaggcggcaccttcgtcgccgtgcctggcaagatgcactacccgtccgcggagtgcgcgtccgcgtttctctgctccccgatcaagaagcacttgttagatcacttccacaaggcacccctgccggtgccggagtaccacccggtgcctgaccacagcaagccgccggtgccggagtaccacccggtgcctgagcacagcaagccggcgccggagtaccaccctcccacgccggaataccaccctcccactccagtgtacgggcagccaaagccaactccgatctaccatcctcccgctgagcactgagttcgatcaacaacgaacgccagagctagaagaacggcaggcttctgttagttattaattcagtactgcacgtgttactagtgcgcctcatgcatggagaataaaatggtgtgaaatatagctgggagcttgtactttattagttatcgattgttgtttatctttaacttgcttaccgaaatcgtgttgtgcatcttgtctttttgtcaatgtaagcagagcctgttctcagtcctaaaaaaaaaaaaaaaaaaaacaacactaaggcaaggaatttcaaaaaaaaaagttaacaacaaaatatttataaatatttactaaataaagataaaaaatattagatttattattaaaacatctaccacaatatataatttttgtgatttaaaataattattttttatagatattatttgtcaaagttttaaaatattaatttaggataaatcttcgtgaccttaagataaggaacagaaggagtaatccgtttcttcagttttaaatatcaaaggattacaatgatctttctgttacaaactcttactctctctgttccaaaatatttgtcgttttagctttggtttttatgtctatattcaaatggatgataataaatctagacatatctaaacacatatacaaaatatattgttggggacttgttctcaaatgctataagttaacaacaatgcaacacaaaaaatgttaaacgttaaagtccttcgtccttcg

SEQ ID NO: 7749 - DNA, 1043 bp, Zea mays
cattgggtacctcgaggccggccgggaaaggtaacggagtgggccgcggcccgggccggcactacacacaaacacacaatggcaccagaaacgatgctcctcggcgtctgtgccgtgctgatggtggtcggcgtcacgaacgcggcggagggccaggtggcgtcggtcgtcgtgggcctggcgaggtgcgccgacagcacgaggaagaacatgaaggctgaggccggtttcaagggtcttcaggtggcgatcaagtgcaagaacagcaacggcgagtacgagacaaaggccgtgagtgagatccaaagctccggagccttcagcgtcccactcgccgccgacctccacggcgccgactgccacgcgcagctccacagcgccgccaataacgcgccttgccctgggcaggagccgtccaggatcgcgcccatgtcaggcggcaccttcgtcgccgtgcctggcaagatgcactacccgtccgcggagtgcgcgtccgcgtttctctgctccccgatcaagaagcacttgttagatcacttccacaaggcacccctgccggtgccggagtaccacccggtgcctgaccacagcaagccgccggtgccggagtaccacccggtgcctgagcacagcaagccggcgccggagtaccaccctcccacgccggaataccaccctcccactccagtgtacgggcagccaaagccaactccgatctaccatcctcccgctgagcactgagttcgatcaacaacgaacgccagagctagaagaacggcaggcttctgttagttattaattcagtactgcacgtgttactagtgcgcctcatgcatggagaataaaatggtgtgaaatatagctgggagcttgtactttattagttatcgattgttgtttatctttaacttgcttaccgaaatcgtgttgtgcatcttgtctttttgtcaatgtaagcagagcctgttctcagtcctactctcccctttcacgaaggtattactaactcaatttttttcaaaaaaaaaaaaaaaaaagccagt

SEQ ID NO: 7750 - DNA, 1068 bp, Zea mays
cattggcttcccccagggcgtcccgggccccggccggccggccgtacactgtacacacacaagctatagctagctatagcttgcagcaccatggcagcaggaaggatgctcctcggcgtctgtgccgtcctgatggtggtcaccgtcacaaacacggcggagggccaggtggcgtcggtcgtcgtgggcctggcgaggtgcgccgacagcacgaggaagaacatgaaggctgaggccggtttcaagggtcttcaggtggcgatcaagtgcaagaacagcaacggcgagtacgagacaaaggccgtgagtgagatccaaagctccggagccttcagcgtcccactcgccgccgacctccacggcgccgactgccacgcgcagctccacagcgccgccaataacgcgccttgccctgggcaggagccgtccaagatcgcgcccatgtcaggcggcaccttcgtcgccgtccctggcaagatgcactacccgtccgcggagtgcgcgtccgcgtttctctgctccccgatcaagaagcacttgttagaccacttccacaaggcacccctgccggtgccggagtaccacccggtgcctgagcacagcaagccggtgccggagtaccacccggtgcctgagcatagcaagccggcgccggagtaccaccctcccacgccggaataccaccctcccactccggtgtacgggcagccaaagccaactccgatctaccatcctcccgctgagcactgagttcaacaacgaacgccagagctagaagaacggcaggcttctgttagttattaattcagtactgcacgtgttactagtgcgcctcatgtatggagaataaaatggtgtgaaatatagctgggagcttgtactttattagttatcgattgttgtttatctttaacttgcttaccgaaatcgtgttgtgcatcttgtctttttgtcaatgtaagcagagcctgttctctgtcctactctccccgttcgcggccctccttagagcaactccaatagttatgtaaattttagctctctaaatcacagatttaagaagttgct

SEQ ID NO: 7751 - DNA, 1033 bp, Zea mays
gaaaaagaggagcaccactcgtggggtggttaaaaccccgagaacaaacttgggggccgccgcggccggccggaagcgagcggagaccgaggggagaggggtgaagaagcaacgagacgcagcgagcaagcgaaagcataccagagcaccaagcataggggcgcgcgcgcttctccagttctccctccctgccctgcaaggcggctgcaactgttccagctagcccctctcccagcctctgcgtcgtagacgtggtagtagcagccgcagcagcagaagcggcggcgagcatgctcttggcacccctccccggcgccgggcggatctgccggagggcggcggccggggcgcttggagcgcggcgctaaccgcgttcgacggacctcgggatctgacgccgcgcctcccctaatcggtcgactccatcggtggcggcggcggccgaggcgccagcagccgggtctctcggctccgggacaagataagcttttgctctgcgcattcgcgctgctcaaacatcgtagccagccacaccaagcaactgacttgtgctcctctgattgtacaagggaaagattgcgcttgcgcttgcttgggcgccggccgcgccggtggcggtaatcttcgagagccgcggtcgcggcgcgcggtgaagagaaaaaaaggtgtgtgtgtgtgagagagagaggaggctccctgccctctcgcggtgacttggctaggagggggagggactgggaaatcgaatggttttcgggaaggcgctgtcatatggcctggaaaggaggaacctttccttcctcttcccgtcttttgccggctcttgtgccgccctcagataggcgacccggttgtttcttcggcaacgggggcaaatcaggctctcgtcgtcgtccggcagcgtccggccggctcagccgggctcgccggaaggtagtcatatgcgtgctgtgctgcgcagaaaacgctatatctcgctgttgtcttgttcattaatgcacgtctttccccgctcgttggattcctcttccgc

SEQ ID NO: 7752 - DNA, 7628 bp, Zea mays
ggacgagcgactgagcttgtcgtcgtcgtcgttcctcgagtctgtctgtgctggccgcccttgttttatgaatgaattttggacatctccgaacgagatatatatatttgctatacgaatctgtgtcaaggtgtccccgccgtgcaaaggggaaaataataatacttatgactatgatgatatgtataaaataaaatggaagggtaggctgggtcaggtcaacgattcctgacatgctagaaatagcatggaccaaggaagaagcccgtatgtcgttcacctgcacgacacgaccacggatataggagtcacaattgctgtactgtaatagccgcgtagtaatggactttatattattactttcttagaattagaaggaaaaaaagtgagagaaaagattccccaggtcgaggcgtagagccatcgcccatcggccggcatcacgaggacgacgaccgagcagctccgagtcatcatcacagtgcccagccagcccaaagcgtggtgttaattctcaggttccggattccctgtacgctcctcgtataggaggacgcgcgtataatacgccgcacggtctcggtcgtggacgcctctgtcttcagctgttggtcgacaggaacagttccgctccggtccactggaacgagaagaaagagaaggaaaggaaccaaccaaaacgtgtgcggctcgcggccggcgccgccgatcgccatcgactgatccgtccgtctcgcctccgtcggcgtcgccctggtggttgcctggatggatcttggacgtggctcgtgagccaggaagggagtactagggaccatatgggctgccatttctgcgtcccagcaggttcgttcccgcggttattttacttttggcttctgccatttctctgtttcggctcaggcacttcattaacagctcacgttcctttcactttcaccgttttctatcggcgacggcgggctattggcgtgcaggtttcattgacgacggcgggctatttactgcagtgctatagctgcagctactactctaccagctagcactagcagcaggttcgatgctgagctcaggcttcagacacgggtggatggatggatcgtcgtcgtcagtgaggttgctgtcggcgaattttactgcgactatgcagccagtcaccagtccaatcaaaatttaccacaggcagacgtacacgtgcgtgcaggcatcgtactcgtacggtactactactaccacagccttgcaagtcaaaaagaagaaagtgttggaggggagagcgagtagtagtagagcaggacgattcctgcactcgccaacagcatgcgactacgagctgcttctcacgctagcactctgctaccggcacagcacagtaagtacatggcaacggcatgctaatcttgcttccgtaccagtcagtcagtgcaggcataataggagatcagtgagacttaagcacctgccaggcatcaatcagcacgccacaagatgaggacgtgacggggggggtcgggagtgcggcacgcggagcactgtacatgtgcgactgcacgtcgcgcgcggcgcagcgcagcgcaggcacagagccactgaaccagtagccgtactctacagaagcaaggacatagagaattgacaagaaaaatcacgcaagggaggagagagagaaggggggagcatagcataggcatagcaagagcaaagctgaaaaagaggagcaccactcgtggggggttaaaaccccgagaacaaacttgggagtagcagcggccagccggaagcgagcggagaccgaggggagagggggtgaagaagcaacgagacgcagcgagcaagcgaaagcataccagagcaccaagcatagggacgcgcgcgcttctccagttctccctccctgccctgcaaggcggctgcaactgttccagctagcccctctcccagcctctgcgtcgtagacgtggtagtagcagccgcagcagcagaagcggcggcgagcatgctcttggcacccctccccggcgccgggcggatctgccggagggcggcggccggggcgcttggagcgcggcgctaaccgcgttcgaaggacctcgggatctgacgccgcgcctcccctaatcgatcgactccatcggtggcggcggcggccgaggcggcagcagccgggtctctcggctccgggacaagataagcttttgctctgcgcattcgcgctgctcaaacatcgtagccagccacaccaagcaactgacttgtgctcctctgattgtaccagggaaagattgcgcttgcgcttgcttgggcgccggccgcgccggtggcggtggtcttcgagagccgcggtcgcggcgcgcggtgaagagaaaaaaaggtgtgtgtgtgtgagagagagaggaggctccctgccctctcgcggtgacttggcgaggagggggagggactgggaaagcgaatggttttcgggaaggcgctgtgatttggcctggaaaggaggaacctttccttcctcttcccgtcctttgccggctcttgtaccgccctcagatcggcgacccggttgtttcttcggcaacgggcggaaatgaggctctcgtcgtcgtccggcagcgtcctgccggctcagccgggctcgccggaagctgcgccggtgcccgcgcgcctgcgccgacttcgatttctctcgctgttgtcttgttcattaatgcacttccttccccgttcgttgtattcctcttccgtattgagtttcacttggagttgtaggactgctatttggtttctgttttgttactaaatgcctctgctttaaacctgctctgtggccgggtgatcccgtagcagcgacccagcgccgacgtgtttgatttgcgaggtttatctggatttgttttgatggtttcttttgaaggtgttgctgtcacaaactggaaaccgtttgttctttcgattttggtccttttgtctactagttcttgctgcatgttgatttcatgatatttctccgactgttttttttttcgattaagctgtaaaaatagttcccttgtccctccagtttaaggacacttattataagttaacaccccatcttgattctcaattttttgcacttagaattggaatttatgtagtaccatctactttctgaaacatttttttttgttggcataagcctgtccccagttttgttctcccttgatatttcgttgctgaagaaacttgcagtactgaatcttgtgctcaaaacaaacaaatacttgtgccattacagctgtggaggagcacaagtgcctgaactcggagttgtggcatgcttgtgccggcccgcttgtttccttgcccgcggtgggtagccgagttgtgtacttccctcagggccacagcgagcaggttagtgcacaatgctcaccatgcccgtgaatcctatgtcctcttccagttcggctgtcaagctcgaacccccaattagcctctgcctgtattttcaagactccagaatttctccctgttttacaaagttcttggtgaatttctactgcaggtagcagcatcaacaaacaaggaaatagagtctcagatccccaactatcctaatctgccgccacagcttatatgccaacttcataatgtgacgatgcatgtaagcttggagcctcggaacactttctccttaagccgggtaaccttagttttctgtttcattatctgtgtttttttctcttctttcaggctgatgcagagacagatgaggtatatgcacagatgacactacaaccactcaacccggtaaattacattgtttctgcctatttgtgccatataacatgcaaacttctcttgggatctacggagagtaatctttggcttgctttttgtgcagcaagaactgaaggacccatatttacctgcagaattaggttcggccaataaacagccaacaaactatttctgcaaaacattaacagcaagtgataccagtacccatggtgggttctccgttccccgtcgagcagctgagaaagtgtttcctccactggtatgtgctacttctctcaagtttcaagctcattatttatgttgattttgttgcagaaagtgaacttctcaaatatttatgtttccttagatttatctaatttgccaaatactatgtaggatttcacccagcaacccccatgccaggagttgatggcaaaagatcttcatggcaatgagtggaaattccgtcacatctttcgtggtgagcaatttttcttttttccttttcactcttttcgctgtgcattcaacagtaagggctattgcataaccttcaaaataccgtccttgatgcaggccagccaaagcggcatcttctaactacaggttggagtgtctttgtaagtgcaaagagactcgttgctggcgactctgtcctttttatctggtatgttctgatgttcatactttaggcattccaaacactcacttgtcctctctctcttttgtctcctgcccatcagatagtttctttttggttgattttatgtctcattgccttgtcaggaatgacaataaccagcttctgctgggaattcgtcgtgcaaatcggccacaaactgtcatgccatcttcagtcttatcaagcgatagcatgcatatcggtcttcttgctgcagctgctcatgctgcttcgacaaatagccgatttacaattttttacaacccaaggtagaacatttgtagtcacttattgtttggacgtttttcctgtcaattgttttaacagttgcttttgcagggcaagcccttcagagtttgtcataccactcgtaaagtatgttaaggctgtgtatcatacccgcatatctgtggggatgcgattcaggatgctttttgagacagaagagtctagcgttaggaggtaagttcaaatctgtttgcaacttcaccttgtatgtttaaactgttagttaatttgccattttaatttttctttctctaccattttcctacacattgcctttgtctattttttagtactgtattcgtcatgatctgtgctccagttcacatgtcaatatacctctttccttacactgaatattgaactaccgtatatgcaatcataagttgtatgagcagtctaaccagatcaaatgcattcaattccagatacatggggacaattaccggaatctgtgatcttgattctgttcggtggccaaattcacactggcgttctgttaaggtatattttgggcctgtgcttctcttgtttcttctggttactacatgcccttgtcaaccatttctattgcaaattttcagttgaaaacgatactactacagtactcccttaatgtttgttctcccagagatacctacttcatggttttgtatgatcacaaattttacctgtgaatgaatataggttggctgggatgagtcaactgctggtgagcgacaaccaagggtgtcactatgggagattgaacccctgacaactttcccaatgtatccatctccttttccgctcaggctcaagcgtccatggccaacaggcttgccttctctgcatggtatgaggtgcagttatgtttagctagcctttgttagatatgttagcttatcaaataattctgcaatatgcattatatcgccaataacctttcttgtcatgtctatccataggtgggaaggatgatgacctggctaactctctcatgtggcttcgagataccgcaaatcctggttttcagtcgttaaattttggtggacttggtatgagcccttggatgcagccaaggctggatgctaccttacttggtctgcaacctgacatgtatcaggcgatggccacagctgcttttcaggatgcaacaaagcaggcatcgcccacaatgctgcagttccagcagccccagaacatagctggccgggcttccccgcttctttcaagtcagattttgcagcaagcacatcatcaatttcagcagcaaccgtaccttcaaaacatctctgagagcacaatccaagcacagggtcagtctgagttcctcaagcagcagatccaacgcagccagtcattcaatgagcagaagccccagatgcaacaccagcaagaatcacagcagcagcagcaaccacagtgtctgccagtcccccaacatcagcaaatgcaacaacagaatatgaccaactaccagtctatatctaatgcattatcaccgttttctcagctgtcgccagtttctcagtcttcacctatggcgctgcagactatattaccgttctcgcaggcacagagcttcacagacacgaatgtaggttcattgtctccatccaatggtaacaccatgcaaaacacactgaggccgttctcatcagaagcagtttctcacctcagtatgccgaggcccactgcgatacctgtcgcagacccatggtcgtcgaagcgtgtcgcggtggagtctctgcttccttctcggcctcaggtttcatcccagatggaacaattggaccctgcaccagctagtatacctcatagctctgcgttggcaccacttcccggaagagggtgcttggttgaccaagatgtgaactctgatcctcaaaatcatctcttgttcggtgttagtatagactcgcagtcactgctaatgcaagggggcattcctggtctccaaaacgggaatgattcagctgctataccttattccacttccaatttcctcagcccttctcagaatgactttcctctggaccatacactaaattcttcaggctgcttagatgattctgggtacgtcccgccatgttcagataattctgacaaagtgaaccgaccaccagcgaccttcgtgaaggtttacaaatctggaacctacgggaggtcgcttgatatcactaggtttagcagctatcacgagctccgtagggaactggggcgcctatttggccttgagggccagttggaagacccattgagatcaggctggcagcttgtattcgtcgaccgtgaggaggacgtccttctcgtgggcgacgacccttggcaggaattcgtgagcacggtgtcctgcataaagatcctctccccgcaggaggtgcagcagatggggaagcagggcctggagctcctgagctcggcccccgcgcggaggctcggtagcagctgtgacgactacgtcagcaggcaggagtcgagaagcctgagcaccgggatcgcgtccgtcggttcggtcgagttgggatgagcagcaagatagcgcgcacgcagcagcagcagcagcaggttacgcatcctcagcctcagggtaggtaggggactgaagggttggtctgcgacttgatgacccacgagctcctcgttgcgcgcttcgttcgcctccatgcgatggatagaagttcagcgcagaccaagccttagctctgcgagctatgtaccatctaataattctgtccgtgtcgtaccatgtcaactcctaagtagaagaattgaagaaactaccagcagccgctgtctggtatacacgctgaaacattttttttcttgtatggagaaatactaatcatctggatgtagccaggcctatgctctctaaaaaaagaaaaaaaaaaacagcccctcgcacaaaaaaaaaaaa

SEQ ID NO: 7753 - DNA, 1748 bp, Zea mays
acagttctcacaaccaaccggtcgccggcgtccataaaacccacccccctcccctcccacctcgaggcggcggcgcgcgccatttcaattcgggcgagagaagtgtctgaaagttgacatttcaatttggccgcccagtccagtcgtcgccatggcgacctacgacaaggcgatcgagtcctacaagaaggcggtgaccacggcggcgtcgctggcggcgtcggcgatgctggtgcggggcgtggtgaacgagctggtcccctacgaggtgcgggacctgctcttctccggcctgggctacctgcggtcgcgcatgtcgtcgcggcacacggtggtgatcgaggagacggaggggtggaccagcaaccagctgtacgacgcggcgcgcacgtacctggccacccggatcaacaccgacatgcagcgcctccgcgtcagccgcgtcgacgagggcaagagcctcatgttcagcatggaggagggggaggagatggccgacgtgcacgccggcgccgagttcaggtggcgcctcgtctgccgcgacggagccggcaacggcgcgggcaacggcgccggcaacggccacggccacggccacgcccgcggcggcagctaccgcgtcgaggtccgctccttcgagatgagcttccacaggcggcacaaggagaaggccatcgcgtcctacctcccgcacatcctcgccgaggccaagaagatcaaggaccaggaccggacgctcaagatctacatgaacgagggcgagtcctggttcgccatcgacctccaccacccgtccaccttcaccacgctcgccatggaccgcaagatgaagcgggccgtcatggacgacctcgagaggttcgtcaggaggaaggagtactacaggcggatcggcaaggcctggaaacggggctacctgctctacggcccgcccgggaccggcaagtccagcctcattgccgccatggccaactacctcaagttcgacgtctacgatctcgagctcaccgaggtcaactggaactccacgctccgcaggttgctcatcgggatgaccaaccgctccatcctcgtcatcgaggacatcgactgctcgctcgatctgcaacaacgtgcagacgaagctcaggatgctggtaccaaatccaatccttcagaggacaaggtgacactctctgggctgctcaacttcgtggacggcctctggtcaacaagcggagaggagaggatcatcatcttcacgaccaactacaaggagcggctcgacccggcgctgcttcggcccggcaggatggacatgcacatccacatggggtactgctgcccagagtcgttcaggatcctggcctccaactaccactccatcaccgaccacgatacgtaccctgagatagaagccctgatcacggaggtgatggtgaccccagcagaggtcgctgaagtgctcatgaggaatgaagaccccgacgtcgcgcttgagggcctcatccagttcctcaatgggaagaaagaccacgccaaggatgatagtcgtcaaggttaaaatgtggaccatgtgagaccaaaggggacgagaaagagacgacgacgaaaaaaagaaaaaaaaaacatgtcccggtcgtcgatcaaaatctcaatgatgccagagtagcgtggatatcaaatatcagcaccatatcagtagcgccagtataacctgccgacaatgtatggttttcatattttaataagatatcatttttttttgg

SEQ ID NO: 7754 - DNA, 1422 bp, Zea mays
tacccctgttggatttgttgtcatcatataaggatgtcaaaatcatacaattctcatctatggttgatgccttcggtggttttgctgatgcagtaagctgctatactcttatacatgttgcctaattttctggatataagtttccaccttataatgcaaattactgaaaccaggctgtggagaagaagttccgaaatcgtgtgaacaggtatgtgggcctatggtgctgtgtggagttccgtgatattggtcacatatattatgacatgtactgggacgagaaaccagggtggaagccacaccctccagagactagggaacaggatcatccaccttggtcatgactactgacaagaagatgctagaaagatcgtgatgatgaagatctgagatcttctagggcaccctgctccaatcgattcttcaggccaattttgtgctgttctagttgtgttcttccatgggtcgctgctgttcgcttgtggccccttgttcgcagctcatcggtcgaagcatggggctcaatgatttagttgggacaacatttagatcacgacttagttccattttccatagtttttgcatcatgttcatagttgatacaggcatcagctccaaaggagaaaggccattattgttaaatgttgtggaaaacttggctgccagctgctgcaataggaagctgtcgtaactgttgtgcaaaactttgcccccgctgctctgttaggaaatatttggagcagctatctttttgacacattgttctcaagtcttaaccatgaagcattgtcttaatatatataagaaggcatttggtcatatttgcagcaacctcagtcgtagaatgataaatgattttcatcagcgaaaagtagatcaatatattttgaccattaattttcttttgatatgttcacatttgctagggaatcaatgtcatcgtagaggcactttgaatataaatgtatctatgtttattattttaattttgtatataatttggacacctacttttaaaagtttaaaagttttgcttttttctgtagaaaatatgattatcattccgtgaccagttgacaacacagagtaacttggtttgacagcttgactagttcagctgaagcgagccccggggtcgggcctgttgctctggattcgagttgcacaatcaccatcagtccatgcctggtcaatgacgtccaggacatagagcatgggacctgtcagtgatataacttaggctttcgctcctagattatataaactatatattacagtggaaggatagtagggtaaaatattactttggaaacataaataagctagtattatgtagcttatttgtaacactaaagtgatatttctctccctctcactcttctaccataattcaacttatataatctagaaaggaaacaaaca

SEQ ID NO: 7755 - DNA, 2324 bp, Zea mays
atcacccgtgcgtgcgcgctctctctctctttctcgtgcggcttcgcggtctccgccctcttcttcctgctctcctccttctcctcgctctccgcgcccacgctccccctccccgccgcggccatcgctggggccaacctctccgcgcctactctcgcccaggctgaaaccatgtacaaccgccccatctggaagcccccgccccggcgggcgcggatgccctctccgcgcgcgttccgcctcacccgcgacatggtcgccgcccgcgcccgcgacggtgtgatcgtcgtcaccttcggcaactacgcctttctcgacttcatcctcacctgggttcgccacctcaccgacctcggcgtagacaacctcctcgtcggtgccatggacaccaagctgctccgggagctctacttccggggcgtgcccgtcttcgacatgggcagcaggatggtcaccgaggacgccgggtggggctcccccaccttccacaagatggggcagggagaaggtgctgctcatcaacgcgctcctgcctttcgggtacgagctgctcatgtgcgacactgacatggtatggctcaagaacccattgccctacctcgcccgataccccgacgcagatctcctcacgtccagcgatcaggtcatacccaccgtcaccgacgacagcctggagaactggagggaagttactggtgcgttcaacattggtatttttcattggcgacccactgaacctgctaaaaggctggcaaaagattggacagtgggtgtcatatctgatgataagttgtgggaccagaatgcctttaatgatcttgtacgcaaaaaatttggacagccagttcaaggagatgatcttgtatattcttatgatgggaaactgaagctgggagtgctaccggcaagtatattttgcagcggccatacatattttgtgcagggcatgtataagcagcttcatttggaaccatatgctgttcatactacttttcagtatgcgggtactgaaggaaagcgccatagattgcgagaggcaatgcttttctttgatcaaccatcttattatgattctccaggaggtttcctgtcatttaaacctaacattccaaaaagtttgctattagatggtgctcatactgttgaatctcattttgagttggttaactaccagctgaagcaaataagaactgcacttgcggttgcgtccttgttaaagcggacactggtaatgcctccattatggtgcaggcttgatagaatgtggtttggacatcctggaattttagagggaacaatgaccagacaaccttttctctgcccactggatcatgtgtttgaggttcatgttatgctgaaggacttgcccaaggaagagtttggtcaacatattgatttcagagaatactcctttcttgagaatccatcattacctaaagaggtgaaagattcgttactcgaggttgaactttgtgacgagcatagctccagatgctctgcaattgatgaaatcgataagcatggaccctttcttttaccaagaaatagtactgaagaaaagctgttggatttgttgtcatcatataaggatgtcaaaatcatacaattctcatctatggttgatgccttcggtggttttgctgatgcagctgtggagaagaagttccgaaatcgtgtgaacaggtatgtgggcctatggtgctgtgtggagttccgtgaaattggtcacatatattatgacatgtactgggacgagaaaccagggtggaagccacaccctccagagactagggaacaggaccatccaccttggtcatgactactgacaagaagatgctagaaagatcgtaatgatgaagatctgagatcttccagagcaccctgctccaatcgattcttcaggccaattttgtgctgttctagttctgttctaacatgggtcgctgttgttcacttgtggccccttgttcgcagctcatcggtcgaagcatggggctcaatgatttagttggggcaacatttagatcacgacttagttccattttccatagtttttgcatcatgttcatagttgatacaggcatcagctccaaaggagaaaaggccattattgttaaatgttgtggaaaacttggctgccagctgctgcaataggaagctgtcgtaactgttgtgcaaaactttgcccccgctgctctgttaggaaatatttggagcagctatctttttgacacattgttctcaagtcttaaccatgaagcattggcttaatatatataagaaggcatttggtcaaaaccccccacctcaaaaaaaaaaaaaaa

SEQ ID NO: 7756 - DNA, 1570 bp, Zea mays
gcaagacagacaaaacgcttaagccccttcctcatcttagaatttagggcgggtgcattccgccacccggccggagaattccctctccaacaactaacaaggccgaaacccgaaagcctgatctgaagcatgttttttggtccgatacgagtctggcttggcctaaacagaacagggaatcaagcacgacgtggtggtccgacacaacccatttaatggcttttttactaaaccatgtttttcgactcattaagcctacttttgtttgcgcttacgggtcaatccagtccgtttaagcctgtagcatgctagacctgttcaagtaaacaagccgacgaatctactaactcgattcagttttttaaccgtgcctaacagactggagctgggcttcacctgccatgccagacgggcggccgtttgaacatcactaacgtgtccccagctttcccgtaaccgggcgggacaaccacacttctataccgtgcacgcgacgaccctgccgtcggaccggacccactgcgcacccaccgcccagcgggacccacgcggtccttgtcccctcactgcctgcgcagaatgtccccggcccccacccgctgaccccgcctccgcctccgccctccggcgaccccgatccccgccggcgaaatggcggcgtggtgctctgccgagtccaccaagccggtcttcgtcgggatctacggggccgtcctcggcggcttcgcggtctccgccctcttcttcctgctctcctccttctcctcgctctccgcgcccacgctccccctccccgccgcggccatcgctggggccaacctctccgcgcccactttcgcccaggctgaaaccatgtacaaccgccccatctggaagcccccgccccggcgggcgcggatgccctctccgcgcgcgttccgcctcacccgcgatatggtcgccgcccgcgcccgcgacggtgtgatcgtcgtcaccttcggcaactacgcctttctcgacttcatcctcacctgggttcgccacctcaccgacctcggcgtagacaacctcctcgtcggtgccatggacaccaagctgctccgggagctctacttccggggcgtgcccgtcttcgacatgggcagcaggatggtcaccgaggacgccgggtggggctcccccaccttccacaagatgggcagggagaaggtgctgctcatcaacgcgctcctgcctttcgggtacgagctgctcatgtgcgacactgacatggtatggctcaagaacccattgccctacctcgcccgataccccgacgcagatctcctcacgtccagcgatcaggtcatacccaccgtcaccgacgacagcctggagaactggagggaaggtaattattgaccacagatattgacgtggtttatgaatctttctggttgctagtgtgttcgttatcaatctctgttgcgagcagtagtaattaagcacagatcgcatcatattctatacaatcctgagggttgacaacagagatggtgtgatctgcatctgaatatagtaaacaggcccgaagaagttatatcttattgta

SEQ ID NO: 7757 - DNA, 2223 bp, Zea mays
gtgagttctctaggtgacacgattcatggatgagcactgaagttcaaagaggcagatacggatcattgcttgaaaaatggaaggactaaatggctgtgaaggtgccatcagagctctgaaaaccgaatgactcgatgttaaaatgagccatctgaaaacccaagggagagtagtacctgaggaagtaggagatgatataactaaacatgcagatgatcaacaacctgaaggtcactcagatgtatctgaagctaacccaacggattagttctcgacttcctaagtcctaatcactggcaaaggcagaattaacaccctgaatatgcacatgtcacatgtgatctcttggctcaggataaagctcctagcactgctcagcaggataaccagatctcttgcactgagaggacagtttgggtatgagaagcagacagagaaacatctttcataagcagagcagtaagagccttatccatagtgggaagcatgtaacgtgctgacgtgcaacaagctcaaccacagtaggatcgaactctgggcgaagacgtgcaatgaagttaatcaagtcatacttctgattaaatttctccttggttgtggaacagtcacatccagacaggcctttggcatcatgcagtccaactgccatgtgctacgcgtgaatgcattgtaagaagcctctccaggacaggaacgtgtactgcaaaattatgctcataacactgctgaagatactcacatatccctcgagatgatgagagaccaaaaaattgtagctcgattggttcctgcgtgctcatgtacaagataattaatcaaaattttgttcctctcaaaacaaaataaaccaaactttgtatttttgttagaaaaacataatttgttgaactgaaaacttatgtcggtctttagctcgttcttatacaactcatcttattttcttagatccttcatttttcttgatttttgtgttgacatgccgcgtgtggtgggacagacgtacattgccggcgctaccgctccagaaatgaaatggggtgatgatggcgtgaagttacgttcggctgccgtatctctatcgatttcatgatttattgtgcaaaatataacaactaaaaaaatgtgatacaactctcggattcagcggtacgcatagagggttctattactgttctagtcattgaaagaaggtaaatagttgggttagtcggcaaaagcgacaaaagcactggatgagactgcaaggtttcagtcaagtctgtaaacaattttggaagtggatatgtattgttatgaagactggcatcatgattgaaatttgataattgagttcttgtctgcctataactgatatgttcattctaaactgtaagttgtttacattttgtttgaagtcgaactcatctagttagcaaagtatagacatctacaataccaaataagatttatcaggtacactatggaatataattgtaagtgtattaattgatattgcaggtgctgattgtataaacttggtcacagttaaaacaatttgactttggacacaaccaggacaagtgtattattataacacttcagcggtaccataggtcgtcccgtaccctgtcatgtagaggaatgttattgatgcaaagggaaaagagtaatgttgagagaaaaacttattgtattgctccataaactaaagactaaatagctattgtaccactgtcattgtataagttattatcatgtaactcaacacattccttttgttatatgcataaattaaaaaacttttaagttactacaagccttcaaatgccaactttttttaaaaaaaatgacaactatacatatcatctattaactcaccaagattgcatagttctgcctccagcgcaaattataagcttatacctttatctgacgtcatataagaaatgcatgatttttctcttaaaagacagctctcatatacaattattaatatttatattattttttgagcatattaactatcttaaataaaaaatctcaaaattacaaagatgtagatctcaacgatagctataaattagtaatccaaaatcctgattttgggattagtaaaagaaagcaaagcaaagtgtccctgatgaataattatactttagaattcacactttttaaaataaatagtaatattaaaacaatgttagttaaaaaaatagaaacaaaaatttacttctgttcaagaaa

SEQ ID NO: 7758 - DNA, 1923 bp, Zea mays
  misc_feature (896)..(896): n is a, c, g, or t
  misc_feature (1794)..(1794): n is a, c, g, or t
  misc_feature (1803)..(1803): n is a, c, g, or t
  misc_feature (1839)..(1839): n is a, c, g, or t
  misc_feature (1849)..(1849): n is a, c, g, or t
  misc_feature (1865)..(1865): n is a, c, g, or t
  misc_feature (1879)..(1880): n is a, c, g, or t
aattcggcacgaggcgccaacccagcgcacggctccgccccgtcgcaccgcagcgcgtcgcggcgagcgggcgggcgggcgacaccgacagctcaggaagacagggagggagggagcgagggaggcggaagaaaaaggcacgaaagccaagggaagcgggcgcgaccaccgccacgccctaccccccctcccccgccgcctagtccgagttgtggaatccccgtggactcccgccccccgtccatcccccgcgcgtcgccgcggcgcgccgggccgatctgctccgccgccccgcccgcctcctcaggtgtccagccgaggaggacgtagagctgggcatataacgagctagatttcaaaaaaaaaaaagggaaccatgaagaaagtgttcgatcagacggtccgggacctaaaaagagaggtgaacaagaaggtcctcaaggtgcctggaatagaacaaaagatccttgatgccacaagcaacgagccgtggggtccacatggatctctactggcagacattgctcaagcgacgaataactatcatgagtaccagatgatcatgcacattgtgtggaagagggtcagtgacactggtaaaaattggcgtcatgtttacaagggattgattgttttggattacctggtggcgcatggcactgaacgagttattgatgacatcagagaacatgcttatcagatatcagcactagctgatttccagtacattgattcttctgggagagatcaaggtagcaatgtacgaaggaaatctcagagccttgtcagtttagttaatgataaagaaaggatacaggaagttagagagaaagcactctctaccaaggacaagtacaggagtgcgtttgcccccagtggcaggagcccaggtggantatggtggtggttatgataatgaccgctatgaaggcagctatggcagtagatatgacaacagaaatggaaatgggaggggagactatggatacagggacgatgacagatatggtggacctgggggtacacccaatcgcggcggagatcgttattccagagattctaatgaacgctatggcagagattatagagaagatgaatacaaaggaagtcatagcaaccatgaatatgctgaaggagcaggtcgcaggagctatggtcaggaaagagattcatatggggatggtgaagcttattcatcccgtggtcgtggcagcaatgctgatgatcctactcaggatgataggcctatagagcgaaagctttctaaccagcaaatttcttcaccaccaccgaactacgaagatgtcacaagagatggccaggacaatcttcacgatgacagaaatggaggaagtgttcctgctgctgtatcaagggtgccctctccttcagttcctgcaacaactgttcctgcagtacaggtgaatggggttcatgacagcactgttgaagatgtacctgcaccaccaactgctcatgccgagcctaatggatttgatgagtttgatccacgtggatctgtaccagattcttcccctcctgtaaaccctgcatcagtagcgaatagcttggagatggatttgtttggatcagatcctattagttcgttggctttggtgtctgtgcctcaaccaacgactacatcaaatgttgaagcaccggcaaattcaggttttgaaacaaatagttttgtgggcatgcctcctgcttcaactggatttggcgagattgatgcttcaaatccttttggggatcctacacctttcagggcagtccttgatgaaggcccaacantactcaaanacatgctgacagttgggtccttccaaccactggacnggggatgttngaacccttccaactgntccaacgaatggtnngggggaaaactggggaattcactttggacaatgtgaccgaatg

SEQ ID NO: 7759 - DNA, 1975 bp, Zea mays
atgaacttagttaaatttaaactactttaataaacgagataagcacttgttttaaaacggattgtgtactttttaccagaggtgttcaactgcactactgcagggataagaagctgctacagtcagctactactgcgtactggcactcactccagtaatttgagagacaagaaaaaaggcacatcataatggcagccagaataataaacgaaattacaagaaaaaatgaagccgcttttataaatggctccacaccggaggggccaaggactggcgcggccctatccctatccggctggctatccccatcggcttcctccccacaagtcctgtccaccaccaacaaactcgtaccctccttattcccacgagacagtgcgtggccatggcctctcgcgacggcgccaccttccaagtgtaccgggccatgcccgcgccgacgccgatgtctctggcgtccgccgctccagccgcagccgccgccgacgccgcggcgccgaagaaggcgggcgcgggcgcgggcaaggaccggcacagcaaggtgaacgggcgcgggcggcgcgtgcggatgccgatcgtgtgcgcggcgcgcgtgttccagctgacccgcgagctggggctcaagtcggacgggcagaccatcgagtggctgctccggcaggccgagccctcgatcctggcggccacggggtccggcaccacccccgccgtcttctcctgctcctccgcgccgtccacctccgcggccagcgccggtgccggcgccggtgtctccctcccgctcctcgggaagcgcccgcgcgaggagcacgagccggcggtggcggtggcagtggcgccggcgccgttctgggccaccctgcaggcgcggcccgtggcggcggcgtgggggctctcgccggcgcaggaggcggcggcgcaggcgtacgcgtcggtggcggcgcagggacaccacctcaacctgctctccgtgctctccggcgccgcgaggccgtcggaggaggagtcccggtgactcgccgcactgttgctacgtaatcgcatgcgtcgacgcgtggtggggtggcatgccgcatgcgtctcgtttccgtgcatctccgggggggtgcgttgcgcgtgttttccctgtggttttgcggtgtgagaggaatgcggcgaggtggacaaggaggatccagagcgcgagatcggatcggggttagcggctgtagatagcattcgtcaggttcgtgtttgtgataatgagctcgccgtggttctgtggtgtggttatgtatgcatgcatgcatggcgaattgtcaactgatctgattcctaacactaaataatgcacgtcccggtgtgtgcaattccgcatgacgttgccttgactgctgttttgaatagaagaaacctacctttgccgtttgagaattcggaatccagcgtcgaaatttgttgatgctgagaccgagcggtcatgcatggctggctggtgagatttttgactgaattctcctgcaactgcgaccgtgaaagtgaaacaatgacgaagcactcccacattattcacccgtctcatgttgtactactcatgagccgctcgtgacagcttgctgcagctctcggtccctgcaaaacccaggccacatgctgttcagtcgttggacccaggaacaggataggccgcgctggaattgctttccctcctcctcagtccctctgcactgcactgtggcaaaagcccgcgtctgcgtctgcgtctgcgtctgcactttgcctctgtgaaaagatcaagctgcttcggggacacatgattcgtgtcaagctgtaggtcactctgaaaaggcctccgaccttgtacagactacagaccatgctcacaggctttttttgtacagtgtataaagtatcaacggcggctcactttgttccaaactcgcagactgatcttctagcacgcacctgtggctgtgcacaagcacagctacagact

SEQ ID NO: 7760 - DNA, 2962 bp, Zea mays
gaaggcacagtcagttgtattttttaacccattagagcagacaagggatgagattgttatggttgttgtaagtagtccagatgtttctgttattaattcaaatgggtcctgtttgccaagtcaactttcccctgagtggcagtttgtcagcgatgaaaagatttcgactggtcggcaccgcctttattggagagcttctgttcctccactaggtttggagacctactatgtggttactgggcaggattgtgaaaaggctattcctgctgtagtgaaaacatacacagctgcacaggaatttccttgccctgaaccatatgaatgttcaaagctggaaggcaaaacagtggagatgaagaactccaattacactctttcttttgatacatgtcatggtctcctccagacagtaactcgtcacaagtatggggaacaaactgtggtaggtgaagaaattggcatgtatagaagccatggaagcggggcatacttgttcaaaccacttggggatgctcgctcaattgtcgaggaaggaggacatttcatccttactgaagggccattggttcaagaagcccattctcttccaaagacagagtggcctaagtcacctctctcacatagtacacgcatctacaattgtggggacgctatacaggacatgctgatcgagaaggaataccatgttgagcttgttggccatgcttttaatgatagggaactgattgtcagatacaagacagatattgacaaccaaaggatcttctattctgatctaaatggctttcagacgagtaggaggcagacatatgataagattcctctacagggaaattattacccaatgccatcacttgccttcttgcaggattcacatggtaatcgattttctgtacactctaaacagtcattgggcgcagcaagcttgaaaaatggatggctagagattatgttggatcgtaggttgggccaggatgatggccgtggtctggggcagggagtaatggacaacaagcccatgaatgttatatttcatctcctcatggagtccaatgtctcagctttgccccaaacccatagcttgcttactcttcaaccttctctcctctcgcaccgtgttggggcgcacctgaactacccaatgcatgcttttatgagcaaaaaacctcatgaaaaatccttcaagctggttcaacagtcatttgctccattaactgcttctttgccctgtgatgtacatattgtgaacctgaaggtcccacagcccctaagattttctcacacagaagcagcagagccaagatttgctgttctgttgcacaggagaggctgggacgcatcatactgcaaaaggggtggactggagtgtacaacagttggggaagagccagtaaatctgttctacatgttcaaagatttgtcagctgtgaatgtgaaggcgacttcgctgaacctcttatatgatgaccctgaaatgctaggttaccttcagcagatcggtgatgttggtcaggagggaaacgttcttatctcaccaatggagattcaggcgtacaagttagacttacagccaccatcatcgcaggaagagtagtttgtggaatcagtacatgcatattgaacagttctacaagacagtgaagatggatcttcccgaaatactttaatagtggcagctagtaccggaacagcagtgttgcatgtatatatgtcattttcttggcatacagttagtgattggacctatggaagttgctggaagttgtcgttgaggcatttggttgcagccttgttatccacgaaggtgcatgcccttgttcttggtatcatgctcaacagattggaaagatctggagcacattgaagcagagctaatttgatttgggtagacctatgtgttcacacgaccagtgttgattcgtccaatgctaacacgacaataacttgtatcagagcaagttttgtaattctgtcttgtttgcatcctttttgtaggtgccatcatcccgctgaccaaaaaaaactcggtttatactgtgtgtacaaaattttgcttgtaagcatgcgaggattgcaggaaatgctttctttttcgaggcattttcatgggtcctggctacaaagctcaccagctttaacgttgtttgatcctgtattgtttgctgcaatatattgccaaaccagagcacctaaaaaaaaaaaaaaaaaaggacccttcatttgatccccacctcatcaaagtagcaccatgactagggatggtaacgggtcagatttggatcggatattgtaaatatccacccacaactatattcacggtcctagatatatccgtccgcgactatacctgtgggtagaaatttatatctatgactatcagagtttcggatatccattggatatgataaagaaccattttcaacaatttgataacataattaatcaaatttctttccaattcatcgtacatacaactaaaaacttaataaaaaaattttaaaaatatatatgtccttcaacaagtaacattctcaacatgacaaaaaatacatgtcttgcattgcaataataaatttagaacagaaagttgtatatgtttgcatgattggctagttatcaacaaatacatgtctgcatgacaaataaatagtttaagtacatgtctacatgtcaacaaatacgttctcaacatgacaacaaatacatgtctgcatatctcctctgcttttggcctttggccttctcccttatgaagttacgatgatctgatcctagtgtagtgttgagcatttaagctagcgctaggagagctagagaggggagcacagagcaggcacaccgccacagcccacaggatatttgtcaacaacaaactggctgggctgtctacctatctgtgatttttttgaagtattggttaattttggatatccaacgggtaacccgtggtgatgtttaatat

SEQ ID NO: 7761 - DNA, 3791 bp, Zea mays
aatgccctatggagttactggtggtccggctacatttcaactcacaatgaactaagtgctacctcctttgctcacgatgtgtgtcatggttttcattgatgatatatttgtttatagcacaagttgggctgctcacttggaccaccttcaagttgtttttgacatcttagatactcatcagttcaaagtcaaactctctaaatgttcattttctcacaccagtttacactaccttggtcacatcattagcaaagatggggttgcaactaatccagacaaagttgaggtagtgaaatcttggcccacaccaagatcatcaaagatgtcgcagttttttgggtttagccagatactatcgcaaatttgtgcataattttaacatcatgagtcgtcctcttatctttactcaagaaaggccagtatttgtttggacagatgagcatgggaaggccttctaggctcttaaaaatgctttgattttggctccgattcttgcccttcctaatttcaccaaacccttcgaattggaaacaaatgccaacgatgtaggcattggagctgtccttcaccaagcctaccattcgattgcattcgtcagcaaagctttaggacctcgttatcaagcccttttaacatacgaaaaagtcacacgtggacccatgggcggggtggcgggtggctaacctcttggatgtgtgcttaaaaaggttgggagagttagagttagttgttgggcttattgactacaagagtgcacacctaattttaccgcgtgaatattacgtatgggtaatcgggttcgagttctgcttttctgtatccatatccattatccaatggagcaagaatttctcccccatctataccgtggagattaaaatcttcccatatcctaaccctaagggctaatttgataacctcattttttaaagagattttctgttttcttaaggaaaaataaattagttttctttagaaaatattttttttaaaaaataaagttgtcaaactagccaaaatagtcataagagaggataaagcaatttcctatgagttatcgggtgtcgaattaaaacctctggttcacccgcttcttctcagaattccaaatttatcggccgaatgagaagaaatttgtgattttgccactcttaattttggttgtctgttattatgtcattccatgtctataactggtgagaccatctgtatctatgatttatggttcgatggcgtaccgccgggccccccgagactccaatttatcggccgaacgagttcacccatcggccatcgccccgtccagttctctcttctctttctttcttccccttcctacaccgccgcaccccactcccagatcccactgctccccagatccgcgcccgagccctagtcccccagatccgccgcggcgccggagatctactcctcgtcttggcgtccgcggcgccatggcgtgcctcgcgatctctctgcagccggtgaacggcccggacatcctactgcaaacgcggtcctggttccccgtctctcgcgccctcgccgccgtctccgcctttcgcctcgcgcgcctccaccttgcacgcggcaagcaacagtcctcctcatcctccgcctcctcggcctcgctcgacgccatcggcgacgacccgctcgccgccgcgtccgggcagctcgttgtcggcgtcgagtcacagtaccgcgtggtgtaccgccttgtcaactccatctacgtgctgggtgtcaccaccgcaggctctgaccatgctgcccctgctgtcaacgccttcgccgtcgccgacgccgtcaaccagtccgtctccgtcgtcgttgcagcctgccgtggcgtcgacgtcacccctgagaaggtgcaccgcaagtaccctgaggtctatctcgctctcgacctcgtcctccacggcgttggctccgtccgcctctctcagatcctcgccaccatccatggcgacaacctcgcgcgcatggtcaactcctcgcccgacgccgaagcccgggcccgtggcgcggatccctggcccgtcgtcgaacacctcgcgcaggaccgccacgctgcgagggagggcttctcgggcgcctctttcgagcttccccaggagacgctcgcggctggtgacgaattctcgtctaacatcgcccccgcgaccactgttgctactggggatgaaccaccacctgaggaggcagcacctgtggaaaaggatcctttcgcagccagtgacctgattaacaacaaaccggaggaggcattggtgggtgggttcaaaaagaacaaagagactgcccttgtggttgctgatcctgcagctgcgctagctggattggaggttacgactttgccaccagctgaggcgactaagccgacatttattggagttgaagggtttgagggtgattatggtggcattgagtttggcaacgatgagacttcacttgctgaggcatttgaagggctcaatgcgccatttggtggtggcctggatgcttctgagtttgttacaacaacgaagaaggatcacaaggacaggaccgtcactgggcttgagttgctagtagcaagtgggcagccaccgaatgcagctgctggtactccattggagaatctcttgctgactaagcgcgcagaaatgaccgctcctgagttgtttattgctgaggagatcaatgcagaattcaaggagtctattcttgtgcgtgttggattgaagggtacaatcttcctgcggaccttgccactgaataaggcagcgggtaaggagacagagttctcatttcgtcttgagggcacatcaggaatgaagagggctgcattgcagagtaatgtcttgagtaacctacagaatggactgttccatgtcaggaccgtgtcgaaagaagaacccattcccctcatgaagtacagcttcctgccgaagcactcacctctccctttgaggatgcgcctagtgaagcgccatagtggaacgttactctcagtgatgatacagtacgcatccaatccaatgctgccccagcctctgagcaatgttacattcgttgttaagcttcctgtggatcctactctgctcaatgtttcacccaaggctgtgctaaaccgggcagagaaagagcttagatggcatatttcagacattcccctgaaaggtccagccggcaggctcagggcgcggatgcctgttgaccaagactccaaagatggtgagctagaggttgttgggatggtgaagtttgcttaccaaggtccattcacattgtctggcattaaactatgcccagccactgatggcattgcccaatttaatgaagttggccataccttctccagtgggagttacctgtgcatttgataggtacctgcttgtgctgtaggtgcttgttcacctgttttatgtttgtttctacagcagggtgtgaaaatcctattgtatgtagcaaagtgtgtttctttcactgaggctgaaattccatcacgtttttgagttgtctgtttcttggtaagtcatttgtggttactcatgaaggctactttatgcatcaagtttatcattcatacgaagaaacaatgtactgctctatttaattactattttattgcttctcatttttcttagcatcagtgtttttaaggcgtcacctaggcgacgcctaggcgtccaggcgctcgtataattctaggggtcttgcctgcctaggcgttaaggcagtcgtccagctcctcacctcgccttacctccttaagaacattgcttagcatgctttacttagagatg

SEQ ID NO: 7762 - DNA, 2244 bp, Zea mays
atttaacgcatctggcattgtgttcatgggagacaacatgaagccaaacttggaatcaggctccattaatggagaggcaaatggcgaggatggagctaaagctgatcagaagtccagccagcagatgggatctcatgctgcatatcctccatgggcaatgcatcctccatctggtgcagttgtttacccaccttatcctatgcaaggcatgcctttttatcctggggtgaatccatactaccctccatatcctccagtggatgatcccaggtaccactactcaggaaggaaatcttcgaggaagcactcctcggatagtaaggactcagaaactcttgacgttgaaagtgaccattgcagttcagatagaggaagttctcatggtcgcaagtcacatagaaaggggaagaggtccggaaagaaaaaacctagtgtggttgttatcaagaatgtgaatgtaacatctaaaaagcatggctcatcagagagcgaatcacaatcaagttctgaagttgagtctgcggacagtgacaattcacactccaaatcaagtgaaaggaagcataaaagctcaagttcaaagaaaaaggagggtaggagaactacttttgcctccggagatgaatatagcaaggatgaaatgtcaaatggccacgatgctgagcaaggaaactggagcgcattccaaaatttcttgttgagagcagaagaaaaaacaagatctagtgatgcagacctgtttgctggtgagaaagaacccccatcaaggagaaaacagaatgtaaacacagcagatcctattcttttagctgagagagatggtggcattgtccatgagcggaacatagtaggttttgattcagccaatgggaggactagagctatccgggtcatgtccaatgatgaacttgttatgtctggagaagggaggaactatatgcatagtgaaataaaggagattgaagctggtggaggaaggtacaggagagggacaggtgatgactacatggtttatggtcagggaagtcagatagccagacatagtttgttggatcctcttgcagaggcccagtacaagaatcctgttcagcaggacaagaataggaatggtgtggcggacgagtcctttatgatccctcttaggtccagcttacatgataatatcggagcagaaagcagaactactattgacatagatgttgagcttccttctagaattcataaagcatcagatgaaaaggctggacatcagcttttttacgaacctgacgaattggtgccagagcgtggatctgaagatgtttcatttggatatgatccagcaatggattatgatagccacatgcagactactgtgaaggtggaagatgaaaaaacagaggatgacttgccagttgctgacaatgatgtacagaaggtagagaaagagaagctaaggaatgcaaaggatggttcagataaacgaaggaaagatgccttattgaggaggttatcggcgccaaggaccccactgaatgatgcacaaaaacgtgcacagaacctgcgtgcatataaggcagaccttcagaaactgaagaaagaacaggaagaagagcaaataaagcgattggagaggctcaaattggagcggcaaaagaggatcgccgcaagaggtaatggaaagggtccagggaatggttctcctaaagcgaatggtacgaatggactcagtaaatcagttccaaccttcactgggttgaaaaaggagaaaaatggaacaactgaatcactcagcgatcgactgaagaggctttctgaacccaaaagcattgctggggcagagcattccttgaatccaaagtcaactggcgcagaccattcacgaagaagaagcatggcgtgagacggagaaccgagcatcttgaatccatcgtaccactcgctagctcagcaaccatgaatggcatatcaaaaggcttcttgtacagaaagaggaaatggctggcgctgtagcactgcctgcttccaagatttgtgatggaaaatcaagttaccttttcaatggcatggcgttgtacttccaattttaacataattatttcattcttttattgaggatggcttgtaatagctgtaaacctggatttttcggcgacgcggagctatattttggtttttggctgtatttatggaatggattgatcgttgtttgagatatattgtggtatttatacagtgtataaatgtcaattggctttgggttgg

SEQ ID NO: 7763 - DNA, 2380 bp, Zea mays
cgtcgtcgcccgccagagctctaggagccggagttggagcgtttgtgagtctttctaaagagaccctaataagtatgtttatgatctagggacttgaattgtatggtgtagtcttttagtctcttgtacattgaaaatcaatatagagattgtacttaccctagcaggttaaataacggcgagtggtttgcgagcacaaccttgtgctgcgtctgcgtgtcagcgtgtgtgtgcaggaaccacgaggaggtaccattgggcgtcgtgcttttgcggaatccgataattaagctaaaaactattttcaaggtccacctgtcaactgatgattagcacctcaaatattgtcaacaccgagttcttcgtttctttacacttgtcaaaaaggcatacattacttttttattaaaaaaatcaaatgcattcaaaaaatggccgcgtccaagcaaaacgaaggagcagacgacacgtcgtgacgcaggtatgcaccttcagtggggccctaaataaaggagccaatccgcaccccccaccgcacacgctctacttcccgaacaaagcaaagcaaagcacggacggacggacgggctctgcacgcgggcgtcgcgtcgcctccgcccgccggacacatccccggcaataatgaggccccccggccggcgccgcgtcctcgccgccggcgcctgcgcgctgctgctggccgcgaccttcctggcggccggcctgttgacgacgtcctccctggcgccgtacctgctgccgccgctggccctgtcgctgccgtgcctgccggcggtgaccgcgccggcggggtccgggtacggcgcggcgccgggcgtggcggcgctggcggaggcggccgtggcgtacgcgacctcggagaccgtgccgcagcagtcggtcgacgagatctcgctgtcgctggccgtgctgcggcggcgcgcgccgctgcggctgctggtgttcgggctgggccacgactcgaggctgtggcacgcgctgaacccgggcggcgccacggtgttcctggaggaggacccggcgtggtaccgcgtggtgcgggcgcagtcgccgttcctgcgcgcgcacctggtggcctaccgcacgcgcctcgaccaggcggaccggctcctggccacgtacaggcggcacccggcctgcctccccggcggcggcggcggcaacgacaccctgcagctgccgcgcgtgcgcggcaactgggcgtgtccgctggcgctgtacaacctgccgcccgaggtgtacgagaccgagtgggacatggtcatgatcgacgcgcccaaggggtacttcgcggcggcgcccgggaggatggccgcgatatggaccgcggccgccatggcccgcgcgcgccagggcgagggcgacaccgacgtcttcctgcacgacgtcgaccggagggtggagaaggcgttcgccgaggagttcctctgcgagagattccgggtcggcggcaccggccggctctggcatttcaggatcccgccagtttcacggcgtggggaggacggcacggcgaccgccggtgaccggaacccgttttgttaaggcgccggtgagagtcttggacggtctatttggccctatttgggacggtctatagttagtactccgtaaacaggatttacgtcgtcgtcggccctgcagttcgaatgcattcgagttttttttgttttgttttgtttaaaaagcagatgcgaacacatgtatttcctttcgttcggtgtttcaaagtgatagttcatcaggaatcagggaatgcacaatagatccaataatgtaatataatgtaatgctccctccagccagcaattattttctatatatgggtcacgcagtaattataataatagacagcggggcgtctccatcgtggacggcggacgcgacgcaacccatgccagcattatccttgttgtccctttttggcccacatccatgaatggatctcagcgtttttcatcgcaaaagtccaaggacaaacaaatcaagtgcaaagcacctgccaccgtttttccttgtagttggctactctgattccactgccgccaacacccccggtgatactaaaatatacgtactacctcctcgctcgtcattcgattccctgatagtattgcatatgtgatccgcatgggactaaatttgtaatcagtgatactgaattgaattgtgctcataatcaacgtggaattaaactgttatatttgtaatcatgtttttagggagtgtctgtcaatgacatgactgctcacttcatcatttcttctcggtgttgatcgatgctatgtcatcttcctgacatgatgtttcgatggtgaccgacacagcaacatacctgcactacatcaaacagaacaac

SEQ ID NO: 7764 - DNA, 1954 bp, Zea mays
gcaccgagaccattacctagaacatcctaatcgaaaagtggcgtggagtggagtggagctggccgccgaagagagaccccgagaggccgagagaaagagagagaggccgtgctaggtgtggtgagtggtgacccagatggaggtggccgccacgtcgccgtggccggaggagccgctgctgcggcccccatctccgcagcccaatctccgtgccgacgccgccagctccggcgacccggcttcccctcctccatcagcggtgaggccgagtcgcctcgcggcgctcatcgggcgcgcggcggggcggcgcggtccctcgatgctggtgcgcgagacggcggcgctgcaactgcagcggaggcgcgcggactgggcgcactcccgccccgtcctcgcgctcgacatcgcctggaacgtcgccttcgccgcggccgccgccgccgtgctctcgtcctctgccgaggagagccccgtcaagccgctccgcctgtgggtcgtcgggtacgccgcccagtgcctggtccacgtcgggctcgtctgcgccgacacccgccgcgagacgcggcgcgcccggagatcggcgtctgacgtcgagtctgccggcgctgggacagacagctcggacgccgacagcgaagatgacgaaagggcggaagggaggagcagctatacaggtcgttgcgagacgatgaacacgttgatatcatttctgtggtggatcattggattctactggatattctcaggtggggaggtgctcgagcacggcgctccaaggctgtattggttaaccattgtgtttctggccttcgatgtgttttttgctgtgttttgtgttgctgtggcctgtttcattgggattgcactgtgttgctgcttgccttgtgtcattgctattctgtatgctctggctggccaggagggtgcatcagatgcagatattagtgttcttctgagatatagatattctgatccaagcgaagatggtgagaagggggtcgatgaaggactgatgatccctatcctgaataatagtggaatgtcaacaagtgagcgtattctccttcgcgaggatgctgaatgctgtatctgtctatcatcatatgaagatggagctgagttatctgctctcccctgcaatcatcacttccactggccttgtattaccaaatggctgcgcatgaatgcgacgtgtccactctgcaagtataacattctcaaaggcagtgacagtgcatgaccaacttattctgacataacttccgtacacagcttcctttcaagtggcgttctcaaagcaatgctgttttcacagctgtgttattaagtgacagtgatctgtgtttttctgtttaggatgtggtgataacctgtagatggatgaaaccttatttacaattgtccttgttaatatcgcttgtaaatacctttcgagttgttttctacgtatgatggaattggaattgctgaaatactttgtgattctggtttgactttatgctgttttaacagctgtgtttttcagtgacagtgatgtgtgttctgctgtttaggatgtggtgagtggtgacaacctgtaaatggatgaaacctaactcagtcaccctaatatcgtttgtaaatatctttggagttgttttctgcgtttgatctttgatgtaattggaattatcgaaatactttgtgataggctcactgtttgcacagttatgaataatattgagaataatgcagcgcttgcccatctaaaatctcgggtaggttctctggcctgcataacattgctgatgaattcagacaacaaaaaaaaaatcctggagctgctcgtgtacatcaggcttttctacagagcaccctgtacaattaaatttccatttctttgagatataatcatgtcgacgatgatattacttctgttacaatatggttattctattctggttagcaactgcag

SEQ ID NO: 7765 - DNA, 482 bp, Zea mays
ggcacgagggcgccaacagagagaccctaggaaaacatgacatgcactttcttgctgattatatttccatgttttctggacagggtccttttcagacagggataacacgctgggtgcatcagatggagatattagtgttcttccgagatatagatattctgatccaagtgagtacagtgatgaggaaaccgatgaaggtctgatgatccctatccttaataatagtgggatgtcaacgagtgagcgtattctgcttcgtgaggatgctgaatgttgtgtctgtctctcatcatacgaagatggagctgagttatctgctctcccttgcagacatcacttcccctggagttgtattaccccatgatgcacaaacgaaaggttcatttaggaaccatacgtgcgcatgccggccagattatctgaagaacaacaacactattttatttgcccattttttttggtatgcctaactgactgggtta

SEQ ID NO: 7766 - DNA, 5361 bp, Zea mays
  misc_feature (4706)..(4706): n is a, c, g, or t
ggttgttctaataacctgaatttctgctattggttatttcgtttaggatgatggcctcggttcatttgtggaacttggaactgagatgcctagacaacagttcatgcttcacttcttttagacttgctcatgagtcatgctgcccatacatctcatccagtatttcattatattgtcaacgaaacatgctagagttatatagtggatgactctgtttaattatattgtaaatagtttcatgtttcttttttgttgaacaaggcgaactcttacttcaggaatgcttctgtgccaatatgagtgtctttgttttaacaatatgttttttggttactttagttggcaaacagattgaacaatgcttctgtgccaatatgagtgtctttgtttccgacgtctctcttgtgttttgctgacagattctttgttccttcaggaatgttgtgtctgtctctcatcatacgaagatggagctgagttatctgctctcccttgcagacatcacttccactggagttgtattaccacatggctgcgcatgaacgcgacttgtccactctgcaagtataacattctcgaaatcagtgacagtgcatgaccaacttatgctgaaataactttcggacacagccttcattcaagtggcattctcaaagcaacgcaatgcctttttcattctgatctggttctgtgctgttttaacagctgtgtttttaagcgacagcgatgtcagggttctcctatttaggatgtggtgaattggtgataacctgtaaatggataaaacctcacttgcagttgcccttgctaatatcacttgtaaatacctttggagttgttttctgttagggctagtttggaaaccctattttccgttttcccaagggaaattagttcattttcccttagaaaattggaaatctcatggaaaaatagtgttgccaaactagcccttaatgataaattggaattggtgaaatactctgtgattctgatatggctgtatgttgttttaacagctgtgcttctatgtcacagtgatgtgtgttttgctgtttagaatgtggtagcaacctgtaaatggacgaaacctaacttacagttgtccttgctaatatcgcttgtaaatacctttggagttgttttctgcgtatgatggaattggagtaagtgaaatacttatttgtgacttttgagcagctggacgttgtaatattgagaggatgcagcgcttgccatataaaaactccgctaggttcttctctggcctgtattattgctgatgaattcagacagtataaaatcttggagctgctcgtgtccaccaggcaaccgttctacagagcaccctgactattaaagtaccatttctctgatataatcatatctacgacgagattacttctgctacaatatggctattctattctttgcagctgcaggatctcatgcagtatcattcaaggacaaagagagatctatagcaggttcggatggtaccagaaccttgatttgataaatattttagaactaatgtattaagaagctgacttagagcatagataaatatgatcacattcacaactgaaaataaatagaaacggatgctcggaaacacctgttaaccagtataaacacataacttgaaaaacagtattggtgaaaatatacttttgtcatacaagtcactgatgttagcgattaaaaaaagacttgaaactactgcttgcttgcacccaacaaagtatgtgcatttaagatgtctatccacagtatctcgcatattcagactctagtgcgtaatccttagatcaagtagtcgtctccataaaccttgaaaaacgcctcataaacatgggaattcctctctctgatcaaggtgcaaacattgtgagcgtcccgccaccgtctacacttgaagtacatatggacaagcaaagtctgtaacacaacgttcatttcagagcctgtcttgatgaggtgggcatgtatctgccttccatagcgcagcagcccttggaaccggcacatgttcagaagacccgccaaagtgtagtggtcaggcccaacacgcgccagctccatctgacggtaaatgtttaccgtggcaacaggctgtccatccccaacgtaacctgagagcaacgtgttccatgacaccaggttccgctcgttcatcctgagaaacagtagctgagagacttcaatacacccacacttggcgtacatatcgatgagctcggtttccagcactacattcatctggtttatgacccttatggcatggccatggatttgccttccgtactctctgtaccttctatcaccacagagcctcagaaggttcacaaaggtatgctggttagactttatttttgcggactccatttgtctaaaagtgtcaagtgctgcatcaacaagcccgttttcgacgaacccggataagagcgcgtcccatgaaacatcattcctctcatccatcccgtcgaataccaatcgagcgaggtccatgtatccgcatttcccatacatgtcaacaagtgcactgccctggatgacatcagtatctaacgctcttctaatcaaatagccatgaaacgcacggccactgtctatgtcagccaagttggcacatgctgcaactccgctgccaagagcgaaacgatcaatagtgaaaccagactcctgcatctgaacgatcgtttccagtgcctcttcacagagtccgagacgagcatagcacgagatgatcgtattccagctcacttgatccctgctgaccgttgtgtcaaacaccctcctgcaactctccacgctgccgcactttccatacatgtcaatgaggcagttccacacggtggcattcctttcgaatccaagggcaactgccatcgtgtgcgcctgcttccctcggaccaggcagcccaatgcgccgcatgcttgaattgccattacgagaacagaaacattcggaggcaaacccgaacactgcatggccgagaatgcatcccaggctttgtcccactgagaagaacgggcatagccgccaatgttcacgctccaagagaccacattgggctggcttatatcatcgaacaccttgctagcatcatctaccaagccaagatcaatatacgcagcagccaacgcagtgcctaccaccacatgctgacacaacgagcagttgatgaccaggccgtgcacggctcggagcatcctgctgtcccataggtcggcgcaggctctgaacacactcgggagcacaaacctgttcaccgggactccctccctccgcatactgcggaagagctcgacgacctccgcatgccggccagcgtgcgccagcgccacgaagaccgcgctctcgctcttctcgccgacctcatggggatcacgtccgcttgcaatctgtccgcccgtcccaaggctttcgtccaacgggttagctgcgctcttagtgttctcagtgctcctctcaggcattatgtcgaactggttacgtgggttcactgggccggggttctgggtggttcttgcactgggcagcatgatgagttctcgctgcaagatgcccgcggaggcggcgacgcacaggaggaggtggcggcgccatcgcccaagctcccatttgaggtgggtgggttgacgggaggcggaatagggatttgcacgagaggaatggagccccggaggataagggtgcaggaggcaagcggccatatccggttgctgtttggctcaaaagaacggacatcacaattcccaaaagaacgaacgaacccgcgacatccgggttatcaataccttagactattctctctcttattattgtttttttatttgtcttggcggctacgagaagtattatcatcgtcgataaaaaaacaagtcaattatggtattttggctatttttagttaaattctgcagaagatgtatttggttaagctatagttttagaaaaagttattatgaggtctgagctgtaaaaaagtagatattgattatggcctgcgaaaaaaaattcaaaaccgtttggttcaaaagctatggctttcgagtaaagtattctttctctcatttttttgaccggtaatctttcccacattttcatgtatcctacctatttggtctaacataaattcaaacaataatgttaattttttttataaatgacaaatattaaaattcacgatctaaacaagatgattaaaatccactagtttgaatttgaatacataaatgtacagaaatgaaagatatttaaattaaacaacgtggggtcgctgctagtgatcccattattgctgagtcacccttgtcggagtcctgttcattccgccattgctcaattaaccgtggttatcactgaaaaccatctaaaagacaacgactaatatgcaaacatatatgcaaatgtgcaagcagatttttttttgtttgttaggtacaaatctaacggtagatataattgtggtttgttagaaagttttttataaagctacaccaggtggtggtggaagggtttaagtgctaaatataacataccgttgaataacggagtaaaatgtctgcttgcacgcttgtacctagtatctgcctgcatattagttgtcttgtacctagtatctgcctgcatattagttgtcgccaacaaaatgaacacaaaaaatgctgcaggtactctcttcccacttttttgtttnaaagggaataataatacgacacaacgtgtagccaattcacaaagggcaaccggttcaactttcaagcatgctcaatacttgcactttacaatagctgcagctcttcattattagatattgtacatggggagaaaggtctaacagcggctaggctaaaacggctaaaccaaatatatacatgaaccatttgtactctcccagttgcctcttgtgggagtagttactgttacaccctcctacagggcatagatcctcttctcatgatcagagaaggcttccagatctgaaaacccatcatggattgaccaggagaaggatttgctgccgcttgccctcttgatgcggcgctgtctgtcttcgccgaacttgaaccgtgggcgcaacagaagataggctaggaacaggaaagttccaatcatgatcggccctccgatggctgatgccgtgaaggccatccaggcatgctgcgggccaactacaacataggccagcgagataaaagccacacccgtgctaaggcatgccgtccacatgagcttattcacgatcttgataacttgcttctgggcaccagtttcccaggcaaccaaggtgatctgcaccacgaccaccgcgagggagatgaagagagcagtagcgttcagaaggcagaaga

SEQ ID NO: 7767 - DNA, 1709 bp, Zea mays
atgcctttctcattttgtttgttcctgcagcttggttcaacattttttagacgacttgcttggtcaccttgtggccacttcataactaccactcatggtttccagaaacctaggcattcagcacctgtgcttgaaagaggcgagtgggctgcaacttttgactttctagggcataatgcgcctattgtggtagttaagtttaataactcaacgttccgtaagaatttctcaaatgaccaagacccaaaggctgcaccagttggatgggccaatggagcatcaaagacaccaactaaagagcagcaaccatataatgttattgctattggaagtcaagatagaactattactgtttggacgacagcgagtgcccgtccactatttgttgctaggcattttttctctcaaagtgtggttgatttatcttggtatgagatgtcaattatttctctacaaccattattaacttgtatgctcaaactcatgttgatattgtttgtttcccttgcaggagccctgatggttattcactttttgcctgctcctgggatggatcagctgcaaactttcactttgaagtgaaggagcttggacacaggttaagtgactctgaaatggatgaatggaagaggaacaggtatggtgatgttggaggacgacagtcaaatctagctgaaagccctgcacagttgctgctagagcaagcatcagcaaagcaatcagctggagaaaaggtgacttcaattgtcgagcaaggtaaagccccccccaaaagtttctgcaggtgtgcctaacccaggtcttgttgtgctaagtctcgaagttcctgaagtgtcacatgaagactctaagaagacagcaggtccaactgctgatgatgtaaaaaaaggcaaccagttatctagtccagtgaaacagagagaataccggcgccctgatggccggaaaagaataatcccagaggcagttggatttgcttccaaccaggataacatacccaaccattctcagaatcatcctgtgaatttttcatccctggatcaacgaatgaatggaacaaaaccatcttatggcagtaacagcaactctaataactgtggagttaaggatcgcactagtgtcacagcaagggcaaacataactgagagtcttgttattcaaaaagcttcagccggtgctggcaatgatggaaggctgagtatagaacacaccagatctgtggccccaagctctttgaccccctgctctgcgctttctattcatgtaataaataagaacggcaatgaggacgctttgcctgtctgccttgaagcgaggcctgtggaacgtggtgctggagatatgattggtgttggtgcgctttcaacaaaagaaactgagataaagtgtataaaaggtacaaaaactctttggtcagatcgtatctctggaaaggttactgtcttggctggcaatgcaaatttctgggctgttggttgcgaagatggtttcctgcaggtgcgtaatatcccctgtcagaatttctttcaaatcgattatgtgtttcaatttggatgcttctacgctcgtcaatatattcctgaaatctgccgtttattttccgacaatatgtcaagtcttcggcacttaaatttatttgttttgaattagttaggtttacacaagatgtggagtgcgagcaatgccagcaatgatgatgggatctgcag

SEQ ID NO: 7768 - DNA, 1635 bp, Zea mays
gcaactctaataactgtggagttaaggatcgcactagtgtcacagcaagggcaaacataactgagagtcttgttattcaaaaagcttcagccggtgctggcaatgatggaaggctgagtatagaacacaccagatctgtggccccaagctctttgaccccctgctctgcgctttctattcatgtaataaataagaatggcaatgaggacgctttgcctgtctgccttgaagcgaggcctgtggaacgtggtgctggagatatgattggtgttggtgcgctttcaacaaaagaaactgagataaagtgtataaaaggtacaaaaactctttggtcggatcgtgtctctggaaaggttactgtcttggcaggcaatgcaaatttctgggctgttggttgcgaagatggtttcctgcaggtttacacaagatgtggagtgcgagcaatgccagcaatgatgatgggatctgcagctgtttttattgattgtgacgactcctggaaattgcttcttgtcacaaggagaggtctaatgtacatatggaacctttatgataggacctgcattttgcaggactccttagctgctttggttgcatctccagatgagtcatctgcaaaagatgctggtacagtaaaggttatatctgccacattctcaagatgtggatcacccttagttgtccttgccagccgtcatgcttttctttatgacatgagcctgaagtgctggttaaggattgctgatgattgttttccagcatcaaattttgctagctcgtttagtttcccacaaggtggggagctaggcaagttgcagattgacataggcaagttcatggcgagaaagcctatttggagcagggttacagatgatgggttgcagacacgtgcccatctggagaaccaacttgcctcttctttggctttgaagtctgcacaggagtaccgtcaatgcctcctatcttatgtacgatttttagcaagagaagcagatgaatctcgtttacgtgaagtttgtgagagcttcctaggtcctccgatgggcatggttggttcggcatcacctactgatcccaaaaatctagcgtgggaccctgatgttcttggaatgaagaagcacaaacttcttaaagaagatatacttccttcgatggcgtcgaaccggaaagtgcagcggctgctcaacgagttcatggacctcctgttagaatatgaaacggatgtcacactgataccgcaacctggaacagaaggcaatggcaatggcaatgacaaggtgatgacctcgtagctacccttgacatgctcagtacagttgctggagagtggagactcaccccctgggtaggtgtgtaggattagtttggcgcggattcggagtgtccaatcggagaggtgcttatgtgaatcagttagttgtgcatgtagctggtagactatttattaaggtgaccccggcaaaaagggaaaggaaaggggggaaaaactgtaacgctgagtgtaccagtagaaatggaagcgaggttcgcctggtgattattgtgtctgcagtctgtaaaaggacggatgaactcgtgtcctttttcattccaaggcagtattggccttgatagttttttagttgaggctgtgtt

SEQ ID NO: 7769 - DNA, 1229 bp, Zea mays
gaaattttccgaattcacatcactcaatcaagaccagatatttatggacctgcatttgtggaagttgaaaacatgtttgggttatcaaattttgttcctatcctttttggaagcaaacagttgtgttctgaactagagaggatacatgatgctctttgtggttcttacagtgaaaataatgtacttggtgagtttctcagtgcttcttctgatcctcatgagccaccggaaactttgtagttctgtgatgtctggattcctgatcgacattggatggcttatcagaaagcctactcctgacgaatttaaaagtgtgctgagttcaacaaatatacagagatggatatgcatgttgaagtttttgatacagaatgatttcatcaatgttctggagataatcgtgaagtcaatggacagcatcatgggttcagaggttctttcaaacttggaaagggggaggttggaagatcatgtaacagcatttcttggatatgtaagccatgctcggaatattgctgatcgtagagctaaccatgacgagaaaacacagattgaaacaagaggcattattgttacttctccaaatcagccaaacttaggcgcctcagtgccatttgctagtgaaaacactgactttggaggggataacaaattgaactcaactgatgaggaagaaattatgccacttgtgactagagatgtctcacaccggcactgctgccagcctgatacgactgttaggtggcttaagccctcactgattgttacttatcctggtggtgccacgagaatgcgacttgttacgactgtggcggttgcggctgttttgtgtttcacagcttgtcttgttcttttccatccgcatggggtaggggtgcttgcagctccagtgaagaggtacttgtcgagtgactccgcatcgtagttgatgttatagatcagatattctattttgccgtgccgctctgctctgtctgtatcatctgcgctttgttaagttgaggcatagcttgtgtatctgatttttttgtaagggaaccaacacgcaggtgcttttcatctgtgcaaaactggcatcttttgtttttttcagactgtaagtataggcgccggaagctctgacctgatgtttgggcatgtaaacttctaatgtagtgcatcagttaatggaaaatagctgcattgctgcaaaaaaaaaaaaaaaaaaaaaaaaaaaaaaaaaagcggcc

SEQ ID NO: 7770 - DNA, 2021 bp, Zea mays
ggaaatgggcagggacgatgcggcgatgggagcaggagtcagggcgccgagcgggatccgagccagggccagggagatgggcgccaccaccttggcgggcggcagaggacgcgctggggaagaagcactacggcaagcgaacgtcagagcgctcggtccgagctggttgacgcgagcagggaggagcagagccgagcggagggctgctcgcgcggccccaggcgccaggagagagccgcggacgagggaggaagaaagctccctgccgagcttgaggggcgcggctatggagatcgggagcagggagggctctgagctcgcgtggccagggaagagcgaactgagggggaaagctgggagttgggcatcatcggagctgggcgagctgggcgccatgggagcttggagtggggaagaccacagcgcgcaggggaactccgcgagcgagggagctgcgcggtaggggaagaggagcagaggaacacgagcttggggaaagggaaccggtgagcggcggagaggagcaagcgaccgagctgccgaactcctgggagggacatagtggagcagggtcatgaggaagatgcagcccggcgaggttgaagaagaggggcacgatctggagcggctgggaagattgcggtgtgctccattgaatggaattcaggccgagcgctgatatttgaagactcccagggacggcgcgtagaagacgagctcggctgagaaaaatccggcgagggcggctgcggggataagcaccggcgacaggatttttacccagggtggccgagcggatgagagcgagggaaacggcggcggctacgaaaaatcagaggaagggtgagaacgatgacgcgcccgccagtcggaggcccggacgaattagagaagggagagaatagcggtatagagagagagagagaggatattttcagtcccattttcgttattttctgtcatgtaaaaacgcctgccaaagtaccatggttctaaaaattaagattttggaagagcccgaataagtagaagtaaaaatgatgtcgcactcacgataaacggaacagatgcgatattaaaatcgcgataagcgaaaataactagaccttagtgttcgtcttattcactgatatcacgtgcttaagtccgtattcgttgtcgagcggaatataaacacctggggtgttacattgatgttaactagatgatggtctttcctgaaaagggaataactactctctaatgttgttgaaggacgaggagaagaacaagacgtgtgggatagaggcacgagcataataagggatggagttaaagcaaggattgtaatctacaagggagaaaatgcaaccaagggcagggtaggtaaacaccattctcaaatcgagatgggaaagattataattcaaaaggtaggcataagatgagcatcatggaaagatctagtgattacaagggtacaggaggtaacaggcaaaatcacaccaaaagatcgagttaagacaagacttgcaacgcgatagaggaatagggaacgaacaagagcacggaggggtaagacacactcttgaactgaaatgggagaggaagctttaaaaatgtaggtgcagaataagcatcaatgtcaaatatcgagtgatgacaagggttaagacgataacagataaacacatggtaaaggatatattttagacaaaacttgtgaggcatcaaagaaggggaagcaatcaatggtgaagtaggcgaggcattatcctcaaacagtgatgaaaaagaggaggctttaaagggtaggttcaaagtaagaatgtgggcaagggcataggtatcatgagggtttaaaggtgataacggaccaggatgtaggagaggaggtaaatgtgtataagaaccaagaatataaataccacaaaggatggagttaagacaagacctgcaaatggaaaaggagagggtacgtcctagagccagataggtaaactgccactctcaaattgaagtggaagagaggagatttttta

SEQ ID NO: 7771 - DNA, 1018 bp, Zea mays
atcgcctccatcagcgcccagcggctcagccatgggagcatagtcctttctcctttgtgacccggcgcaaaaatatggcgtcgtcaccgtccctgcgccccacggacagactccgcaggcctccggcctctcccgcgttctgctccttttcggctgtctccctgcgcggcctcgtctcgctctccagcgcctctagggttctctccgtctccttccggcagcgcctgctgacggctgtgcggagctccagagaccctggagaggtgattgatgtggctagtggtgaaggaactgagctacctggaggctccactggtccaagaaaagatggaaaagagactgccaaaagtttctcaactaaagaattgctagaaaaactaaagagatatggtgttgctggggttctgtcatatggactacttaacactgtctactatgtgactgcatttttgttagtctggttttatgttgcgcctgcacctggtaggatgggttatggtgcagctgttgagaggtttgttaaactaatggcaatggtctgggctggcagtcaagttactaagatttttcgagctggaggagcccttgctctggctccttttgttgagagagggctgaaatggttcacagtcaagttcaacttcaagtcagaagggaaggcttttatgactattgtagggttgtgctttgctgttgctgctctcatgttctttggattaacaatactttgggcatagaacatctgctttcctgacacagttaggaatcttgaagagatgctgtggatccaatcagtaacgcagtgatcacactctactgaaaaatctcacctaatattttcagtgtggttgtccatagcctgcatgaatatgtatcttcatggttcgttagtgatcgcaaacatcttgagtatacatatccctgtaaggtcctgttggaccgtgtgcagtcatgacacattttcaaaacaaaacatgtttgctagtggaattttgccatccaaaaaaaaaaaaaaaaa

SEQ ID NO: 7772 - DNA, 767 bp, Zea mays
aagtacgcaaccccaggtcttccgagaagaagcactgcgccgaacgagcagcgagtgtgttgaggcaggcaggcagtcagtgacagtgggagtaggagacaaggctaccgagatgaagggcctctcgttgctcgtcctcgccctggtcgcgtccgctgcatgcctcgtggccgtccgcggcgcgggcgagtgcggggcgacgccgccggacaggatggcgctgaagctggcgccgtgcgcgtccgcggcgcagaaccccagctcggcgccgtccaacggctgctgcacggcggtgcacaccatcgggaagcagagcccccagtgcctctgcgccgtcatgctgtccaagacggccaagaagtccgggatcaagcccgaggtggccatcaccatccccaagcgctgcaacctcgtcgaccgccccgtcggctacaagtgcggagattacactctgccatgagctgcgcgagagctgcttgagcacatgtgcatgatccgtcggagttagcacgacgtccgcaggaagtgacggtgacgtgtcagtgtatgtgtgcgttggtaataaacgtcgcggcacttgttgtgattaccatacatgtggaagtccagtgtgatatgagtgtctcacaatcttcaaaagaaatatgggtcgtatcgtatgtaagtgtcagggttccagagatactgtcctgcatcctcgaaataaaacctgtcttcttggacagatttggttaagagagcagcttgtgtgccctcgttgtttgatt

SEQ ID NO: 7773 - DNA, 786 bp, Zea mays
gtgcccgccgagggctcggccgaacacaagtcatccgagaagcaagcacaagcaccgcaccgaacgagcagcgagcgtgttgaggcaggcagtcagtggcagtgggagtaggagacaaggctaccgagatgaagggcctcttgttgctcgtcctcgccctggtcgcgtccgctgcatgcctcgtggccgtccgcggcgcgggcgagtgcggggcgacgccgccggacaggatggcgctgaagctggcgccgtgcgcgtccgcggcgcagaaccccagctcggcgccgtccaacggctgctgcacggcggtgcacaccatcgggaagcagagcccccagtgcctctgcgccgtcatgctgtccaagaccgccaagaagtccgggatcaagcccgaggtggccatcaccatccccaagcgctgcaacctcgtcgaccgccccgtcggctacaagtgcggagattacactctgccatgagctgcgcgagagctgcttgagcacatgtgcatgatccgtgtcggagttagcacgacgtccgcaggaagtgacggtgacgtgtcagtgtatgtgtgcgttggtaataaacgtcgcggcactccgcacttgttgtgattaccatacatgtggaagtccagtatgatatgagtgtctcacagtcttcaaaagaaatatgggtcgtatcgtatgtaagtgtcagggttccagagatgctgtcctgcatcctcgaaataaaacttgtcttcttggacagaaaaaaaaaaaaaagcgaaaaaaaaaaaaaaaaaag

SEQ ID NO: 7774 - DNA, 773 bp, Zea mays
atcagcctttctcttcttcttaagagcatggactaaaagcccaaatcaatccatgtctggacgtctgcaattccccatccattttcgtacgccgtacttccccatacacactcagccagtggttttgctagggttctcatccttccaccaccgcccctgcctgccacagcgatggccgccgccgccggcggagaggacgacgcggcgtgggagcgcgccatctccgccgccaccaagtccacctcggcgcccaagaacctcaccctcgacggcgccgtcaagtcctccacgggcggcctcccctccgccgtgctcctcgagcgcttcgctgcctccctggaggagctctccgtcgcgggggcgcgcctctcctcgctaacgagcctgccacacctcccggcgctccggcgcctctccctccccgacaaccacctctacctagggaacaaccggttcgcggaggtctaggagctcgcgccgctcgccggggtccgggtcgagtcgctcgacctgttccagtgccccgtcaccaaggtcaaggggtacagggaggaggtcttcgcgctgattcctagcctcaagtaccttgatggcgctgacgctgagggcaacgagcgtttggagacggatgacgacgaggacgaggaggaggacgacgaccagggagaagaaggggcggagggagaggaggagggccatgagggtgatggggaggaagaacatgacgaggaggaggtggaggcgaatttctctttggatgttttgtcatgaaa

SEQ ID NO: 7775 - DNA, 3883 bp, Zea mays
  misc_feature (3039)..(3039): n is a, c, g, or t
ttgggtacctcgacgccggccgggacttccccagacacactcaaccaggggttttgctagggttctcatcctgccgccacagcgatggccgctgccgccgccggcgaggacgacgcggcgtgggagcgcgccatctccgccgccaccaagtccacctcggcgcccaagaccctcaccctcgacggcgccgtcaagtcctccacgggcggcctcccctccgccgcgctcctcgagcgcttcgccgcctccctcgaggagctctccgtcgcgggggcgcgcctctcctcgctcgcgggcctgccccgcctcccggcgctccggcgcctctccctccccgacaaccgcctctcgggggccgccgccctcgccgccgtcgccgaggcatgcggcgccacgctgcgccacctcgacctagggaacaaccggttcgcggaggtccaggagctcgcgccactcgccggggtccgggtcgagtcgctcgacctgttccagtgccccgtcaccaaggtcaaggggtacagggatgaggtcttcgcgctgattcccagcctcaagtacctcgatggcgctgacgctgagggcaacgagcgtttggagacggatgacgacgacgacgaggaggaggacgacgaggagggagaagaagggccggagggagaggaggagggcgatgaggatgatggagaggaagaagatgatgaggacggtgaaggggacgacgaagaagaaggtgatgaggaggctgaggacgaagacggcgaagctgaggatgacgagcttgacgcagacgcagaagacaaggagaacatcgaaagcaaggcaggatcttccctgccaaataagaggaaaaggaataacgaggatgatgccaatggatacaagtaaaacggtgagggaaagtagtattttcctgaacttcggaaacgttcctgtgcactgattattatttgtatgcttttcgagtcttttttttcccgcacttgtaatagactagagcatagttttttttaggcggttccacttctgaagtatcgtttggattctggaagttgtctgactctgaaaccatgagtaggatgtgtccccagcacgtatatacgctttgtttggtgtgctttgtttggtgtgacttcctgatgctactaatcgagatcccagtttatattatgctgatgtaaacatggaatttgtgaaacaaattcaagggtaggaaaatttcaatgaagatcggacaccatactgccgttgaaaacatgggatgtaggacattccttagatttctgctgctgacttccgttgaactaggtatactcaactgtttcgcataaatcgtcagacagcgaccactactttttccagcgttggaattttccgtctccgttacgtgtagtatgtagggtcagcaatgggcgctgtaaagggtgttgagcttctgccagatccaatggctaattaggaaatgcagagcggagcagcctgccgcgttaggttggttctaatgcagtcagcttataccaatcgtcacatcaatggagtatagtaaggatcatcgtcagctcttttctatcacggtgcttcaggccatcaacttttttatatatttttatttgaaaattattgaaaataaaaaaattcatcaaacatgtaactaactaaataaaaagcacataatttataaaaacaattaaaaattatattagttgaaatatacataattcataaaagtaaaatctaattgttatggtgtagagcctaaatatgttctactaaattattcttgagctgaccatggattggagtagcataaattatgacctcatgtggaaagatgactgcgaagttcgttggtgcttcgagtgtgatgggtggtgccacaacggaggtctcaataattgtccgcttcatatgatcctccatgttcatctttaatgataatgttgtgtagaataatgcatgcacttgtgaccacacaaaatatttggtggaaaaaagaacaatctaagtcagcgagaatgtagaaatgatctttgcaaatgctctttccacatcctggcatgcaacacacttcgaagtctatgggagggaaatggtcttcataaatatcagtcactggaagcaggtgccatcgacgaggtagtacccttagatgtacccatgtccattcatcgtaaatttcatattttgtgcttcttccttgagcacgtcaatgaacaatggtgattggttaaatgtaatacccaatttgtaatttgttagaaatattataaatagagaaaacaatccctttatgtgagtttgacctttatgtaccatcacgtgtgaacatcatattcaacaacaaacaattaataagatatatgccactaaattatgcatcatgccggattttatttttgtgtgcattttgtgataatataaaaataatgtgacaagaaatatattgaagtccaaaaaaggggaatttagaatataaaagaaaatctagaatttagaggtggagaaagaaaagaaataccacataaagcataggaaataaacatatacataaatatattctcttcatccccaaatttaattggcacatttgatatatatgtaaatccataactgaaaattcaaattggaatttgaaatctaaaagaagaaaggaaaaatctaaatgtgaaaaagaaaagagaaaaggggaaagaaatagtaaaaggggggggggcgtgttgggcccaatctctcgggcggcccatactctcttcaaccgtgcagcccacagaaccacactctcccgcacccgctcaccgacgtgtggtccccacttggcagccgcttttccccgcgcccacgtcggaccaagtctgcgctacaccgtgggatttgcggctgacaacatgggcccgttggtcattgtctcggcgccttctgttccgcctcttccgccgctgcgggctcaccggccgccgtgctaatgccccgtagatctcggaattccgttccagctggtcatcgatcgtttcccctctcggaccttttctcgtgactataaanccagttgcgttcttccccctcgtccattagagccatgcgcatgacaccccgacaccatagctgaagcagagagagattagagaagcggctgctatggtataattgctattagcggcgtcgggccttcggtgtgcacgcaggattgttccccggagggcaccgaagtggggagcagtgggcgtcgtggtggatggtggtcgggcatagaggaattcgtcgccggacttggattacggcatggcgaccacggtgtcgcgtgggcggagcccctgttactccaatcggaggtaagctgcctaccacaacaatcgtcttgtcctatacagtgcgtagcacccatagtccatgaaaatcgagcaccagggcgcgttagcaggggggccaaccatggcgaccgccgagggactcggtgcgccagcacggctcgggttgagggaagaagaaagggtgcgtgtcgttgatcttgcaatctacggtggggatttgaagccaagtgaacggttcggctgggacccgatggccgttggatgggaaaggagcgcccgagattagatcgtgtgaactgttgattcctaacccttggatcataatcggacgataggcgcgtagctctgtattcagtagatccgggccgtagatcctcaatccgagggcggtcatcgtgtactggttgatgatacctagatctaatcgtggcccttgattcgcgatcgggcggccagaaaccgtgcataccccttcgcggtcacgcattttgcatatgagcccccgaccaaaacagaaatagaacccgcagtcctgggctactgttgactgagtctcaggattgttatgtaatcgctcc

SEQ ID NO: 7776 - DNA, 407 bp, Zea mays
  misc_feature (363)..(363): n is a, c, g, or t
agagaatctgtacgcagagaaaatacagactaaattatggggggtgatcctgcacaaaaaaatccattgataacaggtgactggattctaagcgaggctactcatcacccgtaactttggaagtgtcggtatgtgtagtgttgttgtgtgtaccttgaatttctttctacatcttcctgtggtggcatagaatgcgtgcagtaagctgcattccaccaatggccagattgatgcataaatcatcatgtgcgtggtgattcaggataaactaattgcctgattgggtttttggtgctgccaatttatctgcgtaagtttttgtattgttgtcatacatctccataagcttttctaatctacacnaagcttttctaactggtttgaatagagaataagattaacatctt

SEQ ID NO: 7777 - DNA, 3084 bp, Zea mays
  misc_feature (70)..(70): n is a, c, g, or t
tatatatgattggatcaagtctactggtaccattagagttgatcctgaagatgagatcgggcgtgcgcanacggaatcccatgtaccaggtcaagacatacaagaatctcaataacaagtgcatggagctgaggaaagtttgtaatcatcctctgctgtcatatccattcttaaatcatgggaaagattttatgatcagatcttgtgggaagttgtggaatcttgatagaattttaattaagcttcacaagtcaggccatcgtgtacttctttttagcaccatgacaaagcttcttgacatcatggaggactatttgcagtggagacgacttgtttataggcgaattgatggaacaacaagcctggaagatcgagagtcagcaattgttgacttcaacaggcctggttctgattgttttatattcttgcttagtattcgtgctgctgggaggggtctgaatcttcagagtgcagacactgtcgtaatatatgaccctgatccaaatccacaaaatgaggagcaagcagttgctagggcccatcgtatagggcagacaagggaggtaaaggttatttacatggaggctgttgttgataacatatcaagttatcagaaagaggatgaattgagaaatggagggagtggagatttggaggatgatcttgctggaaaagatagatacatgggatcaattgaaagtctcatccgcaacaatatccaacaatacaaaattgatatggcagatgaggtcattaatgctggtcgttttgatcaaagaacaacccatgaggaaagacgaatgactctggagacactcctgcatgatgaagagagatatcaagactctgttcatgatgttccttcattgcaggaagtgaaccgtatgattgctaggactgaaagtgaagtcgagctttttgatcagatggatgaagactttgattggacaggtgatatgacgaagcatcatcaggttccaaagtggcttcgtgttaactccaatgaagtagatgctgtggtggctagtctgtccaaaaagccgtcaagaaatatgtcatctgggggcattgctttagacactaacgaaacacttgagaaaagaagggggcggccaaggggtacgggcaagtactccatctacagggagatcgatgatgaagatcttgaagaatctgatgaagattctgaggagaggaatactgcatccctacctgaagaaggggaagtaggggaattcgaagatgaagaagacaatgatgactcagtacctgataacaaggatgaatcagaggaagaagagcctatgaatgatgatgtatatgaatttactgaaggattaagaggcagaaaagctaataggatggaagaagctggttcaacaggctcttcttctggaagcaggagattaccaccacctgtaccttcctcatcttcaaaaaaaattgcggtctctatctgcattagatgcccgcccaggcactttgtcaaagagaactccggatgacctagaggaaggtgagattgcaatgtctggggactcacatatggacctccagcagtcagggagctggaaccatgaacgtgatgacggtgaggatgaacaagtactacaaccgaaaataaaacgcaaacgaagtattcgtcttcgtccaaaacctaatgcagaaaagcaggaagatagatctggagaaggggccttccctcagcgtgctgccaggcagcaagacgcggttcatcctatagtgaaacagaagcgcaacatgtcatctaggaaggtttcaccggcttctaggtctgggaaattgagtcacttgtctgggtctggtgaggggtctgctgaactctccaaggaaaattggagcagtaaggccattgattccactgcccctgagttcggtggcacaaagatgtctgacagtatgcaaagaaagtgcaaaaatgtgataagcaagctttggaggaggattgacaaagaaggtcatcaaatgatacctaacatatcttcttggtggcggaggaatgagaattcgtcgttcagaggtccggctggtagcacacttgacctacaaaaaatcgagcagcgagtcgatgggttggagtacggcgctgtaaccgagttcatagcggacatgcagcagatgttgaaaagcgtggtccagcacttcagctataggcatgaggtccggatagaggccgagaccctccacaacttgtttttcaacataatgaagatcgccttcccagactcggacttcatggaagctaagaacgccatgtcgttttcgaatcctggaagcggtgccgccgctgccccatcatcgtcaaagcacgccgcaccatcccttaagcgcagcagagccagtgccagtgccagtgccagtgaagcagagcagcagcatggctcgggacacagcagcaggcacaatcagcctagcgaggcggtcccgcccagccggtcccacagctccaggtcagagagagaccccagacatggcggcagcagggatcagcacctccaggacggcgccgctgggttgctgcaccctagcgacatgttcatcgtgaagaagaagaggcaagagcgcgcgaggagcggcatcgggtccccttccagctcgggccgaggcgccggacctctgtcgccggccaaccctgggcgtccgggccctgccccctcgcccagaggtgccaggacgccgttccagagggatccaccgccacacccgtctcagcagtcgatgcattccgctgggtctggatggggcagcggcggtgcgcattcggatcatcaagcgggggcaagctcgtcagcacccggcatcggagacatccagtgggcgaagcctgccaagaggctgaggaccgacagagcaggcagaggcggccgagcctaacggttggttcttctttagcgtcatatggatgtgtaaatgcatccacgtagcggatggaggcgtttgataataatcgtcagtgtatttagttcatcgtcctagcaagtcaaactttgctggcagtttttaaaacagttttttaaggaaaatcaggttatatttcagacctctttaattaacaaaaaaaaa

SEQ ID NO: 7778 - DNA, 1821 bp, Zea mays
tgggggtaccctcgaggccggccggaacgaacccgtccgtgcacgccaagcgaaagccgaaagaaagcgaagcgagagcaaacagccctccccggccggctgttcggcctgttcccctcccgagtcccgtccctgcggccaaacccacgaccaacgtctccgatccgatccaagccgccatggatttcttcaagtccatcctcgccgagcccgatccggacccggcctctccgccgccggagcaggagccggagccggagccggagcccgccggatccgcctcatcctccagcggcggcgggtgggggttcggtggcctgctcaagacgctcacctcgcagtccgagaccgtcctggaggcctaccgccgcgacctcgccgagtttggcaccggcctgcgccgcgagaccgaggtgcttcgcgaggccgccgcccgggccgcgcgggacctgccgtcctccgcgcacgcgctagacggactcgccgacatcgtcgcgcagggcaaggaggcgctctcccaggccgccgccgccgccggtggcggcccccaggcctctgacggcggcgactccgaccccagctccgcctccgggacccacgtccggtacagccgcttcgaggcgcagctgcgcgcgctccaggcggatccggccacgttcacgtccgatcccgaggacgccgaggacttcgccgcgtggagcaaggggtttatcctggacgagagggaggaggagatcgaggccctgtgctacgacagcgacgcgctggaagccatggcggacaggctcgtcccggacgccgtgccccgcgaggtgttctggccgaggtacttttaccgcgtccataagctgaagcagcaggaggacgccagggcgaagctcgtgcagcgtgtgattgcgcaggaggaggacgaggacttgagctgggaggtcgatgacgacgaagaggaagaggaagagcagcagaaagacagcacggaggagctagcagaacagaggcaagagccgatcaaagaagaagtcaggcaggatatggctgagaaagaaaatgtggagagaattgtagaagaaagtggagttgagacggtggaagaggcgcctggtttggtgaaggaagagaagaatgccgcagagccgcagccaattgttctcggtagctctttggtggtagtggacaaggaggaggaacgggaaaaagcagttctcggtagctctttcggtgtggtgggtgagggtgagaatgcagagccctccaagtcgaatgtcgaagaatcaggtgccaagaaggaaggagcgaagcatgagacgagtgattcgagcaaggacagcgattactccatagtgtctagacagcgaactgcggaggaagaggatcttgagtgggatgagattgaggatctaggagagcatgaagaaaagaaaggcggcatccagacctcaagccctgctctgaaggaggagctgcgcaagaggctgagcattgccgaagatgatgaggatttaagctgggatatcgaggatgatgatgacaatgcctgaatgccattggtggtatggaagtgtcagttgtatttctacattttgtaccttccattactcgcgcaagttactgtgatttggccaataatgattggctatccttatgctatggacacgtgtgtatactgtaaactctccagtttgatgatatcaagtggcaattggctaagcgtcaatctattaggttgtctttgtggtatttaccgtaaacatgccatgtttatttgacttgtgtcacatgttataatgttgtttgtttattaatgcacatttgctgcaccag

SEQ ID NO: 7779 - DNA, 1449 bp, Zea mays
  misc_feature (1433)..(1433): n is a, c, g, or t
atcagctgttccttactgggccgctcggcccgtattccctgctcgttcagtcgtcctcttcctccaaacctttccgctgccggtgaacttcctccacctgaagcccctaccacgataagccctaatcccagcgccacctcgatggcgaccacctctttctttcatccgctcgccgccccgatggaccgcggtagccgtttgttttcgtcgctgcccgttcagcctaaccatccccgcccgtacagcgccccggcgaccggcgccgcttctcgtcgtccgcgctaagcgcgccggcagccagccccctgctgccgccgcctcgcgtcagcccgcgaatcccagcgcggtcccgaagcgggacgtggaagaagaggaggaggaggtcgaggaggagatgccctggatccaggacaaggcgctggacctcgtggagttcactggcaccgtcacacaggccatcccagggccccgtgtcggctctagccctgttccatggcttctcgcggttcccctcgcctacgtcggggtctcctttgtgctcgcggtcgtccgcaccgtgcgcaggttcacctcgccgcacactaagaagaagcgaagggtgagtaagaatatattcttgttgaagtcactagatgatctgtttcagaagggcagggaggcaataaattatcctgctcttcaggacctaatgcaaaagacaggatttgacatggatgatgtagtaaggaagtacatccgttacacactgaatgaaaaacagttcagtcctgatgtggttgtggatctcatacatcttaggaaggcatcaatgctggaagatgcagaagttgctgaaattttaaatgagatttcaagacgaattgtccgggaaaaagggccagtagttatggacttatctggttttacagagcaaggttttaagcggaagcttgctgtacaagcactgtttggaaaaatcctatacttatcagaacttccggagttctgttcacgggacagctcacttgtagtcaaagaaatctttggagttacagatgaggatgcagacagcctgcggattcacaccctatcagcaacaggtgatatcgaatctatacagaagatggtggacgatctagacctagaacaaggtcccccatcatcgtcttgagttatggtggtggaataatgctaaacatcttcgttgatagtgttgcaattttagattgatgtgagtttctcgaatcttttcgtttagttttttcagctgctgaagtaggacttgggcctgtgaacacaggatactttcggctggagcctggaggttttgtaaattgcctctcgattaggataacgtatgtcagacctgcccatgatttgagtaaacgagaatactattattatagaaaaaaaaaaaaaaaaaaaaaaaaaaaaaaaaaaaaaaaaaaaaaaangaaaaaaaaaaaaaaa

SEQ ID NO: 7780 - DNA, 1531 bp, Zea mays
  misc_feature (1450)..(1450): n is a, c, g, or t
tgcatgcctgcagccagacaaaactgcaattgtggacagaaatgttcttcttcttgctcactgtttggacaaaactgctatgtttttctaataatctagattcattcatggttgtggcatgagttataacctttgtcagttggtctcactgtttgggtggacaaccttgatgatgatttttttttgaaatccttgatgatgaattgaatggaagctgagtgcctcactgcctcttcagagttaaaaatggactgagaaacatagcagtgatggcggtgggttacagagaggggacagtggatggagtggagcctgcatctcatacaggagaaaggggttcggatacaggagaacaagaaggagcaggggcagaaaagtcctatgccatgagcagcatccgtgtttgttatgtatgcgcaaacagttcgaaacgagcgagcgtatggctgtctccgtccggttgtagcgaagtccgacggcgggatccgattgtggcgaagtcacgcccgtgcagtgcgcccacagcaaaaagctccgcggcggtcgcgtgacgtcgcggcaaacggcaaacagcgaattcacagcagcaaacagtgtgaatcctgcaatctccaaacccaagcccggcggcgagatccgcgcggcaggcggacggggccgctcgaccgccttcgtgccgtgcgcgcctccccacctcttccgttctccgctccccgcgcccgcgaaggcgaattgctgaattgagggtggtggctcgtgcttgattttgattttgggggtcggtttcagttccaattcatgacggtgcggccggggtgggtggtgagggtggcgcatggctcggcggcggcgtggcagcgcgtggcgtgcaacccggagacgctcccgcctgaccgcgtcctcgcgctcatctgctgcgcgccgctccacctcctcgcgcgcctcgccgccttcctctgcatccccttcctccccgggcccacacgcaccccgctccgcctccaccgccgccgcttcctcgtcctccgccccccggagcttgcgccgcaccctttcgcttactccccctcgtcttcctcttcttcgtcggatgaggaagaggacgacgacgatggggacggcatccacgaacacgtcgattgaggttgcttgaggttaaggctcagaaaaggagaatttggggttgaggagggaagaatgaacattggcatgttgtgctggatgctgaactgctcgcccttctatgattctatctcgtagttctcaggatatggcattatgacgacgctcattataaaaagccaggtcagaagctctgcaaaaaggataccaacggatgaaactggtttgagttgtcattattgttgctgttgtttaaacgaactactgatttttttttttatattgaaaagaagaaagtggaggaggttaagccttggttaagaggatnggtttgtgttagacttggcgagtcaacgttaaacttagtcattttaatagtaatggaatctgaaagaaattcattgtggcg

SEQ ID NO: 7781 - DNA, 972 bp, Zea mays
ttgggtaccccgtggcccccccggccgcgcactgcttctccccacggcgcacgccagccgtcagcccgtcaccgattgttctggctcctgcgcgccgccagccccgcttgttctggctcctgcgcgccgccagccgtcagcccgtcaccgattggagatccttggacacctgcgcgccgccagcccgtcaccgcttggagacccgcgcagccgcgcttccctgcgcgccgccagccgtcgccgatccgtggccgcgtccgccgccgccagccctaaggtcgcgccgtcagccagcccgtctgccgtcgtgaggtactgaggaatttttctggtaatcagcatggcactgtcatcaatgtttaagagaataaatgtgaaagatttgacctccaaggtttcagtctataccagtgctacagagttatctggtggactaaacatgatatttaggcgctgggccacgaaaaggactgctggatcaacaaaaaatggtcgcgattccaatccaaagtatttgggggtaaagaagtttggtggagagaaagtactaccagggaacatcattgtccgccaaagagggacccgcttccatcctggaaactatgttggcatgggcaaggatcatacacttttctgcctgaaagaaggcaatgtacgctttgagcgcaacaaactctcaggcaggaaatgggttcatgttgatccagttgctggtcatgatcttcaccccatttacgcagatggttttgctactacatccgacactgagccaatgcaataaatgtgcttggggatttgggctgtcattttgttccaactcattcagctgccattttacagtttcatgtgtaaactttagcaggcttgaacgtagctggatcttttctttgtaatcataactactttgaataatataagttatacactgccaaaaaaaaaaaaaaaattcgcgtctggttccctccctcgtgc

SEQ ID NO: 7782 - DNA, 1206 bp, Zea mays
ttgcgcgcccccagcccggcccagccccagcatcatatctattcatcttgctctcctctgtccaaaaaggaggcgccgcgctcctcttcttctacgccgttcactctctctagtctctcccttcccttctccacgcctccgcccccactcgtgagaccctacctagccctagcgccagcaccacccgcccaacctcccggagagagagaggaggaggccttcgccgccgccgttaccgtcggccgaggcgccagaatgttcgggtaccagaagggcctcgacgtcgaggcggggacatcgggcgccgccgccacgggcggcgcgcgccagctctacccggggatgcaggagagccccgagctgcgctgggcgctcatccgcaagatctacgtcattctctccctccagctgctcctcaccgccgtcgtcgccgcagtcgtcgtcaaggtccgcgccatcccgcacttcttcaccaccaccagcgccggcctcggcctctacatcttcctcatcatcctcccctttatcgtgctgtgcccgctgtacttctaccacgagaagcacccagtcaacctgatcctgctcggcctcttcaccgttgccatcagctttgctgtgggcatgacatgtgccttcaccagtggcaaggtcattctggagtctgcaattctgacaacagtggtcgtgctcagccttaccgcatacactttctgggccgtgaataggggcaaagacttcagcttcctgggtcctttcctgttcgccgccatcatagtgctgcttgtgttcgcactcatccagatcctgttcccactgggcaagctctcccagatgatctacggcgggctggcgtcgcttatcttcagcgggtacatcgtctacgacacaaacaacatcatcaggcgctacacgtacgaccagtacgtctgggccgcagtctcactgtacctggacgttatcaacctcttcctgtccctgatgaccctcttcagggcagccgactaggcgctctgctctcatcctgtctatctacgagtcggtgcctgaatgctcccgtgggttaagctccggtacccagaattccagttccaagaatagagttgtatatagctacccgcgttgcctttctactagtatggtcttattcggcttggctcggttcgaacaaaaaaaaaaaaaaaaaaaaaaaaaaaaaaaaaaaaaaaa

SEQ ID NO: 7783 - DNA, 1370 bp, Zea mays
ctgtcagtccggtggtgcaaacatctatagtaactacaatacgacgtcttcctctccgcagaggccaccaatacatcatctgctcccctcgggcccgccggggtccaaaaaggaggcgccgcgctcctcttcttctacgccgttcactctctctagtctctcccttcccttctccacgcctccgcccccactcgtgagactctacctagccctagcgccagcaccacccgcccaacctcccggagagagagagagagaggaggaggccttcgccgccgccgttgccgtcggccgagacgccaggatgttcgggtaccagaagggcctcgatgtcgaggcggggacatcgggcgccgccgccacgggcggcgcgcgccagctctacccggggatgcaggagagccccgagctgcgctgggcgctcatccgcaagatctacgtcattctctccctccagctgctcctcaccgccgtcgtcgccgcagtcgtcgtcaaggtccgcgccatcccgcacttcttcaccaccaccagcgccggcctcggcctctacatcttcctcatcatcctcccctttatcgtgctgtgcccgttgtacttctaccacgagaagcacccagtcaacctgatcctgctcggcctcttcaccgttgccatcagctttgctgtgggcatgacatgtgccttcaccagtggcaaggtcattctggagtctgcaattctgacaacagtggtcgtgctcagccttaccgcatacactttctgggccgtgaataggggcaaagacttcagcttcctgggtcctttcctgttcgccgccctcatagtgctgcttgtgttcgcactcatccagatcctgttcccactgggcaagctctcccagatgatctacggcgggctggcgtcgctcatcttcagcgggtacatcgtctacgacacaaacaacatcatcaggcgctacacgtacgaccagtacgtctgggccgcagtctccctgtacctggacgttatcaacctcttcctgtccctgatgaccctcttcagggcagccgactaggcgctctgctctcgtcctgtctatctacgagtcggtgcctgaatgctcccgtggttaagctccggtacccagaattccagttccaagaatagagttgtatatagctacctgtgttgcctttctactagtatggtcttattcggcttggctcggttcgatcagagtctttatacgtagttggatcgcgaacaaatgaacctgcatgggattatggagagccatctgctttatgatcctcgtttaaaaaaaaaaaaacgttgtatcagctgaaagctgaaaataacatgaatagaattgtgaaccaccggagaaccgt

SEQ ID NO: 7784 - DNA, 1238 bp, Zea mays
gtcttgctttctctgtccaaaaggaggcgccgcgctcctcttcttctacaccgttcactctctctctagtctctcccttcccttcacgactccgcccccactcgtgagactctacctagccctagcgccagcaccacccgcccaacctcccggagagggagagagagagagagagaggaggaggccttcgccgccgccgtttctgtcggccgaggcgccaggatgttcgggtaccagaagggcctcgacgtcgaggcggggacatccggagccgccgccactggcggcgcgcgccagctctacccggggatgcaggagagccccgagctgcgctgggcgctcatccgcaagatctacgtcattctctccctccagctgctcctcaccgccgtcgtcgccgcagtcgtcgtcaaggtccgcgccatcccgcacttcttcaccaccaccagcgccggcctcggcctctacatcttcctcatcatcctcccctttatcgtgctgtgcccgctgtacttctaccacgagaagcacccagtcaacctgatcctgctcggcctcttcaccgttgccatcagctttgctgtgggcatgacatgtgccttcaccagtggcaaggtcattctggagtctgcaattctgacaacagtggtcgtgctcagccttaccgcatacactttctgggccgtgaataggggcaaagacttcagcttcctgggtcctttcctgttcgccgccatcatagtgctgcttgtgttcgcactcatccagatcctgttcccactgggcaagctctcccagatgatctacggcgggctggcgtcgctcatcttcagcgggtacatcgtctacgacacaaacaacatcatcaagcgctacacgtacgaccagtacgtctgggccgcagtctcactgtacctggacgttatcaacctcttcctgtccctgatgaccctcttcagggcagccgactaggcgctctgctctcatcctgtctatctacgagtcggtgcctgaatgctcccgtggttaagctccggtacccagaattccagttccaagaatagagttgtatatagctacccgcgttgcctttctactagtatggtcttattcggcttgactcggttcggtcagagtcttgatacgtagttggatcgcgaacaaatgaaccttgcatgggagtatggagagccgtctgctttatgatcccaaaaaaaaaacccaccaccccgcggcca

SEQ ID NO: 7785 - DNA, 850 bp, Zea mays
ttttttttttttttttgtgtttcgtgcacgttgcaacaatgaatgggtgcggttgaggggttaccttgtacatgtttcttctacaatgcaaatgcaatgatattcacagcaccggttcaattcaacaaatgaatggggttatgcaacactcctattttttacattaaaaaaaatgcagtgcttcttccactgtaatctgttccaacaatacgtgctggcatacattaactacctttgaataagctcctgaatatcctcagtaacaactaacaagaaacaacagcagcaatagccacggcactcatttccttctcaggcctatgctcttcttcttctgagtgattgcaaatcgtctcgacatcgcaacattgtaaaatttcctcatatgctctgacaaccgatgtatcgcaccaaggttgcctacagctgataacctcagcattatagcatcaaacttcttgtatgaaagtttcatgtcacggtttataacctcatctagaagagcagttgcatattctgtttctccacaatcaaagagaccatagatcattatctcgtaggtatcgatagcacgttgacatcctcttttgtccatctcaagccatatatctaatgctctatgtgcctctcccatctcgaagaacatcatcatcagcatattataggtatgaacactgggctcacagtgtgcctctatcatcctctcacagagttcaagtgcatcatcagcatttcgaagactacatagcacattaagaaagcaattatacgtgacaatgtcaggaggacatccagccctccccatctcgtccaacacacgataagcagcatccagtctcccacgcgtccg

SEQ ID NO: 7786 - DNA, 1879 bp, Zea mays
tttggcctttttttttttttttttttctttcccaaacgggctactccaacggaaagcctcgctagtcgctgccatcgatgttacacacactgcaaaagtacatcagttccaacaggcacagcagcagtcgatctacgcaccgccgaccccgtccgtcctggtgttatggcagcgtcagggttccaacttccaacaagtcagtgctcctagtcctagcatagcctggccctccctactcatgcttaactacgtcagcatttagatctgaaacagaaacttgaggtccgcctctgtaagcttcgacatggcatccggcgagtcccccacggtgccttcaaacaccagctgcttcttctgttgcagttgcagtatgcgctcttcaaccgtgtcctttatcacaaacctagtgctcttgattggcttgaactgcccaattcggtggatacggtcctgcgcttggttctcgaccgctggattccaccaagggtccatcaggaacacatgagatgctacagtgagattcagagcgactcctccagcttttaagctcatcaagaagaccctgcagtctgcatcatgggtgaaggtgtctatggctcttcccttttcggtaatgttcatggctccattcaactggacacacttaatgccggacctctccaaggaaaactgaatcaaatccaagaatgatgtgaactggctgaagacaatccctttggcagaaccatcgtgctcaatcatgtttcttatctcctccctcaaggcatcaatttttgtactcgtcttaaaatccacaaggcttggtagtctgctcaatattcctgaacatttgcgacccttgacacttcgagttacttttccaactgaattttgtgctgttaagtccacggtgagaggtattgaacaggatggacatgaaacattccccaaagctgcagagtagtctatcaaacaagtcttgcagaatgcatgatcacaagaggtaaccacaacatcttcagccaaattatgacatataccacattggctctccatggactcgtttccttcattcttcattccttcaggatgtcctgctgttttagaatatgctacaagatagggatgatcaacagcctgtctcaaccttgtgagaagatcgaagatatgagcgtagttattcatcagtgttccagcatctacatatgcatcaaattgtgtgacactctgagtgtacaaagcttcatagaattccatttcgcttttatcaaaagagtcccgcctcaatgtcacctatcatgtaaaaactaactgcctcaaaatgtttgcaaatgaggaaagaaagggtattactctgtatttggccagacgaggaaggccgaaattgaggtggtcgagtgctggcaatagcttgtctcatacggatggtgtgcgcccctggatatcccttctgttcatctcctgtcacagaaccactgggagcagtctgctgaccagaaacttgacctgataaagaatagttgcttgggtttgtctgagggcttcgttatgcctgcatttgatattgtgaagcagcttgcttaagcaatttatcaccaacaatattccttacagtttttaagaagtattccttgctgacttcatttttcatcgaaggtctaacacttccaaaatagcttcatcagccttctgatcctttgaataagatcctgattatccacagtaacaactaacaagaaacaacagcagcaatagccacggcactcatttccttctcaggcctatgctctttttcttctgagtgattgcaaatcgtctcgacatcgcaacattgtaaaatttcctcatatgctctgacaaccgatgtatcgcgccaaggttgcctacagctgataacctc

SEQ ID NO: 7787 - DNA, 906 bp, Zea mays
  misc_feature (39)..(39): n is a, c, g, or t
ccccggccccggccgggggaaagggctctcagccatggngaagcccaacgagaactcgggcccaatccgctcacgcacctttctccgtcttcacgaacgaatcacgatcacgggtgccacaactccctgccgatccagtcccccggcaaattcccaaccgccgcacagcaagcaacaccagcggtcggatcgggggagaaacggaagggcaacagcagagcgcgaattcctcagacaaatccaaggtttcgagcacagacacaggcgaaactcgatggcggaggggtccaagccggacgtgccgctgttccagctcctcagcgatcttctccagcaggtggagtcaatgagcaatcaggaagaagtagagctgcgcgctaagattgaagcattaggattagaagtcactaaggtaccagagcagcccgctaatcatctcagcgagctagaaatagctgcagagttggacaagctgtcatcgcggcttgataacgtcgacaagatgatatcatctgccatggcctcagatccagaggtgaagtctcttctgagcagcacatctgatatctggatgccggtcataacagcgtctgccaatgagaggcgggggtttgttgggacgagcagcgaaggcagccaggaagagcaggagaattccaagcaatagctggtatatgggctgttaatagtttcgttttgtgggtctgtaccgaccttatctatgttcattcaaactagtgtttccatgccaaaaagtttgtggcgtaataaacaataaaaacccatgtccttcattcggattagtaatgagtgtgatgatagagctaaaataaaaaaaaaaaagcccccaaggccgcctttgaactaaaacgcgaataatagaaaagaacggagggagtatgattt

SEQ ID NO: 7788 - DNA, 5406 bp, Zea mays
  misc_feature (1993)..(1993): n is a, c, g, or t
ccgagcctcgccagtgctcccgccgccgccgcccgggcccccgccacccggcccgcacaagaagcgtagggaggagggcggtggcggcttcgaccggcgccggctcggcccagtcggcggcggagggcacgaacaggacgacaggaggtatggaaatggtcttggtggtgtaggaggaagaggtggtgatggtcaatatacgaatcgtgcaccagattggtcggattctggacgtggtggatggaatgagggtcctgggaacagtcgtagggaaggattgatgtcatacaaacaattcattcaggaacttgaagatgacgtttcaccagttgaagctcaaagcagatacgaggggtacaagtcagagtacatcacaactcagaagaaagcatactttgacctccataaggatgaagattggttaagaaataagtaccatcctacaaaccttgaaaatgtcattgaaagaaggaatgaactggcaagaactactgcaaatgatttcttcctaaaattgcaaagtggagatctggacatcggtccaggtttgacgggttcggcagtgagcaaatcaggaattaatagcagtaaaaatctagatgcttgtggaaggcgatggtaaaaagggaaaacatggaaagggttctgatgattcatattatgctgcttccaaggctcacccagttagttccgaggttcgtcgaattcgaattgacattgagcaagctcaagctctcattcgtaaacttgattctgagaagggtattgaaaacaacgttctctcaagtagtgaccatgaaaagtcagacagggataagtcacatggttcagtggggccaattgttataatacaaggatcatctactgtgaagggtcttgagggtgctgagttgctggacactcttgttacttatttatggcgtatccatggtgtggattattatggtatgtctgagacaaatgaacctaaaggcctaaggcatgtgaaagctgatgcaaggacatataatggggctagctcaaatggtgctgaatgggagaataaacttgattcattctggcaagacagaattcaaggtcaggatccattagaaatgttgaaaggaaaggagaagattgatggagctgctactgaagtcttggatccatatgtgaggaaaataagggatgagaaatatgggtggaaatatggatgtggagccaagggctgcacgaaacttttccatgccgctgagtttgtccagaagcatcttaaactgaagcatgcagacttggtggttgatctaacttcaaaagtgagagaggatatttactttgagaactatatgaatgacccaaaggcgcctggtggtacacctatcatgcagcaacctgctccaaggggaaaaggcagacaaaggccaccaatagagagtcggctgagggatgagcgtgggaatcataggttcgacaggaatgttgattcaccaacacgtgatgggtctggtgaaaatcccgatgatcctatttatgattcgtttggtgatccagctatgcatggtgccttccctccagatatccctgctcccccggttctaatgcctgtgcctggtgctggtccgctcggaccgttccttcccgccacccccgatgttgcctggcctacgatgtactcatccagctcatctccatgcagtccgctcggaccgtttattcccgcaccacccgaagttgccatgcatatgttgagagatcagggtgcgccgccacctattgagccaaccggaggtccacatcctaggaaagcagggacgggtggtggtccttcaatgcgtggcccatccccaatctttggcgctccttcccctcatcatatgcatgatcctcgcagaatacgaaggttagtatttacttgtctatctcaagtttctttgcactttgcactgcgtttctcatgatcatgaagtcatcactctttgaataaaacaattcatttgccacattctgagacgangcctttgacagtgagacaaagcaatgcgtaactgtttatccgttgccaacttaagtttgatatcattctgttttacattttgccttgatttgtatattgggagcctccggacctcactcatgtgggagactctggtagtaggtctgtccttggtttttgttttggccatttcttgtgagtttgagtaccaaatttgaacacttgactgtaaaatttaagctgatcggctgattaaaactcctgcttgctgccactggaaaatgttctagttgaagaatggttggaattttggattatgggactctgttcgcttctgattgctgcagcaaccgctgcggcattcattcagcagcagctgttgcctcactttacaacccaagcagccgcaggagctttggctgtgcagccatctctaccgacactgctatctgcagtcctagtcgttctcaagtctcaaccatgttctagtacttctgcaaccatattatgatcgtgtggaatatggccagtttataacaaatgcttgactaggacgtacgtctttccagatacctagcgatgcaaacatttcgtctgtttggtacaccctctcaccagttcttgacctcaccgtgcttgcagctaccaagacctcgatgctccggaggacgaagtgactgtcatggactaccgaagcttgtagacttcctccagttcttgtgcatccagatacctttgtagtcaacatttttagcgcgagagaaaaacaccttgctctttctagaatcgccgcggaggaaaccccggcaggctttttgtgtcgcgaccactgagatgtcagcttctcagtgttttgtaaaacgaaacacaggaagtacattacaacttctccccattaaacaaggtgaaagatttccatcagtgttttgtttttttggtcagcccagcattgatgtacatgtacgtaccttggcaaatagggcgggggttcgtttgtcgctgcacatgcaaatggcaagtggagtcgactggtgtctgctctcgcagtttattatattctgtgcctgcctggagctgtttccgggaattcttcatttcttccccgtgaccgtgatcctgatccgtgggagctggcaagcatgctggtccagctcgtggacggaaactgtttggaaagctccagcccctggacctggacctggagcgctgagctggacgggtggaccccagatccggtccagtctgtctgtatctgctcacccaatctggacaacacgtggaaacacactgctgagtgctgactgcgatgtgcgatcgcatcgcatgcatgacccagcgacggtcgcgggggcctcaatcaacacggcgaacacgaaacccagcggatgacagatgcgccgaacgggcgtgccgcgccacgcttccttgctggccagcggcggcgagcagccggcggtggtcgctgtcggccacccaccgccggagccggagctctcgctctcgtgccccggcgtgcaagtaaatccgtgacccgtgagaaagggaggcgggcgagtactatgattgggcggcagggcgctgtacccgtactgagggaagacgagcaggagcatgtgtgcggtggtgtgtgaccgaagagcccgggtttccggcgaagtgagtggcacgcgacgtggaccggaccggagcgggatcctggacggatcgcaagctggacccagtaatgaccgtaataccgtatgctgctgctgctgctgcttcctcttcagcattccttttgtcgcctgaccgatcgtctatacatcgtattgatatgtcatagtacgtgactgttgccggtgcatgcaactccttttttcgttctttctttttgatatatcgcgggagatgaatcctgctacgtgctacttggacatgacagtagtgccatgtctgtggttcgcatcgatcgagttgtatcctcatgctccactgctccagtatcccattatccttttgggtcccgtctgtgaatgaatccatcgagctgcgtctccatttcaaacctgtcagctaaacccgccgcgccaagcttgactcgagtaatccgcagcgtccgattccgatcgttacttcccgccggacacggatcactgaccggtgggccacctccacgtctggacgagctcccacggtcctggccatgcgcgggcccatgtggcagcgtgatgcgccgcaagaagcttccacgaagcttcatggccgctaccgcctcgagaacaagtccccattcccgaccgcaaaagcgggccgagccgaggaagaagagaacaaaacgaaacccgaagctttttcccccattcttcgctggatatacaggaggattttcagagtcagggaggtgagggagagagggcgaggcaactgtgtgtgtgtgtgtgtgtgtgagcaggcccgccgagaagaaccttcgcgacgccgaggtgagccgcgactgggttcccgccggccccacctggcgtccccagcgatctcgtggtgacgtctgtgtggcgcgcaggggtcggtcgcgcgcgggcgctcgtcggtcggtcggtcggtcggtgtcgtctctcctgcgaaggtgcccctggctgctgctgccggggtggtctgatcgggcatggcgcaggggagttcgccgccgccgccggagatccgctcgccggacgagcgggccgcggcggaggaccccgccgaggcggaggcgggggaggtggtcttcgacgacgcgttcgacataccccataagaacgctccgcacgaccggttgcgccggtggagggtacgcgatcgtctccctcctctgactgtctctgttcccttcggatttggatcttcggttggcctgtcgtgccccggggatctgggttgcgtcctccgtgtggtttacctcgatttggaaatcattagtgcgtatgccgtactctaaccgtttgagtgttctcggagaataaaataagtatacagccattgtcggtatgatcgtgactggggtgtggagttcggagtgtggttgtggaggcgtcgtttccattttcgaggctccaagcgttctgccgcacggagagaaggggaattgcgaatgtgtgacgagcatttcactgaagagttatactccagtgaaatgtcccgatgctttgattcgggggttcagcagcctcttttctcctaatgacatgcgcactgtgcttgttttctttctacattcctacaaatgcattgtggatcgtggtctgtttgcggacacaacacacaatgcctgatcctgccactttgcgcaaattcatgtagccacagagttttccaaacattgatgctcttatgcagacgaggatactgtctgtagcttggctggattatcccgttgacatgctggggagattattaaaagaagcaggcatcaattttatggc

SEQ ID NO: 7789 - DNA, 2043 bp, Zea mays
  misc_feature (2029)..(2029): n is a, c, g, or t
cattgttagcttatttttatctgccactatttgttatatacaaaaaatacgcggtgcatccggtgtgggttctcggatcagtcgtagggaaggactgatgtcatacaagcagttcatccaggaacttgaagatgatgtttcaccagttgaagcgcaaagcagatatgaggagtacaagtcagagtacatcacaactcagaagaaagcttactttgccctccataaggatgaagattggttaagaaataaataccatcctacaaaccttgaaaatgtcattgaaagaaggaatgaactggcaagaactactgcagatgatttcttcctacaattgcaaagtggaagtctggacaccggtccaggtttgactggttcggcagtgagcaaatcaggaaataacagcagtaaaaatctagatgctgtggaaggggatggtaaaaaggggaaacttggaaaaggttccgacgattcatattatgctgctcccaaggctcacccagttagttctgaagttcgtcgaattcgaattgatattgagcaagctcaaggtctcatttgtaaacttgattctgagaagggtattgaaaacaacatcctctcaagtagtaatcatgaaaagccagacatggataagtcacatggttcaatggggccaattgttatagtacaaggatcatctactgtgaagggtcttgagggtactgagttgctggacactcttgttacttatttatggcgtatccatggtgtggattattatggtatgtctgagacaaacgaacctaaaggcctaaggcatgtgaaagcagatgcgaggacatataatggggctagctcaagtgccaccgaatgggagaataagcttgattcattctggcaagatagaattcaaggtcaggatccattagaaatattgaaagcgaaggagaagatcgatggagctgctactgaagtattggatccatatgtgaggaaaataagggatgagaagtatgggtggaaatatggatgtggagccaagggctgcacgaaacttttccatgccgctgagtttgtccagaagcatattaaactgaagcacacagacttggtggttgatctaacttcaaaagcaagagaagatatttactttgaaaactatatgaatgacccaaaggcgcctggtggtacgcctatcatgcagcaacctgctccaaggggaaaaggcagacaaaggccaccaatagagagtcggctgagggatgagcgtggtaatcataggctcgacagtgatgggtccggtgaaaatcccgacgatcctgtttatgattcgtttggtgatccaactatgcatggcgccttccctccagatattcctgctccccctgttctaatgcctgtgcctggtgccggtccgcttggaccgtttattcccgcaccgccggaagttgccatgcatatgttgagggatcagggtgcgccacctccttttgagcccagtggaggtccacatcctaggaaagcagggacgggcagcggcggtcctccaatgcgtggtccgtccccagtcttcagtgctcctccgcctcatcatatgcatgaccctcgtcgaatacgaagctaccaagacctggatgctcccgaggacgaagtgaccgtcatggactaccgaagcttgtaggcttgcctccagatactcgtttaggtaaacattacagtgcgaaatcaaaacatcttgctctgtctaaaatcaccgcggaggaaccccagcaggcatctcagcacctgtgtctcgactcctgagctgtcatcttctcactgtttgtgaaacgaaacacactacaggacgctcgacaaaaataggccaccgtgaaacacggtgttagctcagtctgtgcaatgcgaaagattttcgtccatgtttgagcactgtaaaacactgttcccaacataacgtccagctggacagagtagagtttaaatatggttagtgagatggatagtttgatggagataagatttattaggggattaggccaaaaaaaaaaanaaaaaggcggccgc

SEQ ID NO: 7790 - DNA, 758 bp, Zea mays
ctcccccttacttgacctagaacctggcctcgggccgacgcctcctgctccctctcgctgtcgcgtctcccggcgaccctctccgtcgacgccccggctatcggctgccgcccatcatttcccggcgaccagatcgacggcaatcccatcctccttgatctccctctcgggcgtcgggagatctacgcggggaccatgcataagctggggagaggaagccgcgacaaggtgcaacagttcatggccataactggtgcaagcgagaaggtcgcccttcaggcactgaaagctagtgattggcacttagaagggtcttttgattatttctacagccagccacagatttctgtgaccaattctcgacatcttgaagatctttacagcagatacaaagaacgtgacgctgatatgatcatggtggaaggcacatctcaactgtgcaacgacctgttggtggatcctcaggatgttgtcatgcttgtcatatcatggcacatgaaagctgccacaatgtgtgaatttactcgccaggaattcattgatggtctgcagtcaattggggtagattcaattgagaagctccgtgagaaacttccatcactgcgagctgagataaaggacgataataagttccgtgagatatacaactttgcgtttgcttgggctagggaaaagggtcagaaatcccttccactggagacagctattggcaatgtcggaggttgctgcttgctgaaaggcattggcccttaattgat

SEQ ID NO: 7791 - DNA, 1293 bp, Zea mays
ccacgcgtccggtcattgtggttatcgggttgggtcgggccgtatcttcgtaagcatacacacacacgcgctggtttagactcagcacacagcattcattcagctagcgagcgagagagaggggaacaaaaaggaagggcgaggaggacagggagccgagcgcaagagctgaggcttcgccgcgaaaccccagacctcgcgccgccccttcccctccgcggcgtcgtcctcgcacgctctccgatccaagatgtataagctggggagaggaaaccgcgacaaggtgcagcagttcatgaccattaccggcgccagtgagaaggttgcccttcaggcactgaaagctagtgattggcacttggaaggagcttttgacttcttctatagccaacctcaggtttctgtggtcaatactcggcatcttgaagatattttcaacagatataaagaacctgatgctgatatgataatggtggaaggaatatctcaattttgcaatgatctgcaggttgatcctcaggatattgtcatgcttgtcatatcatggcacatgaaagccgccacaatgtgtgaatttactcgtcaggaattcattggtggactgcagtcaattggggtagattcaatcgagaagtttcgtggaaaattaccatcattacgagctgagctaaaagatgacaataaattccgtgatatatacaactttgcattcacttgggcaagggaaaagggtcaaaagtctctctcactggagacttctattggaatgtggcagttgctatttgctgaaaggaactggcctcttctggatcattggtgtcagtttttacaggtcagacacaataaagccatatctagagacacatggtcccagctgctggaatttgtgaagacgaccgatccacagttatccaactacgacgacgaaggtgcctggccctacctcatagacgaatttgtggaatatctgactgagaacggactcgtccagcgtaaaagatgaacaacggggagatgcatctccaaacaatggttgggctgtacaaacatgatttatctcggtcagctcgacgcccagggcctgatattggcactcctgctcaattcattcaccaaactgttggcatatcattgaatttgcttataaacgtggggaaacataacttgcctgggaagtggtggctgtcagcctgcgatcgtgaactgtaacttatcgaaaatgcaacggagtttgggactctactatatgatttgtttcagtttttcttaaaaaaaaaaaaaaaaaaaaaaaaa

SEQ ID NO: 7792 - DNA, 1435 bp, Zea mays
aaagagcagtgggtgtgggttggctttggcttggcttggcttggctggtcgcagtcgcagcatatataccacctcggcattagagcggagcggttgctctctccacctcctctctctctttctctttcggtatcgcagtcgtcgtcgccgctccccggccgggctcgctcgcgtgcgcgacccacccagccagcacaccagccagtcggcgcagcaaagcatggggaactgccaggcggcggaggtggcgacggtgctgctccagcacccgggcgggcgggtggagcggctctactggtccaccagcgccgccgaggtcatgcgcgccaacccgggccactacgtcgcgctcgtcacgctccgcgtcgccgaggagcggcaggacgccccgggcggccagcggcgcaccgtgcgcctcacgcgcgtcaagctgctcaagcccaaggagacgctgctcctcggtcacgtgtaccgcctcatcaccacccaggaggtgacgaaggcggtgcaggcgaggaagcaggacaagcagaggaaagcgcagcagcagctgctggagccgaggcagggccagggcgtggcgagtggcgccgcggccgaggaggaggacgacgacgacgaggcagccttggacgccagccttgatcagttggcgcggcaggacaacggcagccggagctccagtgcgcggcaccggcaatggcggccgtcgctgcagagcatcgacgaggccacgacctgatgagatgtcagctcgatacagccgtagcaccgtaatcattgactaccggtgggcctgtactttcggtgatcacctggcctcggccagttcatcgcaagggttgctatttggcctactgctacgattgcacactgtggactgtggagtgagttgggagcttgacaccccgggatgagagggcactgcttcggatgcagcatgtagcctcggatccgtgtaaattttcaggtcttggtcaggagtttgttagtgagactgctttgcttcttcttcttcttcttattttctctcgatccatacggtttgcacatggaattatatcagtaacaaattagagtagcttactattagatttacagccagacatgtcatgtacttgctgctactctcttgcagatgggaatcgagcgtgtagccttttgagagtagcgctgtgtttctttagtattcgctgttgatgccaaataggcgatgatcatgaactcagtgccaatgattccggcggcagttagtggaatcatcggagccttttgggctggaagcccatcatgcgtattattcgcgtcggcgatgcttagcttagcgcttagcgcctgtcctgacggagccttttggggttcgtgcgcatttgtttaagccgtcgctggtgctgtagaacaggacaaacggcaaggggtttcgaaactgatacgt

SEQ ID NO: 7793 - DNA, 4722 bp, Zea mays
  misc_feature (4472)..(4472): n is a, c, g, or t
ccttcttattcgtgttggaccggcccaggcccgtataaaagcgggacagactgggctcgtaccgggccaaaaaaatgtgcttcggaccgggctttcgtgctttttgtacatgtacctccggctcatcctaatttgacctcaaatcaaacacatcttagtatctcatgcaagtggcgaagtaagcaatttttttctagcttaatcaatgaattagagctgcttgaatccaaaaggataaggatttccatgtccctaatatgccctaagaaccggattgcatttggggcttcagacccgtgcatggcagcatgagaaagagacagggcttgaagttcagtagtgaccggagaatccacaggctcctcatgcatcatccgacaactggaggaactaccagcagacctcttccaccatatgaagaggcactgtatgagcacatttattatgtccacgatatgggagtccacacacttatagcataatcctttcgccttgtagagagtggccaatttatcttcattcggtgcatgtcggacagggggtgacagtgacagcttcatatcagccccttccagcggtatatagatgaagaacgcttggatagacctcaggcagaatacttgaagtcaccatgacgacggccgacatgttgcgactaagtccgacaaggtgttgccggagttgagaacgtcgacacacacaagacacaaacgcgaaggctggaatacacgagatcctttttggtgcagttaagccacagttttttttgactctgtattcatactaaacgaacagaaagagtgctgcgagatttcctcgcgcacgacgcatgaccgctccacgttcgtgagctccgtgccatcccacggcgaacgtgacgcatggatcatccttgaccacgtccatgatgctaacagactccctacttccaagcttagtccctgactaactccgactcacccaagctgactagatattgaagaaccctgacgaaactgaaacaaagaacgattaaagactctgaaactgaaactctgaatgcagcatactggcgtctgcatctcactgtcaattctccccctgagatcagtcgccgtcatgcctgaccactcctatcttctttcgaaattcttggaactttgttttccccaacgccttggtaaggatgtctgcacactgctcctctgatcttacaaactgaagctgcacttctccattttcagcacactcccgtaggtagtgatacttcaaatcaatgtgtttgctccggtcgtggagtaccggattcttgctcagtgccagtgctgacatattatccatcatcaagactggtgaagccaagttggtgcccaggatgtcggccaacaaacgtttaagccaaactccctggcaagcaccgactgctcctgctatatactctgcctcacaagatgatagagcaactactcgctgcttttgtgattgccaagtgacaggacattcgttgaggaaaaatatcacacctgtagtgctcttcccgtcatttgcatctccaccatggtcgctgtcactgtacccagtcagacttagttcttcacccatcttgttgtacacaagtccatggttcactgtccctgcaatgtatctgagaactcgcttcatagccaccaagtgttcttgtctgggatcctgcatgaaacgactcaaatatccaactgagaaggcgagatctggccttgtgttcatcagatagcgcagacttccaatcaggcttctgtacttggttgcatcaacctgaggtgaatcactgtccttcagcagcttgagccttggttccattggtgtttcacttgggttacaggtgctcagtcctgcattctccaatactttcacagcataggatgtctgggatagcctgatgcagtttggttcctgtctcacttctataccaagataataggtgagtccacccaaatcactcattctgaatagtgatttcatttcttgcttgaagacatcaattgcttcagttgactcccccgtaatgatgagatcatcaacataaatccccaccaccaatctggactgttgagtgtctcttgtgtacaagccatgttcattcctgcttcttgcaaatcccaattgcagtaggcttgtatccaactttgagttccatgctcgtggagcctgacgaagcccataaagagctctgtgcaacttcagcaccttgttcttgtgttctgcagccacaaagcctggtggctgtaagacataaacttcctcttccaattccccgttgaggaaagccgatttcacatccatgtgatgtactgaccaacctcgatgtgcagccacagccaacatgagtctcactgactccatccgcgccaccggcgcgaacacttcttcaaagtcgatgcccttcttctgtacatagcccttggcaaccagacgcgctttgtacttggtgacgtccccatgctcattgtgcttgattttgaacacccatttgagaccaattgctctctgtcctgctggaaggttcaccaatgtccaggtcttattgtgttctatggacgccatctcttccaacattgctgttcgccattgctcactactcattgcctcctctgcagtgagtggttcattcccagttgccatcagtagctcttgatctgacgcctgttcaacaagtccaggtgctggttcttgccccatgatatcagtgatggatcgataacgaagaggagcgtggttggggtcaacgtccaggttgtcatcaacctccggcagtgatgcagatcgggcgcctgagccagaccccggtgcctgaggtgtgcgggatgctgacccgcacgtgggtgttgacgtcctcgacgtcgaggtcgccgacagcgaaggtggcgtcgccaacgccgcattcggcgtcgtcggtgaagctgtcccttccagtacgcctcctgctactgcagccacgccgtgttcgacacaaaatggctcaaaggcatcctccagcgcgcttgggtgttcagcagtccagtcccacgcacgttcctcctcgaacacggcgtcacgcgagacaagaacacgctgtgttgttgggttatagaatcggtaccccttggtcccgatttcataccccacaaacaccatgggcacactcctgtcctcgagcttggacagatacttgccgaccgtcttcacatgtgctacacaaccgaatgtccgaagaaaatgaacaggtggcttggcgtcatgccatacctcaaacggcgtccttccttctacactttgcgtgggcgcgcggtttaggaggacccccgccgccgcccccgcctccccccaaaaccagcttggcactcgcatcgccttcatcatactcctcgctgttcccatgacggtctggttgcggcgttccaccacgccgttttgctgaggacagtacggcgcggtgagatgcctggcgatgccttgcgcggcgcagtagtcggcgaagctccttgccgtgaactcgccaccgcgatcggtgcgcagagtccccagcctccgcccggcctgcgtctccacgccgccaagaagcctgatgatcgactccgccgcccgatctttagaactcagcaagatcagccacatgtagcgactgaaatcatcaaccaacagtaagaaaaatctgttgccacttggtgtaattggtgcgatcggcccgcacagatcagcgtggacaagctccagcttgttctttgcgcggaattttgcttcagtcgggaacgaccgtcttcgctgcttccctgccaagcagctgtcgcacacctgatcgatacgatcaagtgacggcaacccccttaccatctcttgctgcgacaacctccgcagcgatctaaagttgaggtggccgaaccttgcatgccaccgccatgctgcatcatttccctgcgccgccaaacaaaccggcttgccgatgtcgaccgtcagcacgtagagccggttcgctgccctcggcacttttgcaagcagtcgtcggcgccgatcccacaccttcagaaagccattcagcaggaggatcttgaatccatcctcctccaactgtccgagactcacgatattggtcgtgagccgcggaatgtggtagacgcccgtgagcgcctgatgttcgccgttcttgcagttgagaagaaccgtcccgcgcccttcgattgcgacgactgatccgtcgccgaacttgacggtgccctgaacaccggcgtcgatgtcggagaaggcttccttcgagctcgtcatatgattcgttgctccggtgtcgaggacccacctcgtggagtcatcattgctcccttccccgagatgaacgaagagcttgccttcgtcgaggtggacctccgtcttgggcttcgtcacggctgtgttcgccgtgatcatcaacagggctgcatctgcatcttcctctgcctgagtcgtatgcgcctgctcgactttcttcttccctcgacagtcangagcccagtggcccagcttgccacaattgtggcactcgtcgtccctgcgtgcacggccaccgccgcggcctccgccacgcgatcgaccacggccgcggccacggccgcggccagaggactgcttcgcgccagagctcgagcctgttcggcttcctccatcagttgacttgaatcgcgccagccattcctcctcggtgaggagtaagctaccgctgccttctttggtagtcgttgcagccgccgtcttgcg

SEQ ID NO: 7794 - DNA, 1391 bp, Zea mays
cggacgcgtgggcggaactctgcatttgagttgctcgtcctctccccactttctatcacgcaattcctatctcgcagtcgtcgccgctccccggccgggacccagcagagcagagcagagcaggcagtgtcggcgcagcatggggaactgccaggcggcggaggcggcgacggtgctgctccagcacccgggcgggcgggtggagcggctctactggtcaaccagcgccgccgaggtcatgcgcgccaacccaggccactacgtcgcgctcgtcacgctccgcgtcgccgaggagcggcaggacgcccccggcggcgagcggcgcaccgtgcgcctcacgcgcgtcaagctgctcaagcccaaggaggcgctgctcctcggccacgtctaccgcctcatcaccacccaggaggtggcgagggcggtgcgggcgaggaaggaggagaagcagaggaaagcgcagcagctgcttgagtcgaggcagggtgtcgcgaggggcgcggccagagggggaggacgacgacgacgaggcagccctggacgccagccttgatcagttggcgcgtcaggacaacagcagccggagctccagtgcagggcaacggcagtggcggccgtcgctgcagagcatcgaagaggccacgacctgatgtcagctcagtacactcataccacgcaaccgtaggggtagggccgtaatcactgacggctggacctgtatcttctcggcgattcacctggcctcgattagttcatcgcagggggttgctattggcttactcctacatttgcacgctgtgagtttgacaccctgggacggaggactgcttcagatgcagtgcagtatgtagcctctggatccgtgtaaattttcaggccaatgatgcaggcagcagatggccggtcttgagatagcgctgcgtttctttagtactcggtgttgagatgccaaatagacaaccataagctcagtgccaatgatgcaggcagcagatggtcggagccttccgggtcggaaagctcatcatgcgtaattgcgtattattcgcgtcggcgatgcttatcttagcgcctttcctgacgaacaggctcatgctgcacacttgtttaagccgtcgctgatgttgtagaacaggacaaacggcgagggtttccaagcagataccgcaccatgatacctaaccttgggggtcaatactgttagcagaatgggtaaataaaacaaagtaaatcaaccaacaaatcacagagcatgacacacagatttacggccatcggccaccaaccagaccgggcgtccttagacggcggcttacaagagaagtaaaacaaatgacactgtagaaaccctaattagggtcaacaaatttattccgcccgggggtttaagg

SEQ ID NO: 7795 - DNA, 1064 bp, Zea mays
ccacgcgtccgcaagaagcctgaacatgcataagtgcagggtgaaaggggcggagttgattctcttcttcagttgctcatgaaacactctgtggaccagacaagatagaatggcgacgacaaagagcacaattccgatgtattgaggagaggcaacgatatctggaaatagacaaggttcaacgcgtctttggcacaaaaagcgacatgcaggaagagaagaagaagccacctccggcacccttcataaggccagcctcaaatttcaggcgaaggtctcctgttcctggagagaagatccagcctgttatcaatgcggatctggacactgatgacgatcgcatgtccatcggcagtaatgccgtggatgctgcacacaaagctaagccagctcttgatgagaggcctgctacagatgagcctgactccatgtctccatatgaggcggattctgtgatagaaccaggaaacatttctttgaatgacctcgatgacattttacatgacgatgaagaattcgatgcggatgaaccagacgacgagtatccagagccttctttgggtatctctgatgtcacagatacggatgagtcgcacgagaacgactccccccccacgggaagtgcggatctaagctctctgaaggttgcggagctgagagagctcgcaaagtctcgaggaatcaaagggtactcgaagaagaagaaaaacgagctggttgaagtgttgagcagctgcatggattgatgataagtgggtggtgacctggcgctctgtttgaagtttgaacccactttgcttggccccctctagaaaattgtaaatgagcaaggctaactctgttccggtctgtgctgatcttttgctggttcattttgtacgcctagcttggtagccgtttagctgaattctgtggtgagtggagtaaggtagctgagagccttagctgtctgtgtactaaatcaatgcactgcatccgttctagggtgttgttcgtctgttttccgcggaggtgacctatctatggctcgccgatattgtcttgttctgaaacagacgatcaac

SEQ ID NO: 7796 - DNA, 4905 bp, Zea mays
  misc_feature (3187)..(3187): n is a, c, g, or t
ccgcaccacgcccctcgctttcgctttatcacctgtcgcccccgcccccgagcctggtcgccgcttcacccgccgtcgccgtcgtcggtcgggacgcctccgggcggccgcgccctcgacggaggaatgtcttctgctgctcccgccctcgtccaccaccgcggggtctcaggcagagcaatcttacctttgcatcatggagaatgcagagtccctccaggtgcttgtttcatgggcacatcacctacgttggggccaatgagggtatccttggtatgtaatgcaagccccaaccaccataggccaaggaattcggatatatcgcgacaacaaaaaggggggtcctccagaggaaaaggcaagtcgtaccaggataaagatgactctgagaacattgatgaatttgatagtgatatcatgttctccaagaatgggccaccaatctctttggcaagcaattcccgtcctcaagccacatcggctcctggggaaagagagaaggagatcgtggaactctttaaaagggttcaagcacagctgcgagctagggggaaaagcagggaagacaagaagcctgaacatgcaaaagtgcagggtgaaaggggcagtgttgattcacttcttcagttgctcaggaaacactctgtggaccagagaagaaagaatggtgacgacaaagagcagaattccgatgtattgaggagaggcaacgattctggaaatagacaaggttcaaccgtctttggcacaaaaagtgacatccaggaagagaagaagaagccacctccggcacccttcataaggccagcctcaaatttcaggcgaaggtctcctgttcctggagtgaagttccagcctgttatcaatgcggatctggacactgatgacgatcgcaagtccatcggcagtaatgccgtggatgctgtacagaaagctaagacagctcttgatgagaggactgctacagatgagcctgactccatgtctccatatgaggcggattctgtaatagaaccaggaaacatttctttgaatgacctcgatgacattttacatgacgatgaagaattcgatgcggatgaaccagacgacgagtatccagaaccttctttgggtatctctgatgtcacagatacggatgagtcgcacgagaacgactccacccccacgggaagtgcggatctaagctctctgaaggttgcggagctgagagagctcgcaaagtctcgaggaatcaaagggtactcgaagaagaagaaaaacgagctggttgaagtgttgagcagcagcatggattgatgataaagtgggtgacctggcgctctgtttgaagtttgaacccactttgcttggccccctctagaaaattgtaaatgagcaaggctaactctgttccggtctgtgctgatcttttgctggttcattttgtacgcctagcttggtagccgtttagctgaattctgtggtgagtggagtaaggtagctgagagccttagctgtttgtgtactaaatcaatgcactgcatccgttctagggtgttgctcgtctgttttccgatattgtcttgttctgaaacatttgtggtttaaaactcgaaccggggcccccgcgggcaactcccctgaacgaaatgttgccacatggtgttgcattgcacccttctctctctgtgtgtgtattaattgaagatggcgctgtgccgcaacaacgcctactatttgtttatgtaggccccgtccccaaacatttaccttagcacgtactgatttctctttgcattgcaggtgactgaaggctggctattattggtctgcgctgcgctctcgacgccgtgcagtagctgcggctttgctcatggaagacacgcccttctctgcatatgctttggttcctggcagccgtcagatgtggagtgattggacggttagttgggctcctcacgtgccgcgtctctgctccttgtctctctggctggctctgcttccgcctgggcctgggcatattgcggagccttgattaaagctggcccagctcggatacggccgcagctatcattgtacgtactactgcaaccgagttccagccagccagccaccccacccctctcctttctttttccctttagcaaaaaataataaaaaaagagatagagcgagagagaaaagaaaaaccctgtaggaggaagagaaaagaaaagaaaagaaaaaaaacagtaacgtgcacatttttgccctgttagcatgcagtatttgcacacaggggcctttatgcaatgcttcctccttttgcgttctctgtctcactagggcaaaggctgatcttacgacacaaaacgctcgctccgcatgcatggactgatgctcgccattggccagcaaagcatgcagatgcaggtaggaacgacgtgacgaagccacagcagcccagcccccagcacagcacaggtcgaggtgtgcgtagcgtagacacgtagctaaggatgcatggtcccggccagcgttgctgtagcgcgccatcactgttcgaactagctccatctcttctccaagctgacccaagagccgcggcgcgacagagcgagctaacagtagcgcctagctataggccgcgccgatatgatactgttgccgcgtcggagtagctagctagacttttctgcacgcgccgtgcgccagtgggtgcacgagagacagagagaggccggccccccgcttcgtgccgacgacgacggccgggaagtcgggaactgaaggcgcgcgactagtccacatcacacgcgctggccctgcccatgtgtcacggacccctgcatgcatggaccatgtgtggtgtgtccggccgcatcgcaggcagcctcgcgcgcgcacacacacacacacacacatcaagcatgagcactagctagctatatctatactatcgtcacgtgttttttcccgttttccttatactagtaataaatgtatgttgcaataacagcgtgttacgcgcggtcacagtgacgaaactagagtaaaccaaacgaggatgtccatgcatgccttgagaatacatgctaataataggtggtcacagtgacgaaactagagaaaatctatcaccagttttgcaaatttttgtgggcgtatatgcatcctctagtgtctaagtagtttcgccactgcgtgctcatcaaagtgatttgcngtttagaggtttagagcaagtataataagctgatgtaggtgagatgtaagagatgtcatgttagatttatggtcgctatcggacacgtttgctttgccgagtgcttcaggcactcgacaaagcccaaaaaactcttggcaaaaatgtctcggcaaactgtatattggcaacggcttctttgccgagtactttttgtcgggcactcggtaaagtctttatcgagtaccacctggtgctcggtaaacaaaattcgccatcacggcgacaagtgatggtgacaaagactttgccgagtgtgctcagtggcattcgtcaaagaatgttttgccgagtgcttgagaaatttccctcgtcaaagtgccgggcactcggcaaatagcctgtttctagtagtgggtgatgtggaagaaagataagtggggagaaagaaaaagcggtcggcatacaaactccaagactctccgtgcgagacagagatggaccaagtattaaatgtatatcttgtatcataagtgagttattatatgagttggtttttagttgactatatatgacatgaaaacaacgtaaaacccgctatgggttgtattattaaacttgctcttatgcaacatatatgtgaagattggtttgaagcgtcatgttctttattaagaccaacgacctctatatttatatgcatgactggtataaaatttgatcatatacaaactagaatatctagacttggagtcctagttgaagtcctcacaacacatgtcaagctcatggcttttctaacagcctccctcaatcataacttcactgagttaagattgttctaaatttataacacttgagtactctaccattgttttatgcatccagtggtttaggttaagaacaagcctaatttcttctaacatgatcatcattagataccagtgccatagcatctatcgtcctcgcggctatcaaaccagataacacattttcaatatttgtatccatattttaaactgaatatatacaaatatagattcaatatcctcgaatatgaatagttggataattcggatcagacattattataccgttcaattagatcatattttatttgaataagtaaatattatttttttatcttatgacaaaaatgcaattttcttatttgcactccattagagattgagatgtatcacatgtatagttggtatggcactccgcactcctctatctatcatccattttttgcggtcatccttgcgctcggaacagagccggtcttgacatgtactgcaagtacgtggtaactatggagtagtgagtagtgactactggtacgacgacgacgacgaaaacggcgactatattggtgctgtacaacgcgagaagccggggaggctagcagccggctttaatcgcaggcactgttggtccggcgagttaggtcaccgtcaagattccggtggcgccaccactacgtacgtcgatcgtgtgtatgcgtcatatgtctacgaccagtaccccatgcatccatccagggatacgatcgcatatataataaacgctacgactacaagcagcatccgatccgcgcacaatgcatggcaactgtacgcagaggaagcataaataggcgcccggccaggggcgcgctgcaagctggcgcgctgatccacggccgccaggcgccgcatgtgaccgatgtgaccaactggggctgctctggcgccgag

SEQ ID NO: 7797 - DNA, 2789 bp, Zea mays
gcgcggctcgcccggaccggcgggaactcgtcgccgccgtccgtggacggctccaacagcggccggcacctcctctcttctcccttcgtggcctcgtcgccgcagtccatgtcagacgggagcgtgcagctgcagcaggcgcgcgtggcggagggcgcggctgtggcggaggaggtgatggcggcgctggagcgcaacggcgtgagcttcgtgggcggcgggctgggcaaggccaagaaggacggcagcgggaagcagctcatggggcgcgccgcgctgctgcagctgccggccacggtgcgcatcgacatcccgcccaccagccccggccgggccgcgctcaaggtgtgggaggagctcgtcaacgtgctccgcaaggacggcgccgaccccgccgccgccttcgtccaccgcaagaaggtccagcacgccgagaagagcatccgcgacgccttcctcgccctctaccgcggcctcgacctcctcaagaagttcagctccctcaacgcggacgcgtgcgccaaaatactgaagaaattcgtcaaggtgtcggagcagcatcggaaaggagacctgttttcagagaaggtgaagaggtcgccgttcagcagctctgacaaggtgcttcagctggcggacgaggtggagtgcatcttcttgaggcatttcgcgggcaacgacaggaaggtggccatgaagtacctcaagccgcagcagcccaggaacacccacatggtcaccttcctcgtaggcctgttcacaggcacatttgtgtccctgttcatcatatactcggtcctagcccatgtcgccggcattttctcttcgaccggaaacacagcctacatggagatcgtttaccatgtcctcagcatgtttgcgctcatcagcctgcacgtcttcctgtacgggtgcaacctctccatgtggaagggcaccaggatcaaccacaacttcatcttcgacttctccagcaccgccctgacgcaccgggacgccttcctcatgtcggcgtccatcatgtgcaccgtcgtcgcggcgctggtcgtcaacctgttcctcaggaacgccggggcgacctacgccaacgcgctgcccggggcacttctgctgctgtcagcaggggttctgttctgcccattcaacattttctaccgctccacgcgcttctgcttcatgcgcgtcatgcgcaacatcgtgctgtcgccattctacaaggttctgatggcggatttcttcatggctgaccagctaaccagccagatcccactgctaagacacctcgagttcacggggtgctacttcatggctgaaacattcagaactcacgcgtatggaagctgtaccagcagctcccaatacaagaacctggcatacgtgctctctttcctgccatactactggcgagcaatgcagtgtctgagaaggtacctggaagaaggccacgacatgaaccagcttgctaacgccggcaagtacgtatcagcgatggtggcagctgcggttaggttcaagtacgccgcgacgcctacgccgttctggatgtggatggtcattgcatcatctaccggcgccaccatctaccagctctactgggatttcgtcatggactggggcttcctgaacccaaaatccaagaacttttggctccgggatcagctcatcctcaagaacaagtcgatctactatgcttccatgatgctcaacctcgtgctgcgcctagcctgggccgagagcgtgatgaaactccggcttggtatggtggagtctcgcctgctggatttctcgctcgcttcgctggaaatcatccgacgagggcactggaacttctacaggctggagaatgaacacttgaacaacgctggaaagttcagagcagtgaagactgtcccattaccattccgtgagcttgaaactgactgatgaagacggagctccaagttgaacagcaggaatttagggggaagaattccaggaatggatacactgtcccctgcaagaactggtgtttaagtggtaataaaacgaatcggagagcgtaactgcacaagaccgagacgctgcagattttaggatggaataagctcaggcgggtgcgccagggtacaacatgaggcgttctggtcaggagagatgatgtgcatttaactagctagtggtcgattgagaattgttgcatgtcaatcgactaacaagatcttaattttgtcgatcgtttaagttgtgaaaatgtatctgggaattggtgactgaaaaaatattgcatggaaggaaacatatggtcgttaactaatttatcaaaaaaaaagtaagaactagtccacatctgctagcaagtactacagtgaaagcaagatgcttgacacggcagatggcttcacatgtgaagcataaacgaagtacatatattacatgacacacacacaaaaaacgttacatagctagctatacagcctacaagtacctccaatgtgccgggcggtctcttgagacgagcagaacccttgacgacgagtaatcaaatgtagggcagtacaaatcgtcagggccaatcgcttctctcactccaacggtgtttcctcggtcgaagctgtaggttgttgttggctgcgcctgcgtgtcttccttgaatgtgtcgaaggcaaacagccccataccacatgctgccaacacaaggtttgagtcgccccatacctgggttatcgcggagtgatggatatgggcgctgaattctggtagctcataggtggcgacaagtttcccctttctcagcgagtaatgctggactc

SEQ ID NO: 7798 - DNA, 1372 bp, Zea mays
  misc_feature (12)..(12): n is a, c, g, or t
  misc_feature (18)..(18): n is a, c, g, or t
  misc_feature (74)..(74): n is a, c, g, or t
  misc_feature (83)..(83): n is a, c, g, or t
  misc_feature (794)..(794): n is a, c, g, or t
  misc_feature (1326)..(1326): n is a, c, g, or t
atgttgctaggntcaagnacgccgcgacgtttttttttttctggatgtggatggtcattccctcatccaccggngccaccatntaccagctctactgggatttcgtcatggactggggcttcctgaacccaaaatccaagaacttttggctccgggatcagctcatcctcaagaacaagtccatctactatgcttccatgatgctcaacctcgtgctgcgcctagcctgggccgagagcgtgatgaaactccggcttggtatggtggagtctcgcctgctggatttctcgctcgcttcgctggaaatcatccgacgagggcactggaacttctacaggctggagaatgaacacttgaacaacgctggaaagttcagagcagtgaagactgtcccgttaccattccgtgagcttgaaactgactgatgaagacggagctccaagttgaacagcaggaatttaaattccaggaatggatacactgtccctgcaagaactggtgtttaagtggtaataaaacgaatcggagagcataactgcacaagaccgagacgctgcagattttaggatggaataagctcaggcgggtgcgccagggtacaacatgaggcgttctggtcaggagagatgatgtgcatttaactagctactggtcgattgagaaagaattgttgcatgtcaatcgactaacaagatcttaattttgtcgatcgtttaagttgtgaaaatgtatctgggaattggtgactgaaaaaatattgcatggaaggaaacatatggtcgttacctaaaaantgagtttatcattccaggggtaagaactagataacatctgctagcaagtactacagtgaaagcaagatgcttgacacggcagatggcatcacatgtgaagcataaacgaagtacatatattacatgacacacgttgcacacacagacacacacacaaaaaaaaaacgttacatagctagctatacagcctacaagtacctccaatgtgccgggcgatctcttgagacgagcagaacccttgacgacgagtaatcaaatgtagggcagtacaaatcgtcagggccaatcgcttctctcactccaacggtgtttcctcggtcgaagctgtaggccgatgctggctgcgtgtcttccttgaatgtgtcgaaggcaaacagccccataccacatgctgacaacacacggttcgagtcgccccatacctgggttatcgcggagtgatggatatgagcgctgaattctggtagctcataggtggcgacaagtttcccctttctcagcgagtaatgctggactcgtgacctcgaccctncttttatttgcagccttccttctgtgctacctataaataccgagtc

SEQ ID NO: 7799 - DNA, 3044 bp, Zea mays
tataagcagcattatacatagtcagtcagtatagttaatttctactggtgtttatggtcaattagtctgcttctgtcacttctgccagtaggctttacattttttttctctggaagtttttttttctcgaacacgcaggagagctgcacatctttataaattagagaagagaaggaaaaagtcttacaagaattctatggaagtttcaatgaggactgttctttctttttatgcgaatttggcttgtctaccttaatcagtattcactcttagggaatgtgtagagaagcttagattgctaagcactcctgaggagcgtgctcgtaggctgaatgaagaacttgaaatacatgctgaccctgcgatggatccatattatgaatctccggaggaacaggagcaggaaattgaaaaaagtattgtactcccgcccatagtatcatctgatattattattacaactctgacatgaatttccatatttttattgtacaggtagcttcaacaagtccagaggttctttcttgaggaaagatggtaatcctgtgcctccaggtaaaggagatggtagaaatgctgcacagcgagattcaaaaactaattgggaatctaatcgaaatacatgggccgaatcgagttctcatatggaatcaccccttccacggaggtccacattttcttctcaaggtgaaagtgctggttatacaagtaaatcagagagcccaaacactggtgcacaaacagttaaactggaaggcaccacacgcagtgctccacaagggtcacctggtgcctcttctggaattttagctaataacatatgttcaggggcaaaaactgcacctcaatcagccattaacgagtctgagaagatctggctgtacatggatccttctaataaaatccaaggtcctttctcaatcatacagctgcggaaatggaacagcaatggctacttccctcctagtttgaaaatatggaaagctagtgagaagcaggacgattccattctattgactgatgctttggcagggaagtttgagaaagaccttcctccatgggaaccgccacatgttagtttgtttcaaattaacaaaacccctcttgagcaaagcacaatagctggtgaacaaactccaaaatcagtagttgcaaagtctttctcaagtagtaatcaaagacatggttatagttcaacaaaccttggaacaaccatgatccattctggcacacaaggttattatggaatgcaaaattcccatgcagcatacacaagccaacattctcttactggaagttggaatgccacgtcaagtcagtttggggttgcggtaaatcctgtgacacctactcagcctgccatggggagcttttcaggacaaaacatagtgtctgcagaaaatatgggtcatctaactcctggaacggctcctgcagctgcaaatgcagaaatggttaattcagatttgacctcccagaagcaaatatcgtatttaccgcaaacagacggcatattagctgatgacattgaatccaaatcaggagaagatgtttcacatggaaaagtgagctcttcagccaaagcaattggaccactgggtgcacagcttggacaaggacaactgaacactcagcaacatgaagcagacacaaaaaaccagatgtcatcaactgatgtctccaactcgacgatgccatcgcagatgatgtcaacaccatccgctgcatcagtacaaccttcattgtcaaccattgctggcagtgataatcaaagcagtgggtgggctgtacctacacaagtggtgaacacatctggccagtctcagataactggaaatctgacctggggaaatacacctcagggtgatgcaagcttaggttggggaatgatgggacagaacaatatgaatatgccttgggtagcatcagctcaaggtgcttcgggctacaacatgggtgcagccatgccaacccagccaaatgcagttccaaacatgggctggttaccaaatccaggaaacaccaacatgaacatgatctgggccgcaactcaaggccaggggattccaaatgcagctgctatgatgggaggtcagatgcaaggagtcgcagtggccccttggggtggtgttgcagcaggaaatgcaaattcttatcctgcctggggaaaccaacaagttggaaacatgaaccaaaacgttcgatggagtgctcctgtgcagggaaacccgagtcaggaaaataacaacatgaactggaatgcaccaaatggtaatcctaataattggaataatcagcagagagagaatgagggcaggcactctggacaccgtggtgcttttagtgctggcgactcaggcagaaagtcatggaagccacgctctggtgccgatggggggtcatgggggacatagaggagtctgctatacatttcttgaacgcggggactgctttaaagttgactgcaaattcgcccattcaacaaacacagagggatatccatccatccaggattcgggcaacgagaggcgatatgagaatcacaatgagagaaatgatcgacagtttgataggcagccttcggataatgaaaggcatcatgttaggcctgatgacaggcatggtggcagggatgacgataggcaggctgataggtctcagtcaagagagccgcgttagaactgatttctgtttcgtaccttccctttgttgtatgtgcagtagcaaactagcataatagcttccgtgcatgttttgaactttatgccctgtagcaagctgcaaacatgtgcaaatcgtgtacagcagttgtagtttaatgctgtgtgcgtcctagccccatatttaataatttacttgaataaatcgtagttgtctgatatctgatgtatagcaggggctacacacccaggtcctttatggtgatgactattgagtgttttcttataagcctcatgattgtaagtgaaggtgtttttggaaatcctatgacctaatgtccgatctgtgttcttcgttgtccagtaaaaaaaaaaaaaaaaaaa

SEQ ID NO: 7800 - DNA, 3836 bp, Zea mays
gaaccttggaacaaccatgatccattctggctcacaaggttattatggaatgcaaaattcccatgcagcatacacaagccagcaatctcttactgggagttggaatgccacgtcaagtcagtttggggttgcaataagtcctttgacacctacccagcctgccatgcaaagcctttcaggacaaaattcggcgcctgcagaaaatatgggtcatttaactactggaatggctcctgcaactgcaaatgcagaaatggttaattcagatttgacttcccagaaccaaatgttgtcttctttaccgcaaacggatgacagattagctgatggaattgaatccaaatcaggagaagatgtttcacatggaagagtgaggtcttcggctgaagctatcggaccacaggatgcacagcttggaccagtgcaactaaacgctcagcaacttgaaaacacaagaaaccatatgtcatcaattgatctctccaagtcaatgatgccatcacagatgatgtcagcaccatctgctgcatcagtacagccttcattgacaaccactgctcgcagtgataatcaaagcagtgggtgggctgtacctgcacaaatggcgaacacacctggccagtctcagataactggaaatctaacctggggaaatacacctcagggtgacgcaagcttaggttggggaatggtgggacagagcaatatgaatatgccttgggtagcatcagctcaaggtgcttcaggctacaacatgggtgtagccatgccgacgcagccaaatgcagttccaaacatgggctggttaccaaatccaggaaacaccagcatgaacatgatctgggctgcaactcaaggccaggggactccaaatgcggctcctatgatgggaggtcagatgcaaggagtcccaatggccccttggggtggtgttgcagcaggaagtgcaaattcttatcctgcctggggaaaccaacaagctggaaacatgaaccaaaatgttggctggagtgctcctgtgcagggaaatccaggtcaggcaaataacaacatgaactggaacgcaccaaatggtaatcctaattggaataatcaacagagagagaatgggggcaggcactctggacaccgcggtgcttttagtggtggtgactcaggcggaaggtcatggaagtcacgctctggtggcgatggggggtcaaggggacatagcagattctcccattcaacaaacacagagggatatccatccaggactgatcggcattacgataggcagaattcaggcaacgagaggcgatatgagaatcacaatgagagaaatggtcgacagtttgataggcagccttcggataatgaaaggaaccatgataggcctgatggcagacatggtggcagggatgacgataggcaggctgataggtccgagtcaagagagctgcgttagaactggtttctgtttcttacattcgtttccttgtatgtgcagtagcaaactagcatagtagcttccgtgcatgttttgaactttatgctctgtagcgatctgcatacatgtgcagatcaccgtgtataacatttgtagtttaatgctgtgtgcatcctagttccgaatttgtaatttacttgaataaatcgtcttgtctgatttctgatgtaaagcaggggctacacgcccaggttcttggactagggttgttggagcatcactcgctcgcgcgggagagccagtggtggttggagtagagggaatggaaaagatgaccgttgggggagaggggagagtttaaatacccccctcagccccatagccgcccaattagatagaacacgggggctccacccataggccataggctccgcctccgagcgtggagaaggaataggaatttcgagcatctgattgtcgttgggtgtgtttgatatgtagatggacatgggcactttgttctttcaggcacacctttacccttgataatacgacttatactaaactcaattttaaagtatataatgaatttaaacgagctctttgagccttggcaagccatccttttgagttgaggggtctcccatattgctcctttatatccacaacagatgataccctatatttagcggatcacgagcttctctctgtgtccaacaacgtactataagccgttcgctatgatagcggatagccagcgtttttcaaatgtggaatgtcctttatgctcatcgcggcctccatcttcttcgcacgagctcctccaccggactattcattttttttttgtatttggacgaatacaacttttgtttaggcttacgaatgatctttttcatttgacatttgacgtacattagtataatatagaaatgaatgtgcaaatattttattagcttaattgataatgtatgctagtagaatcttaaattttttgaagttctctataattcaattgaggcacactcgaacgttttttccctgtttgtgtgcaaaaaaaatgtataatttaaagttttggtaaattgcgttcgtaattatgaacgatgaataatttattcgttgaacaaaaaatttgtaacatgtttttttcatgacatatcaaattaaagttttttttgtatgctaatgaccaaaaaaaaaacaatgtagtttataaaatttgttagactgtctccaacagtttacctatataattatacaaaacattgttctacattgtagaatgtattattattagagtagaatttgaatatagggacgagaatgagtaaattgtttaagataattttagggccttttttttatccacactggtttcttaaaaactgactggtttttagacttggtttctagaaaacggttgttaggaaaaaaactggataggaatgtttggatccatcattttttcaaaaatggtttctacttttccttcgacaatgacaattatactccttatatgtgtagagagtgttctcagctcccaccattttatttcgctcgcgtctgtacaagctttcattatattagtaatatcagctagcgactgatgatgcaccagctggtttacgctgcatatggttcacgttcatatcatactagctcactactcataattgcgacgagctaggccagtacctgcgctaagggacagcagcccagcactcgtgtcgccgtgggctgatgaggtaggtcattgggctgatttttttggtgggctaaaaagctgtatcacaaattttgaatatccaccgggtacccacgggcaagagataaaacccgtacccgatccgattgtatcacgggtcgggtacggacaagacccgtggatcaaattacgtacccgaatccgaacccgatgggtcggatatccgaacccgcgggtaaatttgccatccctaagtagaagtatgatcctctagtgatattgtcgaatcgctacggtctcggttgcaggttcagtgttcccacatagacttcacccctgtagcaggacaaaacaaaatgaaacacacattatattagcacaatttaacgaagatgcaagaagtttcatatgttggaagccagggtggaccaactcgtagccattatttctaggtccagccaaaatggactcaaaacataccaaaaagagagagaaaaaagaggtttgacaatttccgatggcttcaacttgatttgctactcgtctcacagtgctatatatttggagcaaggcaggcataactgctgccaccgcagcgatttcggaaatgaagtatcgcggtggcccgggacgcttagtcggtttgggacgtgttgctgatgaaggcaggtatcacggctgtcgcaacagcgacggcgg

SEQ ID NO: 7801 - DNA, 1786 bp, Zea mays
attgggacctcgagccggccgggaacgtacgtcgccgcagcagctcagacgtgcgccgctaccacgtgtcctgccgcacgccccgcgtcagcggcatctgtaaagccgcttgtcgccgccccggcgcccaccccgcccccgcgcttttattccccacttcaccgcatctccccctcgtctacgatgccgttgcgcacctcttctctctcgccgccccgagacccccacgcttccctctccgcccccgaactgtggcgcctccccccgccgccgcagcgatgccactcgcggcagagcccgacgacgctcatgaggaaagggagaatcagcagctgctaattacgacgaagggagggcccgggcttgagggactggtggtggggagctactgccacgatgtgctaatccggggcgggcgcatagtgggggagacgctcggcggggctgcggccttcgtgtccaacgtgctcgacgccgcttcgccccagggcgccgcgctcaacgagacatccccctttgtcgttgtggccaaggtgggtcacgacttcatctacgcccgcgcgccggcgtccgcgcggcatccgcctctgctctgctcgtccccaaccacctccttccacgcccagttctcggagaccgccgcctcggcgcacgcccccgaccgggagctccggcgcgtgcgcgcctgcgacccgatctaccccgccgaccttcccgaccgccgcttcgcctacggcctcgctgtcggcgtcgccggggaggtgctaccggagacgctcgagcagatgatcaggctctgccgcacggtgctcgtggacgcgcaggcgctgatccgggcgttcgacggtgacggcgccgtcggtcacgtggcgcttggcgataccccgtacgcgcggcttctgccccgagtggcgttcgttaaggcgtcgtcggaggaggcgccatacgttggggtggaaacgacgaggcggcagtgctgtgtgatcgtcacggaggggagggacggctgccggctgtactgggacggtggggaggcgcacgttgcgccgttccccgccgtacaggtggaccctactggcgccggagacagttttctcgcgggctttgcagccggattgctgtgggggttgtcggcgacggacgccgcgctgctggggaacttctttggcgccgctgctgtatcgcaggtcggcgtgcccaccttccatcccaagatgttgcaggcagttaaagaaatacttgaagagaagacaaggaaacgatctagtccatgtatgaacggcgctagttttaccttggagaagtcaaatatgcacaacgagttacacgcagctctccaagaagctgcggtgctgatgtctgaacagcagcaggctgatccggcgaacggcagtggcggtgatatttgctcggcataggtacctcacagtgaagctgaagcagtcgaacgccaaactgaagtttgtggcaaaataaccagcactgcagtcctgaactcctgatctcacattgagatctgtaaacatggtgccaacaagtggaggaagtttgtacatacgctctctccggcctttacactactattctgctggcaaggccgtcagggatcgtttctaccttgctatcgctgacgaggaaatgaagacaactgaacagttgagctgtggcgcttgcacgcaccatgttttctccgctgaacaagtgcgcatttttgagctttcgggcattcgtgctgttaactttttaccattctatatgtcgacttctaccaaaaaaaaaaaaaaaa

SEQ ID NO: 7802 - DNA, 1974 bp, Zea mays
gagaatttgtggaggctagaggacagtggttcagatgactggatggtcgttagtttcgagataaccttcccccagctgctggagatggcaagagacttgggtctcgacgtgccctgcgacgagccatccctgctagctatctatgcaaggagagacgcaaagctcgcaagaatccctaaagaattactgcacgcttcaccgacaactctgcttctgagcatagagggaatgccgggcttagactgggagagactactgaaactccagtgctccgatggttcgttcatgtcatcgcctgcacccacagcctacgctctcatgcagaccggcgacacgaaatgcctcgagttcctcgatggaatcgtcagcaagtttagcgggggagtgccctttacctaccctgtggatctgttcgagcacttatgggtagtggacaggatagagcggctgggcatagggaggcacttcacaggtgaaatcaaggagtgcctagaatacgtacacaggtactggggtgacgaaggcttgcccgccacgagggaccgtccggtctcagaatgtcgatgacacggccaatggggttccgtcttctccgactgcatggctacgatgtctctccttgcatgcatatgcagctgtgtttaagcacttcgagcaggacggggcgttctactgctacccagggcagtcgaacaaatccgtgactgctatgtacaacctctaccgcgcttctcaggtggcctttccaggcgaggatgagctccgacgcgctgaggcatacagccgtgagttcctctgccgcagacgagcctccggggagctcaaagacaagtgggtcatccccaaggacttgcctggcgaggtcgcttacgcactggacgtgccgtggaaagctagcctgccgcgcatcgagacgaggatgtatctggagcagtacggtggtgccgatgacgtgtggattgggaaggtcctgtacaggatgtctctcgtcaacaacgagctcctcctccggacagctcaagccgacttcagaagtttccagagacaatgcaagctcgagtggcatggcctcagaaaatgggccagcaggagaaacctccaagcatacggcgtgacgtcgaacagcacgctgcgatcctacttcttagccgcagccagcatctttgagccagacagagcgacagagcgtctgggatgggctcgcacggcggtgctcgccgaggccgtctcctcctgcctccgagacggtcgttgtagccgtgccgacggcatgctgagggaactgaccagcggcatccacctacgcaacgacgataatccggcagccagcttggtgcatgctctccatgagctcattggcctccttgcattcgacaatgcttcctacaacagccttcttgatgcctggaagcaatggctcgccatgtggaccgcccagggacacgaagggagcgtagcgctgctgctggttcgcacagtggagatatgctccggccggaggcgtagcgcctctgccaccgacgatggccaagcacacagcctctccgagtactcccagctcgagcagctcacgtcctcggtatgcagcaagcttgctgcagcaggcgccggagacggagacgacctttccccggcaagtgtggaggacgcagcagatcgcctccgtgtggatctggagatgcagacgttggctcggtgcgttctccggagccgcagcagtatcgacgcagtgaccaggcagacgtttctccatgtcgcgaggagcttctattacgtcgctcattgctcagctcgaacggttgatgcccacatctccaaggtcttgttcgaggatgtcgtgtagccatcgtttgggcctcgttttgtatctttaaagcagtgtttggttccacccaggtttagttccggtcaaatcaaatgtttgaatgataattatatgtattaaatatagtctaattataaaactaattagat

SEQ ID NO: 7803 - DNA, 1029 bp, Zea mays
  misc_feature (795)..(795): n is a, c, g, or t
ccgtttctcttctagggttaggtcaagacctccccgacctcgagcctcccagtattaatagaggccatgcggccgccgccgtccgcatcaccatcaccacctatcgtcggagaaccacagaatccaccgcatcgcagagacgagtagaggttagatttaggctgaggtaagatggtgtgcatccggcaggcgaccatcgaagacctgctggcgatgcaggcgtgcaacctgatgtgcctgccggagaactaccagatgaagtactacttctaccacatgctctcgtggccgcagctcctcttcgtcgccgaggactacggaggcagcatcgtcggctacgtgctcgccaagatggaggaggacccctccgagccctgccacggccacatcacctccctcgcggtcctccgctcccaccgcaagctcgggctcgccactaagctcatgtccgccgcgcaggccgccatggaccaggtcttcggcgctgagtacgtgtcactccacgtccgccgatccaaccgcgctgccttcaacctctacacctctaccctcgggtaccagatccaggacatcgaggccaagtactatgccgatggggaggacgcgttcgacatgcgcaagctgctccggcagccacagcccaagaagcaccaccaccaccaccatcacggcccaggggggtgctgctcccacgacgcaccagttgcggcgactggttcttctccccagtcttctggttcacccgataagaaggctatcacttgatgtagggtaagccttttcctttcaagctcntagatgttatgcgctctattgctggtcaccaccgcgttttcggtgattatgctgtgattttgtttgacagatcaaactagtagtttcgttgtagaatatgtagtatgtaaatgtgcctctcctcacctttggtttcttgagaatgttcactctcaaggcagcccagtcatggaggcacatatcaattattggtgagtttaacgtggaagcttactgttttgttgtggtattgct

SEQ ID NO: 7804 - DNA, 764 bp, Zea mays
gttattcgtcatgtaatgattattcattggtttgatgtttataccttttcttctgcctagtgatttaccatcaaaataaattactttgtgtgactgccaatgatgattagtctgcaaaatggatgtcctgtggaaacatggtacataatatgacaccatttgataacactgaggcattacagaagaaccctatttccgttcagtttttgcttcgtgctggcaatatcagaatccaggcctcatctttcagtgatggttctgtctgcaatatggactatgtatccaaatccaagtccccgcttcagggaaaacctccttggagaaacatcatctaatatgatatgaattctgatagacagatacagatatatctatgcattattgtatcattttttctagtttcaaggaatcataattattttctatttagaaatctttggtttgcatttgcccaatttaagctcaaattctggtttgtgcacttaataagttgcttctgaatcttgcagaagcatatctacagagaggagtcaccaagcccattggacttccgatacgcagctttttctaatagaatgggaaacgaattgtactgtaattgtttgtgtactttactttggctcaatcgtccgaccgtatctttgtaatcagtgagaatggcaagcaaatgtccttgacatctattgttattgtaaaaacatgtgttataacgctgattctcagattacatttgattattcgagctgacaatttcttcaggtttt

SEQ ID NO: 7805 - DNA, 699 bp, Zea mays
ttaatggaatggaccttttcccccgtccccttgaagttgagtggaatcgtagttattttgtgtcttgactattcctcgtgctatttaaatattgattgatgagcctggaattcatttttttgtgcacctaactagcttctgaaccttgcagactcgtatctacagagaggaatcaccaagccaattgtactcatctttcctctcactgggtatacaatatagtagttgtagcggtctttccgtagtagaacggagaaagacctgtgcagtgagtatttgtgtacttggccgatggctcgaatcgtctgaccgaatcagcgagaatggcaaccaaatatgcttcgtacttgatacccgtgttgccttgagacatgtgcgagttctcacagttcatttgattggtgatgcctgacaatttggtcagatccgacaccgcggaatatataatgcaagtttgaaacctgtaatgcaattgttttgttattggatcacttacagaggaagagggcctttttcagatttaattagcaatcctaagttactagacaattcgaactccagtgttgagatctctgctccgtcgaccctaatcgcttcgatggaaatgctgcaacggaagcagatctggatgttgaaatgtgcaccgaaggttaaacaaaatgagccaacgacaatttacccgttgcaggggtaccgagc

SEQ ID NO: 7806 - DNA, 1122 bp, Zea mays
ctgtgcggcgccccggggccgggcgtcccaattgacatcaccgagacctatcgccgcagaaccaccgaatccagggcatcggagagtgtagaggttagtactaggcggaggtcaagatggtgtgcatccggcaggcgactatcgacgacctgctggcgatgcaggcgtgcaacttgatgtgcctgccggagaactaccagatgaagtactacctctaccacatgctgtcttggccgcagctcctcttcgtcgccgaggactacggcggccgcatcgtcggctacgtgctcgccaagatggaggaggacccctccgagccctgccacggccacatcacctccctcgcggtgctccgctcccaccgcaagctcgggctcgccaccaagctcatgtccgccgcgcaggcagccatggaccaggtcttcggcgccgagtacgtctccctccacgtccgccgatccaaccgcgccgccttcaacctctacacctccactctcgggtaccagatccacgacatcgaggccaagtactacgccgatggagaggacgcgttcgacatgcgcaagcctctccggcagccgcaacctaagaagcaccaccatcaccaccaccacggccccggtgggtgctgctcccacgacgcacctacggcgacgactggttcttctcctcagtcttctagttcgccggataagaaggctaacacttgacggatgaagcatatctacagagaggagtcaccaagcccattggacttccgatacgcagctttttctaatagaatggaaaacgaattgtactgtaattgtttgtgtactttactttggctcaatcgtccgaccgtatctttgtaatcagtgagaatggcaagcaaatgtccttgacatctattgttattgtaaaaacatgtgttataacgctgattctcagattacatttgattattcgagctgacaatttaaaaaaaaaaaaaaaagcagaatgtaatgcgcaatattattgtcggatcactcaaattacggagaattccagtgccgagaaaaaaaccaaaaaaaaaagggcggccgctcgcgatcaagaaccggacgagtgggtcgacccgggaattccggaccggtacct

SEQ ID NO: 7807 - DNA, 1128 bp, Zea mays
tcgagggccggccgggggaaaaaaatgcactccccctagggcgcctggccccctccgacccggccgggatcaccatcacctcctatcgtcggagaaccacagaatccaccgcatcgcagagacgagtagaggttagatttaggctgaggtaagatggtgtgcatccggcaggcgaccatcgaagacctgctggcgatgcaggcgtgcaacctgatgtgcctgccggagaactaccagatgaagtactacttctaccacatgctctcgtggccgcagctcctcttcgtcgccgaggactacggaggcagcatcgtcggctacgtgctcgccaagatggaggaggacccctccgagccctgccacggccacatcacctccctcgcggtcctccgctcccaccgcaagctcgggctcgccactaagctcatgtccgccgcgcaggccgccatggaccaggtcttcggcgctgagtacgtgtcactccacgtccgccgatccaaccgcgctgccttcaacctctacacctctaccctcgggtaccagatccaggacatcgaggccaagtactatgccgatggggaggacgcgttcgacatgcgcaagctgctccggcagccacagcccaagaagcaccaccaccaccaccatcacggccccggtgggtgctgctcccacgacgcaccagttgcggcgactggttcttctccccagtcttctggttcacccgataagaaggctatcacttgatgtaggactcgtatctacagagaggaatcaccaagccaattgtactcatctttcctctcactgggtatacaatatagtagttgtagcgggtctttccgtagtagaacggagaaagacctgtgcagtgagtatttgtgtacttggccgatggctcgaatcgtctgacctaatcagcgagaatggcaaccaaatatgcttcgtacttgaaacctgtgttgtttttagacatgtgcgaattttcacagttcatttgattggtgatgcctgacaatttggtcagatctgataccgcggaatatataatgcaagtttgaaacctgtaaaaaaaaaaaaaaaaaacaacgagctcagctttggaaaaaaaaaaaaaaaaaagcggcc

SEQ ID NO: 7808 - DNA, 865 bp, Zea mays
ttattgttcatgtaatgattatttgttgttgagatgtttatgccttttcttgtgtctagtgttttatcagcaaaacaaattactttgtggcactgccagtgatgatttgtctgcaaaatggatgtcctgtggactcaagtcccctgtttcagggagaacctactcgaggaaacatggtacataatatgacatcatctgattaaactgaggcattacagaagaaccttatttccttgtcagtttttgcttcgtgctctttccttgtattctgaaagtttttctgcttggtcataaagaatcgtaaagcttggttgaggtcatataacgatccaagcagttgtctttcagtgatgtttctgtctgcaaaatggatgtgctatgtatccaaatccctcttatagggagaacctacttggagaaacagcatcgaatatgacatgaatccagagactgagattgtagtgctgctttattgttatgttctttttctctctttcagttgaagttgagtggaatcgtagttattttgtgtcttgactatgcatcgtgctatttaaatattgattgatgagcctggaattcatttttttgtgcacctaactagcttctgaaccttgcagactcgtatctacagagaggaatcaccaagccaattgtactcatctttcctctcactgggtatacaatatagtagttgtagcgagcggtctttccgtagtagaacggagaaagacctgtgcagtgagtatttgtgtacttggccgatggctcgaatcgtctgaccgaatcagcgagaatggcaaccaaatatgcttcgtacttgataccaaaaaaaaaaaaagaacacgagggggggcccggtacc

SEQ ID NO: 7809 - DNA, 6538 bp, Zea mays
cccttggtgggttttgccggttcaattggtggattatgttgttgtatagattcagagtaggaaactctctcctattcttttccaaaaaaacacagcagcccatccatccattagaacatagcttgctgttcggttatcgagaaaacccaaatgtgcgagactatgggtaaacaaaaaccacataataacttaggggttgtttaatactgccctgatctataaattttagttcactcataaaaagtatgaagtttactctaacttcatcgatttgatcgggccattcacctggtacagcgcaagggctcgagcaataatgaaccggccgaacgcccgaatggatggatggatggatgggatgccgcctaccgtgggtacaagtgcacctatgaagaaaaattattttaataaatgtatattaaaaaacaacctaactttagtctagtctctcttctttcaaagtggaattattttctctctgctctaaaatgaatatacttttagaattttagttagagatctatgcttgtaaaaaaaccaaatatatatccttataaaacgtaactattatatttagaaaagcgagaaagtaacaaataactactgatttagttcttgatatttatcgccgttagtttattagtaaactaaaatgtagggagtacaagcggatggttccatatctaaagctacactatacagaaaagtattttttttgtctaaattgcatttattttgggaccgagaggacagaagaagtcgccgttgctgacctcacccgccctggcgcacgcaaccctcacgcctgccgcacagccgcactgatgcgctgcgacaaagccacccccggaccctccccagcgagcagcggcccagccacccgcctgccgtccgcccccgcgcttttctttttaccgccgaggcagtgaggcccctcctccctctcgccgttcccaccacttcaagatccgatccatcgtccgtcccatccaatcgccccctctccctcgtgatcccgacgccgacgacgacaacgaaacagctcagtttcgtgtttttctcccgtaccccgcagccccccacacggccacgccccacctccgaatcacaagggtggcaccgtggcagtacaagtagaaacgtcgagtgaaactgaaaccgggggaggggtcgtgggaagaagcaaggccagcagctagcacgcgggccgcaccacaagcgcgccggcaccggccacctacctggtcgcccaacctattgcctataggctataggagtaggcgggagggggacgatatggagtagcagtagccagtaggcagtgtagcactgcggcttctactaccaccgcacctccaacccccgtccgatacctatccaccacaggtctctatccagtccacttgcccttcttctcatccgtcactgcagcgagctctcgcttcgtttccccctttccctcaggtgatgcatcctttattttgttgcaatgtggattttacattgttttcttgtggtcgattgctgatctttcacgctggcgtgcctgcaggactggcagatctgttggtgtgatccccagcttggatcttgttgattcggtgatttgagtagccgattttcttcgagcaaactggtatgggcgcacatgggttttatgcgttcattcgtttcgatttcttggtagtacgggctgattcgattcgttaggggattcggggtagaaagagtgactaccgaaggaggtttctgttggggtttagtgccgccgcttgcaatctgtcttcttatcttatttctagtcctgtagctagtaatatttgttgatgtaattttggttaatctgcaaaagaaggggaaaaaaaggttctgtttcaactcagctactgatataatttaagaagcatttttggcctttgctcctgtttcgaaattacagtgtcactcacagtacgagtccatattatacataggatcgctggccctttttttttcaagccagtcaagattccagatatcgaaacttccgttttttcatcaaggaaacaacaacagatgtttcgttgtctgtagtacatattgcattaggactgaagtactgaactattggcggctgcctagcagttgcatattcttttcttgattacagaagacggtctgcagcagtgtgtggatattttcatccatcaatccgtcatttaatgtttttgggtgtctttttatcattacttggagcccttttattaatttttctatgtcttggacgcttattttgacatgtcctcattagaacattattgtgctgccaaaagctgtcggtgggcaagcccctggtcactgcagacatgcagaaacagcataaaccatacattcaggattctcggcagacaaaatgatgtaatctatggtgcattcttagttcttaattaatttaacataatacagtattgaatagttctattgcctgctactttactttttgaagagaattctgctactttctggcttttgactagttgcagtgaacttttagtagcctagtaggaattatatatctgataattttttggcctatcttttgcattttcaggtttttaggaagtgtggttttctcagtctctgtttgaaccacaacataccaaactgaatcaagtgataattgtgttctgaccatacgccaagttatacctgaaacttctgcttcatatgttcacccatcataaagatgccaacaaaagttcaggttagcagcgaaaggaatgtgaagatcatatcaggtcgagatgggcaaaagaagggaaattcacagcatgaccaaattgtacgcgtgccaaaggacatggtcacaccagtcaatggaaatgtagatggaaaatttgaagataaagttagagttgtgaagaatgataagttccgaagacaacgagagtcttggggtggggaaagggctgcatgcatgaagggctcaaaaccatggcctggtcgaaaggcaactactgttgatgaacttgtcaaacatatgtcaaatgttccttcatatttacagcgtaaagaaacttctgagcatcttcaagacaaggcgctgaatgttggagttcttgagtggggtcttcttgctaactggtctcagcaacaaaagcatgagctcgctagaagccatggagcatctccatccaatactagcaggtctgtactattctcatctccatcacattcttctgcaagccccagcagcagatctcttgagagcaatcaatctaccccaattagtgactatcatcattcatccatccgagcccagcagagtaggctcgcagataaacaccatgggaaggccagatgttcgcctagcccaaattctgcggtactgagcttattgccaggtcatggcacacatccctgtcaagagaatggttgtaattatgttgacttggatctcaacaatgtttctttagcctcagactctctaggttcttcctctcgaagttgcagtagacatgaaatagttgaagatgaagagactagatggaagattgaagatgttgtccatcattgttctcgtaggctttttacagacagtgataacattgggaaacatttcttcacatcaaataacaaagattccatgtgtaatgatcctgaacagagcagtggcttggattgtgaaaattttgagtcactaatatctgatgctgtgatggatacagctagaaatggcagtaggtcacctgattgtttcttggaggatattgagacatcccgtgaatttcctcgaatcccatattcatgtccacttcccatcatagattcagcagctaaagagattggcaccactagtactgaggctggagataattttattggtacagctgcaaaagtaagtaagaattctagcctaaaccaatctgccctgaatgccactgagaatcctccccgatattctgcaaagtttagtgataggatgcctgatcgccatcaaggttctgtgatgaatcgagtgagccgcagctctagcctcaaggagtcaccacatgctcgacaacccaatgtagttcctcctgttgataagacaggagatcggtcatcacccaacagcaaaggtaggcgaagcccattgaggaggatgttagatccaatattaaagccaagacattctagtccaatacgaccttcatttgttccaaaatgtcatcttccagtcaataccaccaagcaatctctggacttaagggggatcagtgccacagaatatgcagcgaaggtcagttgatttggtagtcaattcgaattatcgaattgaagcaaatacaaatcagccacctcgtgtgctattgaacagtgcaagatacatccagaaagaaaaggattcaacaacaacaagacaagcatttctgcagctagcatggaagaatggcttgcctttattcatgctgtcttatggcgattctgatatcctggcagccactgttagaaggaagggcatctctgaaaaggatgatctggaaagcacatatgctgtattcactgttgaagaacctaagaaaaaaagtggagcttggatcaaggcagggggcaagaacaagaaacaccaccttttgtctagcatagttggggaaataaaggttgcacgtcgaaaatcaagatgtcaccatacagcagatgttcatgtatacagggaatttgtgttgcttggttccggatttctaccatcatctgaagaatcgggtgattcacatgttagtggagagtttgcggcttttattagtgcacttcctcagcaagaagcagaaacttcgaatcaatcatcttcacagaataccagacaaaaaaatttagcaccaactggctgtggttgccccccactgggaaacttccagcctagttctgcttcagccaatgttattgcagtacttcctgatggcttccatggcaaatcaacgtctgggcagccgttgcctttgattgagaggtggaagtcaggaggagcttgtgactgtggcggatgggatgaaggttgcatgctgagtgtcctcactgatgcggccgaagaaaatgatgccgttcaggctaaccaggcaaaggatggcagccagcgatttgaacttctagctcagggcggccctcgtgctcttcccttctttcccccgtattttgtatatgtacagaatttatctctgttcaggctaaccaggcaaaggatggcagccagcgatttgaacttctagctcaggtcggcacgaccgagaagataggcatgccttcagtatgacttcattcaaagaggggctttatacagtggaattcagatcatccattgcattacttcaagcttttgcaatgtgtatagtgatgctacatgggaggtaccctgacaggctgcaagttggttcgcaagcagcgcaggagcatgacctccttgctggtcatgaggtcaaggccatggtagccagtcaaggaagagctccgaccagctatgtgccccaccgtccacctctttctcctgtgggccgagcctagcttatcgcgattaaatgtatgttctttctgtgtctgtgtcctctttctccttcagtcgcgtagtgctggtgggattgatataccatggtcctcaggcccatatgcaatacgcatattgaaagtgacaatctcagaacaatcaatcggctttagaggtagctacctgtacatgttgtgatgttgatgttgtatgactgtactatgatgcggctgcaaggcccatctcggtgattactcacccgttatatgttctcttaaaaaaaaaaaaaaaaaaaaaaaaaaaactcgattactgattagtcacccgttatgtgttctcttctcagttgctcctgtatatgttgattatatgcttaagaggcaattattctattataatactaactctgttctcgaatatttatcgtcaactagtttatttttgtataaaacacgataaattaaaaaaaaacggagggagtattgagtacatgttaacactggcagacctttataaaaggtggagtctatgtaaacgaaaaggcttgtatactagagttgtatgacacgtctcacaaggtagccaccgtcgtctatgtttctagggttgcggactgtcacaatctagtcactgttgtctctcttaagacaagtttgggagctacaaaaccgaaggggattgaacccctctaatcccttccggttttgtggctctcaaactaacccttagggttgtgggaagtcgttgccgtgtttttgttcatgtgcgtgcaagtgcggctggttgtgcatgccccgctgtgcatggcttcctcgagcttgggcctctcctaggtggatctatgtttgggacgcctgatgatcacgatgcattgccatgtctcagagtcgacatcctttcgtcaccacgggtggaagactccttggtctctcttagagttgggttagaggctacctctaggctcgtgcactctttgtcccgtacgacgtcgcaaatctataagcaagtttcataagaatacacaaaaaagatgaaaaaagc

SEQ ID NO: 7810 - DNA, 1578 bp, Zea mays
  misc_feature (1578)..(1578): n is a, c, g, or t
ggccgcccttttttttttttttttttgttgccgtagcaacgcacgggcaccctactagtatgtcattatgtccttagactgtctccagcatgtagtgtaaaataggggacatgaaactatagatgatactgtttgcaaagtgatgtttgaaataggggatgagaaaaggaatgtgatataaatctgctggaggtagcctttgagctcactactcgcagttgagctttgagctgagctgttgaacatgtctggtgagtaggctaatctgtgctagctgagtggtccccagagaaggcgcttccaccgcccgagaaagaaaatgccgaggacccagactgcgaaacggcggcaccacccacacccaggccacggctcctctgaatctgccgaagcctgaagatgtctcgtggcacagctgccctgctctgcaccgccgacgcatcctcttcctcctgcgccccttgcctctccacgtccttccttctctcccttggaggtctatggacagatccattctggttcagtcccgtttttccaacgcctgagagctcactcacgccacctgctttcccagcactctgtgcaactggcaatgtgctctgcagcagcacgctgagcaccacatcgatatccggcgatggtccttcaatagcaggcaaattcttaataaaggacaccatcgacggcgatagcactttgagcgtggcttcaacctccttcgtgtacccactgctagttgctgcaaactctgggcctttcatctgtcttggatcataaataaccatttgagaagtctcaggacgaacaactttggcagattgtggtaataacctcgcactcgcactaaatcctgcagcacctttgtctagcatgctaccgctatttaacatagctggtttctcaaccttcttaacaatgtttttcgcaagccactcttgtctcgctagataatccaattcttttgatgagcatggccaaagatccatgtaactgtatcgagaaactatgtcatgaagtgtgttttccgatgcagataaggcatcttcagatgtcctagatagagcctctttccttctttgttcaaccttaagcatgcttgataaatccccatagttctgttcaaattgtgcaaatcgtctccatacctctgtggattcctcgggaggaagtaagctcagtgccctctcaaacaaagcacgtacatttctatcgtcatttaaacgacacaagaagtctgtgtattcaaggatatatcctggctcatgcataaacctctttaaacctgcttcaaaaacactttgtgccacctttgcatccttgtcaacgcagaatgccattgtagcataagcaacatacaaatgataagtgcagcttggtgacttccgagcatccaaaaagtacttacgggctgcttcagtgccttcagttctccttagaaatcgaataaactgaatatttgcaagtgaggtctcactagcattttcacctagaagagattcgtatactgtcttagcagtctgtatcgcccctctggactcggggggggggggggggactagtaagctctctcctggtgcn

SEQ ID NO: 7811 - DNA, 4602 bp, Zea mays
  misc_feature (2401)..(2401): n is a, c, g, or t
  misc_feature (2651)..(2651): n is a, c, g, or t
ccctataccatgtgttttgtgtatttcctctgtcgtgcttatgggaagggagacgagtcctctatagcttcttgcgtctctactgctgacgggagggaagggagcggatctggtgatccgagtaacatagttctcaacaatttcctctcgtttcccctccgctcgactcgttgaattggtgaattcgttaggactcgtattttccttcgatccattctttgatttaaatggacttttcttggctagaacacgttggccaaatcgtttcagcccatgcaccacagtccacaatacactttttttttttggtcaaaaaggccgaagcagccgcagcacgagaatttgattccgcagaagcagaagggccaagatgcaaaacagcggaaaacaacttgccctccctataagcccaaagcacccggtccgccacggcgcccgcctcccctcgccggtgtcgcgtgtccctcgttcgcgcacgcccagcccgcctccacctctcatgccggagcagcaccgcatcgccggagatccgccgtactggtgatccccggagcaggagcagacgcaatggaccgcatcatgatgtcccgcccaccccttcccgccccgacccatgccgctgcgggcgccgacggtgacttcctcgagctcgacgtgctctggcccgcctccccttccgcggtaggtctcggcctcctcgccgcgctcccggaggatgagggcaagaagaagaagcgcgccgcggccggggtcggggtcggggtcggagcccccgcccgatccgccgcgcgccccgtcccggagaccgtcgcagcgtccgcgatggcgaggtcggcgccggtgcgtataccgtcggatcccgcgcggagggggaggtgggcccacgccggggcgggagctggcggcagcgcggaggacgccggggaggccttggtccccccgcacgagatcgtcgcgcgccgcgccgccgcgcacagctcggtgctggagggcgccgggaggacgctcaagggccgcgacctccgccgcgtccgcaatgccgtcctgcgccgcaccggcttcctcgactgaggcggaggcgagtcgtcacgtcgctttcgcgataaagttttgatcatgttgttttctcttcgcgattttgtttccccatgatgtgtttctggtccggctactttgattccttcccctaccgagagggggttggaaaaaaatgaggtgagttgaggtgaacgagcgacgacgtaattaccttgctgtgttgtttcatcacacatatatggaaaattttggcccttatatttgttccaatccttatgatgtgtgttgacaagtaatgattacatggactaagagaggtggtttgttataaatcatgcctagttctatgctcttcgtgtcttgttacttgataataacacctgaatcgggagcttcttggagtgatttatgcacaaagtggatgtcaaaaacgctagtagattaatatctgtaattcttaactggccatcaatatctgaaattgttgaatttggaaggataccattatttgcttggttaatctatcctgggattctgtttagttccgttcttgtataatagaaggacagacctctttaattacccggcctctggcatttggtatttcccttgtgataataacgtagtaattaaagtaggtatgtttctataacctattttcattcctagcttttgattttgaaaattcagccgaacagccggtagtatgcactacctccgccctcgaatatttatcatccgctagttcaattttgaactaaaatgtgacaaataaaaaagaacagagggagtatcttcgagatgcccccctcccctggctttgtagggcatatcaaaattgtccatgcggtggtaagtaataatgtcaggtagttccattcagttttgttcatgtcgaacatagtcacactaaaagctggaaatggatggtatttttgtttcagacttcatttgttaagcattgatcttgttcatacatagataaataacttcaagatgaaatgtgatgaattgacagatatatgtacctcttttagaaattactcgccttaaaaaacgcatcatgaacacaagaataatcggtagtccttttcagcaatagttgtttcaatcctgcaaggtcaaaaagaagagtatgttgatagtggaataactttttgttgattgagaagggtttcatacccctaattttatccccagcatccgttgccctcgaatgcctttattcaggtacaaggaccaccactgtggaactcagcaactgcggcgctacttatgaactggtcccgtgattcaaacacagttatgggattgctcagattcagagtgtttttcaaacacagttatgggattgctcagagtncttggattatctcaatcattatatacagctaacatgcatttgctgcccgtgtcctgtgccataaaactgtttgcctggcacatttcaaaaccttaggccaacttaataacggacggtagtacagtaacaaaaaggctgcttgggttgtgaggcataaaagttgttaccagcgagtacaatagagtttctgctagatttctgaagacgacaagttgccaccagcagattattgagcgtcgttgcatgactngtgctgaggctcctggataatatctttatgtgttattacttattggctaacgctggagcagaagactgttccaatccaagttccaacacgatgacgaggtcacgctgtagcggatgactattacaacacaatgacaaggtaacgctgttggaatttaatttggtggaatagaatggccatctttagtggatacagaaacagaaataagcatgacaatcaacaacagtgctgaagattaaaaccaacagctcttagtactttgcttgtttggctgctctgcacttgccgccttcatagatatagatgcattgcgaaatatatataacctatctggagtgggttcaattgcatgttcttctttcacgaattacgactgggcatttcagttctcggataccatgatcacgggaacagtgtcgcagaaagcgactcggccatttagacgcattacattacattacagcactgttaggttcgctcatgctttggtggttcatggaactgacgccgacctgaaagtgacgctgcctttgtgcttgaccattcacggtcgcattgcgagatttggtccactactaatctgcctccctatactggagcccgtcatggttgggcagctacgcttatcggtttctttgccctgttggctttacattatggacccaactgctctgaatatgcaacgcatcttccatgcagtactgggatgacgacctccgaattatttgatgagcgtgttgtgtgtatgcggtgtccagctcatggtttttaattttaatctgaaaaattggtccagctcatcctcatctctttggactctggtacagaataatgggtagccttggatgctttttcatcctgttaccaccagaatttaaaaaaaggaacttggtggaggggaccacggcccaggcccaggcccaatgaaatggtttgctcatgcaatcccgtagatctccaacttcctggtgtattttctttttttcccttcaacatggcgatgatctcaccttcatcttcacgagatatgctgcttcgtaaccatgcgcccccatggcccataccttggtggttggttgcgggtgtgagccgtctatggctcatgtgctacgtgtgcacacaactgactgcgctcagctttcaagtttttttttttgtctcccacaatgtattttgtatttgtagtgaagctccatttactgagcgtctgctatactgtatgattggttgattgcgacaataatacctctaaaatggttactcttgctgtatactgtgatctagtgatgtcgatcacatgaacatgacggttagtttttaagatcgtccgattgtatcgattcggaatgaatgcttttggaagcgaagaatggagatcatatgagaattcctggtcggcgtagcttcataaacggctttctgagttattataagcttttatttttgtccaaacaaccctttcaaacagttttatgggtgaaactcatgtttcatgctctcataaagcaatgacgaggtgaaaaataagagtagcttttcgtagctctctgatgtaggtgcagtctaatgtttcgatagagctaactttgattgatgaactccacgttcatgatctaggctttgaaccaaggctgattctgtcagggcccaagatggcccgctatagtgtactgtagcacatcccttagatttgtttagataaagatagattagtttgagataagattataattagagataaaattagatctagtgtttacgggtcaagtaacactctttatataagggaaattctctcttatcggccttgggcaaagccttgcgaccgtcctccccagtacccctaaaccctaatcgtcaccctctaaccttagccatcgccctctaacccacgctgcagccacctgccggccataacagattcatacctccacagccgaacacaagttcg

SEQ ID NO: 7812 - DNA, 1135 bp, Zea mays
tgattttaaaccagactactgtaattagtactgacaacaagtaattggtgaatgatttggttcgctaaatcattagactgaaatgtgtagccgtataacgcgttgaccaattatgttcatcgcttaaaattgtgatccaaaaatatctgcaaaattctttaaaaaaaattataaaaaaggaaaaatatcttctccttatcctcccatcgtcttcctctcttgattttttttcgcatgagccttatcaggatccgcgtcactgtgtcctggaacaaaaaaatctatcgtcgttttctttctcagatatcctcccaccgctcactgcctttgctctatcccggccaccgccgctcaagcacctggatgaggatcgatgtcgtcgccaggatttttcctcgtcgtgctcttctgctgaaatcggtgcccagccactcctcctctacagccgttgccatctccctcttgtagctcgtcttctccctctactctccgctcaagcttgccgaccgcccgtcttcctccctggccggcgttctgcctccggctcgccgctgctcgcgcccatctccctccgcgccgcgcatccgggtgtctgctcgccccctgtgccgcgtcgtggtctccctccctgcgcacagccaccaccggccgagctcgccccggccccttcgctcctcccatggcgagctcgcctgggatgcccctgtcccagttcgctgcgccctgctcggtcccgggcttatctgctgctcggccgcgtcccttcccttgttcctccagccgagctgctctcccagcgctcttccttccctgcaacctggaccttcccagctcggcctctagctgctgcgcgcgctcttcctccatggccgcgcccgctgtcgcgcccgtccaggctcctctacgcgcgccggagcttcctctactcggtcccctgtcggcctgctccatcttcctggcggcgctcagctctgtcctttctccctctgtttgcccacgcgcaggcatgcttcgccgagctcgcccctgcacgtcctgctctccccagctccgctctggtcgtgcgcgctcctctgctcgccgaggccccttctctatgcactctccggccagccgaggtctcgccagctacagt

SEQ ID NO: 7813 - DNA, 3254 bp, Zea mays
  misc_feature (21)..(21): n is a, c, g, or t
gtactataattgatgaaaatnggagtatctgcgcagctcatgtgatccccacgtgctgccacctcagcggcaccccttccgaattccgatcgtctccgcgaacaaaaccgctcgcacctgtgtccggccagccatcgtcattggtttcgcgcactctcgctcctgctcccggttttgtcgctccccactctctcctccagacctctaccaccaccccacaccgccgcacgcccacacgcaaccacgaaacggaagttttcctcgccttgcctgccctctcgatccgatcgggacccaaccctagcccggaatggcggcggcgaccggcggcatgcggaaggcgccgtcgctggaatggcggtgggtgtccacggaggacgacgacgacgaggaccgcgccggggacggggccgccgccgcggtcgtcggggcggtgagcaggggcgggagctttgagtcggaggatgacgaggatgatgaagaggaggaggacgaggagaagaaggggaggaagaggctgatccggaccgtgccatccgtcgactggttcgacgtcgaggggaacgaggtctccgtcgcgcagcagctcgacgactccgaggtgaggttgattttggcaggacaatgtttcttgctcttcagactcttgctgtggtgtttggagatattggaattggtccattgtatacatttgatgtcatgtttaacaagtaccctattcttggagaggaggatgtcctcggacgcgtgcgctctcactagttctgtatactcttatattgatgccattagtgaagtatgttttggttgtcctttgggccaatgatgacggtgaaggtggtctatttgccttgtattctttgatttgtagaaatgcaaaagtgagtctcattccaaaccaagtacagtctgagaagaggatgtcaagttttcgactcaagcttccaacaccagagcttgagagatccataaaagtaaaagagaaacttgaatcgtcactactgttgaagaaggtgcttctaggcttagtcttgtttgggacttctatgtttatatccaatggagttatcacaccagcaatgtcagtgttatctgctgtcagtggcttgaaagttgggctaccaaatacctcacaagatgctgttgtgatgatttcaattgcacttcttgtagtattgtttagtgtacagaggcttggctgtccctcggtggttgtcttttatgtgcaacaggatctgaggccatcttttcaaatctttgttactttcccgtaagatacgttcagtatatgtttgtgcttcttgttcttccttgccttgtcttggcgtatctagggccggccgcgtttctcattgccaaccaaaagtcatcggagcatgtcttcttttcatctattccaagtggagttttctggcctgttttcttagtggcgaatctggctgcactaattgccagtaggacaatgacggttgctatattccagtgcctaaagcagtctatagcacttggttgttttccccggctcaaaatcgttcatacatctcgaaaatttatggctaagatatacattcccgttgtaaactggtttctattggtttcctgcttgggctttatcattctgttcagaaacatatatgatgttggcaatgcatatgctattgctgagctcggggtgatgataatggccacggtttatgttacaataataatgcttctaatatgggagtccaatattacaaaggttctgtcatttgttatcacattcctgttcttggagctgattttcttctcatctgctctgagtagtgttggagatgggggttgggcgttgttgatttttgcatctgttctactcatgattatgtttatatggaactacgggagcaaactaaagtatgacagtgaagtcaagcagaagcttccaaaggatttgatgaggaagttagggcccaaccttggtaccatcagagctcctggactaggcttagtctgcagtgatattgtgaaaggagttcctgcaatttttggtcattttctgacctcactccctgcgatacactcgataattgtatttgtgtgtatcaggaatgtgccagttccggtggttcctcaaagtgaaaggttccttttccaacgtgtatgctcaaggggctatcacttgttccgctgtatagcgagatacgggtataaagacaagaagcaggagcaccatagcgtatttgagcgtcttctgattgaaggccttgagaaattcatacaaagagaggcagtagagctatccctacaaagcgaagacgacattgactcggacgaagagcctccaacccctgtgaagatcatcacagcaccaaatggcagcctgtactcgctcgacgtccctctcctggcagactatgtgccttcaacagagctcattcatgaagccagctgctccacgcctcaacacgatcctgtactggattatgcacagaaccttgaactggagctggcgttcatcgagcagtccaagcggtctggggtcatctacctcatcgataatcccatcatcaaggccaggaaggactcatggttcttcaagaagctgatgataaactatttcttcgcgttcctgaggaacaactgccgccgggcgatcatgttgatgagcatcccgcattcaaacatgatgcaggtgcgcatgacttcttatgtctgattgctggaactgcactggttctgttcatggatgtctgatacaaaccacactgacagtaaaagaatgaacgtggcaaatgcaaagaggatatcggcacttttgtttttgttcataatttgatgatggcttaggttgttgtcggaatctatctcccctgtagttgtacaatgccaaaatatagttggaagttttagctggtacaccattagggtgctgtattaaccttttttactcttgtgcagtaaagattctttttgtcagcctccttgattttgttagataaggtttttggtgtttgcaaagttactggtgaatgtggcaatttgtatgtatatttttgcctctttttttaggtaacggaagcataagcatctggctttgcgaaggaatcaggccaaagtttcaataaccgatttcacagacacttaaccaagataaagacaaaagcctaaacaccgagtctgagggctaaggctaaccaaaagacacaaagaaatgcatagctgctgtctccaacatccgacttaaagagcttgttctgaaagtcaggggtaccgag

SEQ ID NO: 7814 - DNA, 1090 bp, Zea mays
  misc_feature (962)..(988): n is a, c, g, or t
  misc_feature (1057)..(1057): n is a, c, g, or t
gggaccctcgaggccggccgcgtccggccgggcgccggccctccccattccttccattttacccctccgtccgtctctcacactgtctctctccaccctctcgctctccgacaaggcgacgacgggtaggccaccgccgccggcgccgtcccactacgacaagtgctgaggccttcatcgctttcttcgccggcgacgagcacccaccaactaaggtcatggaagagatgatagatctaacgggggatggaggtgttcttaagacagtagtgcggaaagcaaaagatgatgctatagcgccatccgagagcctgcccttggttgatgttcattacgaaggtacacttgctgagactggtgaagttttcgataccacccatgaagataactctattttctcatttgaaattggacaaggcgctgtcatcaaagcatgggatatagccttaagaactatgaaggttggcgaggttgcaaaaattacatgcaaatcagaatatgcatatggagctgcaggctcaccaccagagatacctcctaatgcaacccttatttttgaggtggagctagtagcttgcaggccgaggaaaggttcaagcttaggtagtgtatctgatgagaaagccagacttgaagaacttaagaagcaacgggagctagctgctgctaccaaagaagaggagaaaaagaagagggaggaagcgaaggccgcggcagcagcccgggtgcaagcaaagcttgatgccaagaaggggaaggggaagggaaagggaaaatagatcgtgacgttgctgctgactattgttgtaaccaagaaaataattgtgggagcgtcctcaaactgctccgtcacttgctggttactgtgcttgatgttgtagcgtggactaatgtatcgaaaagacctaagtataaataatgtctggtatctacgtagatcacgtaaaaaaaaaaaaaaaaannnnnnnnnnnnnnnnnnnnnnnnnnnaaaaaaaccgtatcgtatgcatcatgttaggatctatgggccaggctcaatagagaaatttaaataaantctaggaaattttaaaagccccccacgcgtccg

SEQ ID NO: 7815 - DNA, 1013 bp, Zea mays
aatgatagagattagagaaactcgtggaaaaaaaagatcggcatagaagaaggcctgggccgaataacccgggcgccggattccccattccttccattttacccctccgtccgtccgtctctcacactgtctctttccaccctctcgctctccgacgaggcgacgacgggtaggccatcgccgccggcgccgtcccactacgacaagtgctgaggccttcatcgctttcttcgccggcgacgagcacccaccaactaaggtcatggaagagatgatagatctaacgggggatggaggtgttcttaagacagtagcgcggaaagcaaaagatgatgctatagcgccatccgagagcctgcccttggttgatgttcattacgaaggtacacttgctgagactggtgaagttttcgataccacccatgaggataactctattttctcatttgaaattggacaaggcgctgtcatcaaagcatgggatatagccttaagaactatgaaggttggcgaggttgcaaaagttacatgcaagtcagaatatgcatatggagctgcaggctcaccaccagagatacctcctaatgcaacccttatttttgaggtggagctagtagcttgcaggccgaggaaaggttcaagcttaggcagtgtatctgatgagaaagccagacttgaggaacttaagaagcaacgggagctagctgctgctaccaaagaagaggagaaaaagaagagggaggaagcgaaggccgcggcagcagcccgggtacaagcaaagcttgatgccaagaaggggaaggggaagggaaagggaaaatagatcgtgacgttgctgctgactactgttgtaaccaagaaaataattgtgggagcgtcctcaaactgctccgtcacttgctgttgctggctactgtgcttgatgttgtagcggactgatgtatcgataagagctaagtataaataatgtctggtatctacaaaaaaaaaaaaaaaacttaaaaaaaaaaaaa

SEQ ID NO: 7816 - DNA, 1332 bp, Zea mays
aaattcggcacgaggcaaggacaaggacggaggaggagccattaccgctgggccttggacaaacctccggccggcccctatcggcccaacactcacgtttctccagacacagagggcagagcgccgccgccgccgccgagtcaaggaacaaggatgatgggcagtgggatgggcgcgtacggcggcgcgctgcgaccggtggagagcgcggccggggagacgatgctgctgtggggcctggggcagcccgagtcgcaccgcaacaacgcgctggtccgccaggcggcgcacgccttcgagctcgacgcctgcgggcggcgcctgtccctgctgcagtccccctcctccatggccaccccgggggtcacgggggcggtcgtctgggacagcggcgtcgtgctcgccaagttcctcgagcactccgtcgactcccagcggctgctcctccgcggcgcgcgcgcggtggacctcgggtccgggtgcggcttggtggggtgcgtcgccgccctgctgggcgcccatgtggtcctcaccgacctcgccgaccggctcaagctgcttaggaagaacgtcgccctcaatgtcgacgacccccacgtcccgggctccgctcgggtcacggagcttgtgtggggcgacaatcctcaccatgaattgctcgaggagccactgcccgatttcgtgcttggctccgacgtcatatacaacgaggaagctgtggacgatcttctgatcactctcaaccaactctcagggaagcacactactatacttctagctggggagcttcgcaacgatgctgtgctggagtgcttcttggaggcagccatggaggacttcctaattgcgtgcatcgagcaggaccaatggcaccctgaattccgcagcaaccgtgtagccttgtttatcttggtcaagaaaccagagaaacctagcgcagagtagtcgtctgttcctcgccttggtgtagaacaaggataggaggcatctgggttttccctttttccaattccaattatgttgttgcgatagccaaggttttagcgccggcttaagccatggaagtttgatagctcattgtatggtttgcttgcaacctattctgaaagtttgtacaagagtgaaagaaaggattttagataaccgatgtctgaaactgcaaatgatctcagtggtggcaacacctaaaagctgatatgtgagtttggacaaggatgtgcacagtggtagtacaaagatagttttgaaatgaatttaaagagaagtccagaaacttatgacagtacagaaagctcaataacgaattgtattcattttatttggtttatgctt

SEQ ID NO: 7817 - DNA, 943 bp, Zea mays
acagatgatggggttcttggcaagagcaatgcggaacccagagttcttccagcagttggcccagcagcaagacaagaggaaggagctcgaggataccatctcaaagaaaagaaggcggcccattgacaacacaccattctacagtgatggggaaagcgaacagcttgattcacagttgaaaatgttcgagtcaggtgttctcaatgggctcaatgaacctgagctggagaatttagcagtgaacattcaggagcttgggaagggaagcatagatgatgggaacttgactcaagttagtgaccagtcagagctgaacgacgacttctgggcagagcttttggtcgaagattttggagacaaggcaggacagccagagttggagggaagaactgaagacgtgaatgaccttgctcaacaactggggtatctgagttcttgtagcccaaaatagagccagttcctaatggttgccccccacaatcactggtgctttccctacactactgttgcagaccatcctgatcaaaccgttgactggtggtggagaggtgttcacactgaaggcgtgctgtggaggtcactgccttgacgttgaaggcttagtgctgtactgctgtgggagttacgtgtggggtgttggctaaatgtctcttccggcgtcgactggcaaaatgatctcgtggacggtgactgccaaagatgcctagggggccaacgtatacgtacacagctgttatcagggttctggccttctggggttgggttgtagaattgactggctgatctagtgttctccatgtatgactggtgtaaccttaaaacaccctcagcttgttgttgaactgtgacaagcatctcgttttttttgttgtactccattttcatcatcattgtacatcaaattgctgaattatgaacagatcccgaataatttggtggactg

SEQ ID NO: 7818 - DNA, 4450 bp, Zea mays
ggtacccgaatgtgctgttattaaaatagaataaactttcctgacaatgggcagggccgatgcgtcgtgggcctccgctctcgcctagtagtccaccacgcggccacttgcaccgccgtgaatcgtgatcgtgctcttctcgcccgcccggtcttgtctctcctctccagaaccttccaacggcagagtgctcgccgcgtggtctagaaccttccacaagcctcgcgacgtgtctcgacgcgccggtacggcggtgggggtatttaggggtccggccaccggccaccgcccgcccttctcccgatttcaccgaccatttttccccatttcacagcgggcgaatatctctcatctcccccatcctctttcctgcaacaactcctacccacccgacagaaatatcctaagcgctgacccgaatacccgattcgctcctcgtccggtcgattcctgctcctaatcgctcgaatcgagtccttgccccgtgttccgtgccacaatctgggcgcttggctcccgcgagccggggttcttgggcctgggcggaggccatggacaagccggtggcgccgggcattatcaaggaggagctcctggagcagcagccgccgacgcaggacggtgtgggtggcggcggggatgcgccgcgcccgatggaggggctgcacgaggtgggtcccccgcctttcctcaccaagacgttcgaccttgtggaggacccggccaccgacgccgtcctctcctggagccgcgccggcaacagcttcatcgtctgggacccgcacgtcttcgccgacgggctgctcccgcgcctcttcaagcacagtaacttctccagcttcgtgcgccagctcaacacctatgtgagtcggcaaaacccaaaccccccttcttcctttcctttgaaataatccttctcttggtcagggcttgctaatggtaatttgcgtttggttgcaattgcaagctgctttattcggcggagagcatccgaatcctctgcaatattacttgtatattaaactagtttgcaatgttaggacaggaaaatctgttgtgcacttgttcttcactaaagttttaggtgatgtaacactgttgtgaggcattgttgtgatttggtgcattttttattgttgattttaggcagctggttccccaatgagatcgaggatgcctggctaagatatgaagagacatagggctggtttggtgacaaaggaattgaaggggatctataggaagaaaatcccttgctttactttgtcaccaaatcagccctttgccttgtttggatactctagtattccccctaattcacatgtgttgagatatattggggtgtaaattagtttaatttatactctaataaacctcaacacacgtggattgcggtgaatactagagtatccaaataaggcctaaggggtattaaccccctcccccccaaaaaaaaagtcctgggaatctatttactgatttcacttatataggtgtagtgttaggaaacattttagcgtcggaaaacaagattttgaagcaattaagtgattttgtattttgtgctctttgaggttgtggaaaacaagactcgaagtggttgaagtgattctgaccagacctactgcattatgttttgagcatatctggtcgtgtagtgggtttatggcagtagggattcagtgctatcgttttcactcattagcgcatttgattgtaaacaaatacatccttgaaagtgtttatgatacattctccggtgaacctcatcttcagggggggcctcgagaggcggctcgagctctcccagcaaatttataatcctgacatggtttcttgaacttttttattgtagctagatggaacaagatactggatgaagtaccaagaatcagattgttttgttctagaagactctactgaccaccttcacatgctatagtatattgctggcctatcattatccctgttattgcagatataaagatacaaaagctgaaatttacagagaacctcatccaagcgaacataatgccttatgactgacctgctgatgaccatttctggtctattgcaacctgcagggcttcagaaaggttgatcctgacaggtgggagtttgcaaatgaaggtttcctcagaggtcaaaggcacctgctgaagatgataaagagaaggaagccaccatcagctgtggcaccattgcgacagcaacgtgcccctgcttcttgcctggaggttggtgagtttggatttgaggaggagattgataggctgaagcgtgacaagaacattttaatcacagaagtagtaaaactaaggcaggagcagcaaagtactaaagatcatgtgagagccatggaggaaaggctacgagtggctgaacagaagcaggtacagatgatggggttcttggcaagagcaatgcggaacccagagttcttccagcagttggcccagcagcaagacaagaggaaggagctcgaggataccatctcaaagaaaagaaggcggcccattgacaacacaccattctacagtgatggggaaagcgaacagcttgattcacagttgaaaatgttcgagtcaggtgttctcaatgggctcaatgaacctgagctggagaatttagcagtgaacattcaggagcttgggaagggaagcatagatgatgggaacttgactcaagttagtgaccagtcagagctgaacgacgacttctgggcagagcttttggtcgaagattttggagacaaggcaggacagccagagttggagggaagaactgaagacgtgaatgaccttgctcaacaactggggtatctgagttcttctagcccaaaatagagccagttcctaatggttgcccccacaatcactggtgctttccctaccctactgttgcagaccatcctgatcaaaccggtacttttcaaattcaattcaatgacacaaacctgttaaaatctggtaacattttcattccatttcttttatattgctggattagccaggaatgatgatggatctggcagacaaggtttgacgacccatccttctaaccatatccattatgtttgcgcagttgcatcttcagatttgccctcatcttttcttcttcttcttctgaaacattctaaattgctccttatccagttgactggtggtggagaggtgttcatactgaaggcgtgctgtggagaggtcactgccttgacgttgaaggcttagcgctgtactctgctgtaagtattcagcgctctgcaaaggagtactatcctatgttcgcatatgtgctctgccatgtgttctgatattcggattctgtgatggatgcaggtgggagttacgtgtggggtgttggctaaatgtctcttccggcgtcttctggcaaaatgatctcgtggacggtgactggcaaagatgcctaggggccaacgtatacgtacacagctgttatcagatcttgttcaaagtcattgcgcggttttgacggtgctatgtatcgatcagggttctggccttctggggttgggttgtagaattgactggctgatctagtgttctccatgtatgactggtgtaaccttaaaacaccctcacgcttgttgttgaactgtgacaagcatctcgtttttttgttgtactccattttcatcatcattgtacatcaaattgctgaattatgaacagatccctaataatttggtggactgcgtcttggcatttggctacggcccagcttgcagtgtagttgatacatgcttttgttgaagctcttgccataggttgggcgcccacagtacgccttctgcatgtgcactgtcacagttggctagtgtgcagcgatggttagctcaccgtagtggatcgaggtagttcggtgatgttgaaagctctgtgcatccggattccctcgcaggccactagttgaggtagcgataaaaaaaagcatgttcaatgtcagagatgtggacagcgttgggatatgtaattcattaagagaaagggcaaagatacagaaatacatacacgctactagttttgtatggtaacaaatgtaaaggagtcatgtgtcgaggctaaacaggatgacatcctttttttctgtgtgcgattccaaatggcaatgtgagcacgacagtgaagaagacctctggcggagaaaatgggaggacatgcatcagaactcaaaaaatattaacaagtctcacctactatcttcccaccagtccaccacttcattagtgcactgccacccccgcaccccctccaaaaaaataaaaagaagaaaaaataaacaaaaaaatagtttgtcagaaccaaatatatacagcaccacacaagccaaatgcgctgaaatttggactcatggacaggtgatccgccagtaactgactgaagtttactagataccaggcggttaccaatacgaaaagcaaatcactgca

SEQ ID NO: 7819 - DNA, 2136 bp, Zea mays
gcacgagaccattacctagaacatcctaatcgaaaacccgatttcaccgaccatttttccccatttcacagcgggcgaatatctctcatctcccccgtcctctttcctgcaacacctcctacccacccgacagaaatatcctaagcgccgacccgaatacccgattcgctcctcgtccggtcgattcctgctcctaatcgctcgaatcgagtccttgccccgtgttccgtgccacaatctgggcgcttggctcccgcgagccggggttcttgggcctgggcggaggccatggacaagccggtggcgccgggcattatcaaggaggagctcctggagcagcagccgccgacgcaggacggtgtgggtggcggcggggatgcgccgcgcccgatggaggggctgcacgaggtgggtcccccgcctttcctcaccaagacgttcgaccttgtggaggacccggccaccgacgccgtcctctcctggagccgcgccggcaacagcttcatcgtctgggacccgcacgtcttcgccgacgggctgctcccgcgcctcttcaagcacagtaacttctccagcttcgtgcgccagctcaacacctatggcttcagaaggttgatcctgacaggtgggagtttgcaaatgaaggtttcctcagaggtcaaaggcacctgctgaagatgataaagagaaggaagccaccatcagctgtggcaccattgcgacagcaacgtgcccctgcttcttgcctggaggttggtgagtttggatttgaggaggagattgataggctgaagcgtgacaagaacattttaatcacagaagtagtaaaactaaggcaggagcagcaaagtactaaagatcatgtgagagccatggaggaaaggctacgagtggctgaacagaagcaggtacagatgatggggttcttggcaagagcaatgcggaacccagagttcttcctcagttggcccagcagcaagacaagaggaaggagctcgaggataccatctcaaagaaaagaaggcggcccattgacaacacaccattctacagtgatggggaaagcgaacagcttgattcacagttgaaaatgttcgagtcaggtgttctcaatgggctcaatgaacctgagctggagaatttagcagtgaacattcaggagcttgggaagggaagcatagatgatgggaacttgactcaagttagtgaccagtcagagctgaacgacgacttctgggcagagcttttggtcgaagattttggagacaaggcaggacagccagagttggagggaagaactgaagacgtgaatgaccttgctcaacaactggggtatctgagttcttctagcccaaaatagagccagttcctaatggttgcccccacaatcactggtgctttccctaccctactgttgcagaccatcctgatcaaaccggtacttttcaaattcaattcaatgacacaaacctgttaaaatctggtaacattttcattccatttcttttatattgctggattagccaggaatgatgatggatctggcagacaaggtttgacgacccatccttctaaccatatccattatgtttgcgcagttgcatcttcagatttgccctcatcttttcttcttcttcttctgaaacattctaaattgctccttatccagttgactggtggtggagaggtgttcatactgaaggcgtgctgtggagaggtcactgccttgacgttgaaggcttagcgctgtactctgctgtgggagttacgtgtggggtgttggctaaatgtctcttccggcgtcttctggcaaaatgatctcgtggacggtgactggcaaagatgcctaggggccaacgtatacgtacacagctgttatcagatcttgttcaaagtcattgcgcggttttgacggtgctatgtatcgatcagggttctggccttctggggttgggttgtagaattgactggctgatctagtgttctccatgtatgactggtgtaaccttaaaacaccctcagcttgttgttgaactgtgacaagcatctcgtttttttgttgtactccattttcatcatcattgtacatcaaattgctgaattatgaacagatccctaacaaaaaaaaaaaaaaaa

SEQ ID NO: 7820 - DNA, 2165 bp, Zea mays
ctcgaggccggccggtgagtctctgacgctgccttttgctctccccttccaccccgtctgcccgcgcgcgctgtctcgtggcgacaactgggcgaccgccgccgccgtcgctgccgccgctacgccaagaagctaggtcttcatcggtcccttcgtcgagattttctccggcgacaagcacccagcaggggactacaagattgattttgatggattatgacaagtctagaagaagtaactccaaaaagaggacacattccaattctgatgacggaaagaggaaacggttgagctctaggcatgatgacacatctatgtcctctgagccaattgaaaccatctacaggatattgtgcccggcaaaaaagataggcagtgtcttgggaagaggtggtgacattgttaaggcccttagagaggaaactaaagccaagataagggttgccgattccattcctggtgcagatgagagagtaattatcatcttcaattaccaaaatcaacctgaacttactgatgaagcagctgaaaaacaaattagtgatggcttagggaacatgaaaccccattgctttgcccaagatgccttattgaagatacatgataagattgtggctgatgaaatttatgatgaagtcgctcatgatgaaagttctgaaagtgctgatgatgtcactgctcgaattttggttcaaggcaatcaagttggctgccttctaggaaaaggtggctccattatacaacaactacgaagtgatactggtgctgggatccgtgtcttgtcatctgaaaaccttccccagtgtgcacttcaaagtgatgaactggtgcagatatctggagcaccatctcttgtaagaaaagctctatatgaaatatctactcgtctccatcagcatcctcgtaaggaaaatagacctcttgaacaaataatagatgcaagcacacaaaggaaacacgagtctccaacactgcaacatgaaaatccaatgttgccgcacctgcatagtcatcatccacctccaatacccctgcttgacccatacagaagtggacctcagtatcctgttagtgaaactgaagagttttctatcagaatcctatgtgcttctgagctcattggttcagttattgggaaaagtggggctaatgttaggcgggtagagcagcagactggtgctcgcattaaagttcaagagattgacaaagatgcttctggagaaaggctgatcattgtttcatctaacgagataccaactgaaccaatatccccaacaattgaggcactcattttgctccacgataaagtaagtgcatcctctgagaaacaccattcaagtacaaggcttgttgtaccatcaaacaaagttggctgtattcttggggaaggtgggcaggtgattactgaaatgagaagacgaactggggctgaaattcgagtttactcgaaggcagataaaccaaaatacttgtcttttggtgatgaacttgtgcaggctgctggacaaattcatggactggaggactatagaggactgccaagtgcttctggaaggttctcgagcactattgaactaaggattccaaatagttctttggagtctattgttggtgttggcggggtcaatttagcagagatacgtcagatttctggtgcaagactgaggctacatgaggctcatgctggttcttctgagtctgtggtggagatccagggcacactggaccaagcaaaagctgcgcagagcctcctggagggctttatcagcgcgaacagcaggcagcagcaatcccattcttctcgcatgccactttacccaagatggggatagcttctggttgtggcaggggaaaaccgagtcagcagggttggctggagttatctcagactgcagattagatgcatcgatgatgttaatggtagctgtttaaattgaccgtgcaagcatgataacttatattatgccataggacaagtaatgctgattctctcatgaaatactaagtgacaagctgtctctgtagttgtatttgtttctgaatgtttgaaccctactgttacaacggctgctattttaggtcagatttcagaggccggataattatgttatctgcagagttgggccaaaaaaaaaaaaacaaaccggctggggccggcctccccc

SEQ ID NO: 7821 - DNA, 1802 bp, Zea mays
  misc_feature (5)..(5): n is a, c, g, or t
  misc_feature (93)..(93): n is a, c, g, or t
ttagnaatggcccacaatatcctgttacctgaaactgaagagttctctatcagaattctgtgtgcttctgagctcattggttcagttattggngaaaagtggggccaatgttaggcgtgtagagcagcagactggtgctcgcattaaagttcacgcgagccccgccgggcctcctggacaaaggctgatcattatttcatctaatgtgctaccagctgaaccaatatccccagcaattgaggcactcattttgctccatgataaagttagtggcaccctctgagaaacaccattcaagtacaaggcttgttgtaccatcaagcaaagttggctgtattattggggaaggtggaaaagtgattactgacatgagaagacgaactggggctgaaattcgagtttactcaaaggcagataaaccaaaatacttgtcttttgatgatgaacttgtgcaggttgctgggcctccaactattgcaagaggagccctcacagaaattgcttcgaggcttagaactaggactttgagagatacaagtaccgccaataatcctccaccttttgccccttttgatgatcctcctgttgatatgcctagcagaaagttgtcactatatggagggcctgccactgatccaccgtatggaaggcctgccaatgatccactgtatggaaggcctgccattgatccaccattcggaagacctaccaatgatcgaccatatggaaggactgctgttgctcccccatttggaagacctgccaacgatccaccatatggaaggcctaccaacgatccaccatatggacgaccttccggtagtataccatatggaagaccaaacggaagtgcacctcgtgagccttccgatgcatatcctgtagactacttttctaaaagagaatatcctagtggaagtcctatgtttactagtaatgccccatcagctgcttatgagagatatgcagcacccacacgctttcctactagagaatttccctctgctttcagtcctggtgtagatcatatgcctcatcattcctatcgtgaccatgtgcctactgatagctactctagtaggggtacacagcaattaggcatcacaagaggtggaaattcagatgcttatgactataccgaggctgctggacaaattcatggacgtgaggattacagagaaccgacaagtgctaccggaaggttcttgagcactattgaactaaggattccaaatagttctttggggtctattgtcggtgctggtggggtcaatctagcagagatccgtcaggtttctggtgcaagactgaggctacatgaggctcatgctggttcttctgagtctgtggtggagatccagggcacactggaccaagcaaaagctgcccagagcctcctgcaaggctttattagtgcaaacagccggcagcaacagcagccctattcttctcgcatgccactttacccaagctggggatagcttctggtctcatggtcgtgtcagaggaaaacagagtcagcagggtttgtcatgtggctgtagatctcggactgcagattagctgtagcgatgatgttgttgaaggaggctgtttaacagtgcaagcaagataacttatacttatgccttaggacaagtaatattgttttcctctgatgaaatacttggtaacgatctgtctctgtatttttatatttgattctgaatgctttgaaccctagtgttacaaaagctgctattttgaggtcagactacggaggccgaataattctgttatctgcagaattgggcaaaaaaaaa

SEQ ID NO: 7822 - DNA, 887 bp, Zea mays
  misc_feature (872)..(872): n is a, c, g, or t
cattgggacctcgaggcggcacccacccgaatctccgttcaacccccctgcctttttgctctcctgttcaccccttgtgcccgcgctctctcgtggcgacgacttgcgcgaccgccgccaacgccaggcacctaggtcttcgtcggtcctttcttcagagacgagcacccaacagggggctacaagattggttttgatggattatgacaagtctagaagaagtaactccaagaagaggacacattccaattctgatgacggaaagagaaaacggttaaacactaggcatgatgacacatctatgttctctgagccaattgaaaccatctacaggatattgtgcccggtaaaaaagataggcagtgtcttgggaagaggtggtgacattgttaaggcccttagagaggaaactaaagccaagataagggttgctgattccattcctggtgcagatgagagagtaattatcatcttcaattaccaaaatgagcctgaaccgactgatgaagcagctgaagaaaaaaatagtgatggcttagggaacttcaaatcccattgctttgcccaagatgcgttattgaagatacatgataagattgtgtctgatgaaattcatgatgaagtcgccaatgatgaaaagtctgaaagtgcagatgatgtgactgctcgaattttggttcaaggcaatcaagttggctgccttctaggaaaaggtggctccattatacagcaactacgaagtaatactggtgctggaattcgtgtctggcatctgaaacctttcccagtgtgcacttaaagtgatgaactggtgcagatatctggagcactttccctttgtagaaagctctatatgaaatatctactcgtcntcatcagcatcctcg

SEQ ID NO: 7823 - DNA, 1203 bp, Zea mays
  misc_feature (1189)..(1189): n is a, c, g, or t
gcagaaaccgacgcgcacgcgcgcgcgccccagactagcggctctccacgcaagcggagccgaagagaaataatggccacggcgacggccctctccctcagcggcggcgggggcggcactcccctgctccgggggcacgcggccttggcctcggggcggtgctgcgcgttcccgcgctcgcggtggaggccgccgcgcctgtcggcctcccgcgcggacgactcctcaccggcgccgttcgagatgacggtggagggcgcgctgaagctgctcggcgtcgctgagggcgcgtccttcgacgaaatcctgcgcgctaagaactccgtcctggcctcctgcaaggatgaccaggacgccgttgcccaggtcgaagcagcctatgacatgttgcttatgcagagcttatcacagcggagggctggaaaggttgctaataacagcatccgctatgctgatgttaaacctgtaaagagtgcaggagctggggcagtcccacagtggatgcaggcaaccatgaagaatgcacctattacattcgagactccatcttcgagtagcttgggcatccagtcttgtgtttatggtgcactaatggttttcacgtatgctagtggaagctcgacatctttgccatctgcatacactagccctgatgtcccaggttttatcctagcaacaggatttggtgcatcactgtatttcctggcaaagaaaaatatgaacttaggtaaggctgcattgatcactgtcgggggacttgcagctggtgcaactgtcggatctgcagtggaaaatttcctgcaggttgatatcgtgccctttctaggcatccactcccccgccgtcgttgtcagtgaatttattctgttctcccagttgttggtatcactgtttgttaggtaggatctgaaatcaagctgtcatcctgatcatggcatgtaagtaactgaaatggttcgtgttcaaacttcaaagggtcagggaaatgcttattttccgctcaaggtgcaagcagctgtgtatagcaaacaatacatggacatctctgtcccttataaagatcacttgtatctagttctctcaaccccaatcccaatctttcagaagaaagtttgtatcgattgcagaatgtggaatgagaattcttggattaaaactctggagtctggaatatcgtagcctcttgttntatttttcaaaata

SEQ ID NO: 7824 - DNA, 911 bp, Zea mays
  misc_feature (720)..(720): n is a, c, g, or t
  misc_feature (752)..(752): n is a, c, g, or t
  misc_feature (854)..(854): n is a, c, g, or t
  misc_feature (861)..(861): n is a, c, g, or t
accaaaagcggctcctcgcggcccgcccgccacacgttccctcgtcttttgtcagttggacaatccgcagctcctccatctcattcttccccccatcccatccccaaggttgaccggcgaaatcagcagtccgagaaccgcgagcttctgcctgatccagcctcatcccgccatggacgaatctgaggagcacagcaacggcggcgggcacccccacccgcaccacgggtacgagtggaagttcccggcggcgctgagcgcgaacacgacgagcgtgcacgtgacggcgctggacggcgtggtgaacgtgaactcgctgttcacggtggccgtgttcgtggggctgtcgctggcgaccccggggcagctgcggagcctggcgggggacccgcggtgcgacgccggcccgggcgtggcgcggtcgctgctggtgctggaggtggtggccttctcgtccttcctcttctccagcctggtggcgcagggcctgaagctggcgctcaacctcatcaactccaaggacccgcacgacgcggcgcgcgcccacatcgacgcccgcgtgctccgcctcggcatgctcgcctccgccgtcggatccgtcgtcggctgcgtcttcctcatgacgtccatggtcatggtcgtgcaggtccgcctcggcacgctgagctgccccaccgaccgcgccgccgcagggggccgccgcgggggccctcgtcggcnctcgtcaccaccgcgctcgcctttctacgtgngcaccgtcttctacaccttcacccactgatgccagttccatgcgtccgtgcgctgcatcccaatccatcctagcggttgcgttgcgttgcaaaggcactcgncatcaanggggtgtcggtgtgcgaggaaattgaaaggaggacctgcaatctgcgttt

SEQ ID NO: 7825 - DNA, 1351 bp, Zea mays
ttcccagttcccacacgttcccgcgtcttttgtcagttggacaatccgcagctcctccatctcattcttccccccatcccatccccaaggttgaccggcgaaatcagcagtccaagaaccgcgagcttctgcctgatccagcctcatcccgccatggacgagtaagtctcttcccctcgccccttccatggatggatgaaggaacctaatgtttcgtgccctgtctccatccatcccagatctgaggagcacagcaacggcggcgggcacccccacccgcaccacgggtacgagtggaagttcccggcggcgctgagcgcgaacacgacgagcgtgcacgtgacggcgctggacggcgtggtgaacgtgaactcgctgttcacggtggccgtgttcgtggggctgtcgctggcgaccccggggcagctgcggagcctggcgggggacccgcggtgcgacgccggcccgggcgtggcgcggtcgctgctggtgctggaggtggtggccttctcgtccttcctcttctccagcctggtggcgcagggcctgaagctggcgctcaacctcatcaactccaaggacccgcacgacgcggcgcgcgcccacatcgacgcccgcgtgctccgcctcggcatgctcgcctccgccgtcggatccgtcgtcggctgcgtcttcctcatgacgtccatggtcatggtcgtgcaggtccgcctcggcacgctgagctgccccaccgaccgcgccgccgccaaggccgccgcgggcctcgtcggcctcgtcaccaccgcgctcgccttctacgtgggcaccgtcttctacaccttcacccactgatgccagttccatgcgtccgtgcgctgcatcccaaatccatctagcgttgcgttgcgttgcaaagggcacatcgccatcagtggtgtcggtgtgcgaggaaattgaaaggaggacctgcaatctgcgttattactttgatctgatgcgctgttcgtttttgttcgtgactaaagtttagatagtgttggatattagttatgaatattaaatatagacttaattaagtttaataaattcatctgatcttttattttcatatgtgtaattagttttataattaaactacttgtaattgtcatcaaacattcgacagatactaaacttttgattacaaccgaacacccgtggtccgtgccgcttgagttctgggctgtggtagtgaacgtggttatctcaaaagcacatggcagagatgctcacgcgtgatccgatgccatccctcctgatggagatatagctagaacaagctagagctccggatccaattttactggtaaggcctcgttcgtttgtgccg

SEQ ID NO: 7826 - DNA, 933 bp, Zea mays
tgggtaccccggggcccccccggacgttccctcgtcttttgtcacttggacaatccgcagctcctccatctcatattattccccccttcccatccccaaggttgaccggcgaaatcagcagtccgagaaccgcgagcttctgcctgatccactgatccagcctcatcccgccatggacgaatctgaggagcacagcaacggcggcgggcacccccacccgcaccacgggtacgagtggaagttcccggcggcgctgagcgcgaacacgacgagtgtgcacgtgacggcgctggacggcgtggtgaacgtgaactcgctgttcacggtggccgtgttcgtggggctgtcgctggcgaccccggggcagctgcggagcctggcgggggacccgcggtgcgacgccggcccgggcgtggcgcggtcgctgctggtgctggaggtggtggccttctcgtccttcctcttctccagcctggtggcgcagggcctgaagctggcgctcaacctcatcaactccaaggacccgcacgacgcggcgcgcgcccacatcgacgcccgcgtgctccgcctcggcatgctcgcctccgccgtcggatccgtcgtcggctgcgtcttcctcatgacgtccatggtcatggtcgtgcaggtccgcctcggcacgctgagctgccccaccgaccgcgccgccgccaaggccgccgcgggcctcgtcggcctcgtcaccaccgcgctcgctttctacgtgggcaccgtcttctacaccttcacccactgatgccagttccatgcatccgtgcgctgcatcccaattccatctagcgttgcgttgcgttgcgttgcaaaagggcacatcgccatcagtggtgtcggtgtgcgaggaaattgaaaggaggacctgccatctgcgttattactttgatctgatgcgctggt

SEQ ID NO: 7827 - DNA, 1910 bp, Zea mays
cgaaggcttcggaagaagcttcgggggcggcagtactagtttcttcagccgaaattggctcttgctatttttgtttcttcggcttccaaggatttcaccttggtgggctctgaaggcccagcttcagtttcagattgttgctttgaagcttcggcaacaaaggcttcagtatgcacttcagaagattcaacaattttcttcggagttgtgcttgaagactttattgtctccaaaacatccagcacattaaccatcctttttcttttgggggtcaatgctggccccttttggcttgttgctgcctcaatttttgctgaaggacttagaacttccgatgtctttggttcttcagccctcggttcttctattttttctgtcgccggcacttcggccgacccttcaatagtcggcaggggagttggttctttagcttcggtggccgaagaggtctcaccgacaaactcaggcactgtggccggttcgatataacgtggccggtgtgtgagaacctttacccttttcctcttcggcgccggctcgctaggagcggctgaagcaacttccttcgcagaagatgtattctttcttttttgaccccgcgttggataacggtagtcggggtagacaaacccaattgcatcaaatactcggttgagtctcttcttctttcggcctccgaaggccgctgatagtgcagtgtcttcggccttcgagtataatccaagcaattcatcacttatggcctcaatactttttagccagtcgtcatctggctcgacgaatttatctccatattggaatgtgtattttagcttaactaatccaccttcgtcagtttctttaatggtctccttcggcatttcccacttttctacaagtggccatactctgaaggcaatgtgttcttggaccaaatcccttgtcccaataaaagagcaaaccacgccgaaggctctctggcattcttcggctgcttcattcatttccaccttcggcctccggaggccgaagcgttgccagatagggcgcataatgatatctttaatatcttcccgtgttttcaagtcattcttcacataaaaccattccgtcatccagtcgccgggccacctctttcgaaaggttggcacgggacagcttgacccagatcgggcgccgaagctgtagcagccaaaattgttgtgatactgctctttaccccagggtttcgtctcgtacaatagctcatgtatgttgcagaaactttttgcatttggttctaaaccttggctcctcacggcccacacaaagatgcccatccttatgattgcttcgggagtaagttgatgaaggtagatttcaaatatcttcagtatttccacgacaaaactgctcaagggaaatcgcagtccagcctttaagaagcttcggaatatcacgacttcattttcctcgggagtcggacaagccttctctccttcgtcagccctcacaacagacaagtcccaaaaatatctgcccctcatattgacaagatggctttctttaatacttgatttaccaaaaaccgcatggcttggtcgccaaggtcgatcttcggagtctttaccaccactatccacatcataactgtcactatcaccagtatcttcagataaaccctcccaaatctccctagtaatcttctctgtattggtctttgacattgattaaagaaagcccagatgcatctcctcagaaaggctcagcttcggatcaccaacaactttcttatcctcagacatcttcgcaaacgctgagagagtgctcttgaaaccgaagcttaaaaatttaaaaagccaagcaagtgttgttgcgcacaggctaaaagttgagtgagcaaaagcagatggcaagaaagcgtgccaaataaactcgtggtgagctcttat

SEQ ID NO: 7828 - DNA, 3136 bp, Zea mays
tgacattttcatgtcttcggttgcctttgcaattgttacttcttctacttccgaaggtattaccttggttggttctgaaggcccagtttcaacttcagtctgttgcttcggagcttcagcaatggacacttcagcaagcgcctcagaagtttcagcagttttctttggggttgtgcttggaagtttaattgtttccaaaacatctaatacattaaccattcttttcctttttggggtcactgttggcccctttttaatttttgctacttcaatttctactgaaggacttaaaatttctgacatttttgctccctcagttgatgcttttgcttcttccatcttttctgtcgatggcgcttcggccatctctttggtttctggtagcagaatcttcggttcctctaattcttttgttgttggcgcttcggccatttctgcgacttctggcagcagggttggctcttcagcctcggtggccgaagaggtctctccggtgaattcaggcaccgtggctggttcaatatagcgtggccgatgtgtgagaacttttaccctctttctcttcggtgctggctcactaggagcagctgcagttttttctttcgcagaagttgcgccttttcttttttgccctcgtatgggatagcggtagtcggggtagacgaacccgattgcatcaaaatacccggttgagtcttttcctttttcggcctccgaaggccgctgacaaagcagtatcttcggccttcgaatatgccccaagcaattcatcacttacagtctcaatgctctttaaccaatcatcatctggttcaacaaatttgtctccatacttgaatgtgtacttcagccggactagcccaccttcgtcagtttctttaatagtttctttcggcatttcccaattatccgcaagaggccacactctgaaggcaatatgttcttgtgttaaatccctcgtcccaataaaagagcaaacaactccgaaggctctctggcattcttcggctgcttcattcatttccaccttcggccttcgcaggccgaagcgttgccagatgggatgcataatgatcttctttatatcttctcgagatttcaagtcatttttcacgtaaaaccattccgtcatccagtcgccaggccacctcttgcgaaaggtcggcactgggcagcttgacccagaccgagagccgaagctatagcagccaaagttgttgtgatattgttccttaccccagggttttgtctcgtataacaattcgtgtatattgcagaagctctttgcatcaggttccaagccttggctcctcacagcccacacgaaaatattcatccttatgatcgcttcggggataagttggtgaaggtggatttcaaatatcttcagcacctccacaacaaaacggctcaggggaaatcgtagtccagctttcaagaagcttcgaaatactacaacttcattttcctcaggagttgggcaagtcttctctccttcgtcggcccttacaatagacaaatcccggaaatatcttcccctcatgttggcaagatgactttctttaatacttgatttaccgaaaaccgcatggcttggtcgccaaggtcgatcttcggagtcttcgccaccactatccgcatcatagctgtcgctatcaccagtatcttcagataaaccttccaaaatttctttagtgatcttctctgtattagtcttcgacatagattgaagaaaacccagatgcatctcttcagaaagactcagcttcatttcggcagcaaccttcttctcctcagacatctcttcggaattcttgccctctcgcttccgaagcttaaaactagggaggcaacaaaatatttgtggccagaaaactatttgagcaggcaaaacagatggcaagggagcgtgccgaataaattgtgacgagcccgtatttataaacccattatgtcggaggctggaaggccccatttgccattgactgttgctattctagcaaagggaaggtgttttttcggaccttcggctcgaagccttcgtccatgtcgcaatataaatttgttattccagcaaattaatattgtgaggggctactgttgggggccttcggcttccgaaggtcctcaaaaatgtaatttgactatgttttccaggagaaatatgtgaacaggtaccttcgaagtcagattgcgagtatacaagagcatggttaagacgaagcttgactgggacggcgatcacgacgaaggataagacgatcacgaagctatgtgcagaagagcttcggcataacggcgggaaggggaaaccgacttaaagatgaaaagccaaattagacctcgaagaattactatagagttattgataaatgtaaagggcattaatgtaattttgcatgggctgcgacccgtgcctataaataggtgaacagtattcccgtactgttcacgctgacttggcattcacttttgcgtcacgcctgtattctcattccttcaagccgaaggtacatttgtaatttaccattgtttacacaagtaatataaatggaaatagattaataataatgtttacagaaattatgttactttctgtactttgtatgaatgttctccatcttctatcatgatcgtgaaggtgtgtccgtcatgaccttcgtccgagttgcgttggttccgaagggaagtaatgatccaaaggacgaagggctttgatatttaacattttatgttgccttgttcttgattcatagcatttgagaacaagtccccaacagttctcatgatccatattgttatggatatatttgatgtcatgattaattatcttttatatgtcatcatcataatattaatttatggaattaaaatgatatggaaaatgcctataagtctaacaatccaaaaacctaatgttaggcatttttctgtcagaggttttgctactgtgctaaagcctggtccttttgatggtaaaaacttcttgatatggaaagctaaatggaattgtggctaactgcaatgtcttgttttcatgccgctgaaggcaagctgccaactactctctgagatgagctagtttaagatgaagacactctgacgtacgatagctgaatcaatctgcagcggggat

SEQ ID NO: 7829 - DNA, 1717 bp, Zea mays
  misc_feature (233)..(233): n is a, c, g, or t
tggataacggtagtcggggtagacaaacccaattgcatctagtcggggtagacaaacccaattgcatcaaatactcgcttgagtctcttcttctttcggcctccgaaggccgctgatagtgcagtgtcttcggccctcgagtatgatccaagcagttcatcacttatggcctcaatacttttcagccagtcatcatctggctcgatgaacttactccgtatttgaatgtgtantttagcctaactagtccaccttcgtcaggttccctgacggtttccttcggcattccccacttttctccatgtggccatactctgaaggcaatgtgttcttggaccaaatcccttgtcccaataaaagagcaaaccacgccgaaggctctctggcattcttcggctgcttcattcatttccaccttcggcctccggaggccgaagcgttgccagatagggcgcataatgatatctttaatatcttcccgtgttttcaaatcattcttcacataaaaccattccgtcatccagtcgccgggccacctctttcgaaaggttggcacgggacagcttgacccagaccgggcaccgaagctgtagcagccaaaattgttgtgatactgctctttaccccagggttttgtctcatacaatagctcatgtatgttgcagaaactttttgcatttggttctaaaccttggctcctcacggcccagacgaagatgcccatccttatgattgcttcgggagtaagttgatgaaggcagatttcaaatatcttcagtacttccacgacaaaactgctcaagggaaaccgcagtccagcctttaagaagcttcggaatatcacgacttcattctcctcgggagtcggacaagttttctctccttcgtcagccctcacaatagacaagtcccgaaaatatctacccctcatattgacaagatggctttgtttaatacttgatttcccaaaaaccgcatggcttggtcgccaaggtcgatcttcggaatcttcaccaccactatccacatcataactgtcactgtcaccagtgtcttcagataaaccctccaaaatctccctagtaatcttctctgtattggtctttgctattgattgaagaaagccgagatgcatctcctcagaaaggctcagcttcgattcagcaacaactttcttatcttcagacatcttcgcaaatgctgagaaagtgctctcgaaaccgaagcttaaaaatttaaaaagccaagcaagtgttgttgcgcacaggctaaaggtcgagtgagcaagagcagatggcaagaaagcgtgccaaatgaactcgtggtgagctcttatttatacacctagtgcgttgaaaactggagggtcccgcttgtcaatgactgttgctattctagcaaagggaaggtgttttttcggaccttcggcctaaggccttcgtccatgtcgcaatatgaatttatcattctagcaaattaatattgcgaggggctactgttgggggccttcggcttccgaaggtcctcaaaaacataatttgacaatgtttcccaagtgaaatatgtgagcaggtatcttcggaatcggatcatgagtatacaagagcacagtcagaacgaagcctgaacgagacgaaagatgattatgacgaaggtctagataatcacgaagctgtgtgcagaaaatcttcggcatgatagcagaaaaggggaaccg

SEQ ID NO: 7830 - DNA, 1736 bp, Zea mays
ctcttcttttttcggcctccgaaggctgctgacaatgcagtatcttcggcctttgaatataccccaagcagttcatcacttacagtttcaatgctttttagccagtcatcatccggctcaacgaatttatctccgaacttaaatgtgtacttcagcctgactagtccaccttcgtcagtctctttaatggtctcctccggcatttcccatttttccacaagcggccatactctgaaggcaatgtgttcttggaccaaatccctcgtcccaataaaagagcaaacaactccgaaggctctctggcattcttcggctgcttcattcatttccaccttcggcctccgcaggccgaagcgttgccagatgggacgcataatgatcttctttatatcttctcgtgatttcaagtcattcttcacgtaaaaccattccgtcatccagtcgccaggccacctctttcgaaaggtcggcactgggcagcttgacccagaccgggagccgaagctgtagcagccaaagttgttgtgatactgttccttaccccagggttttgtctcgtataacaattcgtgtatgttgcagaaacttttcgcatcaggttccaggccttggcttctcacggcccacacgaagatattcatccttatgattgcttcgggggtaagttggtgaaggtagatttcaaatatcttcagcacctctacaacaaagctgcttaggggaaatcgcagtccagctttcaagaagcttcggaatactacgacttcattttcctcaggagttgggcaagtcttctctccttcgtcggccctcacaacggacaagtcccggaaatatcttcccctcatgttgacaagatgattttctttaatacttgatttgccgaaaaccgcatgcttggtcgccaaggtcgatcttcggagtcttcaccaccactatccacatcatagctgtcgctgtcgccagtatcttcagataaaccttccaaaatttctttagtgatcttctctgtattagtcttcgatatagattgaagaaaacccagatgcatttcctcagaaagactcagcttcgaaccaccaacagctttgttatcttcagacatccttgcaaacgctaagaaagtgctctcaacgccgaagccttaaaatttaaaaggccgagcaaaggctgttgcgcgtaggctaaaggttgggtgagtaaaaacagttggcaagagagcgtgtcaaataactcgggatgagctcttatttatacgcccagagcgttggaaactggagggtcccgcttgtcaaggactgttgctattctagcaaagagaaggtgttttttcggaccttcggcttaaggccttcgtccatatcgcaatatgaatttatcattacaacaaaattaatattgcgaggggctactgttgggggccttcggcttccgaaggtcctcaaaaacgtgatttgacaatgttttctaagtatgcgagcaggtatcttcgggatcaggttgcggatatacagaagcatggtcaaaacgaagcttgactgggacggcgatcacgacgaaggataagatgatcacgaagctatgtgcagaagagcttcggcataacgacgggaaggggaaaccgacttaaagatgaaaagccaaattagacctcgaagaattactatagagttattgataaatctaaagggcattaatgtaattttgcatgggctgcgacccgtgcctataaatag

SEQ ID NO: 7831 - DNA, 2297 bp, Zea mays
gtttttgagcgtaaaactgggcctcttgcttttctttttcagtcaactttttccccgaagcatgtcgtaaaatataatcgaaagcttcggaaaatgcttcgggggcggcagtgccagtttcttcagccaaaatttgttctgatgtttctgtttcttcggcttccaaggattttaccttggtgggctctgaaggcccagcttcagtctcagattggtgctttgaagcttcggcaccagaggcttcgatttgcacttcggaagtttcaacaattttcttcggggttgtgcttgaagactttattgtctccaacacatccagcacgttaaccattcttctcctcttgggggtcgtcatcggcattggcattggcacctccattctagctgaaggacttagaatttccgatgactttgtttcttcagccctcggttcttctattttttccgtcgctggcaccttggctgactcttcaacattcgcaaggggagtcggctccttggcttcggtggccgaagaggtctcaccgacaaactcaggcactgtggccggttcaatatagcgtggccggtgtgtgagaaccttcatctttttcctcttcggcgccggctcgctaggagcggctgaagcaatttccttcgcggaagatgtattctttcttttttgaccccgtgttggataacggtagtcggggtagacaaacccaattgcatcaaatactcggttgagtctcttcttctttcggcctccgaaggccgctgatagtgcagtgtcttcggccttcgagtatgatccaagcagttcatcacttatggcctcaatactcttcagccagtcatcatctggctcgacaaacttatctccgtatttgaatgtgtattttagtctaactagtccaccttcgtcaggttccctgacggtttccttcggcatttcccacttttctgcaagtggccatactctgaaggcaatgtgttcttggatcaaatcccttgtcccaataaaagagcaaaccacgccgaaggctctctggcattcttcggctgcttcatccatttccaccttcggcctccggaggccgaagcgttgccagatagggcgcataatgatatctttaatatcttcccgtgttttcaagtcattcttcacataaaaccattccgtcatccagtcgccgggccatctctttcgaaaggttggcacgggacagcttgacccagaccgggcgccgaagctgtagcagccaaaattgttgtgatactgctctttaccccagggttttgtctcatacaatagctcatgtatgttgcagaaactttttgcatttggttctaaaccttggctcctcacggcccagacgaagatgcccatccttatgattgcttcgggagtaagttgatgaaggcagatttcaaatatcttcagtacttccacgacaaaactgctcaagggaaaccgcagtccagcctttaagaagcttcggaagattacgacttcattctcttcgggagtaggcacagtcttctccccgtcatctgccctcacagtagacatgtctcgaaaataccttcccctcatgttatcaagatgactctgtttaatgctcgattttccgaagactgtgtgacttggtcgccacggtcgatcttcggagtcttcacccccactttctacatcatagctgtcactgtcaccagtgtcttcagataaaccctccaaaatctccctagtgatcttctctgtattggtctttgatattgattgaagaaacccgagatgcatctcctcagaaaggctcagcttcgattcagcaacagctttcttatcttcagacatcttcgcaaacgctgagaaagtgctctcaaatccgaagcttaaaaatttttaaaaaaagccaagcaagtgttgttgcgcacaggctaaaagtcgagtgagcaagaagcagatggcaagaaagcgtgccaaataaactcgtggtaagctcttatttatacacctggtgcgttgaaaactggagggtcccgcttgtcaatgactgttgctattctagcaaagggaaggtgttttttcggaccttcggcttaaggccttcgtccatctcgcaatatgaatttatcattctagcaaattaatattgcgaggggctactgttgggggccttcggcttccgaaggtcctcaaaaacatgatttgacaatgttttccaagtgaaatatgtgaacaggtatcttcggaatcgggttatgagtatacaagagtacggtcaggacaaagcttgagtgagacagaaggcgattat

SEQ ID NO: 7832 - DNA, 2320 bp, Zea mays
cactcctatgggcgattgggatccccggccggcccggccggcgtacacccgctcttccagttaggaggggagcacccatcagccaagagctatccatacgcacagcgatgcaccagcacgagatactagccatcatgcgcctgtcgtccctcctcctcgtcgtggccgccctctcggcgcgcgccgcggcgcagcaggtgccgccggtgggcggcagcgctctgaagccggactactacagccagtcgtgcccgcgcgcggagcggatcatcgcggaggtgatgcagacgaagcagatggcgaacccgacgacggccgcgggcatgctgcgcgtcttcttccacgactgcttcgtcaccgggtgcgacgcgtcggtgctgatcgcgtccacccagttccagaagtcggagcacgacgcggagatcaaccactcgctccccggggacgccttcgacgccgtggtgcgcgccaagctggccctggagctggagtgccccggggtggtgtcctgcgccgacatcctcgcgctggcgtcgggggtgctggtcaccatgaccggcgggccccggtacccgatcccgctggggcgcaaggactcgctgtcgtcgtcgcccacggcgcccgacgtcgagctgccacacgccaacttcaccgtggaccgcctcatccagatgttcggcggcaaggggttcacggtgcaggagctggtggcgctgtccggcgcccacacgctgggcttctcccactgcaaggagttcgccgaccgcctctacaacttccgcagccagggcgggaagccggagccgttcgaccccagcatgaacccgtcctacgccagggggctgcaggacgtgtgcaaggactacctcaaggaccccaccatcgccgcgttcaacgacatcatgactcccggcaagttcgacaacatgtacttcgtcaacctggagcgcggcctcggactgctcagcaccgacgaggagctgtggacggacccccgcaccaagcccctggtgcagctctacgcgtccaaccccactgccttcttcaccgacttcggccgcgccatggagaagctcagcttgttcggcgtcaagaccggcgccgacggcgaggtcaggcggcgttgcgacgcgtacaacagcggccccgacgttggcggcgccatgcctatggctatgcccatgcccaagatgtgacgctgcgcgcgctataagtacaacgacggcggccgcacgcgtgcttgtctgccgatcgatcgacggccgagctgtgtggcacgatgacccctgctgctcctatagtcctatacggcggtcacgatggtgttaaaaaaaatatatgcggagatgtgatatgtttcctgcttgatcaagtaatttatttctaatccgtgtgctgcgaaaaaaaactcttcgaagtgttgctgcttgctagtataaattaatttatttttttatcctttgatcgtactcatcgtcatgtatgtaagtaaagtcacgcagactgtcacattgttttcttgtcaacagtttgtgagacagactgttttttaagcgatgtttagtttctagagattaatttttattctctttattttattatattttaattactaaatttaggaataaaataaatgtactaaaactagtcaaaaccagcacccctaaatgtgtgacatttggccgccaaggacacaggccacggcagcatgtctgcgcgcttgtgattggctagttccctgggagtgcacgtcacaagccagcggggtctgaaaccggcaaattgttttagtgcgcgccgccttgtgtacattgctatgtgtacacaagttctcatttcatgcttaaaagcaaaatatcacattaaacacagcataaatattactgtctccgtcctaaaatataatttattttatactaatcatatatatttattaactaacatatgaatgcagtttgcatatatatatatatatatatatatatatatatatatatatatatatatatatatatatatatatccatattcatttgaatcaatatggacagaaaaatagattaaaaagaactatattttagaacagatggagtacataggactttataaattcgacagttcttcttataaagttgacatagtaacttaaaatatgtggtggggacgaaatataaaaaaacacgaagctaacatgaagtttaattgattcacatacttttgtttttaagtaagagcgagattattggcaacaaatgaacctagcggtggcgttagacatagaagcgaccgatcatacgcaaagatggtgtgcaatgggaaa

SEQ ID NO: 7833 - DNA, 1483 bp, Zea mays
gcacgagaccattacctagaacatcctaatcgaaacgcatttcttggacccgcacacccacgcttccaaaagttaggaggggaacccatcagccaagagctacgcaaacgcacagcgatgcaccagcacgagataccagccaccatgcgcctgtccctcctcctcgtcatcgtggccgccctctcggcgcgcgccgcggcgcagctgccgccggcgggcggcgccctgaagccggacttctatagccagtcgtgcccgcgcgcggagcggatcattgcggaggtgatgcagacgaagcagatggcgaacccgacgacggccgcgggcctgctccgcgtcttcttccacgactgcttcgtcagcgggtgcgacgcgtcggtgctgatcgcgtccacccagttccagaagtcggagcacgacgcggagatcaaccactccctccccggggacgccttcgacgccgtggtgcgcgccaagctggccctggagctggagtgccccggggtggtgtcctgcgccgacatcctcgcactggcgtcgggcgtgctgatcaccatgaccggcgggccccggtacccggtcccgctggggcgcagggactcgctgtcgtcgtcgcccacggcgcccgacgtggagctgccgcacgccaacttcaccgtggaccgcctcatccagatgttcggcgccaaggggttcacggtgcaggagctggtggcgctgtccggcgcccacacgctgggcttctcccactgcaaggagttcgccgaccgcctctacaacttccgcaaccagggcgggaagccggagcagttcgaccccagcatgaacccgtcctacgccagggggctacaggacgtgtgcagggactacctcaaggaccccaccatcgccgcgttcaacgacatcatgacgcccggcaagttcgacaacatgtacttcgtcaacctcgagcgcggcctcggcctgctcagcaccgacgaggagctgtggacggacccacgcaccaagcccctggtgcagctctatgcatccaacgccaccgccttcttcgacgacttcggccgcgccatggagaagctcagcttgttcggcgtcaagaccggcgccgacggcgaggtcaggcggcgctgcgacgcctacaacagcggccccgccgtcgccgccaccatacccaagatgtgacgacgctgcgcgtggtacgacgacgggcgcgcacgtgcttgtctgcatgcggatcgatcgacggccgagctgtctggcacgacgacggcgtgttgatcgagggcctcggctcctccagctgcgacggtcacgatggtgttaagatttcgtgccgaaatgtgatatgtttcatgctcgatcaagtaatttattcctaatctgtgtgctgcgcaaaagaaagaaaaacttcgaagtgttgcgctactcgctagtatgaattaattcgtttttccctttgaaaaaaagaaaaaaaaaagcggcc

SEQ ID NO: 7834 - DNA, 3397 bp, Zea mays
tctctagtagtgtgtactctatatgaagcatcggtttccattgtcgccatgagtcacgtacgaattataaagcatcggttttcatggtttccaccgttgccgtgattcacttacaaattataaagcataaatttttatcgtttccatcatggttgtgtcacttacaaattataaacacaattctagaccctcaattatccggaaaaaagaatcccccaattattcggtaaaaagaaaacatcttaattattcagggaaaatagaaaataaactaattatttgagagaaaaacaaaaaaaaagaaatttacatataattatctcttatacctattaatgtgtattacattttttggtctatcatccataggttattgtatgtttatatgaagaaaaattaagaacctaggggcggccatggctccttttggtcctccctatcctctgctgctgtagttgtgctgggtgtaattttttgagcttgtttacttgtacgttgttgatatacggtttggtttgcctggcacaaatccatgtcatttggcgtttgctatttgtagtaaagaccacaaggacgacacacgttagaagcagcacagcgtgcgcacgcactgttttcctcttcctcttcttgggctgtttcccccgcaaacctctccccgccactccctcgtttccgttcgcccaccctccattgcctccaagaacggccgctcctcccatctctgggcgccgccctcccacgcggccaaaagttaggaggggaacccatcagccaagagctacgcaaacgcacagcgatgcacaagcacgagataccagccaccatgcgcctgtccctcctcctcgtcgtcgtggccgccctctcggcgcgcaccgcggcgcagctgccgctggcgggcggcggcggcggcgccctgaagccggacttctatagccagtcgtgcccgcgcgcggagcggatcattgcggaggtgatgcagacgaagcagatggcgaacccgacgacggccgcgggcctgctccgcgtcttcttccacgactgcttcgtcagcgggtgcgacgcgtcggtgctgatcgcgtccacccagttccagaagtcggagcacgacgcggagatcaaccactccctccccggggacgccttcgacgccgtggtgcgcgccaagctggccctggagctggagtgccccggggtggtgtcctgcgccgacatcctcgcactggcgtcgggcgtgctgattaccatgaccggcgggccccggtacccggttccgctggggcgcagggactcgctgtcgtcgtcgcccacggcgcccgacgtggagctgccgcacgccaacttcaccgtggaccgcctcatccagatgttcggcgccaaggggttcacggtgcaggagctggtggcgctgtccggcgcccacacgctgggcttctcccactgcaaggagttcgccgaccgcctctacaacttccgcaaccagggcgggaagccggagcagttcgaccccagcatgaacccgtcctacgccagggggctgcaggacgtgtgcagggactacctcaaggaccccaccatcgccgcgttcaacgacatcatgacgcccggcaagttcgacaacatgtacttcgtcaacctcgagcgcggcctcggcctgctcagcaccgacgaggagctgtggacggacccacgcaccaagcccctggtgcagctctatgcatccaacgccacagccttcttcgacgacttcggccgcgccatggagaagctcagcttgttcggcgtcaagaccggcgccgacggcgaggtcaggcggcgctgcgacgcctacaacagcggccccgccgtcgccgccaccatacccaagatgtgacgacgctgcgcgtggtacgacgacgggcgcgcacgtgcttgtctgcatgcggatcgatcgacggccgagctgtctggcacgacgacggcgtgttgatcgagggcctcggctcctcctgcgacggtcacgatggtgttaagatttcgtgccgaaatgtgatatgtttcatgctcgatcaagtaatttattcctaatctgtgtgctgcgcaaaagaaagaaaaacttcgaagtgttgcgctactcgctagtatgaattaattcgtttttccctttgatcgatggtcttgccagtttattcatcatcatacgcagatcatcacatatttacattgttttgtcgttttttttgttgctaaaggataatttgagaaccttaattttctaaggtatttctattttatcaaagaaaattagttcattttaccaaagaaaaatagaaatcttttaaagaaatgggttcccaaactagccttaaacattgccaaacggaccttttttttattagtgacatctggcggccaaggacacaggccacggcacgcgcttgtgattggatagtttctccggggtttagcgcgcgttgccttgcgtacgttgtattcaggttctcatttcatacttatggtaaagcaaaagataaatgttgtgcatattcaaatacttagtttttatgtgcatatttaaataaataaagataaatctagacacatatacaaaacacaaaacacgtatattaattattatataaattcattgaaaaatttaaaaacggattttaatttgggacggatggagtataaaactttatgaacaatatttttgaacaaacatatacaataacttgaaaaacaaaagcaaacaatcaaatatgaaaaccataaatgttgtgtgaagtttaattgatcgatgcaactttcttttcaaataagttttcttattatctataggtctataggaacatcgttagcatggagtcaggaagccatattggtgcaaatgtgcaacagccaacgcccacatcctgtgagtttttactgatacattaaaattagattagatgttgattattagcatgtttcatgtgaaaatcatgcataaagtatatacaattgggtgatggagcacacctagctagttgagaatcaatgcgagaggtatgtataaaaggaaaataatggacaaaattattgggtgtgtcacctagttagttttgttaccatgctttatattttgtcactcagtcgcctcctcatgttctcctgctgcacatttcatctcctagtgttacctttcctaaaacttgacccatgcgtaagtcatgtattttttgaacaatgaattaatctgtttaacctgttactccttcggacaaaaaaaaaccatgttcagtgttcagtgctagtaatttctactggttcgtgaaataaacaaagacgcatcgatgtcactatggggacaagataagactatctccaactaatgtgctccatatcttctatctatatttcgtctttacacactcaa

SEQ ID NO: 7835 - DNA, 1529 bp, Zea mays
gatcaatcccatcttgtaaactgcttgaagaagtatgcaagaggaattttgctacgcattttgattattgcacaactgcttgcacggactttgtgtcattagatgaggcaacatttaaggatattcttgagcatggtgatatgacagtaacgtcggaagagagggttctggatgtcattttaacatggtgcatgtcggctcgggaccttttcactggacttcagttgttgagctgttgagaacttcaacaccagagcagctctttggggagaggctttccgccatcaatactttgctaccattagtgaggttccctttgatgcacctgtctatactaaagaggatggagagaagtaatctagcaaaccacatacaagcattcagacagttggttgcagaggccattgaattctctcatgctggacaattgatgcctacagcatgcgaatgtgagagatttcagcatagacggtcaagctataaagagctgcagtatatctctgatggtgatagcaatggtgttatctactatgctggaacatcatttggaaaacatcagtggatgaatcctgtgttaaccaagaatatcactgtggtggcaagcagtccaaattcaaggcacacagatccaaaggctttggtttcaaagaattaccaggggacatgttttgctgggccttgtgttgaaaatggcaagagggtttcttggtggatggtagacatcggacaggagcaccaggttggttcatatattcctggcatctgatctgatggttgccaatgcagtagataatgggatggcgaattgccttacagttgatgtgcaactactacacggtgaggcaggatggctccacagcattcatgaggtcttgggctttccaggtatatactaactaactaatgcttggtgttgcatggagcgaggctgaacctatgaagctggcagggatccatggacggccggaactggacaagcctccgtgtccacgacagcgaccctaccgtctgctatccaggccagttcgcctcttggcccatcgttggcccggcggcccttctgcccttccgattcttcagggtcgccctgacaggccctgccgtcggctgtacgtggaacctctgcatttgcttcctcgagctctacggctacttccattagatcttcttcttcctcttcttcttaataaaaaatatagatgccggagtttttgtgcaaacacaagtaatattacctgcgatgccacaattgctggtcattgcacatcatgaaacaagtattcacagttgaaaaagaaagttgttagaacgataggcctaagactccgatggcctatcttatactcacgaaaagatcatgtcaacattatctcccgtttatttgcatactacactcgtacggtacctttgcttaagctatcttatactcgcgaaagcatctagaccatcaaaagttttggtaattaatgatgaaataagatcattgtaactaacatttgttccgtagagacaaatttaagttaaccccc

SEQ ID NO: 7836 - DNA, 1112 bp, Zea mays
ggaagtgtttgcatggtgatatgacagtaacgtcggaagagagggttccggccgcatgccgggttttaacatggtgcatgggagcttgtgaaacttttcactggacttcagtagatgagctgttgagaacttcaacaccagagcagctctttggggagaggctttccgccatcaatactttgctaccattagtgaggttccctttgatgcacctgtctatactaaagaggatggagagaagtaatctagcaaaccacatacaagcattcagacagttggttgcagaggccattgaattctctcatgctggacaattgatgcctacagcatgcgaatgtgagagatttcagcatagacggtcaagctataaagagctgcagtatatctctgatggtgatagcaatggtgttatctactatgctggaacatcatttggaaaacatcagtggatgaatcctgtgttaaccaagaatatcactgtggtggcaagcagtccaaattcaaggcacacagatccaaaggctttggtttcaaagaattaccaggggacatgttttgctgggccttgtgttgaaaatggcaagagggtttcttggtggatggtagacatcggacaggagcaccagttgatgtgcaactactacacggtgaggcaggatggctccacagcattcatgaggtcttgggctttccagggatccatggacggccggaactggacaagcctccgtgtccacgacagcgaccctaccgtctgctatccaggccagttcgcctcttggcccatcgttggcccggcggcccttctgcccttccgattcttcagggtcgccctgacaggccctgccgtcggctgtacgtggaacctctgcatttgcttcctcgagctctacggctacttccattagatcttcttcttcctcttcttcttaataaaaaatatagatgccggagtttttgtgcaaacacaagtaatattacctgcgatgccacaattgctggtcattgcacatcatgaaacaagtattcacagttgaaaaaaaaaaaaaaagggcggccaccgactagtgagctctggcctatcttatactcacgaaaagatcatgtcaaca

SEQ ID NO: 7837 - DNA, 1816 bp, Zea mays
tagcgacggttcttacttggtactccaggaatgggttgctcttgacctagatgcgacactgaaaggcctttttcagcaagtcctccattgtctggagaacattccaaaacctcagggggaaagtgttcctgacattaccgctgacttggctgatttacgtaagcactggctgtcaattttgatgatagtcacatcttcacgatcctcgataaacattaagcacttggagaaggctactgtgtctactgggaaggagggtttggtgtcagaaggcaatgctgcatataattggtcaagatgtgttgatgaacttgagagccaactctccaaacatggaagccttaaaaaactctacttttatcatcagcatcttaccacggtcttcagaaatacaatgtttggcccagaaggtcgtccacagcattgttgtgcttggcttggagccgcttgcagttttccagaatgtgcttctgcaattattcctgaagaggttaacaaaattggcagagattctatctcttatgtggagtcccttatcgagtctatcatgggtgggttggaaggtttgataaatattctagattcagaaggtggatttggctcattagagatgcagctttccccagagcaagcagctcttcgcttaaataacacaagagcaaagggtgtttcaagcttgttaactccaggatatgagagctatcctgataacagttcatcaattaagatgctggaagctgctatgcaaaggctgacaagtttgtgttctgttctaaatgacatggagcctattggtgttctcaaccatgtttttgttctacgcgagtacatgagagactgcatcataggaaatttcaggagaagatttcatagtatgattagaactgagaactgcattcagcgaccatcaatcatagaatctcttctaagaagacatctgggcatcatccatctagcagagcagcatattagtatggaccttactgaaggcatacgtgaagtgctgctagctgagagttatactggtccatttcccaatcttcaaatgtttgagactccagtggggacacaaggagggggatctgccgttgagatgatatgcaactggtatattgagaatgtagtaaaggacgcttctcgcattggagttgcttttgatgcaatccaaaattgcttcaggagctcacagcctattggtggtggatgtttagctgaatcatttacagataaaagagaaatgaaatcacttgttcgtctttttggtggctatggaatagataaaatggataagatgctaagggagcatacgtctgcgcttttaaactgtatcgattcagcattgaggtcaaatcgtgatgccttagagggcctagctggaactgtaaattccggcgataggattgaaagggatgtgaacctgaagcaaattattgacctcgaaacactggctgacctctgtattcaagcagggcaggcaataactttccgtcggctgttggttgaggccgtcggagcagtccttgaagagaaagtgcctctgatatattctctgctcaaaggattagccttgcagttgccagacgaggtacctgataaaaatgagataattagattgagaaaggttgcgagcagtgttggtgttggcgacaaacatgatgctgagtgggtacactctattctggcagacgctggtgcagctaatgataattcttggatcctacttccatacctttgtgctgcattcatggtgtccaacatttggaacggtgctgtttatgatgtcaatataggtggactcagtaacaatttgcactgc

SEQ ID NO: 7838 - DNA, 1388 bp, Zea mays
actaccccgcacgctataactgcaaccagcgtagcgtaggctcgcggcggccgccgacaactcgggcgggacacgggagacagccatggcgacgggcggccaggggaaggccgcgggctactaccagtacccgacatcgtacgccggtgctgcggacgaggagcgccggtggtggccgtggctcgtgcccaccgtgctcgtcgcctgcatcgcggtcttcgccgccgagatgttcgtcaacgactgcccgcgccacgggagcacgctcggcggcggcgccgggtgcgtggcggccggtctcctccgccggttctccttccagccgctccgcgagaacccgctcttcgggccttcctccgccaccttgctcgaggccggcggtcccaactgtgccaaggtagttcatgagcaccaagggtggcgcctcattagctgtatctggctccatgctggcctagttcacttggttgtcaacatgctaagcttgctcttcattggaatccgccttgagcaacaatttgggtttgtgcgcattggtgtcatctacttgatatctggctttgggggcagtgtgttgtctgcacttttcttacacagtaactacgtctctgttggtgcctctggggctttgtttggcctccttggatctatgctttcagagcttattataaattggactatctattccaacaaggcagcggcaatcataactctactttttataattgtaattaatctggccattgggatattacctcatgctgataattttgcccacattggtggatttgcttctgggtttcttattggatttgtgctgctggcaagacctcaatttggttggatggaacgcagcgagctacctcagactagtcaacctccaaagtacaaatcgtaccagtatgtcttgtgggttgctgcactcctcttgctggtagttgggtttgccattatcttggtcatgctcttcacgggtaagaatgggaacgacagctgccactggtgccattacctgaactgcgtaccaacgtccagatggaagtgcgatacctgaattccgcaaagtatatgctccactggtgttcgtgtgttcgtggaaatgtacgaccaaatgtatcctccacttgaccatcctgcgcttcttttgcccggattctccctggttccatgaaatacaaatgttccagaattgtagcacgagcttgtaactgttgatttcggcataattgatgtattcatctcaccaaactctatagcaccaccttgataattttagacggccaatctaaagtattcagattttgcgagtgtccacgcactgacgatttcagccgaaagatcggtaaagttcaattgcatatgatggcactatgctgacggtttgtttg

SEQ ID NO: 7839 - DNA, 710 bp, Zea mays
ccactaccccgcacgctataactgcaaccagcgtagcgtaggctcgcggcggccgccgacaactcgggcgggacacgggagacagccatggcgacgggcggccaggggaaggccgcgggctactaccagtacccgacatcgtacgccggtgctgcggacgaggagcgccggtggtggccgtggctcgtgcccaccgtgctcgtcgcctgcatcgcggtcttcgccgccgagatgttcgtcaacgactgcccgcgccacgggagcacgctcggcggcggcgccgggtgcgtggcggccggtctcctccgccggttctccttccagccgctccgcgagaacccgctcttcgggccttcctccgccaccttggagaagatgggagctctcaactgggccaaagtagttcatgagcaccaagggtggcgcctcattagctgtatctggctccatgctggcctagttcacttggttgtcaacatgctaagcttgctcttcattggaatccgccttgagcaacaatttgggtttgtgcgcattggtgtcatctacttgatatctggctttgggggcagtgtgttgtctgcacttttcttacacagtaactacgtctctgttggtgcctctggggcctttgtttggcctccttggatctatgctttcagagcttattataaattggactatctattccaccaaggcagccggcatca

SEQ ID NO: 7840 - DNA, 1664 bp, Zea mays
atagtaggactagagagtagagaggccccgcccccaggaccgaccgaccagggagtccagcggcgcacatcgcggcgacccccaccccaccgagcgcccgcggccgcgatggagagaggcgatggcgggagcgggaggccgccggccgagaggaaggcggcgtggagggacggcgccgtcacctacttccacctcctcttctacatcgccatctccggcggccagatcttcttcaacaagtgggtcttatcctccaaagagatcaactttccctatcccgtggcactgactctgctgcacatggtcttctcctctgtagtgtgctttgcaatcacaaaagttttcaagatcataaagattgaggagggaatgactacagatatatatattacttcagtcattccaattggaggaatgtttgcaatgacactttggctagggaacagtgcgtacctctacatatctgtcgcatttgcacagatgttgaaggcaataatgcctgtagccgtgtttcttctgggagcagcatttggcctggaagaaatgagctataaaatgctttctatcatgtctgtcatcagtgttggagttattgtggcttctgttggtgaaattacaatcagttgggttggagtggtttaccagatgggtggagttgttgcggaagccctaagacttatcttcattgagatatttctgaagaaaaagggtgtcaagctcaacttgatatccatgatgtactatgttagcccttgcagtgctgtatgcctctttattccctggctgttcttagagaagccaaagatggatgatagtatttcatggaacttcccaccattcacattgttcttaaactgcctgtgcacctttgtactcaatatgtcggttttccttgtcatatcaaggactagtgcgctgacggctcgagttactggtgtcgtgagggattggtccgtagttttgctgtcagctgccatctttgctgatacacagcttaccttcataaacataattggttatgccatagccatagctggtgttgttgcgtataacaaccacaagctcaaggtaaaaccccaagcgaacccacagcaaggcgacgagaacaaggtcatctcaggaagcactcaagatgtggtgttatcagtgagctcagcaaaagaaacttcgtagcaccaaaagtagcacgattttgaaacaattttatttttcacaaaggagaattgtgctctctttcgttgggttggccagctctccttggactatacattctttttccttcccctgggtctggagggaagatattttgtacaatgatatgctcaagatgatgatacgctgccttcactgtcgtaatattgctgctcaaaaaagtgggagcacgccacacagatggaaattaggccatgtaaagttgtgttttctcttgaactggtgtagcgactcatcaggtgctccaaaaatggcagccctgaatctttgtacatggttgcttggtggtggtcatgagatgtgatgtaaaacgatatatgtaagcctggcagatcaaagaattcaagatacgcaagtttctgtgtttttgaatccagcatttctcttgcgctgatagtttgcttgagatattgattctgcaatatatgtttttaaactaaaaaaaaaaaaaa

SEQ ID NO: 7841 - DNA, 1859 bp, Zea mays
ggccgcttttttttttttttttttattggccgctgtttcctgtggttttttccgaatatacatgcatacaaccatacttgtcaagatgcaaagcatgctatatcaggatccaatacaaaatgtgatgttgtgtcatgtcggatattaaggggatgtttagactgctccaggttccagctccaggggggggctatattctataatataaatttaaatagtttcagaaaatatttctaatctaaattttttttttttttttcaatctaaatatcttttaaaattcacaactccagctctaagattttctggagcatagtgacctgttccatcaaattttctgaagctggtccaaaacagagcctaaagcctaacagacttgggagaaaatctaatgcaaatgcccaggatcattttatctagtacccagatttgtactcgttgtacctgacaaatacttgacaatgtactttcttcgaagccactggaatcgttcctcggccgtttccatggtcaggaacatctccctctgttctctactgacaaacagttcagttgcgatgaaatgctcattgcttccacaccgtgctccgcattcccagacaagtgtcataacatcctggatgctaggccatggcaccaagtcagcttgggagctaaactttttgaaagtatcctgtgctttctgagccagctcagttatgcgatacaaatgagcttgcatgagcagagcagtttcagccttgtttttcttgttcttctttgtagcactgaaactaatcggtctcttcttcctgtttgaagtatactgaaacacaggctcttgataaatgtcatcattatcttcagtgttgttgtccaatccatcgaggttcacaccattcatggggatttcttgaacacttcgcaaatcatgtgtgggtagtggcaactgatccatcccattcatggggctgtatggaccagatggcaaaccatgtgcagtcacaggcgaatgatccactccattgagcgtgcagtctggagcagatggcaaaccagttgcagccggtggcgaatgattcaccccattcttcgggctttccggagctggcggtgaaggatccacaccattactggtgatgtagtcaaacattacattcaacttatcctcatgatgtagacgccatgtcgaaatttccttgcacccggcagctccttattgatcttcttccaccattcttcgtcagcaacaaatgtcccctttgctgtgtcccagggtaaacccttccctactacaagcaacttcctccaggtgatgtaatcattcttaaacttgtcccatttgttcttaagctgcaattttgtatagagaagctctgtcctctgctgaaacttagccgcaacttggcggtaaccaatgttgttcagatgcgtgtttggcctgttcccagcccgaacttgttcttcaaagagttcgcagacaatcctagtgtgttcatcattccactcggcttctggcatcagaacgacgaaaaggtgaggacgaattcgaaccgagtccggtccgattcccgctccgctcagcagcgacccagcagcaccagcggagcgcggcgaggcgaggaggtgatggcggctgctatcctagagaaatcctcgctcgactgagcggcgcgctatgattcaatgcgcgtgggagcgcgctcagcggaggggtcggttgtgcgggcaggccgggtgggccgggagaagaagaagcaacacccgccagccggtcggtggcctcgccgcgccggcgcggggggaagggctggagtgtgacgaggcggtgattcggtgaatccgggccgccccgtggttcccagtgtgtattagatggg

SEQ ID NO: 7842 - DNA, 4333 bp, Zea mays
gcaatatattattggggtataaacagattttaggtcttggacttttatttatttgacagtttgacttaaaattttcctaggatattaagttacacaacattttttgtgatttcagggtcaatctcaatcccctgaagcctcttcaagaagtaagtatgattacagccaagaaattgaagtggcaagatccttgaatggcaagcaagcagcaggggtcaatttgaataatattaataaagagcatggtcaatcaatagaacagtatgtatcctccaatgttagagatgaagagatcaaggagaccttggagagtttgaacaacagactttttgatgcgctattgaccatcagagcaaaggaggacttggtgaaggagcatgctaaagtcacggaagaggctgttgcaggtaacttttgctccttagtaattctctcgaattgagtgcaaaagttattcagtttttataatcgaacctataaagtcatgcgagagtacagttagatttatttcatcttttttctagtaatggatggtaatcttaaatttacatgtgtgagaagtttgctttcatcctatgtagccgttctcttaatcttgtttccgaaacttattttgtaggctgggaacaagctgaagctgaagctactacactgaaggggctacttgaagcttcttgtcagaagaatgcttctctccaggatcaagtctgccacctagatgaggccctcaaggaatgcgtcaggcaactgcggctggcaagggaagaacaagaggacaaaatccgtgaaatagtttccaaaactctggtgccacagtctgaaaaccctgagctccaaaagcatatcggagagctaagaaagcgactggaagtgaccagattagaagcgtcatcttccatgttattacaacatgatctacaagaaaggcttcaggcaattgagagagagaacttgggccttaaggccaagggtcaggcaattgagagagagaatttagatctcaaggccaaacttcttgtgcagtccaatgatctgaagatagtaatgttggaaagagatctgagcaaccaagcagcggagacagcaagtaaacaacacttggaaggtgttaaaaagattgccagggttgaggcagaatgccgcaggctacagcatctgatgcggaaagcaacactgatcaataattctaggtcagcacaaaacagttgctgcatggaatcactgactgacagccagtccgatcatggggagcacatggtggctgttgataatgatctgcaaaattctgactcatgggcattggctttgattgctgagcttgatcagttcaagaatggcaaagatggttcaagaaatattgtgaacaatcctgttgagattgacataatggatgatttccttgagatggaaaggttagctgcattgcctgaatcagacggcacaagctctaactttgaaatggaaacagattctgacaaggccatcgcaagaagcagctccttgaaaatcaaaagtgaagaattgcaaaacaaggtcgccaatttgcaggaaaagtttgaagcaattgcaagcgagaaaagggagcttgagatggcacttatggaggttaggaatcagcttgacatttcctgcgatgcgctagtggcggcaacgaacaggctggtcgaaatgcagatgcagttggaatcagcaaatgactccaaactttccgctttggaagatgtggagcgtttggactctgagaggaaggctttggagttgcagttggagtccaaatctgtagaagttgaggagttacttatggctgtaacttcattggaggaaaacaccgagcagaaagagttggagtcacagttagaactgatgtcagcacaagctacagagcttcgcctgactgtggcatcactggaagagagagttcaggctgaaagaaatatttctatgcagcagaaagaaaatgcagaagctatgttgagtactaaagaagaactggaagcacagctgtgttcagcaaccactgaaatggggaaactgcgtgacatggtcaaagcactagagaatgaggtcaaaacggagaaggcactgcatgaagaactaacagcacatatacagataaaggttgaagcagctgttgatgcagttaaagaaccattggaagcacaactgtgttcaacaaatactgaagcagagaagctaagagatgttgtcaaagcacttgaggatcaagtagaaaaagagaaggcattgtgcgaagagcttgcagcaaaggtagagttgaaaactaaagcagcaagaactgctgaggctgttcaagaatccttggaggcacaactgtcttcagcaaatgctgaaatacagaaactggaagagatcacgaaacaactacagagtgagttagaaaaggagaagacacttcatgaggagttctcagcacagttagagatgaagattgaagcggagagagctcgttctatggagtctgctaaagaatcattagaggaacaattccagttagtgaactcagaaacagcaaaactacgtgacacggtgcatgcgcttgagcacgatgtggaaaaggagaaggtattttctgcagagctccagatgcagctagaagctctagaggctgtaaagaaggtgttggagtcagaagcggagtcagcgcatcaggatgccaaaattctcagccagaaggtggagtcattggaagcaaaactcacggagcatatgttggtaaccgacgaattcactgccaatgtagagtctttgcagtcagataggattgcaatggagcataaacttaaaacagcagatagggaactcataaaattgacaaacaaggtgagcttgctccatagggagatcgagcaggagagattgatgtcagaagagtacgaacagaaatgccaaaagctggaggatcaactgtcgagagatagccgtgacgcaaagctctggcgactcgcaaactcgaatggagatctgaaggttaagaaggagaaagagctcgctaacgcagctgggaagctcgcagagtgccagaagacaattgcttctctggagcgccaaatcaaatcactgacagacctcgacggcgtcgtgctggagcctgaaaggcttgaatccagcagggacatgccattgccactggacttcagaaacagtgatgctgaatttgctatgtttacggatgatttatacgactttgaccttccaaacgacagcaaaagcttcttctctccactcccgtcgatccagacctcgtctccgccctcggagatgtcagtattcgcaggggggctctcgactcttagcagttacaggagcaaaagagcaagtagaaggtgatgaaaaactaggctgcgcccagatgtcgtactaacaaatagttcatggatgctgccatatgtaggtaggtaggtcgatgtacattacaggaactgattgttagatttgtgtgatgaacatcccttccagcaagcgcagttttttttagcgtgcttgatgaggtcttaggtcttactgtgtcagtgacggttagtgtggtacaaaatgtgaactcggttatctgcgtgtgtttccagttacaggaaagtgcagaggaagtgcatattcaatgctcatgtgatgtttgtatgtgttgttgttcaacttaaattctactttcagggtcgaaatttgttgtgcagcgtcgaaattttccattcatttggaagctgtggaatatggtagcagcaactagcaaggggatggaacatcgtaaattgcagtgaaatctttcagggggccgcagtttcccagatacgtaacatcgaagaacaaccgttcagatttaaaatgccgcagttccacaatagcacggggccgtaaaatttctgcacaccaccggacaacagaaaccgaactaaaaattatatagttctatatagagagatgtaaacttgtcatctatggtcagtggcggatcatcaagcagaacaatgaccataacatacaagtgaactttatttcttagatgatcacgacacaagtgacctaatttcttgacatgtttcggatgtgctctttttatcctctttgcatcccgtataactggagtccaaatgtctaatcaaattaaattgtgacccattagaataccaaaatttaacatttggtgtatacttcaagtacctcaaatattctctatgttgctttcaaatcacattgtctaggtaagtcttgaaaccatgcataaattatacactaaatatcacatccgaccttgatgcagtcgtagagtaggctttcaatcattgaccaatataaagtttttaatctaccatttcaccac

SEQ ID NO: 7843 - DNA, 2062 bp, Zea mays
cggacgcgtgggttttgaattcatatactagtgaccagcatctctgcctatggtgcgcagctgtctccccattccaatgccaagtgttgatctctcagcaaggagggagaaagcagaaggaccggttttgatcttctgagcggttcatggttatggatcgcgcgggttggctctggaggcgcaagtcatcggacaagagccccgggggcagtgacagctctctgtccgtgtcgtcacattccgagcagtgctctgatgatcagggtcaatatcaatcccctgaagccttttcaagaagtaagtatgattacagccaagaaactggagtagcaagatccttgaatggcaagctagcagcaggggtcaatttgaacaattttaatccagagcatggtcaatcatttgaacaacatatatcttccaatgttggagatgaagagatcaaggaaaccttggagagtttgaactacaaactttctgctgcactttcgaccatcagagcaaaagaagacttggtgaagcagcatgctaaagtcacagaagaggctgttgcaggttgggaacaagctgaagctgaagttactactctgaaggggctacttgaagcttcttgtcggaagaatgcttctctccaggatcaagtcagccacatggatgaggccctcaaggaatgcgtcaggcaactgccgctgccaagggaagaacaagaggacaaagtccgtgaaatcgtttcgaattctctggtcccgcagtctgaaaaccctgagctccaaaaccatatcgcggagctaaaaaagcggctggaagtgaccagattagaagcgtcatcttccatgatattacagcatgatctacatgaaaggcttcgggcgattgagagagagaacttggaccttaaggccaagcatcaggcaattgagaaagagaatatagatctcaaggccaaactgcttgtacagtccaaggacctgaagatactgatgttggaaagagatctgagcaaccaagtagcagagacagcaagtaaacaacacttggaaagtgttaaaaagattgccagggttgaggcagaatgccgcaggctacagcatctaacgcggaaaacaacactgatcaataattctagatccacacaaaacaattgctgcatggaatcactgactgacagccagtccgaccatggggagcatatggtgggtgttgataatgatctgcaaaattccgattcatgggcattagctttgattgctgagcttgatcagttcaagaatggcaaggatggttcaagaaatattgtgaacaatcctgttgagattgacataatggatgatttccttgagatggaaaggttagctgcattgcccgaatcagatggcacaagctctaactttgaaatggaaacagattctgacaaggctgtcacaagaaacagctccttgaaggtcaaaaatgaagaactgcaaaacaaggtcgcagatttgcaggaaaagtttgaagcaattgcatgcgagaaaagggagcttgagctggtgcttgtggaagttagagatcagcttgagatttcctgcgatgcgctagtggtggcaaagaacaggctggttgaaatgcagatgcagttggactcagcaaatgattccaaactttctgctttggatgatgtggagcgtttagactctgagaggaaggctttggaattgcagttggagtccaaatctgtagaagtcgaggagctactcatggctgtagcttcattagagggaaatgcagagcagaaagagttggagtcgcaattagaactgatgtcagcacaagctacagaacttcgcctgactgtggcatcactggaagagagagttcaggctgagagagatctttttgtgcagcagaaacaaaacgcagaagccatgttgaatgctaaagaagaactggaagcacagctgtgttcagcaaacactaaaatggggaaactgcgtgacattatcaaagcactagagaatgaagtaaaaaaaaaaaaaaagggcagccgctcgcgatctagaactagactagttctagatcgcga

SEQ ID NO: 7844 - DNA, 4599 bp, Zea mays
tatcaaagcactagagaatgaagtcaaaaaggagagagcactgtgtgaagaattaacagcacagttacagataaaggttgaagcagctgtcaatgcagttaaagaatcattggaggcacagctgtgttcagcaaatactgaagcagggaagcttagagatgttgttaaagcactccaggatgaggtagaaaaagagaaggcattacgtgaagagcttgcagcaaacctagaagtgaaaacaagagcagcaagaactgctgaggttgttaaagaatccttggaggcacagctgtcttcagcacacgctgaaatgcacaaactggaagagatcacaaaacaactacagaatgaggtagaaaaggagaaggaattctcagcacagttagagatgaaaattgaagtagagagagctcgttctattgagtctgctaaagaatcattagaggaacaactcctgttagtgaactcggaagctgcaaaactgcatgacatggtgtctgcgcttgagcacgatgtggaaaaggagaagtttttttctgcagagctccagatgcagctagaagctctagaggttgtcaaaaaggtattggagtctgaggcggagtctgcacatcaggatgccaaaattctcaagcagaaggtagagtcattggaagcaaaactcgaggagcagatgtcatcagctgacgaattcactgagactttgcagtcagagaggatggttatagagcataaacttaaaacagcagacggggaaatattaaaacttacaaacaaggtgagcttgctccatagggagatcgagcaggagaggttgctgtcagaagagtatgaacagaaatgccaaaagctggaagctcagatgtcaagagatagccgtgacgcaaagctctggcgtcttgcaaattcgaatggagatctgaaggttaagaaggtaaatttcatccctttctaacacctgaaccttataggcccatacatatttgtagtattaaagcatgtcatttcagaggataattggacaaataagactattagcatcactgaattcaagtcgaaatgttgacattgctgtaggagaaggagctcgctaacgcagctgggaagctcgcagaatgccagaagacaattgcttctctggatcgtcaaatcaaatcactgacagatctcgacagtgtggtgctagagcctgaaaggcttgaatccagcagggacatgccactgccactggacttcagaaatggcgatgctgaatttgctatgtttgcggatgacttgtacgactttgaccttccaaacaacgacacaagcttcttttctccacccccgtcgtcgatccagccctcgtctccaccctctgagatgtcagtatttgcaggggggctctcgactcttagcagttacaggagcaaaagagcaattagaaggtgatgaaaggaaggctgcccaaatgccatgctaacaaacagtccatggatgccgccatatgtgtaggtaggtcgatgtacattacagagactgattgttagatttgtgtgatgaacatccattccagcaagctcggtttttgtagcctgcttgatgaggtcttactggtggtcgtttgctgtaaaatgtaaacatggttatcttgtgtgattctagttacaggaaagcaccgagcaagtgcatatttagtgtccactagttaggtaccccgtactagaatatttaatttatttaaatatgaaggaagcatgtcacttatttctctaaatttacaacaatagttaggccctgtacgttgatacgatttctatatattacataaatatatcttattttaattaaaaaaaaaaaaaaaaaaactcgagaggggggcccggttccatgttttatttgaattggttgttgtgtctgatctcagtgtgtctaccatataacatgtataaatgtattttatatgttgagtgagaaatcataatttgaatccccacgccatctcttgtgaggcggtccaggcggcaccaaaccttagcagccgtcgttgccccttccttccctctccacctcgcctcccctagagtaagtagtcgaaagtctcgagtggtttacgagatggtggtggtgggtcctttatggcccggtccgagcatggactgacccgttattcgtcaggcttgtattggccgagcctggccatcgtgtcgcatatgggccttagatgcggcaaggtgggctaggctcgacatagtctgattttcccccatatttttcataaaaatatctatattatgttgagtataaagtataaaacacaaaaacatgtatgttttattgactaggtaaatgtaaatatgtgttcggagccaacaaccttggttcaaacccatacttgcgtataattttaaattaagttctaattttgaaattaagcaaaaccataaaaaataataatatacactttgcaggtcatttacttgatgtcctaacaatgatctagactataaaaatgaacattaaaatttgtaattaattaataaataaatctataacaaaattagacatgtagttaatgaacgaagcgagaggaacgagattaccataataatattgcataatcaccatcttaatcatcaagattatgtgtacaaagtgctgtttaaaagtattagatagttctttatctaaatctacaaatacactagattagtataatctaatttagacctaatctattgcccaaacctctaaatttatgtttgaggaaaaaaaaaatccgaaactgatcccttgttatatatgccaaatagctctatttcggccggaccagcctattttctcgggctgggctgcgcccttgttgggtcgcggtgggccgaatcctaccagcccacgtccagccaacacctcgccagcccacaccacactaggtcgctgtcggccgcatgggccgctgcaccttgcgcccgtgacccgtccattggcacgcctccacgccggctagggctggctggcttgactgtgtaagaaaaatggattgtgaaatatttgattaatgtattttagtgtttggtgatcaatataaccatttagactgataaaatctgatagtgcttgtgaatatagattaaaagatgtggtgtggacttggacgaaggcaacatggggatgacaaagatcaacgcctcgaaaacaacaaggcattataaggcccaaccaagattaaagaagatcatgtaaaagtgcaggacacaatggcaagaagaagcacggacgaagaaacacaaagaaatatgctagagaagtagtagataacagcacccccccaaatgaaggttttgatacttaaatgcaatgcaggcagattcattctgcaggcccgcaggaacatttgcacaaaatactttggagatacgacacttgcggtgctgctagccagcggtggaccggaggtttcagaggctcaggacaaatttaaaatagagactcatcaaattattgttatataaaaatagtactaatatataaactcaaaatacgtctaaaaatattcatgccaaataaaaagatacatattatagtattattttaaaagtttttttaacatatttaaatacgatcgggttgtgaacgatttgtggctgctaattattcaatatttcgctattaaactattgtaactggtagtctaattactgaatgtataattatatttgaggtcctatataattaggggctcgaggcgacctccctctgccctaccctcagagctgccactgctgctagctctcttcctcggagaaattgcattgattaaaagtttcgatcccgaccttcacagttttcagctcagaccagaccaaaaaccagactgtttcaggctaaaataattttcagcactacagacactcacacagccggagagctatagccttacgttcgtttacagcaccgagcacaccactagatgcaagtggcccctgacccataacagtcccactgtctatcaataagacgacatgggctggagacggtaggttagtgcatgtatagtggagaaacactaaaaattctaaatataagagataactaaaagactctattatataatagagtgtttataaatatagtatattaataaatacagaaataaatgtatttgtacaatattagattgatagatttgacgacgaattcgtacagtgcaaagcgagacatctgttgctgcttgggtcacgagccagagacatctctttacggagaaatagctctatattttttttttgcatatactccttttaagttttaaacatctcaatagcctctacattaggtctgtttggttcgtgactaattatgccacaattagtctaaggttagtcgtataaattgaagaactaacattagatagaaaagttagttaaaatatattaagatagtcagcgaaccaaacatgtcataaataacgatgtacatgccttcagtgcacaaatcatggcacaacgcaccaccgctcgtgcccgcgcttcgcgcgccctggatccgcttgcaatgaatagcaaagccagatcaattgcatactgcagctaaaggcacagcagggagagaaagagaaag

SEQ ID NO: 7845 - DNA, 2796 bp, Zea mays
tcgcggacgcgtggggtggcaaatgcagtttcagccagtttttccgttcatagcagcacagtgagaggattgagatggcttggcaactcacgtcttgtttcattcacatataatcaggttaatgattaaactggtggatacaataataaacttgttattacatgcttaagaagtgggctaaatcgctcattccgtgtgctccaaaagcctgaacgtgcaccgattagagcattgagggcttcttcatctggacggtaccttctaattctgtttcgcgatgctcctgttgaagtgtgggctatgacaaagaaccccatgatggtccttggcgcttccttttacagtattagaatggacactgccagctgcacctcggccaggtcaaaatgcatcatctaaacagtcttcaacctccaaggagcgatcagcagaggcttctggtgcagaaagttctgatgaaacatgtgaaagttttgcttttgcattagtcaatggcgctcttggtgtgtttgaagtgcatgggcggcgaatacgagattttaggccaaagtggccctcgtcatcatttgcatcttcagatggtttggttactgctatggcttaccgccttccccatgttgtaatgggggatcgatcaggcaacattagatggtgggatgttacaagtggcctttcttcttcttttagcactcacagggaaggcatcaggaggataaagttttctcctgttgttcatggtgatcgaagcagagggcgcattgctgcgcttttctatgataatacattttcgatatttgacttggatagtccagaccccttggcaaatgccgagagagagagacactagtcccccccccccccccccccgcttgattggttgtcaacccgaacaaggaaggatgaaccacttatgttatgcattgccggagctgatagtagcttccgactgattgaggttaacattgatgctaagggcagttctatttcgaagccagtagctacgaaagagaggtttaggccaatgccattttgtttgccagtattatttccaacggcccatgctttggctttgcgaatgattcttcaacttggggtgaagccttcttggtttgaatgcaataatagtgataaattaactggggacagctttaaggtagcaccaacatttggagatcttcgtagttacatgattgagacaacactccctcctattggtgacgccgttgtggctgaattgctccttaaagtgttggaaccatacagaaaggagggttgcattcttgatgatggaagagccagcctatattcagctatagtgaacaagggagcttgtgcaagatttgcatttgctgctgcgatttttggtgatttccaagaagcacttttctggctacagctgcctcaagctcttcgccacttcctgggtaaatcaacaagtagatcaagagagaagatctcacaatcaagtttacatcctgattctgaacaaagctccagatttaatcggatagcttcaagagagagatctgcttctgaaaagttcacgaaaaatgctgcgaattatggccaattaagctcaatggcatttaatcaagagcaactatggttcaatgcaagtgaaaggataccttggcatgacaagctcgatggtgaagatgctttgcaaaagcatgttcatgagcttgtctctctcgggaacttagaggctgcggtttcattgttactttcaacgccccctgaaggatcaaatttttacccaaatgcattaagagcagttgtgctgtcatctgcagtctcacaatccttgcatgaacttgcagtgaaggttgttgcagccaatatggttagaacggacaaatcgctatctggcacacatcttctctgtgctgttggaagatatcaggaagcatgttcacagcttcaagatgctgggtgttggaatgatgcagctactttggccgcaagccatttgcatggatctgactacgcaagggtgctgcagaggtgggccgattatgttcttcgtggtgagcacaatatgtggagagctcttatcctatacgttgctgctggagcactgccagaggctttggatacactccgcaagagccagcgcccagataccgcagccatgttcttgctagcctgccacgagacctactcacaagccttatcagaatcagagcccgaggacgacacttccgtgttagcactgacgccgacgccgacgccggagcagacggagaacctccggttcccttccaagaatgtggccgacgaggacctgatcgcagtcagtgaggtcttcgggcagtaccagcagaagctggttcatctctgcatggacgccgaaccgacgtctgactgaatcgcacgccttgtcgcatggcagactgatgcgaagctttttgttctgtctgttggtaggtaccagacgtccagacatgacatcgggactgctgatgtggcagaatctgatggcaggaggcaggaacagacatgcagtgctgtatcgtaggtgccaatggttggcactgtttatacatacgtaagcatttgtatttggtacaagctatgtttttttttctttggtgcgcaaagagcgagtgcgcagcgaacttctcttgtggccgagatgagatgagaacagatgccatcgaggcagcagcagacgatatacttacacctgtacacccatgacagtttttgtctgaagattggttattatatgcttatctgcaaatgcatcgcttctggcccaaaaaaaaaaaaaaaaaaaaaaaaaaaaaaaaaaaa

SEQ ID NO: 7846 - DNA, 2246 bp, Zea mays
gccggccgggcctcgacccgaggcctctccagctctccttctctgacccgacccgaccaatccaatccatcccctctccatctcccatgaccatgaacagcggctcggcaatatactactgctaggttatgctacaaaaaaacgaaaaagcgcagagagagcgcagaatggaatcgtcgctcttatcatactccatgactccatcactagactagagagagaaacccttgtaccctttgttctgtttatcccccatttctccgagtcacccacccatcgccgaacttcgagtccaaggaagcggagccaccggagaaggggatatttgcctttcccgtcgggggtctagggagcaggagagatgcagcggcggcgggggcacacgtgggcgggggtggggaagacggcccaggcggcgtcggcgcacgccgcgctcttctgcttcactctcctcctcgcgctcagggtcgacggacgcaccacatactcctggtggataatattcattccactatggctctttcatggtattgttgcgcgtggaaggttttcaatgcctgccccttcattacctcatggccgtcattgggcaccatgtcattcgattgttgcagcgcctttactaattgcgttcgagctgcttctctgcatatatcttgaaagcataagagttagaaatcatccatcttttgatctgaagattgtgttccttcctctgttggcctttgaagcaattatccttattgacaattttagaatgtgtagagctttaatgcctggagatgaagaaagcatgagtgatgaagctatttgggagacgcttcctcatttttgggttgcaatttcaatggtgtttcttatagctgctacaacattcacccttctcaagctgtctggtgatgttggtgctttgggctggtgggatttgtttataaattatgggattgcggaatgctttgcatttcttgtctgtacaagatggtttaatcccatgattcataagtcccccactcatggggaggctagctcatcatcagcggcaattaggtaccgtgattgggaaagtggtcttgtcctcccatcactagaagatcacgaacaagagaagctttgtggtctacctgacattgggggccatgtaatgaaaatacctcttgtggctttccaagtattgctttgtatgcggttggagggcacaccaccaagcgctcgctacatcccaatatttgctcttttctcgccactatttattctgcaaggtgctggtgttcttttctctctagcaagattagtggagaaggttgttctgctattgcgtaatggaccagttagtcctaattaccttacagcctcatcaaaagttcgcgattgctttgcttttcttcatcatggttcaaggcttcttggttggtggtctattgatgaagggagcaaggaagaacaagcccggttattttatactgaatctactgggtacaataccttttgtggctatccgccagaggtggttaggaaaatgcctaaaaaggaccttgcagaagaggtttggaggctacaggcagctttgggagaacaatctgaaatcaccaagtgtaccaaacaggaatatgaaaggcttcaaaatgagaaggttctttgtaggatttgttatgagggggagatatgcatggtgctacttccctgccggcacagaactttatgcaaatcttgtgctgagaaatgcaagaagtgtccaatctgccgtgtgccaattgaagagcgcatgcctgtatatgatgtttaaacctcactaactcagcttaacaatacaaatttgtgcatgtgggttctgtcatgctgtgcatttagtctcgatcacaactttaagctgattgaggtttgcacttcagaaagggtctgcaatatatgggggaaatacaagtatatcatgtctaaccaaaagcatggatatgtggttgatgagcattgtcgttttggaccagttatctactgtaagtatgtggtcagtgtatttcccttccctcttgtgattggtagatgagtcagatagtcttgttcgcgtagcagcattttctcagggatatgcagttgttgagaagaaagtgaaacaaaaacagactgtaaataaaaacactgccttgtttgaatctagtccttgtttgagaagaaagtggaacaaaaaaaatgtaaacatctctgttgtattattttgtagtagaaaaatgtctgccgaaaaaaaaaaaaaa

SEQ ID NO: 7847 - DNA, 2807 bp, Zea mays
  misc_feature (147)..(147): n is a, c, g, or t
  misc_feature (180)..(180): n is a, c, g, or t
  misc_feature (2219)..(2219): n is a, c, g, or t
  misc_feature (2445)..(2445): n is a, c, g, or t
  misc_feature (2508)..(2508): n is a, c, g, or t
cccacgcgtccggtcgacggacgcaccgcatactcctggaggataatattcagtccactatggctctttcataggtattagttgcacagcggaaggttttcaatgcctgccccttctttgcctcatggccgtcattgggcaccatgnctccgtgggtagcggcgcctttactaattgcgntcgagctgcttctttgtcgacccccgcgtaccctaagagttagaaatcatccatctgttgatctgaagattgtgttccttcccctgttggcctttgaagcaataatccttattgacaattttagaatgtgtagagctttaatgcctggggatgaagaaagcatgagtgatgaagctatttgggagacacttcctcatttttgggtttcaatttcaatggtgtttcttatagctgctacaacattcacccttctcaagctgtctggtgatgttggtgctttgggatggtgggatttgtttataaattatgggattgcagaatgctttgcatttcttgtctgtacaagatggtttaatcccatgattcacaagtctcccactcatggggaggctagctcatcatcagcgattagataccgtgattgggaaagtggtcttgtcctcccatcactacgaagatcatgaacaagagaggctttgtggtctacctgatattgggggtcatgtaatgaaaatacctcttgtggctttccaagtattgctttgtatgcggttggagggtacaccaccaagtgctcgcaacattccaatatttgctcttttctcgccactatttattctgcaaggtgctggtgcctttttctctctagcaagatcggtgctgtcggttgttctgctattgcgcaatggaccagttagtcctaattaccttacagtctcatcaaaagttcgtgattgctttgcttttcttcatcatggttcaaggcttcttggttggtggtctattgatgaagggagcaaggaggaacaagcccggttgttctatactgaatctactgggtacaatacattttgtggctatccaccagaagtggttaggaaaatgcctaaaaaggaccttgcagaagaggtttggaggctgcaggcagcgttgggagaacaatctgaaatcaccaagtgtaccaaacaggaatatgaaaggcttcaaaatgagaaggttctttgtagggtttgctacgagggagagatatgcatggtgcttcttccctgccggcacagaactttatgcaaatcttgtgctgagaaatgcaagaagtgtcctatctgccgtgtcccaattgaagaacgcatgcctgtatatgatgtttaaacctcactaactcagcttaacattcaaatttgtacatatgggttctgtcatgctgtgcatttagtctcgatcacaactttaagctgattgaggtgtgcgtttcagaaaaaaagtctacaatatgtgtatatcatgccatgtctaaccaaaagcatggaaaggtggctgatgagcattttgccatttcggtccagttatctactgtaagtatgtggtcagtgtattccccttttgtgattggtagatgagtcagtcttgtttgcgtagcagcattttctcagggttatgcagttgttgagaagaaagtagaacaaaaacagactgtaaataaaaaaatactgccttttttaaatgtaatcctcaagtgtaaacctccctgttgtgccattttgtagtagaaaaatgtctgccgaaatttgtgaccgcaacgattcctcgtcggggggccccgcacaatgtgaggggtcgtcttagcaaaattatttaaagattgtggaagcatgtctggagaagaaaggttgcgtctggtctgtgccaaggaatcattgttggtatgttttttcaaaccgtattgcggtgattggaaccaatttaatcatgatactgtggactgctgtctccttttaaagcagagtataaatctaaatattgttcgtcaaactattttaagtttgactaaatttgtataaaagatattgatgcttatgctattatggtacgacaatttttttaaaagtatcagatagtatttctcactaattctcattagagtacgaacgcaagggtgtggctctctttctatgtgcaaggatcaagtgctgtttattggtattttctgccacaaggttgtggctctctttctatgtgcaaggatcaagtgctgtttattngtatttttttgccactggtatggtaaaccatccacattatttgaccactaagctcttggttgctatcagactagctgtttatgtgatgttgatcatcgagagtaaaagcataaacttttatttgacctaaacaagcctaatgagaaatatacacttgctaatctctatacactaataagtccttaatctcgtgactatcaaggcgcaaacacctcactagccaaancctccctcacttgttcttcaatgtgtttctttagctaaacaaacaagagaccaagaacggatngcattgatgcatttatagccctatggcgtggaactagtcattgcccctccactcagctttcatgggggcatcatgcatgtgtgatgctcaccaaacaccagcacttgacacgtccggtgtaggtttcaatagttagtttcaaaactagtcgtcattatgttggtgctcatcggacaatgactatgctcattgaatgctcctcaaagaacatggctacaaacctctttgagtcccttatttggtagagagtccggtgtaccatcaaacatgtctagtctgtacattggctccccatagtt

SEQ ID NO: 7848 - DNA, 869 bp, Zea mays
ccggccgggccggcccgccgccatcgctagactagagagagaaacccttgtacccgtgttccttttcatcccccattttctccgagtttccggcccatcgccgagcatcgagtccaaggaagcggagccggcggagaaggggagatttgactttcccgtcgggtgcctagggagcaggagggatgcagcggcggcggggccacacgtgggcaggggtggggaagacggcccaggcggcggcggcgcacgccgcgctcttctgcttcactctcctcctcgcgctcagggtcgacggacgcaccgcatactcctggtggataatattcagtccactatggctctttcatggtattgttgcacgcggaaggttttcaatgcctgccccttctttgcctcatggccgtcattgggcaccatgtcattcgattgttgcggcgcctttactaattgcgttcgagctgcttctttgtatatatcttgaaagcataagagttagaaatcatccatctgttgatctgaagattgtgttccttcccctgttggcctttgaagcaataatccttattgacaattttagaatgtgtagagctttaatgcctggggatgaagaaagcatgagtgatgaagctatttgggagacacttcctcatttttgggtttcaatttcaatggtgtttcttatagctgctacaacattcacccttctcaagctgtctggtgatgatggggctctgggatggtgggatttgtttataaattatgggattgcagaaagccttgcattttttgtctgtacaaaatgggttaatcccatgattcacaagtcttccactcatggggaggctagctcataattcgcgattaaatac

SEQ ID NO: 7849 - DNA, 1207 bp, Zea mays
  misc_feature (1200)..(1204): n is a, c, g, or t
  misc_feature (1207)..(1207): n is a, c, g, or t
acgaccttctagttctagatgattctcaaacccacttccgggctgccgccgaggttatctacaacaccgagcagcgagaaggggttggtgtccagcacgaattgaatcgtcgccagaagtcatggcggattcggccacttcccgtccaaccgttctcgtcaccggcgccggcggccgcacaggccaaattgtctacaacaaactgaaagagaggtctgagcagttcgtggcaagagggctagtcaggacagaggagagcaagcagaagattggggcagccggtgatgtttacgttgctgacataagagacgcggatcgtctagcacctgctgtacaaggtgtggatgcgctcataatcctcaccagtgctgccccgaaaatgaaaccgggtttcgaccctagcaaaggtggacggcccgagttctactacgaagacggaatgtaccctgaacaggtggattgggttggccaaaagaatcagatcgatgctgctaaagctgctggagtgaagcatattgtgctggtgggatctatgggaggaacaaatcctaaccatccgctgaacagcatgggtaatggcaatatactggtatggaagcgcaaagcagaacagtatttggcagacagtggaatcccttatacaatcataaggccaggaggtctacaagacaaggacggaggagtgagagagctacttgtggggaaagacgatgaacttctccagactgacacaaagtcgattcctagagccgatgtggctgaggtttgtgtccaggctctgcagtacgaagaggccaagttcaaggcatttgatttggcctcaaagcctgaaggtgtgggcacgccaacaaaggactttagggcactgttctcccagatcactgctcggttttgagcgagctgctgagaagcctactcgagttctagattttatggtgtcacaatccattttatcgtgggcttgtcctggagatacaaccaggtagcttgttggagctgcggtttggtgcaattgcaaccaggtagcttgtatcaatccattttatggtgcattgtttgcttgtacactgctgaatgtcgtctggttgccaattgtgtgaactgttgacagccattaaaacaagttatttggaaccctgtttgcataaattgttggaaacaattttcccaggcacagttactcaaaaaaaatataaaatnnnnnccn

SEQ ID NO: 7850 - DNA, 876 bp, Zea mays
ctcgaggcccgccgggatcagaactcagaaggcctcagtgtcacagctcacaagagcccgtcgtcagtctcgtcacactagctcgtcagaacctagctagaaggacgcggcagtagtacacgtacgtacgcatgtctccctccgtgatggccacatggcgccgtcggccaccgccgccgtcactactccattccaaaggctcgtgtccgccgccggactccccgtcgcctggtcctggtgctgctgctccaccgccggcggcttccgcgacgtcgtccccagcggcgaaaggatcatcaggcgcatgcaggacacgtgtggccggtcgagggcaccaaccagtccgggacgacgacgacgacgctgttgtacctgcagccgctgctgctgagcatcatggacgatctgcagatgatgaagcagatcgagatcgactagtacctgctgctgcgctccaactggcggctgccctgcctcgagctcatcatgctcatcagcaaggcggccggctcggtggtgtaccgccagaacgcgaggacccccgggcacgacgacggcaggcgctacaaaagatattctattttttgacactgtatatctctcgtagcatagacaactagtgttattagctcactgtcactgtttgacgacgcttgcatttttctaccgctaatttatgacattattggcttctaagtcatgaaaaacagccgacagaagttggggcctttgctcttgaaataaagaggctttggctttttagggtagggaaaggggcgccaaaaaaaaaaaaaaaattctacggttgactcatgcttattggttgccatatgccttcatagtggagttgggagttatatttggggacaatgttgg

SEQ ID NO: 7851 - DNA, 9368 bp, Zea mays
cattgggtacctcgaggccggccgggatcagaactcagaaggcctcagtgtcacagctcacaagagcccgtcgtcagtcgtcacactagctcgtcacaacctagaaggacgcggcagtacgtacgtacgaacgtacgtacgcatggcgccctccgttatggcgacatggcgccgtcggccgccgccgccgtcactactccattccaaaggctcgtgtccgccgccggactccccgtcgcctgctggtcctggtgctgctgctccaccggcggcggcttccgcgacgtccgcagcggcgaaaggatcatcaggcgcatgcaggtaacctcaacgtcagcttgatcacagtgtagttcgttaattagttttagaaaaagaccttgttagatatataggatcggaataggagtcgatctgtatccgtttctctgcaacacacacaacaatgcaaggacacgtgtggccggtcgagggcaccaaccagtccgggacgacgacgacgacgctgttgtacctgcagccgctgctgctgagcatcatggacgatctgcagatgatgaagcagatcgagatcgactagtacctgctgctgcgctccaactggcggctgccctgcctcgagctcatcatgctcatcagcaaggcggccggctcggtggtgtaccgccagaacgcgaggacccccgggcacgacgacggcaggcgctacaaaagatattctattttttgacactgtatatctctcgtagcatagacaactagtgttattagctcactgtcactgtttgacgacgcttgcatttttctaccgctaatttatgacattattggcttctaagtcatgaaaaacagccgacagaagttggggcctttgctcttgaaataaagaggctttggctttttagggtaaaaaaaaaaaaaaaaagcaagcttcttctcttctcggttgactcatgcttattggttgccatatgccttcatagtggagttgggagttatatttgggggcaatgttgggtcttgggctttccatttgctagttcaatgccaaatgaagttttcgctggcaaagctccaacctgaatgggttgggccctttgtagttgcaaaatcaacaagaggctccatctaaacctcaccttgcctttaaaaaaatcaaagaagaagacatgaagtctcacaaaacaaaaaagtgcaccctgctgcaccagcgaatcctcaccaaaccatattcataaagacagttcgagaactgtctctccaataaagaaagaaaggtatcgtcaggtagcattgcggctcgttcacgtccgattagcagggtggcgagaagaatcgaatcagtccctatctgaggagcatgcatgcagcgatcgaccaagtatttatcttcgtttcattctgaaagggtagccagccacaccagcggcagcagagctagagctgttagctagccttgttgcaaggatataatggcggaggcgatcatggggcctcttgtcgggagggtacaaagacaaggcaggagggtacctcatcttgcctcctaaatacaaataaagacaaggcgggaggtctcacaaaaaggagcaccttcacattcaccccacatgaggggctccagctgaacaccaccttgccttcgaaaagcaaagaaacacaaaggcaaaaggtctctcagaaaggaacatacgcattctctcataggccctgtttgggacagttgctgcttgttgaaaaagcagcttatgtgataagctggtaaaaagcagcttctgcttgttggttgtttttagttcattttgagaagcagttgaactgataagctgctgcagaagctgtctgtttagcagaactttagcttaaatttgtgaagaagctgaaaataaactatgccaaatagggcgtttgtgtcatccggcccggacgaaattgggagcccagcacgaacacgcaagatcacgagccaagaacgtcgaatcccacgcgcgtatacgtcgcgggagcacgcgtctcgtctgcatgcatgtaggacctagcaggctagcacgttgcagtactgtggtaccgcggaagtacaatcctcctagtacgccgagttgcctgagagtaggcactaggcagtgaagggacagagcggcacgaatctagatgcatcgtaggcttgcttcctgtgcaccctatccgtacgtttggttttacggcggctactgtttccgcttgtctttagttcccggatgcggacaaagcacatgccccgttaaactcttactgcgtgcacgatggaagccccatcacgtcaaattaaccatccatgaaaagtacaaattcagaatgaacggaagctcgcagcgagagtaatgaacaaccatttgcttccgttccttgaggcgagccgggccgcaaagtctcttgtatccaaacgtctcttgtctcttgtatagtaaaagatagacgggaagctgcaggcatgcctctttatctcatctccaatattcataatttgtaacagaatataatcctaaagaagcatcctccttttaaaaaacataactctaaaaagataaatgtaaaaagatatgttttagttaatgtgcctgcctgcagtattctactatatcctaaattgacgtagggtactctgaagacaacttacaggcacgagatacaatacaataccagagttctggtgatgaagatgctctcagatcaccacataagttaattagttcagtgggttacaaaacagtgttcaacggaggtcaacatctcttaaatccattggatagtaacatatcaagttcaacggcagtactagtacatctcagaaaaaaaaatgacatgaaacagtctagcgaaaacgccaacacagtagggatagttcgcttcgaattaaactcgtatctttagactgttaattctatagagacaaaaacactatagaatcagtataagataatatggattaaagtcaaacgaacatacatctatgcgttctctttaaaaagccctagccgacgatgcgggttctgaacctgagagtgagacatccactaggcgatgctgctgttcaaaacataccagcacgcatgggagcagaagaacctcccggcgttccctagcgcgggaaaggacagggagggatcgggggggccggccggccgcggggtgccaccgcatttacaagccacatgcacgcattcattgccgccccgatttaacacaccccttgtaacgccgtcgctgggccacaaccctactaccacaacaagcgcagccgcagcggcagcctccggaggaccggattcagtcatacagagagggggagggcatggagatgagcatagggtggcaggagctcggcgtcgtcgacaccatctacgaggacgaccacgaggaggaggaggaagacgacgacgaccacgagggacaagaggaggagcgcttcgactcgcccaccggcaccatgtcgtcctcgccgcccacctcgcgctcctcctccccggaggtggaggacgccgcggcggtggcggaggcgcacccgtcgtccctgccgccggcgctcaggcgcgcagtgcaagcgtggtacgtgcgtgctgccatgtcgtgtggctcagtgcgactctcgatttcgggacataataacgatgacttcactgatcgatcgccgcccgtgcaggtgccgggagaacgggtcgcgcaagcccgacgtggtcgtccgcgtccaggagcatcgcctccctctgcacagggtaacatccgactcctctccgtctcctcgtcctctcctcctgatgcacgattaccaccccagttcagtcctccgtctgcgctgggtgatacagcatgctcaacttcagaaatttcctccgctggattttagctaaaaactgttttgtagttcaaagttttctccgctgtactgtactgccatctgggtcgacattttcaaacacggcaacggaagcggcctctccgttctgccgcattagtgacgcctgcaggcttgctgtcccccatccccttcttttatgacagatcgtgctgcagctgctggtggtatggcatgccttccgttaagagaacagtaataaaccaatttttttgataaaaaattccacgcatggagaattaactagtgtgcagtgtgctcggctcggcttggcttggctgtggatacatacaccgaaacggcaacgcatgagaaatcagcgcccgcagcacacgtctcttgtgatggcaataaacgagcgactcgcattagttgctgtgcgttccaatccatcgttttccctgcctgcgcaaggagacacgagacactgcccaagcccaatccacgacgtatagattcaccgagacatctgcctcctctgtttctggcacagccttgcaggcttcctcctcctcctggcacacctcaagtcctgaactgcacgagaacacgttgtgggtggccaccggccagcagctgcaccgccagttcccgctaaaatgcactaaactctggcctcccaaatgcacgccgtagtagctgaggagtgtggctgagcgtcagtctttagccaggaatggtaattaccctttctcccagctccgccccacgaggaacagttcccaacaatggcctccgaagaggcaataattgatgacgtagtatctgtcgctcatttatttaccgctacgtccccgccttggttagcgcatcggcagtcagtcataactttcagtctactctttctgcaaccgccacacgagttaactcgtgcatgcaggtgacttaagatgagatttatggtggcgtagaagaaaagaaatagagaaaatggtttgctcactactagtagtcagctgaaagtgggctcctcacagactttaagacactttgtataatttatatcatagaagggttactatatgaacaggtttctagttagctatacgtgacatagcaacattataaagctcactatagacttatattattaaatttgctcttacattatgtctgtcaagcgtattatgcccgtcaactgttcggcgttcctgactgttgttcctccattgtagcttcgtttttgtgaatgttgtgttgctggtttaaactgtaaccttaggacttgtttgagaggaagagtattgaagaagattgaggggctatagtgtgtcttcaaaactggtttggtgatcagagaaattgaacaattgaacaggatccatgatgttttctctatatggattctctctaattccctgcttcaatactcttgcttcgagaggagcagatggagatggagatccttttgtccctccatggtactacgtcaggtgtcacatgtgcgcatcagtagtttgggcctttaaaaattataggtggatgaacaggcgacgctgccggcatttcgaacacgggcggccgtagccccgcaggattgggaccagaccttactgtccacgtacgttgtacgggcgtactgcccgtttttgtccaatggccacattgcattcatgtctgccaagtgacaacgcaatgccatttcaaaatgatgttgtactatgctcgctaggatctactttaattctgaatctcagaacgtactatgctcgctacgatctacttactgcagggtagacgaatgcagtgaacaatataaaacgtaaagttgcgcgctaccattttttcccttgccaaacattccttaattaactgcggtgtcatatgcacggccacttaataagagtaatcatcaagatcggagccctcgcccggcaacagtaatttggcgctgctacgttgtgggctcggccaatcatttgccggatcacatggtctagctttcctcctgattgcagccactttggctcgcgcaacctgaaatctgacaatatacctgtcgtacggatagtacactcattgttcttgtctttgctgcaactgatagtggatgcaaggccagaccatgcttggaaaaatatcagattttgcaggagccagctcaatccatgccgcaatgatttttttatatatgtttagtacttcctcagttataaacgtttatatagctcgtacgtactgctgcatatctaataagcatgcataatatgtatccacttatatacaacagttatatatctagaaaaaaaagctactataatttggacttgaaggattatttcgcaaacaggtgactagcgcgtttgttgcagagagtgaagtaatcattttgcagccgaattttgcgaggattttaacagctcactgttcgcaggacgtgatcacgtcgcggagcagctacctgaggcgcctgctgtcagagtccagcgacgtcgcgatcacgctgccggcgggcctcacgttcgacgcgttcgtgcaggccatcgcgacctgctacgtcgtccccgacgatgcagcggcggcggcgctgtccccggcgagcctcgccgcggcgtgggtggcgggggcctggctggagctgggcgcgggaccgggcccggggcgggacccttgcgggctgacccacgccgcggaggactacttccatgaggtggccaccgaccacggccgagccgcgggcgtgctgcggtgctgcgcggcgttcctgggcggcgaggcggccgggcccgccgcggacctgctcgcccggtgcgtcgaggtgctcgcggcgtccgacagcgggagcgggaggtggctcgacgacgtggccgcgctccccgtggaggagttcctggtggccgtggaggccatgcgcgcgcggtccgcgcacgaccacgacctcatgtacacagtcgtcgaccactacctggaggtacgtactggatctcgattccgacctgacagatatcacaggccatcgattgttactggtgattttctcttacaataacgcattacgcattgaggctcggatatgatggctttagaagattgatggtactcgttgtacttgcgcttaggtgatgaatattaatacaaaatgagcttatcaatccagctcagcttccagggctttccttcggctcgtctgggcgattatgctaccccaggcgtacaattatgttgacaaaactcatgacagctcagctttaagaaatgtgcttgtgctctgcagtttacacttcagcagagtttggttgccttgaattcggaaccataggctgatatactcctacttcgtagtaccaactagcaaacagtttagagtgtctgactgccattgcaagcaatcaccttgaacccgctttttaggaaaagtttggaaactctcaaatccccttcggtaatacatgggattgagaggaaaattagttcatttttccctcgatcccatggattcttagagaagatttgagttttcaaactagccctaaatgattaaacatctttgatgataatttagtttacaacacaatcggaaggaagaatatataagatgagaaatgcaatggattatgcccgaaactatgactacttgcaaactcatatggcgaagaaccaactgatttcagagtttcagacataatagtgttcactgtatttttttttcttcagaaccacaaggggaagcttacggaggaggacaaatcccggttgtgctacaacgtcaactgcaccaagctgtcgcagcacctcttcatgcacctggtccaaaaccctcgcctcccgctccgcttcgtcgtgcaggccatgctcgtggagcagctccactcccaccacaccatgctcctcacccatcaccaccaggccgctgcactggcgccgacgcgatcggcagcgccgctcctcaagccaaccccatcgggcgtcttcagtggcggcgtcgcgggggaggacgccagcatgacgctcggcgacatcctccagcgcgacgccgcgctgcaccagtccgcgcacatccgcgcatccatgcaggctaccagcctccgcatcgagaccctcgagcgcgagctggccggcctccgcacccgcttgcgccgctccgagcagcagcaggcggagaccgaggcagcggccgcggccgcgactggcgcctcctcgaccgactgcgcgcccggcaagtccgccagcttccggatcccgcgaagccggctctgggaaggcgaggagctcgcgcccgttggcctccggcgcgccgcagctagggacagcagtgcgaggggcttcaagtcacggttggtgcacggattcaagaacctgttcggcaggaggcaagcggccaccggcgcgccgtccgcgaccggcgagctctcgaggatccccgctatgcttcggtgataaaggcgcggccgctgctacgccggagctggagagcgacgacgatgaggtggtgagcatggaggagaggcggcggcctcaccggagaaaccactctcttgtgtgatcatcgtcgccgtccatgcgctactggcaaacaatgtttgcaaaacatgcaagcagggatagggacacggagtcgtagagatccttggtatatggtgacatcactattttcacacggctatatatgagtatatgacatcgtcgttgattgttagtttatttctttggacggatgcaccgtgtaaggttcttggatgcaaggctcaagaactagccttgtgtttttaacatgtcgatgttttcacaatgacaggttagttgcttggaagggtctggggcaagatttcaagtagaagcccatttattttttatatatgaatgttatcgaaaaatattcatataaaaacatgtaaataaaaaaattaatatattatgtatgcataccttttggacgacatgattgatagagagaagtaaaaaaagatcaaatgtttaaaatctaaaatcaaattagcagatcagtgttctaagtgttgtttggcttatggcaaccagccaaccaaaacggatggaatagaatcttaaatcctcttcatgacttcgtgcttgtgtaagcagcggatgtgtcagcggtgtccgtggatctgaacatgcaacatcacaaaaacgattagacgtctaaggtctcgtgtagcgtgtgactcttcgagactaatttacggtggtctagtgtgattctcgtaatcaaatcttgtaatagacaatgcaaaaactcatatacattatactagtgtgtgtatacaaaatgtgtatactagtcttgtaatatacaaaatctgtgttcatggcaccgcccttgctcttttccccttgaccacctctcctacccacccaagctatctcgcaacacgtcccctaatcttactacgagattattcacattaaggtttcagtggatatcaatgaaaaaaactatgcatggcaatgattcagaccgctgaataaagtaatatcctacatcctatacgataaattgtcttgtgttagattattt

SEQ ID NO: 7852 - DNA, 2984 bp, Zea mays
  misc_feature (433)..(433): n is a, c, g, or t
  misc_feature (440)..(440): n is a, c, g, or t
gcgtggtcgcggccgaggtacctttgcccttatctgccatcaggaagagttcatttcctaaagtggacagtgaaactgaaaagagggtgattaccatattgggaaataaagtgtcttcattgacaataaaagatgtaacgaggaattgcagtttgccatcaactcatgtatactctggcagattgactgacaagataccactgggaaagattgaacgttctgttcaggctgtagaagcagctttaaaaaagctggaaaatggaggtagtgtcaatgatgctaaagcagtatgtgaacctgaagttttaaggcagcttgcaaggtggcatagtaaactcagagtgtatatatcaccttttattcatggcacaaggtacagttcctttggtagacattttacaaacgtggactaacgtgtcccccttgttgatangacttcngactggtatgctcactagtccccccccccccccgatttctgctgtggggcaaatgattttagccgtcttatgaaagaaaaactcgacaaagttcagaagaagtgccatttcaagaattatgatcttatccaaccacagaatcgcttctgctttgaaaagagggattggatgactgtgcagccaaacgagctgcctcatggatcccaactaattatgggtcttaatcctccttttggagtcaaagcaagtcttgcgaacaaatttattgacaaagcattgacattcaagcctaagctcattgtactaattgtccctaaagaaactaaaaggttagatcagaggagaacaccttatgatttgatttgggaggacagtgagtgtctttctggcaagtccttctatttgcctggttctgtggatcttaatgataaaatagttgaagggtggaatgcatctgcgccacccctctatttgtggagtcatcctggttggacaaagaagcacatgcaagtggctgaagagcatggtcatacttgtatggggaagatagcttgccatgttgaagagagtaatctatcagatgacctgtccgtgaggaaacaatctgatgctacaaacaaactgaactcgagatcagggaaagagactccattcaatgacagaatgtccaatctacttgatgatggttctgctaggaagcaagcaagatctgaagaagagaagagaactctagggaagatagaacaccatgtgaaaaaggctaatataccagataacctcccagtgaagaaagaacctgaagcttccagcaaagtcatgtcgcattctggaaaagatagaaagattggcagatacaacaggaggagacatgacaacaggagcagcaaggggacacctgatcacacagagagcctcccccctgaaaagcaagtggaagttgcatatgaggaaacaagagttattcctagcaaaaagattgctcataatgaaaaaaagagcgcgcagtacaactacgagcaaactgcagcagggatgccaaacatgaggtctagaggaggggattctgacatgagtatctcacccccagtcagttgcaatgctcgaagcaaacccatgagctattccctgacgagaccaattgaacacttggatacgaatgctcaccttttggcagaagaacctagtgactctgtgctcaatagggttccaaatcatgacagttatttggcaatcaaagaggaatactgtgatggatttaagaggaaaaatgatcctatcttcagtcacattgatgatagctcaaggatgaggggctccagcatcgaagaagtgaccaagccgtatattactgctccaaacagtgatccgtggtctaaaggagatggcagcttttacaggcatccgagctcagaagatttaaacgctaatgctgatgtgcttatgccaggatacagtgcaagatatggacaaattggtggtgacagtaacccacaagctagtatggtcccactagcaacagattcaagactgcatggtggaacggttgctgataattacctctcggcaagatactcccttggatcttcaggtgctcgcgttagccaaccagctccaactgttcccccttttgggctctcaggtgcaagttcacaacgaggctcagtaatggacaggtattcgtatgggctttcgggtccgactggaacacagcgctcagttattgacaggtatgcgccgtccctcgatggaacgaacacaacaagatcgaggagctccttgcctgagcagtacccgttcggacaacctggctcttccggtggcgggtggcctcatcactgatcgctggaacttggtcctcagatttgaccagcaaaagtgcaaccgatttcttgagtccggtggagcctacaacctatctacggcctaactttttggatcctactagtcgtttcttcctggcgccttcgacgaagacatcacctgtgtctaccaatacagaagtgtagacttcaattcctacaaatacagaagtgtaggcttcaatcctattgtttgctctggatttctgtttatgagcgtatttacaagagtatgtttggtctatgttagtatattaggaatacaattccaaaaccgttgtaccgtgccaaagtttaatactatacgtttgggtctgtcgatgagaaaaaaggacgagtgggtgagaagatgctgccctccgcagaactcgatcaggccggttcctctgcgcgtcctgctatgagaggctaacctgagcccgacagaaccggtttggtcgatttgggacctggtaggccggtattttttttattgaagtctaactttctaaattaggtcttattggtttgtgttggattgcgccaggaatcctttcaagtttatataaattttttgtgccaatccggttagtgttttttataatccttattggttttctaaattaggtcttattggtttaagtgagaaacaatccggttagaaatcgtttcgatccactaatcctaaacaatggattgacacctt

SEQ ID NO: 7853 - DNA, 2579 bp, Zea mays
  misc_feature (2100)..(2100): n is a, c, g, or t
  misc_feature (2139)..(2139): n is a, c, g, or t
cagattcgcttctgctttgaaaagagggattggatgactgtgcagccaaacgagctgcctcatggatcccaactagtatgttctatttgttatttattgagacaatttagtttatcttatataattacaacattcaattgtttattgagtagattatgggttttaatcctccttttggagtcaaagcaagtcttgcgaacaaatttattgacaaagcattgacattcaagcctaagctcattgtactaattgtccctaaagaaactaaaaggtatgtaacatattcctgttgtcctgagtattttggtcaacatcttctcaggttttccttttgggaaattgtgtttcctctacatttatccacttcatatccgggttagatcagaggagaacaccttatgatttgatttgggaggacagtgagtgtctttctggcaaggtaataacttacattcattgtattgaatttcttttgtctgttcttctctagttgtttgacctaatacctttcttgaaattggcagtccttctatttgcctggttctgtggatcttaatgataaaatagttgaagggtggaatgcatctgcgccacccctctatttgtggagtcatcctggttggacaaagaagcacatgcaagtggctgaagagcatggtcatacttgtatggggaagatagcttgccatgttgaagagagtaatctatcagatgacctgtccgtgaggaaacaatctgatgctacaaacaaactgaactcgagatcagggaaagagactccattcaatgacagaatgtccaatctacttgatgatggttctgctaggaagcaagcaagatctgaagaagagaagagaactctagggaagatagaacaccatgtgaaaaaggctaatataccagataacctcccagtgaagaaagaacctgaagcttccagcaaagtcatgtcgcattctggaaaagatagaaagattggcagatacaacaggaggagacatgacaacaggagcagcaaggggacacctgatcacacagagagcctcccccctgaaaagcaagtggaagttgcatatgaggaagcaagagttattcctagcaaaaagattgctcataatgaaaaaaagagcgcgcagtacaactacgagcaaactgcagcagggatgccaaacatgaggtctagaggaggggattctgacatgagtatatcacccccagtcagttgcaatgctcgaagcaaacccatgagctattccctgacgagaccaattgaacacttggatacgaatgctcaccttttggcagaagaacctagtgactctgtgctcaatagggttccaaatcatgacagttatttggcaatcaaagaggaatactgtgatggatttaagaggaaaaatgatcctatcttcagtcacattgatgatagctcaaggatgaggggctccagcatcgaagaagtgaccaagccgtatattactgctccaaccagtgatccgtggtctaaaggagatggcagcttttacaggcatccgagctcagaagatttaaacgctaatgctgatgtgcttatgccagggatacagtgcaagatagggacaaatgggtggtgacagtaacccacaagctagtagtggtcccactagcaacagattcaagactgcatggtggaacggttgctgataattacctctcggcaagatactcccttggatcttcaggtgctcgcgttagccaaccagctccaactgttcccccttttgggctctcaggtgcaagttcacaacgaggctcagtaatggacaggtattcgtatgggctttcgggtccgactggaacacagcgctcagttattgacaggtatgcgccgtccctcgatggaacgaacacaacaagatcgaggagctccttgcctgagcagtacccgttcggacaacctggctcttccggtggcgggtggcctcatcactgatcgctggaacttggtcctcagatttgaccagcaaaagtgcaaccgatttcttgagtccggtggagcctacaacctatctacggcctaactttttggatcctactagtcgtttcttcctggcgccttcnacgaagacatcacctgtgtctaccaatacagaagtgtanacttcaattcctacaaatacagaagtgtaggcttcaatcctattgtttgctctggatttctgtttatgagcgtatttacaagagtatgtttggtctatgttagtatattaggaatacaattccaaaaccgttgtaccgtgccaaagtttaatactatacgtttgggtctgtcgatgagaaaaaaggacgagtgggtgagaagatgctgccctccgcagaactcgatcaggccggttcctctgcgcgtcctgctatgagaggctaacctgagcccgacagaaccggcttggtcgatttgggacctggtaggccggtatttttttattgaagtgtaactttctaaattaggtcttgttggtttgcgttggattgcgtccggaatcgtttcaagtttatataaattagagaagcaatccggttagaaatcgtttcgatccact

SEQ ID NO: 7854 - DNA, 1637 bp, Zea mays
atcgccatccaccactggtcggtccactccaccgcccgtcccccgtgccgttccgtgcgtcgcatgactgtcgccgcactccgcttgccgccgcccgccgcagctccctccggccgcgcgcgcctcgtgggggccgccgcgcaccgctgctcccccagggaggcgtttgggtggtggtgctcccagctgctgctgacgcggagcggccggacgaggacgacggcggcggcggcgtacccgaagatggcgcggccgccgatcctatccgtcgcgctgccgtctgacaccggccgtgtgctcagcatccagtcccacaccgtccaggggtatgttggcaacaaatcggccgtctttcccctgcagctccttggctttgatgtggatccaataaactctgtacagttttctaatcatacaggatacccaacatttagaggtcaggttcttaatggcaaacagctctgggaccttattgaaggactggaggaaaatcagttgcttcattatacccatttattaacaggttatataggctcagtttcctttttagatactgtgctacaagttgttgagaaattgcgatcagttaatcctgatcttgtatatgtttgtgacccagttctaggtgatgaaggaaaactatatgttcctcaggagctaatatctgtttatcaacagaaggttgttccagttgcttcaatgcttacacctaaccaatttgaagttgaactacttactggattgaggatcacctccgaagaagatggtttgacagcttgtaataccctccacagtgccggaccacagaaggtggttataactagtgctcttattgaaggcaagctgctccttatcggaagtcacaaaaaaacagaggaacaacagccagaacaatttaagattgagataccaaagatacctgcatatttcacgggaactggagatttgacaactgctctcctactaggatggagtaataaatatcctgatagcctcgagaaagcggcagaactggcagtttccagtttgcaggcacttctgaaaagaactgtggaagactataaaatggccggcttcgacccatcgaccagcagcttagagatcaggttgatccaaagccaggacgagatccgaaacccaactgttacatgcaaggctgtgaagtatggaagctgaatccatagtacccccactgacaaaggtgccaacaataatgagcagtgcctgcaccgccgataagcgggtgcacctacttccatgactcttggccctcagttttgggatgctgattctgttacaccttagctccaaaatgagaaacaatcatatttctgaaaaaagggttatagacttatagggttatattcaggctgtgcgattgctgcagtctttgggaatgcgtggtggcctgagtgagattgtaaatggcccttgtcattgttgtcttcctcgttgtgttgttgttgctgctgctcccgctgagttgtggtggttggttgggaactctaggtatgctttgtttgaggcattacgaacatatggtgttgagatgtgctcataatgctcaacatgataagtgattattgaaaagatagttataatttaatattgaccttgggctaaaaaaaaaaaaaaaa

SEQ ID NO: 7855 - DNA, 1486 bp, Zea mays
ccggcttccaaaatccaaaccgctcgctcctcaccgaagacgccattagccatgagcagcttggcttatccgctcctccggctcccgtgccgctgctctatcgcgccggcgccggcgccggcgtctcagctccccgcaccggtgtgtctatctgcttcggcttccgcaaatgcagggggcgatctgacggcgcgggaaaagcgagcgcagcgtcgggaacggcgggagctgcgtgcgacggactggaaggaggaggtgcaggaccggctgatccacgagccagcgcggcggcggaagaagcctcctaagcgttcgtggagggaggagctcaacctcgacctcctcgccgagctggggccgcagtggtggctcgtgcgcgtctccatggcgcccggcaccgactacgtcgacctcctcaccaaggctatctcacggcgctactcggaagtccccttcaagatttacaatccatcaatccaagtaaagaggagattaaaaagtggtgcaatcagtgttaaatcgaagcctctgcatgccgggttggtctttctgcattgtaccttaaacaaggagcttcatgactttatcagagacacagagggttgttatggctttattggagctacagttggttcaatcaagaggcagattaaaaagccaaaacctattccagttgatgaagttgaatcaattattagagaagagaaggaggaacaagagagagttgacagagaatttgaagaaatggagaatatgggaaacattgagcctttcagtaaacccgttgaagaatctgaacttatgttaatgaataagatcaagaagcagtttaagaaatcgtcctcacagggtggcactagacacagtgctttttcgcctggtgcaactgttcatgttctctccgggccttttgcagacttcactggttccatcctggaagtgaatcgcaaaaacaagaaggccactgtacagttgtcactttttgggaaagagagttttgtggatcttgattttgatcaaattgaggtagttgaagtggacgacgatgatagtaaactatgaggaatcttgtgtttatgtatcacagtagccgataactttttatcaacaacccagatctccagctgggcctgagtgaatgaagcaggaacttcagtgggtgggcagtggaccgttgaagacccagctatcagcaagagaaacagttagcacacctgcgcatgagctaccgtcaaaattaaccagtaagttctgactgagttcgccagcacgtgttctataaccttattacattgaaattgatttcccctcttcttctttcctgtttgtcggggttactgaaatgcaagtttataaacaatgaggatgctgaggttagaaagctcgctgatttccactaggctgttcacattattttccctgtgctcgaatgcagaaagcagtcccttaggccattcattccaaaaaaaaaaaaaaaaaagcggcc

SEQ ID NO: 7856 - DNA, 3032 bp, Zea mays
gtatatgtatatatatatacactttgacagctggttttgtagggtatactgatacatactcggcatactctatagatccatcgttgccatcatgtgtaaacggctatctcttattcaccctgtcacctatttcaaactccaccgtaaacagtacatgcatatgcaccagctgatgtttgtttgtttgagctagacggtttctcagcatatatagctagaagatgaaacaaacaatttttttggttcagcttttagaaagactaaagattagctaacggagtttatataagaggctaaaaaaactggtttagtagattttctataggttcctgaatttagaaagctaacaacgtcataaagcccaacaatagttttttttttaaaaaaaaatataaaaaccacagctcaaataaatagcccataagacgtttgttattactgatcttttgatctttccggtatgcatatggacatagtacgataagtacgtagcgagagaaagacacgtagcgaaaacattctcgttatctagtcgtatgacatacgattctacagggacacacacggaatcttagaaacaatcatatagtttgggcacctgccccagctagattagagaggcggggccggcggacccagcgaagatggacgtcgctgatctacgtagtaacccagattcttaggactaccagccgtcacgaaatactacacgaagttctatatgcgtctgcaggtgaagcgttgctgtctcacctacacccacagacggcgacgactcttctgaaaaaagaaaagaaaaggatgcatagcagctcagaattgctcaccgaaccacacaacaccacctttgtgataacaagcttctcgtaaaagagctgcgcgcgcgctggccgctctagcttgctcacttcaccatttgcgaaaattttggaaacatttgtttaacagtaggaagaagcaagaaaaaaaatttgggggacaattgctggtttcgggatgagaggttcatgtacgtacgtacgtacgtacgtgtggctcgctgccctagctagtacctcttgtctcgctccctatttttaaggttttcactttgtaagcactgcacggtgtaaaagacggagtgtgggatgcgttagttttggaatataagagagcgtacgcgggacagatgataatcgtatgatgatgatcgatcggtgcgcctaatcatcacccagagagagaagtgagccgtcatgatttactactacttgttgcaagggaaacaaaccgggtaggccactcctagaagaagaacatgaacatgggtcagggggccgggctagccaatgcaattaatcatcatcatcatcgatatcatattatcgatccatcgagaagtgccactttggaccgcccggttgctcaccaaccttggcccttgggcatccacacagcacgcacagagggagagagatgttggcttacctagccctcccttcctttttttcagaaaggagtcaaacaatgcctaatttatttatatatatacttaatttcttcgtcacaaaagagccacgcgcgcggcctagctagtatagaccggtgtcacgaacgtacgtacgtacatgccatatcgagctagctagctagagaacgtgcatgtattgaagtaaaaacaaaaacttttttgcagtagcgaacgttgcgtagagtggaacgcacgtacggatcaaattcgtaacagtttggacctaaaaggccacgcactgctccggtgcgtcgtcgtcgtctcggcggcgtcgcccagcagaagaaaccaccgtcacgtctctgcttcggatgatggccgctgtgctgattcgacacctaacctgtcgatcgtgtctctttctactagcttgtctgtctgtcgtccttgtactctcttcgttttctctctcttgagagcttgtactgtacgcttgtttacgaatcagagatcgagaccaggcagccatctcgttcatttgcaaacctaactataactaccagatcaaatccatacggaaactcacggtcacgacatatataaagtatgccacacacactcgtgtcgcccagtagaagaaagaaccaagcacacgcgacgcgcgctgtgccttctctctcgctgctgccgagctccagactccaaggcaaagcctacaaacacatggagccgtcgtcagcggcggcacggttgcttctgctggtacggttgcttctgctggtggccgtggcggcggtggccgcgggcgcgctggccgcgacgccgtcgccccgccccaaccccaagctcaggggcctgcgcgtgcgcctgacgcacgtggacgcgcacggcaactactcgaggctgcagctgctgcagcgggcggcgcgccggagccaccgccgcatgtcgcgcctcgtggcgcgggccaccggcgcggcgtcgaccagcagcagcaaggcggccgccgccggggacggatcaggaggaaaggacctcaaggtgcctgtccacgcgggcaacggcgagttcctcatggacctgtcggtcggcacgcccgcgctgccgtacgcggccatcgtggacacgggcagcgacctggtgtggacgcagtgcaagccgtgcgtcgactgcttcaaccagaccacgcccgtgttcgacccggccgcgtcctccacctacgccgcgctgccgtgctccagcgccttgtgcgccgacctgcccacctccacctgcgcgtcctcgtcctcctcgtcgtccgcgtccagcccgtgcggctacacctacacctacggcgacgcctcgtcgacgcagggcgtgctggccaccgagaccttcacgctggcgaggcagaaggtcccgggcgtcgcgttcggctgcggggacaccaacgagggcgacggcttcacgcagggcgccgggctcgtggggctcggccgcgggccgctctcgctcgtgtcccagctcggcatcgaccgcttctcctactgcctcacctccctcgacgacgccgccgggccgcaggcccgcttcctcctgggct

SEQ ID NO: 7857 - DNA, 1400 bp, Zea mays
cattgggaccctcgaggccggccgggccaaccccgtccccaattcgaatcctcttcttcctcttcctctgtgctgctgctgctcacagacccaggccggaggccgtctcagccctctcctcccccaagctcccgtctcttcccctcctggtctcagcgactccatcctctccctctccagatccccgcccgtgacgccgccggctgttacctctccggactccggctcatcgtcctcaggcccaggtcttgatccgcgatccgccgatttccatccggcgcttactcggtgtcccgtcacctgcgggttttgctgtgcggggaggctgatccggcgagcgccttggatgaattcgcgccggtctcggtcggtgaagctggtgtcagcgcgcgccaacggggacggggccctggaggtggacgtacctgaggaagagggggacgcgcggatgagctcctcggccgccaacaccgtgtactgctgcatcgccaggggccggagcgtgatctaccggtacagcagcaagggcggcgacccgcaggcggaggccacggcggcgctctgcctggaccggtcgccgccgcaccaccggcattacgtgcacacctccgggcgcaggagctacgggtacctgacggccgacggccacaccttcttcgccatcatcgaccccagcgtcggcagcgccggcgcgctgcagttcctggagcgcgtacgcgacgcgttccggagcagcgcaggcggcggcggcgggcgccagccgcacgagtcgctggtgccggccgtgcagcggctggtggcgtcgctggagaagatgccccacgccgcgttcgtgctcgatggcgcgggcgcgggcgcgggcgacggcgacggcgacggctgcacgtcgtcgtcgtccaaggcgcccctgctcgggaagagcgggagcaggaaggagaagcggcggtccagggacaagctgtcgtcagcggcggcgggggcggggggctgtgaggacgagcaccacgggacccgagcggtgaggatagacgtgatgccggccgaggacgtcggcggcatgtcgctggagcgcagcggcagccagtccaggctgcggaggcagcagtcgtcgcggtcgctgtggatgcggcacgtgaaggtcatcgtcgccgtggacgccgtcgtctgcctcgtgctgttcgcggcctggctggcggtgtgcaaggggttccagtgtgtgtccgggtgatggtgatcggttgtgtacagtagtacagtgtttgtggagagctgaggatggattcaatgcaaattgcctatttcgattgattgaacaaaaaaaaaaaaaaaagcctgtctgtctgtctgcttccatggaagcttgtgttttcctgctgctgctcttctattttactgctgca

SEQ ID NO: 7858 - DNA, 6054 bp, Zea mays
  misc_feature (639)..(639): n is a, c, g, or t
  misc_feature (667)..(667): n is a, c, g, or t
  misc_feature (1373)..(1373): n is a, c, g, or t
tgattctgcagctgtgagaacgcacttcagcttcaaccatcagtggcgtaaaccacgccagtagcctgcaagataaccattttgtactttctgtatttggggtttctgcttatatgagactgtactcgtaccatgtagtgcccctttgtatacgcaattacatttactcagtgaaatccatgtttcatagggagctatgagaagttatgcaggtggggttggcatgcttcctcggtttgctcatttacatcataaatacagtatagaccagcttcggatggaggacctagacgctttcaatcaatcgttaaatgctgggtgtatgggtagaagtcgagcattgcaagattagaagctagggtgtgttgtagagctgtagaaacagagaagattaggaatttctaagtctgatgccttgattttccacttgcaacacaaagcaaatggtgagcatctggataaacataaactcataactcaataagccagttcaccaccatctcatgctttacataattgatgcgatcagttagccaattgcagcagatatgttgctttcttggcaccactggcttgggcctggctgcatgaagtgtggctaaagtttggagtctgtttgcttggagatgtgcttcaacntaacaaagagtgatccgattgtcctgtnggaaggatgtagaggactcgattgttgctgggtacaagatgaaataatgggttctggggcagatgtgtgcacaccctttcagttataagtagtctgttgtttgagctttatcctcatgtgcctgtacatttattttgcttcttgtgacttggcttcttattggtgatcataatataaggattatatctttatatttttgtactaatttaaaagtacttctgcttttgtgcttatggagctcttgtccttgtggataaggataactctttatgtagtttacgacatgtcttgttcttaccaagtattgttttcaacgcgacaatgctgtcttactctgtaaactatttagttgtttattaatactcagttcacaatttacaatctatgtacatggattgttctttatttatcagtgacaccaattcacatcttgatacttctctttggcattatgtactaagaagctctttattgtatgattttagatgatcacggcagaggtgcttcgtcaagaaaccgttcatcaggacgagatcgtgatcggagctcccaacattcctcatctcggagaggttcaagctctagtggtccaaggcggaatgatcgagatggtatagggaaatcaagaggctatggtaattttggaaagcacaacaaggaaaggatacaagagaaggacctggatttccgtgaccgggagagtagnttggttcagtcagacgatcctttacgtgatggctttgagtcatttagctcatgcagatccgaaaaggacaggcttaaccgtactcgttcaaaggtggccatatcaaatcgggcagtaggagtaagtttagacaatggtaatgtatctaaaaaagataatggtgtcatctcttttgagcgggaattcccacaccttgattctgaggacaaaaatggaaagcaagacataggtcgagttccatctcctggaattagcaccccaattcagaacataccactggtagtatctgatggctggaattcagtgcttgcgatgttaggggatccaaacattaactctgtttcctcttcctcaacacatgctggttctagtaaacagactgaagtttccaactctgggagtgcgttaagcatggctgaaacagtgatgcagtcgccattaaagatttctaccacacctcaggtagttaatcagtatgagttttatgtttctctgtttgcatttcattccctttttttttgaatattgtttatgcctttttgatgccatattgattgttctttttgttcagttatcgattgatgcccagaagattgaagaaagaactatgaggcagtgcattctaagacctcttacaccatcatcaaacaaaatacctgtgagtaccctttttattgcatttgtcccaatgaatgcttaatattgtgtgtgtgtgcacgcatgtcgcttgatagatatgttataagctcattagtatctttccatcttgtttggtcattattatgcccttttgaggaaagcacaagcaactcaagtagtgaagtaatgtgccaactgccaagaattcttgaacctttcacacttctctttttttatttagtgaattaacattggatatttatgtctgttctctgtacagcagattatatgaccatattttgtctatgctattagttaacgatcatagacaaaaaatagtgtttgacccctgccccattttatttgctgatgttctattttcaacctaagattttccaatgtattatttagtcttcagttcacccatgacatagttgttggcaattaccttaggggagcgctcagagctgtctttttatcagtgatcaaacaaaattactggagaaccaattgcttggttgtttaaacagacatgtgggattgaatctatgtgattttcctattttcaaaatataaaatcctgaatattttatggcatctattatttaaatttgttagattttatatcaactattttgcaaagaacatgcttcatcaataacttatataaaatagaaagttttttttgtttgttcagttgttgcattaaactgtgttgagatgagactgctttataacctgtgtcttcctgtttattgataaatcacaattccctgatattactgtcatagtccatcctcacatagactttgtattgtgcttgcaacatttttgtttgaaccaattatctaacacttgaaaagtttgagtggtgaaggacaggcctggcacagtggtgagaagccttcccactgagccgaaggtcctggggtcgacgcagcctctctgcaaaatgcaggggtaaggcttgcctaggttattctttctcccaaaccccactcatctaggggccgacagcattgggtctgcccttttattttgaaaagtttgagtggtgaaattctatatgtcgtattgcaataaatacaataaacaatggtagtacttacttttcagttttagctggtactgttgattaaagcaatgtttttgtgctttgagtttataatattactattttcagaagttgtgatccatttctacaagcatatgatctcttgtgactattccacctaatctaagctggctataattcatcttgtagctactgattatgactattccacctagtctataattcatcgaaatcttaagaaacgagctaatttgaagcaagattcaagtctcatgaaaggagctaatttgaagcaggatcttgtttccatcattttttgtgctatcaatagtctgtagttgtggatgctttaagttagtgtgcatatattaaatttagtgggcaactgaatcacttggctaaatgattctgacaaagagattaatcattaaaccatagtataaaatctaaagcatatggtcaatattattgcttatctgaaaaccatatgtttattattttactttaccatcggcattggaatgtttataaatttcctatcttcactaacatgcagaatataactatgtttgggtgaatatatgtgtttctttgtttgtttcacatatttgtcaagtaatgctcttctttgctgaatagtgcattgttggtttgaactaattcactcagattacttacaggcatctagttctttggataagttattaaaatccaaaggtgcaagagctggagagtctaatggtcctatcaaggttgctccacaactgtcaacacagccatctagcaactctgttcgcactccagtcaaaactgagctcgtaaagcaatctcaatcaggcagccttcaagtccttagtcgcgagcagaatggtgctgtaaatactgctgccaaagacagcaccagcaatcctgtgagccctgttctgggtcgatcttcttcaatggaaccgatgagaaagtctattgtcagcccaaagcttaaggttggcactaatggtcgttctttgcatccgctgcaaggttcatttgctgacagaaaagcaagtgcaaaagacaagtacaagttttttgagatgttgcggagtaagtctgtaaatggttcgagcgctgctattgagtctccatcaagcctgactgatgatcagcagaactctaatcttgatttgcctttcaagtttattgaaaatgggagcagttcctgtgaagaagcaaattcttgtgagggatcacagcgacacttgtcggacaatgagaccattccaccttcagaatctcatgatgttttagatgaaggatctctgggtattcaagttgaggacaaggatgtcagctcttcacaagtacttggtggcacacaagatttatcttctaagaagccccaggaagacaatgttaatattgtgcccatcgtacctgtctatgtaaatgatggtttaatgatgcccaattctgttgatgatgaagcaagtttgccgttagaggaaaccaatcctgccgaagtgttacagcacattggagcaggggaggagaatccctgtcctgctcaagagttcgagtccattggagcaggtggggaggaagagttgaacctcctaagatctatgggctgggatgagaacgaagatgttcagcctcttcagcaggaggagattgctgattgtctaaagcagaacgtcaggctgcagcagaagcttcaagaatgcaagggctgatcgcagaatcaatggagcaacgtcactgtgcctcaccacactgagggggtgtttgatacctgggctaaagtttagtccaggttttggatgccaaatgggaggactaaacatgagctgattataaaactaattacataaacagtggctaattcgcgaaacaaatctatttggcctaattagtctactattagcacttgtttactgtagcaaaacatgagctaattatagattaattatgcttgataaattgtctcgtgaattagcaaaaacctgtacaattagctctataattagatcatgtttagttctcctaattggcatccaaaacccagaccaaaccttagtcccggggatgatccaaacacatgtggagctgggttttgggaccttccggtcaaccgatcagagaatgattgtctagcttagcaaatggagagttttgtttttgttaatgcttgttcagcattgtggggggaggttccatggtagagctgataattttcccccattgataagaggttttagggtttttcttcctcattttcccagaaggaatacaccaaatagaagccttgtctggtgtcggaggcacgtaggtgtgtgttgctctgaaagaagaataggttgcctttcttttcgtcgccatctttttttcttttgaaaaggaagggaaaaaataacgatcgagcttaacatggaaaaggtgcacaggaaataccttggtcttcaatcttttgcttgcctcgcgattttcaaacgttaccttttgctgtcttgtatccatttcttcgatttaggccatgttcatctttgttttaagcttatgaatttagaaagctaacaacgtcataaaaaactattattagtttttttacaattaaaagcccaacaatagtttttttttaaaaaaaaactttaaaaaccacagctcaaataaatagcccataagacgtttgttattactgatcttttgatcttaccggtatgcatatggacatagtacgataagtacgtagcgagagaaagacacgtagcgaaaacattctcgttatccagtcgtgtgacatacgattctacagggacacacggaatcttagaaacaatcatatagttttggcacctgccccagctagattagagaggcggggccgggggaccggcccagcgaagatggacgtcgctgatctacgtaacccagattcttaggactaccagccgtcacgaaatactacacgaagttctatatgcgtctgca

SEQ ID NO: 7859 - DNA, 2888 bp, Zea mays
aattcggcacgaggcccgtccgaaatccagcgctccaaatccgttcgtctcctaggcgctcccccgaacccgtcacgaatccctcagatccccgctgaaatccctcaatcctccgtgctcgccgccgccgcctcctccctgcgacagccgcggccgcggatttccacccgagggtttcgtctcgctctcgctctctccgctctactgcctccacagattggcgcgaccgacccgtcatcgaggaccttcttccgcccgagaggccggggctcctcccgcggaaattcactctcgttcagaggcggcgctctcctcttcatcgccgcccccgcgctctgcttgtactggagtggcgcggggtggagatccacccgggcgtggatcgattcctcttcgtttcttcgttcggtggcgcggaataccaatctatagaagtgcacgaggagtttttatatccccgatttttagggggttcaactgaactcccatgccccacgctaagtccgcccctggtggtggtggactgaattggtggacactgttgattttgtcgtgggcatggagcgaagtgagccctcgttgaagccagaatggctgctgcggcccacagtacctgccacgacccataagccggtgacttcgccccgcgcagatgatcacggcaggggtgcttcatcaagaaaccgttcatcgggacgagatcgtgatcggagctcccaacagtcctcgtctcggaggggttcaagctctagtggttcaaggaggaatgatcgcgatggtacagggaaatcaagaggctatggtaattttggaaagcacagcaaggataggatacaagaaaaggacttggattttcgtgaacgggagagtaggttggttcaaccagatgatcctttacgtgatggctttgagtcctttagctcatgcagatctgaaaaggacaggcttaaccgtactcgttcaaaggtggccataccaaatcgggcaggagtaagtttagacaatggtaatgtatctaaaaaagataatggggtcatctccctttgagcgggaatttccacaccttggttctgaggacaaaaatggaaagcaagacataggtcgagttccgtctcctggaattagcacgccaattcagaacataccattggtagtatctgatggctggaattcagtgcttgcagaagtacctgccttagtagatccaaacattaactctgtttcctcttcctcatcacccgctggttctagtaaaccgattgaagtgtccaactctgggagtgcgttaagcatggctgaaacagtgatgcagtcaccgttaaatatttgtaccacacctcagttatcaattgatgctcagaagattgaagaaagaactatgaggcagtgcattttaagacctctaacaccatcgtcaaacaaaatatctgcatctatttccttggataagttattaaaatccaaaggtgcaagagctggagagtctaatggacctatcaaggttgctccacagctgtcaatacagccatctagcaactctgttcgcactccagtcaaaactgagctcgtaaagcaatctcaatcaggcagccttcaagtccttagccgtgagcagaatggtactgtaaatactgctgccaaagacatcaccagcaacaatcctgtgagccctgttttgggtcgatcttcttcaatggaacctatgagaaagtctattgtcaacccaaagcttaaggttggtactaatggccgttctttgcatcctctgcaaggttcatttgcagacagaaaagcaagtgcaaaagacaagtacaaattttttgagttgttgcgaagtaagtctgtaaatggttcaagcgctgctattgagtctccatctagcctgactgatgatcagcagaactctaatcttgatttgcctttcaagtttattgaaaatgggaacagttcctgtgaagaagcaaattcttgtgagggatcacagcgacacttgtcggacaatgaggaaattattccaccttcagaatctcatgacgttttagatgagggatctctggggattcaagttgacgacaagggttccagctcttcaccagtacttggcacacaagatatatcttccaagaagccccaggaagacaatgttgatattgttgtacctgtttatgtaaatgatggttctgtgatgcccaattctgttgacaatgaagcaagattgctgttggaggaagccaatcctgctcaagtgttacagcacattgatgcaagggaggagaatccctgtcctgctcaagagttcgagtccataggggcaggtggggaggaagagttgaacctcctgagatctatgggctgggatgagaatgaagaggttcagcctcttcagcaggaggagattgctgattgtgtaaggcagaacgtcaggctgcagcagaagcttcaggaatgcaggggctgatcgccgaatcaatggagcaacgtcactgtgcgtcaccatgctgagaagatgtgggccgcgtggagggagctgggttttggacttttggtaccttccgggcaaccgatcagataatgattgtctctagcttagcaaatggagagttttgtttttgttaatgcttgttcagcattgtgggggaaggtttcctggtagagctgacaattttcccccattgagaagaggttttagggtttctcttcctcattttcccagaaggaatacaccaaatggaagtcttgtctggtgttggaggcacataggtgtgcgttgctctcaaagaagaataggttgtctcttacttttcgccgctatgttttcttttttggaaaaaagggaaaaaagaatgatccagcttaacatgaaaaaggggcacaggaaaactcgagaa

SEQ ID NO: 7860 - DNA, 1209 bp, Zea mays
tagcgtggtcgcggccgaggtacaaatggaggaggaggaggaagtggagcgcatcctgtgacggcgatgcgggtagcactagggaaatccagccgcatctactcgccttcgctcaggcttttcccgctggccacaactctgggaccatccacatctacatctgggacaagggtttacctaaaggaaagggcctacttttgcttgctgaaatgagctcagctggcaaccttgcttggactacactactgcggttgtaaagagtgtcgagcaacatcctgctttgtaataggatgtagatcagtaaatcctgcatcttggtctccagcgccgtcgagcccagcattcatccatgccactcctggagtttagatggctgttgaaggagatgcccttgggcaacaatataatactcccatttttgtgagtgcatttttgccattcggttctcgttggatggctcacttgcttcttgtcgactggggattaggtgtgttgggttgtggccactggccggcgacagctaggaacaacaacctgtagtaggtgtcaattgaggcgacattgcgtcaggaagcagaagacatgcacacaattggtgaatgacaactttgcatctgtgatttggcccaagaaaatttgttcttaacacttggtgggaataaaaaggaacagagagatagtgatggatggccaggagaggcgagggccacctcaccgtagatggagcccacggcgcacgcaaggagtggcgcaccttctccggctccttgctctgctccaatggcgtcaatgtccacgtgccacgtcatggagcggatgcagcacaattggctagctgtatacatgcatctgttcaatccatggcttctcgacgctctcctaggttttggacttcaaaactttgtcatggtcaaagctagaagctaaatcacaagcagaaccatccgaattagctggagcagtttcattttcagcaagtgctggtcattcactgttaaggagtttgatccacaaacctgcacttggtctaccttgtgtacttatggaaggtcacttgtatgacagtaaagacacgaccacctaactgaacatgccctcaaaggttgcaaaaaaaaaaaaaaaaattcatttttacagttccaggttgcagtttttcatagcctacttgagacattacagtgtcctacagctgaacctgaaattatcttc

SEQ ID NO: 7861 - DNA, 3747 bp, Zea mays
gtctctacaaagatctaccgaatcaataaagatcaacgaatgagaaagttcgacctaaggaccggggaatcggcgcagcgatcgaaattaataccccctccctccccgccgattgcctcgccaaatcaacaccggtagtcaatccacgcaccccgggagcatcgggagggacgaaaaatccgcacgtcgccgaaggacccgagttcgatcgagaaggggaaaggccgaaagggggcaaccgcggtgggtagggagcgcttcttcctttcaattgggtgaatagggtccacggtccaccctccggtgacttatgtgattatcagcgtccctgccaagtggggcagccgagcaagcaagcccacttcaggcgagtccatgaggaccatgaccacgaggcggaccagcccaagcccatgtacgcgacaacaaaccctagccacgaggtcggcagtcggctcctcgaccggacgacgtggctgcgcatctgcaggaggaggaagaggtgaaatggtgaaggccgcgacgtggctcctcgatcggctcctctacctactcaagcaggacaagggcaacgacgccaacgccgcgcgtgaccgacggcgaaggaggcgtgctccggccggtggcgccgccaacgccgttggaaacgatgatggcgaggagcagcacctcaacacctttctcgacgctgcgaatgcgtcgtccgcctcctcaagggtgcagttcaggtgcgtgcttcgtttctcttgcagatgctttgctttttttctgtccgtgttggctcgtcctggtgggattgtgaccacgctgggttctgcggatctcggaacaggaatatggcgtcgcgcgcgcggtgggtggaggaagccggcgctgcggaggtggtggagaacaggggcaagctgtggctgaccaccggtgtcactcgggccggcaagctgtactacaacgttgaggagaccgggtacgcgtacgccgactgtttgatgaactgtctgtatctgtgcagcgtttgattgtactggcccgatagccttggtgtgctgtgcatccagcataccagcacaaatgctgcactgtgtgaatctctgaagccatttatactaccaataatgtactccgtattatacatgagttgcttgacgttgactttattttcaagcactcgagttttgctagtgaaggctcattgtctgatgaaaacgtgcaggttcttggccgaaatgggtgccttgattcttctcaatgataaggatgagacgataggaattgaagatatctatggcaagcttgctggaggaaattatgggtgctcctgggataccttccaggcttataagcacttgaaatcacttggatatattgttggaagatttggtgttccctggacaatgaagcatggtggtactcatcacaccattgctccccagatgaatatacttgagactgatcagagcttaaatagagttgatggggcctccaatgacataaccaaattgctcaaggaaatacagattgacgggatatgtccatcttttgaagtttatctgccaaatagcaagttcaaaaagtcatccccagggtgccctagtttcctcttatgtctattaaggtaatagtagtcctttatcgactcagttaattttatgatcatagatccaatgcagtttcatttttgtgcaattcatcttctgtggatctttcagtatttcagtgtagggtaactaggtctatcttctaaccaggcttttctttaattgtgtaattgtctgtctgtaaatatgaacacatatacaatgttactacaatatcttcttgattggaacatgtgagtgcctcctggtacatatgggctgagctcaaggttcacaatttcgtttagaatgatccgaatttcgttttgttgaccaaaatttgacttttgcattttttacattttgaaccgaaatccagttaaaaacggaccggaatcttttcctcgactagtagcgaaaatgaaataaaatggtgaatttcggtgatctcggaacgggaaagtaaaccctggctgagagcttcatggaggccaagggtggctctggcatccagctctacataaatggatttgttgtgctcatgtatctttttgcaatggtcacccatctgctagctatatgaactcaattgataactcagttgaagctgattgattctcagttcgttggactctgtcttgccaagctaccatcaaattatatgaaaaaaaattctgctaagagataaactgcaaagaataatgtcatgtaattcaagggtcacagcttatgaataaaacgaacatcataggaatcaaggttgatctcatatactctgtttatacatgtttctataacaacttcaacaatcaacatataatcccaaatgaaagatactgataattgttatcccaatctaacgcaggggtaaaccgccctcaagggttgaattggaagcagtggcacgtgatttcagaggcattcctctgaagtatgctcatgtggataatggacgggtcagctttctctcctttgatgaagttacactccccagcttgccctgatgggtagcagcagaacatgtgaagtgataaatagtgtgtttggtttgaggaatgaagtgatccatcttcttctcactcctcacttttttatttggtttgtggaatagaatgggttgatctatcatcactccatttctcataagctaataattagtatatacatgatgagtgggttgattccaccaaaattgatggaatgaacttatgatgcatcatctcatgaaacatagagtgactccataaaccaaacgcaccaaaagggtctgagcttcagaacaatcttgtcagaaatgataaagggtctcagcttcagaacagtgtcttgagatgcattcgccgcaagcgcagggggggcaaagtatttcagtactaacttttgaacatactaaagtatggaattccctggagtctcacaatccagcgatctgttgtacactccagattgtatgttggaaggagaaatcatgtctagtcttcttgttcgtctctgatgattttgtttctgaggctgcacctgtgactttcggatttccaactgcaacaaatgctactctcttcctagttcctagcctcaggcttcaggtgctcgcgagtactgagggtgtcaggcactgaacaaacaccgctttcactttctagttgcctccccgtctgagaatctccggcatcattgcagtagatcattttatctggttgctccgctagagcaacgtctggttggcgagttcgctccttttagacttttcatttctgaaattggtcacaaaatagggcaatagaataaaaaaccatgttttttatgttaaagggcatagaaccctaaaattagaactggtcatgttttacataataaaaaatgttgctaaaaacttttgtttcgttccataaagcaacatccaaatttcaaattaaccaacttttcagttataattatataaataagtaagcaaacattgctccatatatagctgcaatatgcaaaacctggtgcatttcagtcagaaccatgctagcttatcattcaagtaggctatgtgatgttagcacagaacacacgtctgccatatcaccataaaccatgccaccatgggtgactgcagctgttcaaataggctatgtgtttcatactggattgacgattcaggattgcagcacttatgatcctcaat

SEQ ID NO: 7862 - DNA, 1471 bp, Zea mays
atgtgattatcagcgtccctgccaagtggggcagccgagcaagcaagcccacttcaggcgagtccatgaccacgaggcggaccagcccaagcccatgaacgcgaaaacaaaccctagccacggtcggctcctcgaccggacgacgtggctgcgcatctgcaggaggaggaagaggtgaaatggtgaaggccgcgacgtggctactcgatcggctcctctacctactcaagcaggacaagggcaacgacgccaacgccgcgcgtgaccgacggcgaaggaggcgtgctccggccggtggcgccgccaacgccgttggaaacgatgatggcgaggagcagcacctcaacacctttctcgacactgcgaatgcgtcgttcgcctcctcaagggtgcagttcaggaatatggcgtcgcgcgcgcggtgggtggaggaagccggcgctgcggaggtggtggagaacaggggcaagctgtggctgaccaccggtgtcactcgggggggcaagctgtactacaacgttgaggagaccgggttcttggccgaaatgggtgccttgattcttctcaatgataaggatgagacgataggaattgaagatatctatgggaagcttgctggaggaaattatgggtgctcctgggatacctttcaggcttataagcacttgaaatcacttggatatattgttggaagatttggtgttccctggacaatgaagcatggtggtactcatcacaccattgctccccagatgaatatacttgagactgatcagagcttaaatagagttgatggggcctccaatgacataaccaaattgctcaaggaaatacagattgacgggatatgtccatcttttgaagtttatctgccaaatagcaagttcaaaaagtcatccccagggtgccctagtttcctcttatgtctattaaggggtaaaccgccctcaagggttgaattggaagcagtggaaaataatttcagaggcattcctctgaagtatgcccatgtggataatggacgggtcagctttctctcctttgatgaagttacactccccagcttgccctgatgggtagcagcagaacatgtgaagtgataaagggtctgagcttcagaacaatcttgtcagaaatgataaagggtctcagcttcagaacagtgtcttgagatgcattcgccgcaagcgcagggggggcaaagtatttcagtactaacttttgaacatactaaagtatggaattccctggagtctcacaatccagcgatctgttgtacactccagattgtatgttggaaggagaaatcatgtctagtctttgcttcttgttcgtctctgatgattttgtttctgaggctgcacctgtgactttcggatttccaactgcaacaaatgctactctcttcctagttccaaaaaaaaaaaaaaaaaaaaaaaaaaaaaaaaaaaaaataaaaaaaaaaaaaaaa

SEQ ID NO: 7863 - DNA, 2713 bp, Zea mays
  misc_feature (2231)..(2231): n is a, c, g, or t
aagaatatgtgaccaaaatttagcatccacagcccttcaagcaaatttctgctaaaaatgatagcaggggaatttcatgattgaaattgcattttgctgaaactattcatgtcgacatggagtggtagcaaaggatggcaattaaggaggatatgactgtgacagcgctagggattgctgactcttgcagtacccatgtcatttcccatgtgctgtgtgccgcctttggatgggatgggagcatgggacgctcgtgcggtcgcgggctggcggcatcgtggcctcatctcgcgctcaagctgctccccgtagtcccattgagaccaacggcagcgctcgcgttcgtgtacgtttatattatttttttataagggagcaagagggctcggcggcagcggcagcggcgacggcgaccgcgacggcagtggcagtggcagtggcaggctgtcagccgtccctatcttgtgtgtcaagcgcgaactccctatctcgtgtgtcaagcgcgttcgcgtgcgttctaggcacaggcagccgaggcgagccccttccgctcagtggccgccgccggaccgtggacgcagctagcccatcagcccatggcagggacggacgtcgcaggctccgcacgcggctccgatgccgcgctcggcaagacgggcgaaccacccgccgcggcgcgctctggtactccacctctcctactgtgtttttgccctctctatcgtatcggtcaacactcatgtgtattcgcttgcccggccggcgttccactgacatgatttcaatccgtggcctgttttctcgttcctcaggcgcagccaagaaggtgactctcgctctgctagcctccttctcggcgctgctgtacagccagattcagccgccgccgtctaagatccccggcacgccgggcgggcctccggtcacggcgcccagaacaaggctcaaggacggccggcacttggcgtacctggaatccggcgtcccaaaggagaaggccaagtacaagatcatattcgttcacggcttcgactgctgtagatacgacgtgctgaatgtctcccaggtgactactatgagtttcttcgacacagtaaccgcagtcactcttcttttcactttcagaagattcaagtgtttggctttgtgatgaactcatgcaggggctgttggaagagctgggaatttacctgctgtcctttgaccggcccgggtacgccgagagcgacgcccacccggcccggacagagaagagcgtcgcccttgacatcgcggagctggcggacaatctccagctcggccccaagttccatctcatcggcttctccatgggcggcgagatcatgtggagctgcctcaagtacatcccgcacaggtgggtgctactatagctagcctagtaggccaactgaatgtcagtacagagtacttgagcttttccctgtcatgtgttttcgtcttggaatcggtccaggctcgccggcgtggcgattcttgccccggtgggcaactactggtggtccggcttcccgccggacgtgttcaaggaggcgtggcgcgtgcagtttccgcaagaccagcgcgcggtctgggtcgctcaccacctgccgtggctgacgcactggtggaacacccagaagctgttccgcggatccagcgtcaaggacggcgaccctgccatgctatccaaggaggacaggcttgtagctgacaagttcgagaagcgaacctatgaggcaagcggccattggcgtcgtaggctattgaaatcatgatctctgaatccaactctgctctatttttcttccccttcagaagcaggtcagacagcagggagagcacgactcgctccaccgcgacatgatggtcggtttcgggaagtgggactggagcccgctggagatggagaacccgttcgccggcggccaagacgaggtgaaggtgtacctgtggcacggcgtcgaggacctctacgtgccggttcaactgtcgcggtacatcagcgagaggctcccatgggtcatctaccatgagctcccgacggccggccacctcttcccggtcgccgacggcatgcccgacgctatcgtcaggtcgcttctgctcggagatgagtgatcagtatttaggatgcgcggatccaggacttgggcactttttgcagcttcatcagtaataaaaatacactcggaggtcgagatctgtatgatccgtggtccttaaaagcttcnggaatggcgttttgttgtcgatccccattggcgatttggacacgatggatcagcttacccaattggcacaacgcaacatcggagcggcatggccgacaaaacttgcatatccgagaaagtgacgtcaagtttagaactttatgcacctttttactcagaactatgaagtttccactgaatttaacttctgatgttagagaaccacaaccacttaccggctgtttggttctctatttgagcgtgcaaggcccatgaggtgcaacatctcgacgacccgttttgtttggatacctggatacagtttcggaccaggctctgtgcatgcaaatcacccgtctcagcctggctaagtggatacggacgaaatctgcgttcgtcgggagcctggctgtgctcattcactacattggctcacagccgtcactcgccgcattcgctcgagcgggcgaaccccctgctagggtttgctgtcaacgtcctcg

SEQ ID NO: 7864 - DNA, 1803 bp, Zea mays
atcgtggcctcatctcgcgctcaagctgctccccgtagtcccattgagaccaacggcagcgcgcgcgttcgtgtacgtttatattatttttttataagggagcaagagggctcggcggcagcggcgacggcgaccgcgacggcagtggcagtggcagtggcaggctgtcagccgtccctatcttgtgtgtcaagcgcgaactccctatctcgtgtgtcaagcgcgttcgcgtgcgttctaggcacaggcagccgaggcgagccccttccgctcagtggccgccgccggaccgtggacgcagctagcccatcagcccatggcagggacggacgtcgcaggctccgcacgcggctccgatgccgcgctcgggaagacgggcgaaccacccgccgcggcgcgctctggcgcagccaagaaggtggctctcgctctgctagcctccttctcggcgctgctgtacagccagattcagccgccgccgtctaagatccccggcatgccgggcgggcctccggtcacggcgcccagaacaaggctcaaggacggccggcacttggcgtacctggaatctggcgtcccaaaggagaaggccaagtacaagatcatattcgttcacggcttcgactgctgtagatacgacgtgctgaatgtctcccaggggctgttggaagagctgggaatctacctgctgtccttcgaccggcccgggtacgccgagagcgacgcccacccggcccggacagagaagagcatcgcccttgacatcgcggagctggcggacaatctccagctcggccccaagttccatctcatcggcttctccatgggcggcgagatcatgtggagctgcctcaagtacatcccgcacaggctcgccggcgtggcgattcttgccccggtgggcaactactggtggtccggcttcccgccggacgtgttcaaggaggcgtggcgcgtgcagtttccgcaagaccagcgcgcggtctgggtcgctcaccacctgccgtggctgacgcactggtggaacacccagaagctgttccgcggatccagcgtcaaggacggcgaccctgccatgctatccaaggaggacaggcttgtagctgacaagttcgagaagcgaacctatgagaagcaggtcagacagcagggagagcacgactcgctccaccgcgacatgatggtcggtttcgggaagtgggactggagcccgctggagatggagaacccgttcgccggcggccaagacgaggtgaaggtgcacctgtggcacggcgtcgaggacctctacgtgccggttcaactgtcgcggtacatcagcgagaggctcccatgggtcatctaccatgagctcccgacggccggccacctcttcccggtcgccgacggcatgcccgacgctatcgtcaggtcgcttctgctcggagatgagtgatcagtatttaggatgcgcggatccaggacttgtgcactttttgcagcttcatcagtaataaaaatacactcggaggtcgagatctgtatgatccgtgtccttaaaagcttcggaatggcgttttgttgtcgatccccattggcgatttggacacgatggatcggcttacccaattggcacaacacaacatcggagcggcatggccgacaaaacttgcatatccgagaaagtgacgtcaagtttagaactttatgcacctttttactcagaactatgaagtttcccctgaatttaacttctgatattagagaaccacaaccgcttatgctcttcaatggatcgaacaaaactccagtgtatgtgtatgg

SEQ ID NO: 7865 - DNA, 1344 bp, Zea mays
gtcgtataattgaatacagtgctgaccaacatgggaccccctcggccccccacgcgttggaaaattgcactgccgaagagaaggcatatgtgtttgcagaggttcttcctcatgcttcatcactaatgactgacgttttcgggaattatgtgatccagaagttttttgaacatggaactcgtgagcaaaggagggatcttgctaccaagctcgttggtcatgttttgcctctgagtcttcagatgtatggctgccgtgtaatccagaaggctcttgaagttatggaacttgaccagaaaatagatctagttcatgagcttgatggacatgttatgagatgtgttcgtgatcaaaatggaaatcacgttatacaaaagtgcattgagtgtgtccctacagaacatattggttttgcagtatctgcttttcagggacaagttgctagcctttcaatgcacccatatggctgccgtgtaattcagagagttttggagcactgcggtggtacctcacaaagccagtgcatagtagatgagatattgcagtcggcgtgcgtccttgcgcaagatcagtatggcaactatgttacacagcatgttctagaaagaggaaatgctcatgagaggagccaaattattattaaattggctgggcaggttgttaccatgagccaaaataaatttgcatcaaatgtgatagagaagtgttttcaacatggtgatatggcggagcgggatctcttgatcaggcagattgtggagcagacagagggcaatgacaatttgctggcaatgatgaaggaccagtatgcgaattacgtggtccagaagatactcgaaacatgcaatgagaaccagcgggaactcctggtcagccgtgtcaagggccacatgcaagcattgaggaagtacacatacggcaagcacattgtaagccgagttgagcagctctgcggcgacggaaccgccgagccggattcttgaaatgaacccgcctaattcttcccaggccaggggtgtgagggtgtcttgttcttttgctcagtccatcagtggagaaagcagaacagatcaagtccacctctggtgcttccaaacagactaacaaaactgtcatcgaagattgtataggtgtgactcgcttcaggatagtcttgaggttctagaacaggaacttagtggtgtgcatcagtgtatctatgttagggtgtgcctatttacagaataacagtggttggctagctgtgtgcagaagggagtttagcgttatggtttgtatgtgatacatattatgcctggtaatgtatttgctttcttgccccgccaagtgtggggtaaaatgcat

SEQ ID NO: 7866 - DNA, 1935 bp, Zea mays
cgcaaaccctatcgcctatccctctcgcggtcttgcctcggtctctggcggcggcaccgccgttttacactcctcctccttcgacaacccgtcgcagtagcgtccgtctctggtgtccggctgtccggctctggactcccgacctcgacatcaggatctgcgcctcccgaccggtatgtgggggctctgaagaaggtgcagaaggatctgggcgcgtcggtgttcgagccgctggtgcaggcgtacgccgccgtcgggaagttccctgggatgtggcagcggctgaagatcgagaacgtggaggtcggggaggggacggcccagctgcttgactctatctgcgccgatcaatagcccaagcacgtcctagaggcggcgacagaaatgagttgctggcaagtttgacaaaacaagcagacatggtcttggtggctcagcaggaattaatcacccaaaaaaacagttacaagttgggttcatgcatgtcttacgtcaaggattgtactccccgttaaactgttggttcgggccagtggccggcccggtacgttcaggcccaccgggcgaacgggccggcccggcacgatttatccctgtgcgtgccgggtttgggcatgtcgctaggcacgtgggccagcacgacccggcccgaagcatcaacgggccgtgcctggcccggccctatccgtaccgggccgaaacgggttcggaccgggtccgtgccgggtggcccgtttggacatctataggtccctatttggacctgaagtgaagcattttaaagttgaaggacccagattctcacttcgagagtttatgaacctagatgagaatctaaggctctggaagttatggaacttgaccagaaaatagatctagttcatgagcttgatggtcatattatgcgatgtgtccgtgatcaaaatggaaatcacgttatacagaagtgcattgagtgtgtccccacagaacatattggttttgtagtgtctgcttttcagggacaagttactagcctttcaatgcatccatatggctgccgtgtaattcagagaatcttggagcactgcggtggtaactcacaaggccagtgcataatagacgagatattacagtgggtgtgcatccttgcgcaggatcagtatggcaactatgttacacagcatgttctagaaagaggaaaagctcatgagaggagccaaattattactaaattggccgggcaggttgttaccatgagccaaaataaatatgcatcaaatgtgatagagaagtgttttcaacatggtgatattgcggagcgggatcttctgatcagacggattgtggagcagacagagggcaacaacaatttattggcaatgatgaaggaccagtatgctaattacgtggtccagaagatacttgaaacttgcaacgaggatcagcgggagcttctgctcagccgcgtaaaggatcatatgcaagcattgaggaagtacacatacggcaagcacatcgtaagccgagtcgagcagctctgtggcgacggaactgccgagtcaggttcttgaaacgaaccgccgcctaattcttcataggctggagggtgtcctgctcttttgctcattccgtcagtgacgaagaaagcaaaacggatcaagtctaactctggcgcttcagaacagactaacaaagctgtcgtcgaagattgtataggtatgactctgttcagggatagtcttgaggttatagaacagaagggtagtggtgtgcatcagtgtatctgtttactggataatagtggttggttaggtgtgtgcagaaaaagtttagcgctatggtttgtatgtgatacatattaactgtgccttggaatgttcatatgttgtcctgattgcgtgtgatatctctcgttcagttcaagttgcgttttctgcaaaaaaaaaaaaaaaa

SEQ ID NO: 7867 - DNA, 1740 bp, Zea mays
cattgggtaccgcgcgcggcgccgcgcaaaccctatcgcctatccctctcgcggtcttgcctcggtctctggcggcggcaccgccgttttacactcctcctccttcgacaacccgtcgcagtagcgtccgtctctggtgtccggctgtccggctctggactcccgacctcgacatcaggatctgcgcctcccgaccggtatgtgggggctctgaagaaggtgcagaaggatctgggcgcgtcggtgttcgagccgctggtgcaggcgtacgccgccgtcgggaagttccctgggatgtggcagcggctgaagatcgagaacgtggaggtcggggaggggacggcccagctgcttgactctatctgcgccgatcaataggctctggaagttatggaacttgaccagaaaatagatctagttcatgagcttgatggtcatattatgcgatgtgtccgtgatcaaaatggaaatcacgttatacagaagtgcattgagtgtgtccccacagaacatattggttttgtagtgtctgcttttcagggacaagttactagcctttcaatgcatccatatggctgccgtgtaattcagagaatcttggagcactgcggtggtaactcacaaggccagtgcataatagacgagatattacagtgggtgtgcatccttgcgcaggatcagtatggcaactatgttacacagcatgttctagaaagaggaaaagctcatgagaggagccaaattattactaaattggccgggcaggttgttaccatgagccaaaataaatatgcatcaaatgtgatagagaagtgttttcaacatggtgatattgcggagcgggatcttctgatcagacggattgtggagcagacagagggcaacaacaatttattggtctgtttggcaatgttgtaaaagtgttccctccattggcccctcctcccggccccgaacgggtcggggttctggaaggtagggctaggacatggggacctgatctcagttcggtacagccaatcagataacaccatgagtatctcagttctgctattccagctttctgggagctgcgaatcctatggattaccaagacatgggatctctgtaaacttatttcttcctgtgttgatgttagtttatatttcctaatcaccttttatattcaatcaggcaatgatgaaggaccagtatgctaattacgtggtccagaagatacttgaaacttgcaacgaggatcagcgggagcttctgctcagccgcgtaaaggatcatatgcaagcattgaggaagtacacatacggcaagcacatcgtaagccgagtcgagcagctctgtggcgacggaactgccgagtcaggttcttgaaacgaaccgccgcctaattcttcataggctggagggtgtcctgctcttttgctcattccgtcagtgacgaagaaagcaaaacggatcaagtctaactctggcgcttcagaacagactaacaaagctgtcgtcgaagattgtataggtgtgactctgttcagggatagtcttcaggttctagaacagaagggtagtggtgtgcatcagtgtatctgtttactggataatagtggttggttaggtgtgtgcagaaaaagtttagtgctatgctttgtatgtgatacatattaactatgccttggaatgttcatatgttgtcctgattacgtgtgatatctctcgttcagtacaagttgcgttttcgggggcccg

SEQ ID NO: 7868 - DNA, 934 bp, Zea mays
caagctgcatctgcatacccatctgatcagaggcttccactgccaataactggctttcctaattctcctacagccagaagaggagggactgttccaaattatcaaggcatctcatcctacattggagtgccaatgacttatcctactagtccagtgtttcagggacaaacattgcctggagtattgcctcctgttaggagaaacgactctgctggatttctgcccccctcaagaaacatcactggtagccctggaattcaagggcagcgagcaagacagaagtttgatgaatcaaagacctgctctttcttagaagagttgaagtccaacagagcgcgcatggttgagctttctgacatcacaggccgtgtagttgaatacagtgctgaccaacatggtagccgattcatccagcagaagttggaaaactgcaccgccgaagagaaggcatctgtgtttgccgagattcttcctcatgcttcagcattaatgactgacgtttttgggaattatgtgatccaaaagttttttgaacatggaactcgtgagcaaaggagggatcttgccaccaagcttgttggtcacgttttgcctttgagtcttcagatgtatggctgccgtgtaatccagaaggctctggaagttatggaacttgaccagaaaatagatctagttcatgagcttgatggtcatattatgcgatgtgtccgtgatcaaaatggaaatcacgttatacagaagtgcattgagtgtgtccccacagaacatattggttttgtagtgtctgcttttcagggacaagttactagcctttcaatgcatccatatggctgccgtgtaattcagagaatcttggagcactgcggtggtaactcacaaggccagtgcataatagacgagatattacagtgggtgtgcatccttgcgcaggatc

SEQ ID NO: 7869 - DNA, 1990 bp, Zea mays
ttctgccggggctgcggcctgcgcgcgtacgtcttggcctcttccaagcgtggatggcacgagaccattacctagaacatcctcatcctgcaatgacactacctgacaaccacaaacgtcgtctccctccatggcactccgccacggcaataattgaagcaacgctgatctgttgcatctccggcgaggcagagcgcagcagctcgtgcatatatctagctaagccaattgcgcaccaccgcgcgcgccaccccaagatccccgtgccttttcagagcatctctccgtcgccgtgacaatgaagcagcagcagaccgtcatcctgtacccgagccctggcgtcggccacatcgtccccatggtgcagctcgccaaggtgtttctgaggcacggctgcgacgtgaccatggtgatcgccgagccagccgccagctcgcccgacttccgcatcgtcgacctcgaccgcgtggctgcctccaaccccgccatcaccttccacgtcctccctccggtcccgtacgccgacctcgccgtccccggcaagcaccatttcctcctcacgctgcaagtgctgcgacggtacaacggcgagctggagaggttcctccgctccgtcccgcgcgagcgcctgcactccctggtggtcggcatgttctgcaccgacgcggtcgacgtcggcgcaaagctgggcgtccccgtgtacacgttcttcgcctcggccgccgctactctggccgtcgtggcccagctgccggcgttgctctccggcaggcgagcgggcctcaaggagctcggggacacgccactccagttcctcggcgtcccgccgttcccagcgtcccatctcgtcagggagctgctggagcacccggacgacgacgagctgtgcaagaccatggtggacgtctggaagcgctgcacggacggcagcggcgtcttggtcaacacgttcgagtcgctggagagcccggccgtgcaggcgctgagggatccccggtgcgtgcccggccgcgtgctgcccccggtctactgcgtggggccgctgatcggtggcgacggcggcacaagagcagcagcggagcaagagcgcgcggcggagacgcggcacgagtgccttgcgtggctcgacgagcagcccgagaacagcgtcgtgttcctctgcttcggaagcagatgcgcgcactcggctgagcagctaaggggcatcgccgtcggccttgagaggtccgggcagcgcttcttgtggtctgtgcggacgccggccggcaccgacggcggttcggagaatctcggcgcgctctttccagaggggttcttgcagcggaccaaggaccggggcctcgtcgtgcggtcatgggcaccgcaggttgaggtgctacggcatccatcgacgggcgcgttcatgacgcactgcggatggaactcgacgctggaagccatcacagcaggggtgccgatgctatgctggccgttctacgcggagcagctgatgaacaaggtgttcgtgaccgagggcatgggcgtcggggtggagatggaggggtacacgacgggcttcatcaaatccgaggaggtggaagccaaggtgaggctggtgatggaatctgaggagggcaggcacctcaggggtcgagcggtagcactcaagaatgaagcacaagcagcgctgcgggatgacggcccatcggagacctcgttcgccaggttcctctttgatgcgaagaatcttcagggacacctcggtcacggatcggagtgaattttctttaattttctattgaggccttgttcgaaatttatattaggaataagatgcaggaagggttcttgaacttggcagtcatttgagtctcagggtcgacaatgtatcaaatacatatgtgttggagacttgttctcaaatgctataagttaagaacaaggcaacacaaaaaatgttaaacgttaaagtccttcgtccttcggaacactcgaggagggggcccggtgc

SEQ ID NO: 7870 - DNA, 2441 bp, Zea mays
aagttaggccagtggcagctagcttacgttaatttcatcccaacagtacgctagctacagtgtttcttgcttctattacaagccattattcccatcccattcacgcgtgtgaaaatcaacacaaacgctaaaatttcatcgtcgtacttgtgatgattgcttttctactaacgcgcgactgatgagtgatgaatatccatggtcgcagacatggcgaagctgagcacgaacgagtggtacttcttcagcttccgcgaccgcaagtacgccacggggctgcgcaccaaccgcgccaccaagtccggctactggaaggccaccggcaaggaccgcgtgatccacaccccctgcagctggcccgccgccgccgccgccgccggccaccaccgcgccgtcgtcggcatgcgcaagaccctcgtcttctaccgcggccgcgcccccaacggcgtcaagaccagctgggtgatgcacgagttccggatggagaacccccacaccccgcccaaggaggactgggtcctgtgcagggtcttctacaagaagaaggccgacgccatggactatgccgactgcagcgaccaggacgccatcgccgtgcatgtgcctcgcggcagcgctgacccgggctactgctactcgcctcctccgttccccgcgctcggtgtcggtggcagccaccaccacggcagctccctcaacgacgacctccacggcggcatggcgctgcttcagcagcagcagcacaacggcgtgttcgacttccacggcggccagcctcaccctcacggcggcggcggcggcggcctccttgccgggccgccggctacggccgtggggtcaagagacggtggcgatcagtgtggcagcggcgtgctcatggacctaggactcgacgaccactacacctacaacagctacaacagcctgctgcagatgtgatcgttaatgcatgcatgcaagcaagctatatagctagctagctatagctgctcccttgcgttaaacgttgctcatggtcatggccatgcagatttctttcgatctcgtcatccggttcttactatactattcgttggtgatctctttgtgcagatcgagcccgtctctgcatgtgctgcactcgtacgtgtagttaatctctagctacatatcagtagtgctagttgtggatctgttgtgtttgatttaaattgctggatttggtcgtcgttaggatgtgggtgagctgttgtgactaatgtacatacttgaaaagtttggaaccccttttctcttcttgcttttttaacatatcagtatacgttattgttacctgttgtaactatatgtataagagactttcttgagaaattatactccctccgtcctaaaatagtagtcgttttaactcttggttttatgtctatattcaaataaataataaatatagacacatataaaacacatgcatcaagaattatatgaacccacttattctctaaaacgactactattttggagaaccgagtgagtatataagttctctccaaatcctcttgccaaacaaacaacatatatgtttagtttagtattgacagcaatatatcaaatacgaaaaaagttattcaggcaataacaaaacgacctatatttattttcagagggggcatgcagtatacatatatatatatagttagttaccatatatacatatggcgatcagcttcggattaaagcagttgttcgagctgctatagctacaatttgtggagacaaaaaaatataaaaaatatagaatctcgtatggattaaaaccaagcgaaggacgccgccttaaaaaaaagaagtaactgtctttcatagataccctaccagcagctagcatgcacttttctgtgatttgatgtcaccatgcgtaaaaaaatctgtctgacacctgacagggcaatgcgatgcttgtaggatgcatggtttacgttaattaaacaaacacacggtgatacctagctattagatctatatctcaatgcaagcaggggacggttgcagtcatttttcacactactcactgttgcatcacggacttgcagccctggttcctgatctgatcacagaacgacacacacgcacacacaataatgccggtggtaagatgcatgcatagcatatatgtagatgctgcgaacttgcattgagtgcagatatactatatatacggctaggtcaaattacccatcatccgatccctagcttggcgctattatattctcgctgctgcgattagtgccagactgccagctaggctccaccagtccacgtgtgtgtatactacgtttatacatgtatttggagaacatgttatttgtacatgcagcaattatctgatttctcagctgaacgaacagtgtgatgatgttcaaattggtcactgctcagccaacgcctgagtacagtttaggtta

SEQ ID NO: 7871 - DNA, 1270 bp, Zea mays
  misc_feature (63)..(63): n is a, c, g, or t
acacacacacacttgtaccgcctttgttcggagagaatcatcgagtcggatagagtcctgggnctccaggcgctgcgtactgaacgaagaggcgtgtctcttcgatcgacctccaggcttccagctagctagctagcgagcgatggcattgagggagatcgagtcgacgctgccaccggggttcaggttctacccgagcgacgaggagctggtgtgccactacctccacaagaaggtggccaacgagcgcatcgcgcgggggacgctcgtcgaggtggacctgcacgcccgcgagccgtgggagctcccagaggtggcgaacctgacgggcaccgagtggtacttcttcagcttccgggaccgcaagtacgccacggggtcgcgcaccaaccgcgccaccaggacgggctactggaaggccacgggcaaggaccgcgaggtgcgcagcgccaccaccgccgccgtcgtcggcatgcgaaagacgctcgtcttctaccggggcagggcccccaacggcgtcaagtccggctgggtcatgcacgagttccgcctcgacaccccgcattcgccgccaagggaggactgggtgctgtgcagggtgttccagaagacgaaagccgccgacggcgacggcgatggcggcgcccaagacggcgactcctcgtccccgccggccgccttcaccggcccgtcacggccacgcgccgtgtcagagccgccggaccattccgcgccgccggcgggaggaggctactactacggcctcgcgttcgggccgcggcaggtggaggtggcgcagcagcagtgttacggcggcggcggcgccacggtcgccgaccaccaccacggcttcacgcgagacagcgggggcgctgcagggtttggcgcgacgtggggacgaggagtcgccggcggtgagtgcggggctggctacctcgacatggacggcgcctttgacgtcatgatggccggctgctttggcggtggagacatggatgagttccctcaagtgtggaggtgatcgattgggcaacgtcacggggttattaccatcctcttgaaagaggagaatacatattgttcttactggagacactgggtcagttaaatttattggttgtttaatacacatggggtttggctggtagattagaatgggtttgaaatgctgtgagctcgacaaggttcattgtgaacgtgaactatcaaatgtaaattaattgggaaatcctttcttttctatattatttagtgtatagagttaattgat

SEQ ID NO: 7872 - DNA, 1388 bp, Zea mays
tcaagagtcaagatacatcagagtagctcattgcatagtttcagtgtgtaattatatatttgtctcctctagtgcagtactagagtctagtctagctagtttagattgagtctgcttgttcatctagcgcgtgttttggggtaggtagctagctagctagacacgcgcacccggacaaacgcacgcagcagacaccaagcaggaatcatcggcggcaggcggagggatggggctgagggagattgagtcgacattgccgccggggttcaggttctatcccagcgacgaggagctggtatgccattacctctacaggaaggtggccaacgagcgctccgtgcaggggacgctggtggaggtcgacctgcacgcgcgggaaccatgggagcttccagacgcggccaagctgacggcgagcgagtggtacttcttcagcttcagggaccgcaagtacgcgaccgggccgcgcacgaaccgcgccaccaagacgggctactggaaggccaccggcaaggaccgcgaggtgcgcgacccggccgcccgcgccgtcgtcgtcggcatgcggaagacgctcgtcttctaccagggccgtgcccccagcggcgtcaagtcatgctgggtcatgcacgagttccgcctcgactcgccgcgtacgacgacgacgccaccgaaggaggactgggtgctgtgcagggtgttccagaagcggaaagtcgacggcagcgagcaagacaacggcgtctccccctcgccgccggtctttgccggcgcatcgcagtcgcagggggtcgtcctgccgccggaccagccctgcgtggtggacgcgtacgtcgtggtagaccagccgggctcttcttccgtcggactcgcgccgccgcaggagaacctcggtagcggcctggacgcgttgctgacgaacggagcgatgtggcagtacacctcgtcggtcttcggtcacttgttgccgcaggaggcgaccagctccccgccggtgatggacctaggctccaggggaggagaaggaggagactacgggtgcagcttcttctacgacagcagcttcgaggacatggccaacatcgggttccgacaagggtggatgggctgatccaggaccaggaagcacacgtacgtgcgtgcagtcatgcgatatggaatgtgcatttgtgaaggaagtgattgaattaattgattccattagtagtagcaccctctagtgttgtacagtaggtacgtatatagtgtgagattagattattattgggaattgttagagtgcaccggcctctcaaatccaaagaagtaacagcggaaagaaaagctagtagctagagcacacatgtatatatttgcacaaggtagatggtttgataaaaaaaaaaaaaaaa

SEQ ID NO: 7873 - DNA, 1594 bp, Zea mays
acccaacaccccagtatcctgatgcggcttagcgcaccgaggtagaccgagcgagacagccagccagcggggcaagctgaaaaacctatcttctatcaccacctcggagcccgagtggaaggggaaggcaggaatcgccccgcacgcgcccccatccgcctgccggcgacggcccacatgccgaccgcctacagcctccgcgcgccgccctccaccgcgcagcagcgcctcaggctgcccccgccaccgctgccgctttgcccggcgggtggaggggccgcccgccggaggagggttgtcggggtagcgtccgcgtccgcgtcgcccttcgacgagctgtacgcgcgggggaggcccgcacatggaccctccaagaaatccatgctctggaacttgatccaggacatagagcctctggaccttagtgtcattcagaaagatgttgctcctgaaacggtagatgcaatgaagaggactatttcgggcatgttgggtctgcttccatctgatcagttccgtgtcattgtagaagctctttggaatcccttcttcaagttattggtatcttcaattatgactgggtatactctgcgaaatgctgaatacaggctttcttttgaaagaaatcttggactgtctgaagaagttgcagaatgcccaaaaagtgatgtcattgaagataatcatcatgacatcaatttgggtacacctgtcactatttttagattagcagaagaagacatgccccaggaccctgaaaaacgagatgacgaatcatcatatgaaaatatgggagaagagctcggcgacttaaccctgcaggcagaagagtatattattcagatgcaatctcgtttggatgccatgaaaaaagagctacatgatctcaggagaaagaattctgctctgcagatgcaacggtttgttggggaggaaaaaaacgacttgctggactatttgagatcactaacaccagagaaggttgctgaactatcagagtcttcatgtcccggcgtgcaagaagcaatccattctgtggttcatggtctgctggctactctttcccccaagatacactcaaaggcccctccaccgctagataacacttctggaggggtcttaaaccttgggggcgaggatgatgactgtgcagaacttgtggagaatgcttccctcccatttcagcccctaatatctgttccccgtgattatcttgcacgcttgctcttctggtgcatgctgctgggtcactacatccggggtctggagtacccgttagagcttgctcggcttctgcgaatatccagcgtgggttctttctctggtggagatgatcatgttgtttgagggtaccacgtctactgatattcctcaccgggaagaatggaaaggaaagccctggtcaagaaatgggccatatggcagagctgcagaggtgtccgttacactgctgagctatatagttgtagttcctgtatattcagaaaacagtcactcggttgtaaagctagtgttacatatgcacgtgaaccattttctttttcttcctttgatgttgtgccgtataaaaagaatttggtggttcgttggtggt

SEQ ID NO: 7874 - DNA, 1695 bp, Zea mays
cggccgggatctccggccgggatcttctatcaccacctcggtaccccgagggaaagaagaagcggaggggaggcaggaatcgcccgcccgcgcctccatcgccctgccggcgacggcccacatgccgaccgcctacagcctccgcgcgccgccctccgcctcgcagcagcgcctcaggctgcccctaccgccgcccccgccgccgctgccgttttgcccgggtggaggggccgcccgccggaggaggggtgtcggggtggcgtctgcgtccgcgtcgcccttcgacgagctgcacgcgcgggggaggcccgtacatggaccctccaagaaatccatgctctggaacttgatccaggatatagagcccttggacctaagtgtcatccagaaagatgttgctcctgaaacagtagatgcaatgaagaggactatttctggcatgttgggtcttcttccatctgatcagttccgtgtcattgtagaagccctttggaatcccttcttcaagttattggtatcttcaattatgactgggtatactctgcgaaatgctgaatacaggctttcttttgaaagaaatctagaactgcctgaagaaggtgtagaatgcctaaaaagtgatgtcactgaagataatcatcataacatcaatttgggaagacctgtcactatttttagattatccgaagaagacatgcctcaggaccctggaaaaaccgatgaagcatcatcttatgaaaatatgggagaagagcttggtgacttaacaccacaggcagaggagtatattattcagatgcaatctcatttgaatgccatgaaaaaggagttacatgatctcaggagaaagaattctgccttacagatgcagcagtttgttggggaggaaaaaaacgacttgctggactatttgaggtcattaacaccagagaaggttgctgaactatcagaatcgacgtctcccggtgtgcaagaaactattcattctgtggttcatggtttgcttgctactctttcccccaaggtacattcaaaggcccctccaccgctagataacatttctggtggtgttctaaaccttgggggcgaggatgatgatcgtgcagaacttgtggagaatgcttccctcccatttcagcccctaatatctgttccccgtgattatcttgcacgtttgctgttctggtgcatgctgctgggtcactacattcggggtctggagtaccggttagagcttgctcggcttctgcgaatatccagcgtgggttctttctctggtggagatgatcatgttgtttgagggtaccacgtctactgatattcctcaccgggaagaatggaaaggaaagccctggtcaagaaatgggccatatggcagagctgcagaggtgtccgttacactgctgagctatatagttgtagttcctgtatattcagaaaacagtcactcggttgtaaagctagtgttacatatgcacgtgaaccattttctttttcttcctttgatgttgtgccgtataaaaagaatttggtggttcgttggtgtttatctcgtggtagcataataggcatccttgtattctagttgtatgtttctggtggttgtgactgctgtccagtgtccatttagcttttttgtctattcttgattcgagtaaagcttaacttctcggtttggaggtcgcaaaaaaaaaa

SEQ ID NO: 7875 - DNA, 3186 bp, Zea mays
cgtagcttattgattgtatctaacgaattcataacttgctccctgcaaaataagcaatttaaattatttctctctcggttatgggatgatatggtagaattttatttaattggtcaacacttaagctactagagaagccaagctcaaagagctgtagatcgtcttgagctcagcacaagttttggttgaatcggactcggacacaagcttgagctgagctgaagcaagcctaggttggtattcaagttttgtgtgctcgagatcagctcacaacgctggagctcatctcaagcatgggtaggagttaggacatttatcgtgttactcttgtacaatagcacatcataagtggaaacaaaagcccgagcagggcacaagtaagctcagtgtgcaagcttggtaccatagatttggttagtctttggcacactgctcaatctctgcagtcttcttgctggcccattcaattaactaattgagcaagggtcaagccgagcgggaatatcttgttgagctagacaattttttcagctcaacaaaaatatgaaaagaatataaggacatcttagttcactacttcacttgttgaaaaccatttgagacctattcaattggataccctgattcaatctgtgcattatttttctccaatagattgaataggactatgtatacggatggtcttggtttttaatatgacatcggtttggatctaatccaatgatacaacatacatataggctttctcgaaaacaaagagaccaagactataacattggtatgtccaaagtgcaacatggtttacgataatcatcagtttaagtcacatactgtggaagctaccatatatttatgatttgtttgattcaagtttgcaagacaagggtacaaagaaactcaacagatgtattgatatccaaataaccatgatctaatagttttttacatatgctgtgaggccttgcaactaatggcttctgaagtacacttacctaccatatttgacaaaaaaatgacctccagtttctaattcgacaagtactcaaggcaggtgtttatgaactcaaggacacttacctaccatgtttatggaaaaaaaatctaaaccaactgtacctctatattttgtgtagttggacatgtaaaaaagcatttatcattttgaatctgacaacttgtgttgcgtcgcatattgaactggccaggcttattgcttttatttgtattgcaggagttacatgatctcaggagaaagaattctgccttacagatgcagcagtttgttggggaggaaaaaaacgacttgctggactatttgaggtcattaacaccagagaaggtatattctagattgggatctcatggaccatgagaagggtcactgttttgttacatttcatctgcttaatgaataaattatgaccaaatagtctaacacaaatcccaagcttaaaagaaaaaaaggaagttctctcctgctcaattacctaacctagctgctttgtacaggttgctgaactatcagaatcgacgtctcccggtgtgcaagaaactattcattctgtggttcatggtttgcttgctactctttcccccaaggtacattcaaaggcccctccaccgctagataacatttctggtggtgttctaaaccttgggggcgaggatgatgatcgtgcagaacttgtggagaatgcttccctcccatttcagcccctaatatctgttccccgtgattatcttgcacgtttgcggttcgaggtaatgatgatacgtgcagaacttgtggagaatgcttccctcccatttcagcccctaatatctgttccccgtgattatcttgcacgtttgctgttctggtgcatgctgctgggtcactacattcggggtctggagtaccggttagagcttgctcggcttctgcgaatatccagcgtgggttctttctctggtggagatgatcatgttgtttgagggtaccacgtctactgatattcctcaccgggaagaatggaaaggaaagccctggtcaagaaatgggccatatggcagagctgcagaggtgtccgttacactgctgagctatatagttgtagttcctgtatattcagaaaacagtcactcggttgtaaagctagtgttacatatgcacgtgaaccattttctttttcttcctttgatgttgtgccgtataaaaagaatttggtggttcgttggtgtttatctcgtggtagcataataggcatccttgtattctagttgtatgtttctggtggttgtgactgctgtccagtgtccatttagcttttttgtctattcttgattcgagtaaagcttaacttctcattttggaggtcgcaagctcatactttcattgaattatgggtcctcttgattgggctttggatctttttggttgatttgtgggctgtgaaatattgtgctgctgtgggagaagctgaaagccatttggtaaaaccaactgtgaaactagtttggtaagtaactctgggtgaaaacgggacgaatatagatggatagtaggtcatcatgtattctaccctaatttattttagtcggaatcatgtattctgccctaatttatttcagtcggattcatcatcggatacagatagttaaaaatatgatggataagatacatggtatggatatttattcggatggataatgaataagtgacgaatatgatattatttggtcgaatatttgttggataatgcatgaattgcttatcataaaatattcttgttcgaatatgaaatcgtaaataaattatcaagactactacacatttcataacaagataacctcaagtccccacataaaaataataaagtgaagtattgattatattgaaacttggatacttaaagtggtttcacatataactcatgcaataagtaaaagtgaaatggaggaaatgctagcatcatgtggattttatgatctaattgtttttatgattatatgtggacatatgttgtgtctatgtaaaatttcatgaatttctgaggctatttgtgcattattaatttctttcgacatgaaatcatcaaaatataattaaactcataaaatattatagtttcgacaaaaatgcaaataaactaccaaaactaataaaaggtttatatgaagataacctcaagtccctacatgaaaatg

SEQ ID NO: 7876 - DNA, 1137 bp, Zea mays
  misc_feature (2)..(2): n is a, c, g, or t
  misc_feature (32)..(32): n is a, c, g, or t
  misc_feature (73)..(73): n is a, c, g, or t
  misc_feature (98)..(98): n is a, c, g, or t
gnagtactcggcgacttaaccttgcaggcagnaatagtatattattcagatgcaatctcgtttggatgccacncggccgggagctacatgagctcagngagaaagaattctgctctgcagatgcaacggtttgttggggaggaaaaaaacgacttgctggactatttgagatcactaacaccagagaaggttgctgaactatcagagtcttcatgtcccggcgtgcaagaagcaatccattctgtggttcatggtctgctggctactctttcccccaagatacactcaaaggtccctccaccgctagataacacttctggaggggtcttaaaccttgggggcgaggatgatgactgtgcagaacttgtggagaatgcttccctcccatttcagcccctaatatctgttccccgtgattatcttgcacgcttgctcttctggtgcatgctgctgggtcactacatccggggtctggagtaccggttagagcttgctcagcttctgcgaatatccagcgacgtgggttctttctctggtggtgatgatcatgttgtttgagggtaccacgtttactgatattcctcaccgggaagaatggaaagatctggccaagcaatgcagaggtggccgttacactgcgttccctctctgaaatgatgccccaagcccccaatacaggtggcgctgctgagctatatattagttgtagttcctgtaaattcagaaaacagtcactcgggtcgggtgtaaagctagtgttacatatgcacgtgaagcactttctttttttcttcctttgatgttgtgccgtataaaaaaggtttggtggttagttggtgtttatctactggtagcatgataggcttccttgtattctagttgtatgtatctggtggttgtgattgatgtccagcgtccatttagcttgtgtggcttcttgattcgaataaagtttaacttattttttggaactcacgagcacaacctttcaatggaaatcggccaaaaaaaaaaaaaaaaaaaaaaaaaaaaaaaaaaaaaaaacccgaaaaaaaaaaaaaaaaaaaaaaaaaaaaactttggggcccccttggcccaagcgatttttaaattgaacaagttttttcttggggcccg

SEQ ID NO: 7877 - DNA, 2757 bp, Zea mays
gggtacctcgaggccggcctggcggtccctcacactcatcaagggcggctcactctcatgtcatgtggcggcgtccttctccctcgctgctccgtctctctcagtctctctcctgccctgtccgtcccactccccgtccagcggagagagaccctgtgggctgtggccgggcagccgtttcccctccccttccctctccgctccctccagagtctactgtagcgcagtgccgtagggtttcgcgtcctatccttcctcgcatcctccatggccgatcctgacgacctcggccgccgcctcgccgcggtcgccgtatccgagtctcctaccgccgccgcggctgcgctggagagcagcaacaacaacctgttccaggtgatgcgcgccgtggaggacgcggaggccaccatccgccagcagctggaggagaacagccggttgaaggacgagctgatgctcaagacgcgggagctccacagaattaggtcagaagccacagaccaagcttcctctcatgggatccgtatccatcaggatcgcgctcttggtgcccacacagacacctcctccactgctcccatcaggactaccgctacagcagcagaggccttcgaatggggagctggggatgccggcatcaaccacaagtaccttgaggccaaccaggctaatggaattccccgtaaatcaccgagcgctcccgatagcgctttcccatctcagctatctaccccgtcttcgcgatccctttcaccaactaggcaccacaaagaaacagactatgattctaggctcaacttatccggacaaggcgcactgcctgtttcagacctcaactcaaacgtcgtcatctggaagcaggatctccttgttaaggtcaaagaacaaggggaggagattgcacagctgagaaggcatctttctgactactctgtcaaggaggcccaaatacttaatgagaaacatgtcctggaaaaacgcattgcatatatgcgcatggcatttgatcagcagcagcaagatctggttgatgctgcatcgaaagctttgtcctacagacaggatattatcgaagaaaacatccgtcttacatatgcattgcaggcagcacatcaagagagatctacattcgtatcttctttattgcctcttctatcagaatataaccttcagcctcctgttcttgatgctcagtctattgttagcaatctgaaggttctgtttaagcatttgcaagaaaaacttattattactgaggagaagctgaaggaatcacaataccagattactccttggcatgctgaatcttcaaataatacaagtgctgctgcacagtcgccttctcatcctcctggaaatgcattgatcaaagccaaccttgacattgtgccccagcaagcatattctcatgtacattctccagtttcttctcctgttcaaactaggcgtgactgggatttgttagggaatgaaaatcgtcaggtcattcgaagtgaggttgccacaacaagtgcagagcatgataatgttgggaggacctctccttcaaccagcagccataatatgaaggatgcccctcaaagaaccgatcatgattcccgtgctgttcgatttaacattgaatccaaggatcaaaacccatcattcaaggaccttattaagagtgatgcctcagaaagtctggagggagctgaggcccaaattccacaagaactttctgcgcagcaggattctggaggctcacctaatttgacatctggtcttgatgacgcaaatccaccatacccttatcttcctactgtccttgaggagcctagttcttctttttccgaagttgcagaggatgatccgcttccagccatagaaggactgcgaatcacaggtgaagcctttcctggaagagaacttcaagcaagtgggtactctatccatggaaccacaagttgtaattttgagtgggtacgccatttggacgatggatcaataaattttatagaaggtgcacggcagcccacctatttagtaactgctgatgatgtggactttgtactagcgattgaagtccagcctctggatgacaaaaaaaggaagggcgagattgtgaaggtttatgctaatgatcaaagaaaaattacatgtgaccctgaaaccaaggagcatattaagaaaattctctctctggggcatgtctcttatgaagttctattacctgttagatttttagatatgtgggaaccagctattttggcaataaagagggaaggttacagcgttaagtgtaatggacagcgcggtgtcgttgtcatggagaaatttcagcaagcgatgaccatcaatatcccatttgggcgtcctactgagttttcaattttgtctgctgatggtgctgagtacaatttaaagcctgcagagaatgccccatcacgagatgccattgttctaatactaaggctattcaggatgaaggctgttgagaagagcaagggaaaaagaaagggcatcttcttcaagtagtttgtagttgtagcagtattactacgtagtgtcatggcaggttgactgtatctgttacctatgttttcgcggttcatgtatttagaaggaaagagcaagttgtctgcgtgcttatgtaaagttccgattcaattcgattagattcaattggcactgtacccagttttttgtttgtttttgttctgttgtagggagggatgaattcattttccaattaatgttggtttgtttggccagattgta

SEQ ID NO: 7878 - DNA, 2592 bp, Zea mays
agcagccttaatatttcatctccttcctttgttgatatgttcatattgttcggatgaagcttgatgttttgtctttgtgcttgcatgattgtcggccgcacattcctccagataaaaatatccctcactaatttgtcctgttatatctgaaacagatctagagactattgtcaaattaatgttttgaggaactccgaacagaaaaggccaccaacaagtactgtcaggctagtaggcatgcgggcacaaagtcagtggaagggcccagggtgaagctttaccgccacatagcgctggcctcacataaccctatttggtggaccattggctgcatctagctcgtgggcgccttcattcaatttaggtctttcttttttctagttattttttacacaaacgatctaaaactgtactcaagctgaccaaaaaaattatttcttatgtatttagttttcataatatgcaaaattggcattcctaggttcatgtttaaaagttagttacactagttttcaccttcctatgctcttcacatttcacatttaaatactagaaaagctaaaatagtacataaatggagactatggttgtggctctaaatctagattcacatctatcctatctagtagaacatatatatcctggttggtgtagcaacataaaagcactttacgataatgtgtttgatatattggccgtggaaaaagtgaaaataaaaaaagataaaaccctttacctcctccccgctcagaccatcgcggagagaaaccccaaacccccaaatcttgtcgactccaacgatgccgccgccgccgacgagcgccccgcattctctcgctgctgacgatttccacacctcggacacggctgccgccgcggccggggctgtggtgccatgcgcggcgtcccagccggggaccaacggcggcaagaagcctgcgttcgcgttcgggcgggtgtggtcggaggcggacgaagttcgcatcctcgagggcctcgcggcgtacgccgcggcccacggcgcagaaccgcgccggtcccagctccacgccgcgctcggcggctgcggcctggacaagtccgagttcaccgtcacggagatctacgagaaggtgcggcggctccggaccaagtacgcgaaccggcgctccgccgggggcgtgccggtgcctgcagctgcaggtggggctggtgacggcgatgaggcgcgcaagtacgagctgtcgaggtcgatttggggcgacctgccgctcaagaaagtaggcgccagccacgccaccaacgccagtggtaatggcaatggcaatgccaatgccaatgcggctccgggcacacgggcacgcagagggatcgaggagctgcagggcctgtaccccagccttgcctcggcagttgaggggatcacggacaacgagtcgctgcggccagtgctcaagagggccttccaacttatcagcgacgaacgagcacgtcagttggatgccaaagtgaagaagcagagggatatggaggcgcagatggcggtgaaagtgactgcactgaggaacgaggtacttgacacccttaccggatccatggattgcttcatcaatgatgttaagtatgaggggtaaggtctacatgtctttttgtgagaaatgaactccggaccggaggaattaatcatgttttaaggctagtttggaaaccatattatcccatgggtttttcattttcccaaaggaaattagttcattttcccttgggaaaataagaatcccttgggaaaattgagttcccaaactagcccttattgtatatatagacactctagtgggaggtggttggtgacaattttgtttttggtgttgtcaaccctttagtttcagtgttcccatgataaaacactggtatggctttcctagaagaacatgttctacaatatttggctaaaacttcttgtacttgtagttggatagttatgtaatgcagagagttgtcactaacagatataaacgtgaacctgctgcaaaatacttgatgcatggttcccatccatcggattatgaactttgtgaatttatcccacactgatcataaattcttgcttataagattttatcctcgtaaaaaataaagattttgtcctttaccataaactgaaaactgatccaagactggaggcacttcaaagttgaaacataacaatgggatgggaatggcagtgagtctcggtgtgatgtgtgcagccacgtaggggcgtttacatctggcaactggcatggcacaagaacagaaaaaattcggtgtagcattttgtggaatagcttggtatgctgaactacacgatactccttcagagtgacattacggtatgtcccggtgatgcttgctgggatacacagacgacaatactagatctattttggaagcacaatacggtgatacaaatgctaattaaactacgtgccagcatgaacgtcaggttctgaaacagagtaattacttaccagatttgtcaggatatcttcccaggatcctgttaatgaaggtagcagcaacagctgtaaagatgaactccagtgtacgtacttttgtttggatggatattgg

SEQ ID NO: 7879 - DNA, 2623 bp, Zea mays
  misc_feature (747)..(747): n is a, c, g, or t
  misc_feature (934)..(934): n is a, c, g, or t
  misc_feature (960)..(960): n is a, c, g, or t
ggacaggatacaccaaacctgacgaacagtctattagtttctaaagatttcttgatgctttgatatttttagaaattaaatttattacaaaacaaactctagattcctctttgtctgaatctgctaggggctttttagctggtcatttttttttaatttatttgttttttccccaagtgatctcacttattgacccgagtcaacacaaattctcttgctttacagcatatattcagtaaaatgctaagccactttttgcctcgttatttactgaatagatatgtgagtgcgctgttttgactgatcgattggaagtacttaatctatctgggaatcgcctcactgatgcatgcagttcttacctattcacaatcctgaaaaagtgcaaaggtatgtagcattttatatgtcagtagaattgtagaaatgcatataccttcttttgtaagggcaggtccggtgcagtcgtgagacctgtctcaccgagtcatcaggttgcaggttcgaagcagcatctccgcatttgcggagtaagacttgccttggtttatttctttcttagagacttagacctcactcatgtgctgggtctgcctgtatagcttcttttggagactgggtgggtgggtagttgggctaggatacagattagtcgaggttttccctgatttttcttgttttgtttcattgactgtcataaaaagagatatttatttttgtttcataaactgcatgttatgtatctgntttgtttacagcactttatagcttgaatgtcgagcagtgttctatcacgtcaagaactgttcagaagatgacagatgcactccatgaagagtctgtcctttcacatctctcattaggtacttattatcattacggcctgcttctcttgtgatttgcatagagcaatgtccaaacgttcaaaaattcngtacctttggcaggaaagaacaaccnaatttctagcaatacaatgcttaaccttctatccaaacttgcatctctcacaaggttagcagaaaatgtccatatcagttgtatagttactaaggtgttggcaagtatagaccagccatgcatgttgttcttgcaggttttcagaactaagcctgactggtataaaactgaataagttaatggttgataagttgtgcctccttgcacaatcctcgtgcctatcaggacttctgctaggtggaacttccattggaccggtaatttgctttccattttcttttccaaagaaaggctttgcgttcgagaaaaaaaaggctttgctttccatttgtggttagtgtttgcaacctgtacacaagcaatggtactactgtttatgcaggtggagacaactaggcttactgaggcattgtcttgtacatctcaagatttcctaaggttggagttgtctaattgtgggctcacaacacctgatttcacacaaatctgtacaaatctctcccggatcaatattcttgagttaaaccttggaggaaatccaattaacctggaggttcaattttctactctcatatgcttcggtaacatttatcctcatatttcagtagcaatgatctgttgtgttacattatattatgcagggatgtgatgctgtacagcgaatgcttgtaaatccccaatgcagtattagatctctcagccttgacaaatgcaatcttggacttgctggaattgtccgtgtcattcaatcattaccaggtgaggaacaattttgtggaagcatcagtctctacattaagttaataatattctactttcagaaaacagccaattagaggagctgcgcgtgtctaagaacaccaacttggcgttggagacaacaacaaagtatgacgaagacatgcaggaagtatcaacagcttctgagcaaaagcaatgtaatgaccctgaaacaacgaatgatatagctccagggaacatagattttgcgaacatgcaggttccagacagtgaagatgaagcagataatgatgcccaccgtgccagatctggttcacgcaggagctgtgcaagttcatcgcagaaaaactcttactcttcttgtcagatgattgaagaactggcgaaggcccttatttcagcaaagcagttgatggtgcttgatcttagctgcaatggtttgtcggaggaggcagtccagtcactgtattctgcttgggcgtctgttccgagaggcgatggaatggctcggaaacatgtaaataaggaggtggtccacttttcagtggatggtatgaggtgctgcggcctaaaaccctgctgcagaagagacctgcaaatgtgaaccctggacgaccttccgatgctaaattatggttgcactctgtaaataaatcatgagtgaatcaactaggcgttgaagcattgtcaatgcaacttcacactagtcacgatagtttggtgagtaattatgctgattcgcgggaatgtatacactacaatactagatgcttgagatttgggtatgcagttgtttcctgaggtgcagttactccttcgaaatcgtgccgtgtgacaagtttttcaattaaaaggaagtagaactgttattacgtcaacactacactgctacgagagcccttagcatagaatataaaccacc

SEQ ID NO: 7880 - DNA, 4179 bp, Zea mays
  misc_feature (747)..(747): n is a, c, g, or t
ttttgctctctaaaagccaaaacccaaaccaaagggttcgaaccaggaaacgactttctcttaaagtcagctttctcgcagtgcaaaactgaaagcacctatagaaatgcttttagcggctttcagataaaattgtgcaaatatatatgaaaaaatcttttagtggtttttagtggcttccactagatggtttttagtatttttacagctcacaacccactatcgttttttatagttcacaatccacaacagcttttcttacgactacacactaaacaaatagacttatattgtaactttcatatttgatcgcaagttgaaacacactattaattttcctaaaaatatgtatacaaaatgtatacatccatataatttttgcactaacattttattgaatattttgtatcgttgcaacacacgagggatgtactagtttagattcataaccgagcaaagtcgaatttagtagatgcgaaaatcgaagccaaacccaaaaaccagtacatcggtttagtgtcagtttggtcgattattcactggctgttttgagtttaaaatcagcattttaaatatttgtctatgatatttagcaatatatttcctgatatataaagcagccggctacagtggcagctaacagccgaattgtatactgaaaatagctacatttttttctcaaaccgttatagccggagatagcgacaactattactaaagatttaaatcttggttaaaatacgtccntcctaaaaattctatagacccttatttcggttttcttccatttctaaatgggtgcaaatagagacgtgtatgttatttcagagaaatagagagggaatatgtttcatacttatttcaaccaaacgtactacaattttttatggtgtcgtaattacttacaacttttataaagatcatgatagttttttcacacctcacgattaaacctttgttggagattgtgtacaaatatggtctttatctctttactaaaaaattagtttgaactctttttttaaaaaaacaacaatagttatataacttagggaaaatttgaaaacaaagtattttaaaaaccatgattttagaatatgctatggttttaagatgacaaaaatacaacaatagtattctttacctcactccatgtaatacttgttttggaggtaaagtataccgaaccatgatatttagcatacaggtggaagaagttagtcatatacaaaaactttggatttaggtggagttattttaaataatccaaaaatactatggtgactaacaaagtcatgatattgaaaacaaagtaatttaaaccttgagacaaaatacgatgaaagattatatggtattctataatatcatggttttttccaaaactcaaaaaaaactttgccttagagagtcgacgtatcactgagatgtatccaggaaagatatcactgagggaagaaagaatgagatgtatcgctataaccgcgccgccggccgggccgagaggagtgtatcacttcactgagggaagaagtgaagcggaatagacgccgtcgacaatgggagagagccgcggcagcatcgcctttttcgccacctaccggccaccagtgccgctagacatcttctctgtgcccatctcgccgtcttcgatccgcgacgaggtacacctcacggacggcgtctcctacaactacaactgccgccccatccccaaggacgcgctcaagtccctgctcaagcgccccaagctcgctgccgacggcggcgccaccgacgccgacgtcgacagcggccgcgtctccggccttctcttcgtctccgagcgggacgatggcctcgagacgctccgcgtggccctgcatttcaaggactccggcgagcaggcctgcaaggtgttctccctggctgacgtcttcggcgccgccgacttcagcggcgtgcgcctcgaggatagcggctgcgtcggcggcggctacaaggtgggctctcgcaccgtggaccactcgctcatctacgtttccaccaaggagccggtgcaagagcgacgcagcccgtggaccgtcgtgtacaagaccaaccttaggaccggcaagaccgagcgtttgactcccaaaggtcaatttgatctgagcccagctgtgtcgccgtcgggggaagaaggtggccatggccacgttccggccggagggctgggagggcgagatcgaggacctgcagactgatatcttcgtgatgaacgtggagaggccgccgatgcggaaacggctgattaggaacggcgggtggccgtcgtgggccagcgaggacgtcatcttcttccacaggaaggtgggcgagacctggggagtcttccgccacgacacgaggacgaacgagacggtgcgggtgacgccggaggccttcgacgcgatgacgccggcagccatcagcgacaccaaggttgcggtagcgaccattcggcagaagtccaagttcagcgacgtccgcgtggaggcgcagtaccgccacatcgagatcttcgacacggcggccgcggcggggcagccgtcggtgcaggtgacccagaagacgaggcccaaggcggaccacttcaaccccttcgtcctggtcgacggcgtccgcgtcggctaccaccgcgccaggagcgacctcgtgaaacccggcgacgacgtgctctcgcggaacttcgacaagattgagtcgccggtgaaggacgtgggactgttccgggtgtctggcgtgttcccaaccatctccaaggacgggtcgaagctggcgttcgtggacaacgagttcaaggcggtgtgggtcgccgacagccagggtctgcgcgtggtgtacgagaccaagggccccgacaacattttctcgccgatgtggaaccagaaccccgacaaggacatcctgtacgtgtgcatgggcccctccttcaacgccggcaagccgctggagatctgcgccatccccaacgtgtccagcggcgcgcggcagcgccgacagctcaccaagggcaagttcaacaacgctttcccgtcgagcagccccgacgggaacaggttcgtgttccggtcgaccagggacggcggcgacaagaagcacaagaacctgtacatcgcggagaacgcggaggtgggcgagtacggcgacggcacggtgacgcggctgaccaacggggagtggacggacacgcactgccagtggtcgcccagcggggactggatcgtcttctcgtcaacgcgggacaagcccaaggacgcaccggaactggacaacggcctggatccgggctacttcgcggtgttcatggtgaaggcgagcgacccgacggtggtgatccgggtgatacggagcggcgacgacctcggcgggcacgtgaaccacccggtgttcagcccggacggcaggagcatcgtcgtgacgtccgacctcgccgctgtgtcggccgaccccatctcgctgccgctcttcatccactccgtgcggccctacggcgacatcttcgtggtggacatcgacccggaggacgcgagcaagaacaaggacgtgaagaagttccaccgggtcacgcacagccgctacgagtactcgacgccgacgtggacggtgtttgccacggatgatcccaacgcgcagtggaacatgctggtgaagaaagactcgtacacgccggcgtgcccctacgcgtacccggacggcggcgagagctggcacatgaccgggcacctctgcatccctaggaggtgctgctgattgtgtcattggattttggattgcatccttcgtcgtcacgagcagctaccagctactgcgaccttttttaatatgttcatccatcagtaataaaccactagggaattagcagggctcttcttgcacctgatgatgacatcagcggagccctgcctctatggtctctgccatatgggtttgtacggtttcattcatgtcactactttcccaccacctagctcattctcgctccatcccaaggctatatctagccgtcttcgtattccacctccgaataatgcagtctacagtgtaaaacagtgatttgcacgactatatacatgttatactgagtatggcctagcgttggttctaggctgacctatatccgatgtcacacgttatcgcccggtcgcgcaaaaaaaaaaaaaaaaggcccctagggcc

SEQ ID NO: 7881 - DNA, 4578 bp, Zea mays
  misc_feature (3635)..(3635): n is a, c, g, or t
cggccatctcctgcccactgtcctcaactcctaaaaccataattagggagtgcgcccagctattctaagtctgacgaacgcttgcttgcgcttgccacagcgactggtgtaacctcgacaggtgcaagcgcgtcaagcccttccgctgcggggagctcgacttggaacagcgcattgccaacgccctcaccctcgccgccaccagcgacaggtccacctggagctacaacaagggaaggtacgcccgcatggaggacgccattctccaggccctcgacatagagaaggagctcgctctcggcccggcaaccaaggcctacctccatgcccgcagctgctcgcccaggcccaaagttgaaatgcccaacggacaagtcaaagatactgcagcaaaggatcatgctccaaccatccagccaccgctgccgccgcccaagaggaagcgcaagacgccttatgactccgaggacgatgtgcccgaagtgtcccgtcgcatgagggacctcagggacatcggatccaaggcggtcgtcccaatggacttggccaatgctgctgcagtctctgctcccaagtacgatgatctaactaatgctgggcaggccaaaagaattgtgcactctcaggccaccgcaaagaggaagcatgctggtctgcatcaggaccaaccttgtgggatccccaggaagaaggataggtctcgtccgctctcggagctctgtaatggagacatgtggggtggttccagaccaaatggccagaaggccgatgaacatttgttgggtgtggctacatgttcaagcagctcctctggcacttcaaccttggacactccattggacatgaacaactgtcatcgcagcatggcattcaaaacagatcaagcaaagggcacagaaatatcctgcatgacaaggctactgagtgatgattcccggcatggaaatgattttgtcggaactcctgctgcacaaaatattgtggaaccagatcatttgcatagatatcaaccttgtggattggcaaagaatcctacctggaaacccaataagcaaactaatgacgcccgcaaagctgagaaacatgcacgcaaaaatatgaagatgagaaccataagctctgttgatcaggagaacaagaacaggacaagagattctaatgatcatgaccaccacaaaccaaagacaggaaagcacaaatcaccaagagatggggttgtccttttggagaaaaggcaggagaagcgttctttggacaagaacaagcccgctgaacatgatattaaaatgcatattgccgtagttcctagtggtatggattgtgttggcgcctttcagcagcagcgctttaaaagcaggtgtgatcctgaagagtcattggaaagcttaagcaaccattcaaactgtgagagtggctcggtatcatcgctggtgtttgagaagccactgcaggcattgccgcccggaaagaatctgctgggttatgaaatatgtcatgcagcgaagccaatcaagacactgcatttgaatcctgccctgtatgatgtggagttgagcgtgttggggagcagcaacacggggcgccgtgtgccccttgtttctctaatgagtaggtggaattgtaaagccgtcgtggggtatcctgtctccgtggaggtcagcgatgatgtgtttggctgtccttctccttcatcagagaaagatatccagcaggctgctacaaacagtgtgaatgggatagtattgaagaaggatgaaactgagggtttggaacgtgttgttgtgccaccatcagcgcagacatcccggccaagatgcaaaagccgcagcaggagggcatcagagaaagcagtggacaagttatggcagccacataccaaatggccagcatcctcgtcgagaaagatgcggaggctttcctcttttggtccaggccagagagatgggaagtcagcggtgaggaaagtgtccggggcaaccgtcgcgtgcatcccgctccgagttgttttcagcaggatcaacgaggcgctgagcttctcagttaatgagaatgccctagctgggtgtgggactgcttcccggctgaggaatacttggtagctaggttttgctgtttgttgttcaccgcttgctttttttgtagccatgccataatagcattggtaaatgtttagtgtggcctatcacttggagcatggtaataggtgatgatgtatcgtcatcttggttgtgagccacatcacacttcactcacagtagaggcagtagaaggaagaactgtgctgatgcacccctctttattaaaaaaaagaacatttgatgggtctgtggagcacatggtctgatggtggaagcaaataaattagcgtaggatgatggttacttgctgggagtctgttttggtattagtgatgcatcgctgctgtaatgtaacttcctgtgttgccatcctaagctaattgtaatcggaagtgtcagcttctgcttgccttttttttttggttacttcctccatccttcccagattacaagtatcattagctttctttattaattgcattttcatagtatacctttttatttgatgtcataaatctatagttttggtcaaacttaaaatattaatgactacgaggatgaggtaggtaccttgagccttagcaagaggggggattctttgcttccctctgcgagagatgaaattcgaatgcaacgattccaactctcttcctgattcagatggtacgcatgcgattttatggtttggcgatgagcaagtagccatcgtttgcttgcgtctaagcaagcaagcatgcgcaatgttaacgccacacccattcacggtagctgcacgcaacaaccaagtaatttgatctctaaaaatctttattttcgatcagagaaagtataaagctagtagcagttctctttagaattttttgtaccaggagtgtaggagttgtaacttggtacccagccatggcgagtcgtcgcctcctctttgccgtgcagctcctcgtactgatcgccgcagtggccggcacacggtggcaggacttcctccgcctgccgtcggagtcggagtcggtggggaccaggtgggccgtcctcatcgccggctccaatggctactacaactaccgtcatcaggtagtaatttcatccattacgttatcattatgctttgcgaccactcttgttgagcagatcctgctacatgcctacatccatatccatggacaggcggacgtgtgccacgcgtaccaggtcttgaagaagggcgggctcaaggacgagaacatcgtcgtcttcatgtacgacgacatcgccgacagccccgacaaccccaggccgggcgtcatcatcaaccacccatccggcggagacgtgtacgcgggggtccccaaggactacacgggcaaggacgtgaacgccaacaacttcctcgccgccttgctgggcaacaggtccgccgtcaccggcggcggcagcggcaaggtggtcgccagcgggccggccgaccacgtcttcgtctactacagcgaccacggcgggcctggggtgctcgggatgccgtcgtcggacgactacctgtacgccaaggacctggtggacgctctcaggaagaagcacgcngcggggggctaccggagcctggtgttctacctggaggcgtgcgagtccgggagcatcttcgaggggctcctgccgcccgacatcgccgtgtacgccaccacggcggcgaacgcggaggagacccgctggggcacctactgccccggcgacgacccgggcccgccgcccgagttcgacacctgcctcggggacctctacagcgtcgcgtggatggaggacagcgacgcgcgccgcgaccgccgcgccgagacgctgaggcagcagtacctggcggtgaaggaccggacgtcggcgcacggcacctacagcctcggctcccacgccatggagtacggcgacgtgcagggcctcggcgcgcagagcctgtacacgttcatgggcagcgacgacgccaccgccgcgagcttatccggccgtggccgtgggcagccagccgtgagccagcgcgacgctgacctcgtctacttctggcggaggtaccgcagggcggcggagaggacgcccgagaaggccgaggcccggacgcggctgctgcgggcggtgtcccgccggtcccgcgtcgacagcatcatggagctcatcggaggcctcctgttcggctcggagggaggtcccagggtgctcggtgccgtgcggccggcgggacagcccctggccgacgactgggactgcctcaagtccttggtgcgtgcgtacgagcgcagctgcgggccgctcgggcagtacgggatgaagcacatgcgtggcttcgccaacatctgcaatgccggcgtcggggaggacggcatggccaaggtggcgtccgaggcctgcgccgccgtcgcccgttctgacgactgaacaacccgtcgccttgtctttgtaaaattgtctttgtaaaattgttgctattttttttgtaaagaagagactgaactgtaacagcaaaaaaaaaaaaaaaaaa

SEQ ID NO: 7882 - DNA, 1081 bp, Zea mays
aaccggccgcgtctttttttttaatacataataaatgaataaggcttttattgattgtgtttcttctcttcatgcatgtaacaaggccggaaccggaaaccctagaacatatatatatacgtacgtatccaacagcagcacatacatatacatgtaaggaaattaaaataatttgatatagtacgtacgccttggaaagacctgcatgcggcgtggcatcaatataatataaattataatatgcatgcagatcgatgcaagaaggtcgagaagcgatcgatcatagtagatagcatgcatatatatatataataattaatcgattcatgcggcggcggcggcgacggcggcgtggtgtgtgaatccgaaggcgatgtgcgccatccgaccgtactccctgtcgtgcgcggcgacggggacatcctcctcctcgcccttccacgcgtcctcgcagctctcggaggcgcccattgcggcggtcagctgctccatggccttgccgtagatcttcgccttgaggttgtccagcgcgtcgcggaggaggtcggcggcgccgccgtactgctccaggcagtggttgaagcgggcgcgcgcctgcggatccgacgacgccgcctccagctccgcgaggtcgtcgatcttggactcggtgctggcggcgtggtcgatggccatcctggtggccagcaccgccagcccgtgcatgttcttgttgccggcctccttgctgcgcgggtcggcgcccagcgacgccatgcagtggtcgtaggccacgccggcgtgcgtctcggacgcgccgcggcacgcctcctccacgctcaccggggtcgcgcactgctgaggcggctcgccatcgtccaccgccgtgccagcagcggcggcggcgatattatcatcagcaggcaccaactccactaccgcctgcgcaacaccaaccagaagcagcaggcggagaccgagcagtaccagcgtcacacgccggctgctgctactgctgctggcacgggtcattttcgacctaattacttagctcggatggacgatgttccctgctgctggtctcgatcggaagcccggccgg

SEQ ID NO: 7883 - DNA, 1799 bp, Zea mays
  misc_feature (97)..(97): n is a, c, g, or t
aaacctaagttgagtttgcccagtataccgtaagtgcacaacaaaaaatctagcatgagatacacaaattttatttggcttatcatttgttaattangttaatcacttaaacatatgagaatgtgtatatggtaaataaatttttttttttttttttttaaattttataaccagtttccctttattcactaattttgggtattacaaaaacaattgatagtacgccttgttgctcgacgaaatacctgcatcatcaatataatgcatgcaactaatactatgcgatctgctagggaatgatgagaagagccagccaacaaggcagagcagagagatatgcatatagagatatgaatcattggacgcatgaaaattaatgcgacaaggaagagaagcgatgcatgcatatgacatgatgattcatgcggcggcggcggcgtggtgtgtgaatccgaaggcgatgtgcgccatccgcccgtactccctgtcgtgcgcggcgacggggacatcctcctcgcccttccacgcgtcctcgcagctctcggaggcgcccatcgccgcggtcagctgctccatggccttgccgtagatcttggccttgaggttgtccagcgcgtcgcggaggaggtcggcggcgccgccgtactgctccaggcagtggttgaagcgtgcgcgcgcctgcggatccgacgacgccgcctccagctccgcgaggtcgtcgatcttggactcggtgctggcggcgtggtcgatggccatcctggtggccagcaccgccagcgcgtgcatgttcttgttgccggcctccttgctgcgcgggtcggcgcccagcgacgccatgcagtggtcgtaggccacgccggcgtgcgtctccgacgcgctgcggcacgcctcctccacgctcaccggggtcgcgcactcctgcggcggctcacgatccatagtcatcgcaattgcatcagcaggcaccaactccatctccaactccaccgcctgcgccacaccaacaaccagcaggctgaggaggaccagtagcgctagcgacctcatcgccattttcgacctactgctgcttactgacttattagcttggatgaacgatcgaagatctactaatataccggccggttgcctgcctgctacctgctggctatagaaatgaaagagagagagagagagagagaatataattaatggtgtcgaacgaacgaacaacctacgtactagtaggactaggatgcagatatggacgacgaggatggtcggaggcaaaaattaatgagaggcggggaggaagcctcgcttcgatttctatggatggaagaggcgtcgcgatcggtggtgcatgtcgttgctggctcgccggaattaatattattgcaaattgccattgccatgcatgctcgatggagctagctcatgccagaccgacgacagcctcttcttcctctagcttcgatcccgcctcagctccatccatcgttgaatgcttcaacggctgctattttaagctaagcccatgccttcttatttaggcttcgttatagtttggcacaacaacaacaacttcagaagcctctttttaaccaaatccaaatgggataaaacaaaatagttaaagttcctgaaaaccagttctcccaactagatggagctgaaaataatagtatatagtttctctctcccacttacaggttgttttactgatatttttttaaatagcttcaatttcatcagcaaattaaaggcaaatctatcaatatagccagagctaaagaataatgttagtatcttggccg

SEQ ID NO: 7884 - DNA, 1723 bp, Zea mays
cgctgaaaaggagcttggagcaaatggccacagccttgatcgatgtgatagtgttcaagaggatgaggatggtttgagttgcaaggagaaagatctctataactgtggtaccaaagcttcagatgaggaattttctgatagattgcaagagaatcacgagaacacccagccaagtaataatcataacgattcagtaggtcagagtcaactgcccccttcttcaagccctactgagagtacagatgaaatttcatcagaagacgaagaaaataatgataaagagaacatggatccaagcgctcagaataatgatgtacatactcttgaacacctccaacaagccatcggaggaaactcacgtccagatgatgctatcttaaaggattttctagatgatgaagctgaggaagaggatgatagtgacaatgacatgactagatttaaggacaatgaagaagatgatggaagcgatgaaaacgaggtgttcaatgacctaatagcagctggttatgaagaaaaagaagtagatcacgagaagcgtaatgaactccaccaaaagtggcttcaacaacaggatgctgctgaaacaaataatgttatccaaaggctgaagtttggtcatcgggagcaaaaagaatcagcatatgaagatgaagatgaagacgaagacgaagatgaagatgaagatgatgtagctgattgtgaggaaggatcacaaaatgaagatttaactccagcaaatattgtgcgacaaaattcagagaaggcaaaacagatgattgcaaagatgtttgaagatgacaatgatacttatgagcactcggatgatgaggaaatagaggagcatttggctcgtcagcgcatttcaaagcgagaggttgataataatacattgatatccccattagaagatgacaactcaagggaggtatttagtctaataaagaagctcaatattgcccctaaacctaagatgagaggaaagcaatcaacatcaaatcatgaaatgcttatggctggaaggaacaccattgcttcaaagtcatcgtttcttggacgaacagccagtggttcactggcatcttctcacagatcagtctatagatcctatgtatttggtcgtgatgacagcaatagcagcagtaggagctgcatttctacttcagagagtaatttagatctggatcagaccaattcctctcaacccaagaaggccaagttcagttcacagccgaaaccagaggggacaagggcaactccagagtgtaacacgacgagttcaggtgtttccctcttcgacgtcctgcgcaggacttcagagcagagcagtcaggaaagctgtagcacaatcacagaaagtcaagctgtgcaccagttctcggcattcaagttatcaaggaggttttccaaggtgggttcaaaaaattgacaaactctagatggctgttagtatcgagagggtgggttactgttggagcttatggggcaacgcgttgagttagtttcgaccttcaaaccgccaaaatgttccagattgcatcatgagtgccaggtgttttatgcacgaactgagaatgctgagacctggccctgttgtagattatgaaacccagaatcttgttgtgtgtgtactcgtatgctcttgagaacgcacgctgagtttcctgagaggtttaaagtggagtgtaatgtttgcttattctttcaaaaaaaaaaaaaaaaa

SEQ ID NO: 7885 - DNA, 4634 bp, Zea mays
ttcttctaccctttccgggtagtcgatggcagctacctttgcgaccatggggagttccgcgagttgaactcgaaagctcgaggcccaggcgacgcgacgcggccacgcccacgtccttccatggcgaccgctctccccgcctccgcctccgccgcttgccttctccagctctcccggcgcggtctccctggaacatcttctgtgctctccccgcttcgcaccgccactttccgctggcacggtgcctgtaacgtggcctgttcatgctctcccggcccccggccggcggttcccgcggagcgaagggacggcgtcgctggccatgccacttctccagagggaactgtacgaatcgtcgccgtggttggagaaggtagcatcagcccgattaaggacgcgccctgggaagaggtcatgcgccacacggctgataggctgaagtgggtcgatgaaggatttgaaatgcttgtcttcacggataatttggttggtcatgataacctcaggaaagagttactatcacactgtgatatgctagtcaatgttgcaataacaaatcaggatgctgttcagtggcttataaacaacagcaaacacatttctaatgtaatttgctttcagtcatctccgtctttagtaaacaaactaggtggcacatatgttcagtacactggagagcaggacatgtttgggaagctaacaagtattggaaaaccaagtggcatagaggaaatcaactgaagttatgaagaccatatctaatgcttgggaaagacacaattcagatgacattagattttgcttgcttgttgttgtaaatgcatacataagaccggttgctatgctgaaaaatctaagggcaaaaggcctttctaccctaacttgcatgataaagaactgtggtcctcagatactcaattgtctgtttgaccctaactgtaggaaggcccttcagtgtttgaattcctgttctccaactgatcaagtctgcaactatcgttgcattgcatcatatgaaagtccatatctggaggctttttccctctgtgttttgcagaagaacaattgccttgacctcaatgctgagatacccagtaaaccgaatgtaatgccactaaccatgttcagagaacaaaaactaagccatgaaatagcggaagatctttttgttggttggttggacagcatggaatggagttggcgagtggcagctggacaaaatccagcatatgatcaattcccatgtcagtaccagttattttacagagggaaagctaaaggttcattttggtatgagccggtttttcaggtcaaaaccctggaaggggagctggtttggaggcgcaggaggtatcgtgtgagaagggctagcactcctggtacattttacttcagtgtgttggataatggtgtcatttccaaagaatattggacaattgttgacgttgcggaggatttcagctggggtctgttccattatcgtggcgcagcacaagctgctgggctatcatacactggagcagtgcttgttactccagatgggtcttatcctgacctggaagacccaagattggcctctgctttagagaactgtgctataaagaaatgggagctctatacagtcgataactgctcctgcatgggtgcaccactgggaactcctgagggttcaaagctgcaccatcaaatttctccaggaaaagaaagtagtgttttgcagagaagattgataatctgtaatatgttaaagtgactcccaaatgtattatgtcgtacgtacaaagatgtacagccaagtggacatgtattgctgaagagagctcatatgtaacctgcaggtatattttcttcttttgaatatacgtgtaacctaattcctaccttttgtggctgccatcagggtttgatgattaagaaataaaaagtttgatcgcaagatcgtcacttatacactagtgtccaagtgatcatgtattgctgaatgtctgctcatatgtaacctgcaggccttatttatatttacagcaacagatcacactggttgcagcaatgcagcctgcactggtgagcagatgtcttcaattctgcatcacctgtgtagagctgcattactgtttgcaagatcagagccgatgtcctgccatgttgtgccagtattaaatccctcataacagaacccaggagttctgaccggctgcctgggttgcggctgcggctgcagcccaacagccaaattattatcagcccctctgatttttcttgtactaaattgccttggggatttagtaatctttgattgagtacttgtattagaaattacatctaatgtagtgatgtatttatggtcatcgatgagaccaagagttgactactcgttgtacatctggaataaagatgaagttgtcttgttgatgattcagtattttatacctcatatgtaacctgcagcatcttcggtgttcccatcggtacctgtcgaagcatcttgtagtgttcagacagttcagttggctatcagtgcgaaggagacacattggtcaagcagaactgcagaggaggtgtacctgggcagacaagttagagttagcaactgacccacttcactttgattttacgttattgagttgctctgcgatgtacaggtttggatctccttatgttgacccaagttctatatcctacaggtttgttttaaatttggtatactttcataaatgcaattctcacttttcgagaagtaggacaatttaaagtctgactaaaattattttaaaaaggtattaatattgaggatacagaataaatatcattatattgattataaaatatattttggtagtaaacttagttgaagacataaatgttaatgttcctctatagttttagttaaattgaatctagtttgatttgcacacatcccgtagtttggacggaagagtaagctcttgtttttccctgaattgctctgaacaacctgttcctgctttcctgaatcctggtaccatgagaaaaaacatctcatgttgtatatggtttctgctgctgcacaagattccccatgaccccatgtgatgttgcagtttgagtcaacatatgtgattcgtcagtggataatgcaaagttctttttgaacgggatcatatgactagtttgacttggctatgactctgaccgcttttgttttgtggctataaattccatccaacatcagaccctgcaatccgcacttgacagctgataggcaggcgataccgtaccgagagagttgaagctgagaaagaatggcggggctctacgagaagcagtcggagacgtacgccaagaagcgtccgcagtaccccaaggagtggttctccatgctggccagcctcaccgcggggcaccagcgcgcctgggacgccgggtgtggcaccggccaggccgccatcagcgtaagtttttttttttatcgaatggtcagcagcggcttcaccgttcgatctggttaattctgaaacgaacatgtggcttaaacaactcagatggcggagcactacgagagcgtggtggcgacggacgtgagcgaggggcagctccggcacgccaccgcgcacccgaaggtgcggtacctccacaccccggagcacctctcggaggacgagctggtgtcgctggtcggcggcgagggctccctggacctggtcgtggtggccacctccatccactggttcgacgtcccgctcttctacgccgtcgtgagccgcgccctgcggaagcccggcggcatgctcgccgtgtggggctacaactacgagatccacccgttcgaggacgcgctgcacggccagctctacccggccctgcggccgtacctggacccgcgggcgggactggccatggagcggtacaggtccctgccgttcccgttcgagcccgtcggggtgggcgccgagggcgcgcccgccgacgtggacatcgaggtggagatgacgctggaggacctggtcgggttcctgaacaccggctctgtcgtgaccacggcgagggccaagggcgtggacctggaggcggtcacgagggccgcgctgaagcgttggaggagcagtggggcggcgcgcccaccgtgccgaggaagctcgtgttcaaggcgttcatgctcgccgggaggcccaagtgctgaagtgataatgccgaataagtgtttgcttgtcagtcagcgtgagattgagatgagatcacagactacaatacatcatatagccagccactggattatgtctggcgatctaatgacatctgaagccactacatccaacccaggtagaggtagcaaactgcgtattcctttcatgctgtatgcagaatgaagaagaaatacctatttccattgcctagtgaattcccattagtatttcttctttcactggattatgttgtatgcagaatgaagaagaaatacctattttcattgcctagtgaattcccattagtatttcttctttcactggattatgttgtatgcagaatgaagaagaaatacctattttcattgcctagtgaattcccattagtatttcttctttcactggattatgttgtatgcagaatgaagaagaaatacctattttcattgcctagtaaaaaaaaaaaaaaaa

SEQ ID NO: 7886 - DNA, 1800 bp, Zea mays
gggtacctcgaggccggccggaaagaaatctcgacgggaggagtagtttcaaatagaagtgaagtaaacagattcaagttagcccagtgtagatccttggaaaagcagttcaaagcaaaggttttgttattgaaagcactacttttacatatacatatatatgaagatgagttttatcaaatcctgtggtgacttcccaagccaaggtaaaaatgtgaagtaaggatttcccatatatatgaaactaaaatgaaccctcctcggctaagggtgaatcagatatagaagaagcggaagcaggaagctgaaggatatccgtagcgaatgaggaataggacatgcatgtgagctagcgaaaagggaatagcacattctctagggttcgtatcaagcgctagcaaatggagagggtcaatcgaatccgtatcctcgagcgctgggtctgtcctctaatgaggagctccttgcttttttgatccgtgaatccggatctgtaccttcatctgaaaactattcgccggttgtccgcattcctctcctcgagcgaaaggtgttcccccgccggcgctctcgccgctgcttgggcaggcgataccgtaccgagagagttgaagctgagaaagaatggcggggctctacgagaagcagtcggagacgtacgccaagaagcgtccgcagtaccccaaggagtggttctccatgctggccagcctcaccgcggggcaccagcgcgcctgggacgccgggtgtggcaccggccaggccgccatcagcatggcggagcactacgagagcgtggtggcgacggacgtgagcgaggggcagctccggcacgccaccgcgcacccgaaggtgcggtacctccacaccccggagcacctctcggaggacgagctggtgtcgctggtcggcggcgagggctccctggacctggtcgtggtggccacctccatccactggttcgacgtcccgctcttctacgccgtcgtgagccgcgccctgcggaagcccggcggcatgctcgccgtgtggggctacaactacgagatccacccgttcgaggacgcgctgcacggccagctctacccggccctgcggccgtacctggacccgcgggcgggactggccatggagcggtacaggtccctgccgttcccgttcgagcccgtcgggggtgggcgccgagggcgcgcccgccgacgtggacatcgaggtggagatgacgctggaggacctggtcgggttcctgaacaccggctctgtcgtgaccacggcgagggccaagggcgtggacctggaggcggtcacgagggccgcgctgaagcgtgtggaggagcagtggggcggcgcgcccaccgtgccgaggaagctcgtgttcaaggcgttcatgctcgccgggaggcccaagtgctgaagtgataatgccgaataagtgtttgcttgtcagtcagcgtgagattgagatgagatcacagactacaatacatcatatagccagccactggattatgtctggcgatctaatgacatctgaagccactacatccaacccaggtagaggtagcaaactgcgtattcctttcatgctgtatgcagaatgaagaagaaatacctatttccattgcctagtgaattcccattagtatttcttctttcactggattatgttgtatgcagaatgaagaagaaatacctattttcattgcctagtgaatccccattagtatttcttctttcactggattatgttgtatgcagaatgaagaagaaatacctattttcattgcctagtgaattccc

SEQ ID NO: 7887 - DNA, 1543 bp, Zea mays
cgtaccgaagcacgaccctaacagaaatgaacttgtcggaagtagaaaagacaactttaatcgacacggcaaaggtacctcatggcatggttcctgcaagtggcacttgcagcttggaccatgcctaaccatcaatgtatcttgtctggaaatgctcacattcatcgccatcttcagatcagatacacatacgccatcatgttaaaactcccggacaatattgtttcccccaatttcactagaaaatttagttgaaccagcagttcagctgacttctctgtgggttggaattgggtagcatttgtccaattctccgtcaccttttttttttgctaactcgaagttggaaacactcgctgcaggggaccggtatctgaagccgttcgtcgttccaaaaccagaggtcacggtggttcccagggcgaaagatgacgactgtctcatcctcgcaagcgatgggctgtgggatgtggtgacgaacgaagaggcatgcaaagctgcgcgccggcaaatccaagtgtggcacaagaacaacggtgccgctggcgcatcgtggtcgttgtgcgacgagggtgatggatccaccaccgaccccgctgcccaagccgcagcggattatctcgtgagggtcgcgctgaagaagggtaccgaggacaacgtcaccgtcatcgtggttgacctgaaacctcgaaagaaaagctcaggagcaactcgtagcatcgggcgttctgggtccatcacagtagagctgagctgaccatggcatggccaaagaactgctgctaggtgctagctggtcgtccgcacgagacttgaccggcccacagttttttttttgggtccgttgggcgtcaagaattgtacatgtatatatggtagatgcgttttccgtggagggttatggcgctcaaccccgctcttgtttctgttggctaaaaatctctccaatcggcatctctaccgtgagcccccccccccccctagtatgcccctaatgctgtatgatagtcgagcttgtaaagagccaagcggctgagacgatcactaaaattaacgcgctgtaaccttcatgattcaaggcctctctacccatcgctgtatcagatgacagttttgtactccagggtccagtgtgtagtttggtgttggtgtgtcagcgtgtatattgtaactcccacacacacacacacacacactgggcttgcaatctcatacaaacatacctgatgaatggaaggccggagggggtatatttgacagggaaaaaaaagtagtaccaaagtttcatatagttcagtttgtgtacaagagccaaaaaggtctactagtttgcttcagtgcctacccatgcggagtctgcaaacatggctagggcctggtggcacggccggcgtagccaagggctgcgactgatgcctcctgcctggggagcgttcagccacacctgcactgcatacaagatgtaactaagaatcgggtccaacatccattgggacagagtctgtacatcttattacacggccgtcgggatggataatattag

SEQ ID NO: 7888 - DNA, 812 bp, Zea mays
gcctgacaggaaggatgaacgagcgaggattgaggccctggggggaaaggtcatccaatggaatggctaccgggtctccggtatacttgctatgtcaagatcgattggggaccggtatctgaagccgttcgtgattccaaaaccagaggtcacggtcgttcccagggcgaaagatgacgactgtctcatcctcgcaagcgatgggctgtgggatgtggtgacgaacgaagaggcatgcaaagctgcgcgccggcaaatccaagtgtggcacaagaacaacggtgccgctggcgcatcgtggtcgttgtgcgacgagggtgatggatccaccaccgaccccgctgcccaagccgcagcggattatctcgtgagggtcgcgctgaagaagggtaccgaggacaacgtcaccgtcatcgtggttgacttgaaacctcgaaagaaaagctcaggagcaactcgtagcatcgggcgtgctgggtccatcacagtagagctgagctgaccatggcatgtccaaagaactcctgctagctggtcgtccgcacgagacttgaccggcccacagttttttttgtctccgttgggcgtcaagaattgtacatgtatatatggtagatgcgttttccgtagagggttatggcgctcaaccccgctctggtttctggtggctaaaatgctctccaatcggcatctctaccttgagcccccccccccccctggcacttagtatgtccctaatgctgtatgatagccgagcttgtaaagagccatgcggctgcactaaaattaacgcgctgttaccttcatgattc

SEQ ID NO: 7889 - DNA, 392 bp, Zea mays
tggacatgggccagcagacccaagggaagaccagggtgggctccagggtccgcaaccgcaagacgctctcctccaagtagtagagaggtgaacacggtgggatttaggagagaagctaatgatcctggtctccttacatttgatgatggatatatatcaggatgtggtttaatctctgtgagatcctttctgtgagcgtgagaacgttgatatcctatcaaagttctcggaatatacaatcactacaaatgtaaaatatcatgcttctagtgtattacatacttcactacaaatcatggcatccatgactcatgcatcctcttctccaatcatctagaagcttctcaagtatgctttgctattttcaacatggacctttagaattctttaac

SEQ ID NO: 7890 - DNA, 1048 bp, Zea mays
cactcctaagggcgattgggatcctcgaggccgcccggggtaccattgggtacctcgaggccggccgggatatgcaatgcaaagcgtccctcaacatttcagtgtgtgccaagaagttctcaggctcaaactgagcaatggcagctcagtttgcagcggcaacaggagtcttcctgagctgccttcttgctcttgcagcacttgcaagctgcaacactgaaggtgacatcctgtacaaacaaagggcgacatggaaggacccaaacgatgtgctcgtgagctgggatccgactcttgccaatccctgcacctggctccatatcacttgcaacaacgataacagtgttatccgtgtagatttggggaacgcaggcctatcaggcactctgattccagatttgggaggactgcagaacctccagtacctgatgttgtatgggaacaatctgacagggcccatacctgaatctctgggcaatttgacgagccttgagaggctggagcttcagaggaatgcgctgagcggtgcaatcccatcctctctcgggaacatcaaaacattgcagttcatgaagttgaacgcgaatatgctgaccggcacggttccattggaagtcctctctcttgtcattgctgggaatctgaccgagctaaatattgcaaacaacgacttggccggcacagtcagatcatctggtttgagagtgactgcaatcatccaggacaagctgaagactacatgatgagtccctgggtgtggacattggctttcttcatgacaatgtttgacaaaaaaaatagtaaataaataaatccagtgacatggattgatctagacatcttgtagtatgatgatatggctgctggataaattctattcttctccgatttttccctcgagcagcattagctaatgagaatatatggggcgtcactgtgctagagaaaaaaattgtacccagttttcttttttatgtaagttcttactttacataaatttctatagattattgaaacatcatgacgtatgacatatttaaaagcggcc

SEQ ID NO: 7891 - DNA, 1136 bp, Zea mays
cattgggtacctcgaggccggccgccccgggccggaggcccgggggaaaaccccatccaattccaaacaactcttctcgccatttcaccaccgcctccgcccccatcctctccccctcccgtcgcgccagtcaacagcctgtctgcctcttccctcgccacccatggccaccgtagcgcgcaccctcgtcgccgcatgcccggcacggtctctcctccgcctccggtctcggcgcctcccgtcctcctcttccatccgtcccgcgcggcaacgtgccggcgtcgggtctgtccgctgcatggctcggcgaccggattcctcctattccccgctgcgttcggggcagggcggtgaccgtgcaccgactgaaatggcgccgctgttccctggttgcgattacgagcactggctcatcgtcatggacaaacccgggggcgagggcgccaccaagcagcaaatgattgattgctacatccagacccttgcccaggtgctagggagtgaagaggaggcgaagaagaagatatacaatgtgtcctgcgagcgctattttggattcggatgcgaaattgatgaagagacctccaacaaactcgaaggtcttccaggggttctttttgtgcttcctgactcttatgttgatgctgagaacaaggattatggtgctgagttattcgtgaacggtgaaatcgttcagcggtcgccagaaaggcagagaagggtggagccagtgcctcagagagctcaggatcggccacggtacagtgaccggacccgctatgtgaagcggagggagaaccaatcttaccagagatgatgtctccgtttctggagatggaaaatgccagggtttccacaggtgtgccatactggagatgcaggagccaccccaacccccactaccccacatgagaatggcatccgttgtgtttgctgcgctttctaagcttgacaagttgacatgcttatgcgtttgggcttgtacctctggttgatatgacggtgtatccttttaactccgcatagtattgtgtttgaagtcttctttagtcagaaattattgacgattatcagatggcgtactgctactgcattgatcatctcggaaggggcccgcccgttcgaccgttcccccc

SEQ ID NO: 7892 - DNA, 1056 bp, Zea mays
attgggacctcgagccggcgggaatccatcactcccctcggccatttcaccaccgcctcgccccatcctctccccctcccgtcgcgccagtcaacagcctgtctgcctcttccctcgccacccatggccaccgtagcgcgcaccctcgtcgccgcatgcccggcacggtctctcctccgcctccggtctcggcgcctcccgtcctcctcttccatccgtcccgcgcggcaacgtgccggcgtcgggtctgtctcgctgcatggctcggcgaccggattcctcctattccccgctgcgttcggggcagggcggtgaccgtgcaccgactgaaatggcgccgcctgttccctggttgcgattacgagcactggctcatcgtcatggacaagcccgggggcgagggcgccaccaagcagcaaatgattgattgctacatccagacccttgcccaggtgctagggagtgaagaggaggcgaagaagaagatatacaatgtgtcctgcgagcgctattttggattcggatgcgaaattgatgaagagacctccaacaaactcgaaggtcttccaggggttctttttgtgcttcctgactcttatgttgatgctgagaacaaggattatggtgctgagttattcgtgaacggtgaaatcgttcagcggtcgccagaaaggcagagaagggtggagccagtgcctcagagagctcaggatcggccacggtacagtgaccggacccgctatgtgaagcggagggagaaccaatcttaccagagatgatgtctccgtttctggagatggaaaatgccagggtttccacaggtgtgccatactggagatgcaggagcaacccccactacccacatgagaatgacatccgttgtgtttgctgcgctttctaagcttgacaagttgacattgcttatgcgtttgggcttgtacctctagttgatatgacggtgtatccttttaactccgcataacattgtgtttgaagtcttctttagtcagaaaatattgacgattatcaaaaaaaaaaaagctactgcattgggcc

SEQ ID NO: 7893 - DNA, 2594 bp, Zea mays
  misc_feature (461)..(461): n is a, c, g, or t
gttcttgttcttgcttttgtgcagttagatgaggcatccagggctctcctgatgaaggtactaggagatgccacccaggacgctgtgcggaggcaggcaaaggtaacctgttttttttcttttcttgttgtgccattaattgtagacggccacaccttcacagtactatcttctggtgaaatgccaacgccaaccaaaattaagatttgtctttctgcagatgttatcaggttctctagtgtccccagcgctagagagagagctctccatgcgatcagactgccggacagggcatgccgatccgcgcctgaggccagtggcgtcacccagtcccagacccagcctcctggccagtgagcgatcgcgccagcttaacctgcaacactctacggtgtcaagccgatccggcctccacgccgacggccttcaccatgcagcggaagagcctgaagagcctaccnttgcccttgctcgcctccccttcaatcgctcgtcgagaaccacgttgccggcagcacggcatcgtccaagccaagagcaacggcactccaacctcagcctccactggttctccgtggctggaacgtcgagacatggcacggtgaccggaagtactccgtttgccaaccgccgggacagtatctatcgcagctctggccgtggtgaccagtgggcgctggaaagcagcagcaggcggcgttccgtgtcgcgtgagctgtctctggggcaatcgtcaaggctgcatggccgcgccaccatcccgcggcacgtgggagcggatagctcctcctcggtgcctctcttcgagaggctggactctgggctgtccgtgagcatggcgtcgcttcatggcgtggagcgtgccggacgcggcgtggctacgccggaacgctcttcctcgagcaacacggtggcgaccattcgaagccgcatcagaacaagcagcactcctttcacggagcgctccctgcgccgatcagcagtacaagggaggactccacgttcacgcgggaggcaacaaggcagcgacgacgtttccagcgaggacatgtaccgcagcatgtacagcggtagcagaagctcatcgtgcgccgcctccagaagcccgacgccgccggcgccggcgccggcgccgcgtgcttttgctaacccctactactactcgccgccggtggtgacacggggcgttgctccgccggtgtacgcacctgagcaggtgtcgcgctcaacgaggaggcgtcgtcgacaggaagtcctggacaagcgggtggcgcggctgcggatgctcaaggacaaaatcggcgcggtgttccatcaccgccacgaccatcaccaccaccaccacctcgggggcggccaggaggagggcccctcgtccaggtccaggagcgtcgtccgcggcgcgggccacaactcgccgtggcagttccttacgagcatgttccaccgcgcgatggaagggaaagataagagcacgaggatccgaacggcggtaggcgtgccggcggagaagaggcgcggcggtggcgggaacatgcgcgctctctttgacgcggtccggcggcacctgaagggaaagcggagggcaccggcggcaggcataaagctgaggaggaaggccagcctgagccgggtgcgggccaagaagatgcattggtggcagcggctgaggcggcggcgcggcatggcagggctgacggcgggcagtagaccacggcgccgtttaggacattgaaaggtggctgtaggccttggccttgttacttgtggtcttgtgcttattgcaactgcacattcacttgcgccgctgtttcaggtttcatgagcttggactgagtttgttttgagctccgaaataatcccattttttgaaagtactctagccggtggatgtttcactgttagtacgtattgtagtagctatgaatatctgccgcctttgtagcgtagcctatctgcctatatataaggagggactggccttttgaactatgctatctgtttgggccttcagttcgagtccgagtgtgcgcaggctaacggacggcccatgggagtgtcaatactcaataggctgaaggacaggacagcaatgtgcgccccgcgcggccgccgcccccgaaaaaagctcaaaaccccatccaattccaaatcccacttctcgccagttcacctccgcctccgctcctcccctccccctcccgtcctgccatggccaccgcagcacgcgccctcgtcgccgcacgcccggcacggccgctgctgccgtctcggcgcctcccgtcctcctcttccatccgtcccgcgcggcaacgtgctggcgtcgggtgcgtccgctgcatggctcggcggccggattccacctattccccgctgcgttcgggccagggcggtgaccgtgcaccgactgaaatggcgcctctgttccctggctgcgactacgagcactggctcatcgtcatggacaagcccgggggcgagggcgccaccaagcagcaaatgatagattgttacatccagacccttgcccaggtggtagggaggtaagtggtgcccctggttcaatcacatatcatgtttggatgattggcggg

SEQ ID NO: 7894 - DNA, 2656 bp, Zea mays
cactaaatctagtttacattttaagatcatgaagctatatctgtagcgccatagatgtgaaagaaaagttgacaatcgggatatttcggagacataaaattgtctctaaccattctttccatatttctcctctttatatgtactttctgttatatttactatattctctctctcttatatatatatatatataaactattctttctatctagctctccttatacgctgtaacttagttatttaacgtttttatcagtttttgagttttaaaaaaccttaaaatatttgtactagcttaatgcacattattattaagttacaaagattaaaaatggttaatatcataaaaaataaagtaattaaataataaaaggatactagaactttctccatgtatgaggagagcaacctctctttctcgtgtagggagcctatccaaagtacactatatatgagattggggagatgtgagagacatccttggagatggcttaacgtaaactttttgcatatcataaacgaggatgccactattttatttgagccttcagtctgagttatgagtagcagaccgtgtataattaccatgaataacattgtatatttgtattgtatgtactgttttacactacactcttttgaaataaggtgccgtttggttcacatacgtaatgagtaactaataacgttaaatcttgtttgttttagtctaaccgtaatcagatatcacactaaaacttgatactagcctattcaaacttgttaccgccggtaatcgaacgtaaatcattactattatgatttgcgttacatttttttttaaccaaacagcaacgggcccatcggagtgtcaacgagctcaagcacagcaaatatctcccgtcgtccgggtcgctcagaaaaaccccatccaattccaaacaactcttctcgccatttcaccaccgcctccgcccccatcctctccccctcccgtcgcgccagtcaacagcctgtctgcctcttccctcgccacccatggccaccgtagcgcgcaccctcgtcgccgcatgcccggcacgctctctcctccgcttccggtctcggcgcctcccgtcctcctcttccatccgtcccgcgcggcaacgtgccggcgtcgggtctgtccgctgcatggctcggcgaccggattcctcctattccccgctgcgttcggggcagggcggtgaccgtgcaccgactgaaatggcgccgctgttccctggttgcgattacgaagcactggctcatcgtcatggacaaacccgggggcggagggcgccaccaagcagcaaatgattgattgctacatccagacccttgcccaggtgctagggaggtaatggttactcctcaggtttatttgtttggcggtatgagaaacaatttttgataattcgctatctgttgttgcagtgaagaggaggcgaagaagaagatatacaatgtgtcctgcgagcgctattttggattcggatgcgaaattgatgaagagacctccaacaaactcgaaggtgacttgtttggttccttgttaaagcgtaaatacatgcataacatggaagattaaggtcatgtttgaatgtactagagccattgttttcaagtcaggacggcttgctggtggttctgtctgaccaacttggacacgattaatcacagacgacttgggcgattaatcgtgattggtccaaaccgacttgactattacttgtgactaatcacgattaatcttatgacttgaaaataatgactagagctaatagttagttgctaaaattagccgaagacatttaaacaccctggctaatagttcagctattaatcacttttagcagattagctaattgctatttgttagctagctaattccactagcaattttttagccaaactaactattagctctagtgcattcaaacaccccatttctgtgtgtgcagaatgcttaggccatgtttgaatgaactagagctaatatttagctactaaaattaggccgtgtttgaatttactagagctaatagttagctactaaaattagttgaagatattcgaacagtttagctaatagtttagctattaattatttttagcaaattagataacagttagctagctaattctactagcaattttttaggagtgcttaaatgcactagagctaatagttagttggctaaaaaaatgatagtggaattagctagctaacaaatagctaactattagctaatttactaaaaactgtttggatgtcttcagctatttttagtagctaactattagctctagtgcattcaaacataaccttgtctaactaactattaactataatgtattcaaacactcatttagctagagacatccaaaaagtctagctaatgtacagctattagctacttttagcaaattagctaatagttaattagctatttgttagctagctcattccaatagcaatttcttagctaatgaacatccccttagttatattcagcgatttcagcgttgctgtctatttgtaattatgtccgtgacacattactttgttgagcttagatactacttgtatgttattttcttctggaacattacttggttgagcttaggtactacttctatgttattatatcatgtt

SEQ ID NO: 7895 - DNA, 1169 bp, Zea mays
ggctggccgggaaaaaaccccatccaattccaaatcccacttctcgccagttcgcctccgcctccgctccgctcctccccctcccgtcccgccatggccaccgcagcacgcgccctcgtcgccgcacgcgccctcgtcgccgcacgcccggcacggccgctgctgccgcctcggcgcctcccgtcctcctcttccatccgtcccgcgcggcaacgtgccggcgtcgggtgcgtccgctgcatggctcggcggccggattccacctattccccgctgcgttcgggccagggcggtgaccgtgcaccgactgaaatggcgcctctgttccctggttgcgactacgagcactggctcatcgtcatggacaagcccgggggagagggcgccaccaagcagcaaatgatcgattgttacatccagacccttgcgcaggtggtagggagtgaagaggaggcgaagaagaggatatataatgtgtcctgcgagcgctattttggattcggatgcgaaattgacgaggagacctccaacaaactcgaaggccttccaggggttctttttgtgcttcctgactcttacgttgatgctgagaacaaggattatggtgctgagttatttgtgaacggtgaaatcgttcagcgatctccagaaaggcagagaagggtggagccagtgcctcagagagctcaggatcgaccacggtacagtgaccggacccgctatgtgaagcggagggagaaccaatcttaccagagatgatgtttccgtctctgaagatgtaaaatgtcacggtttccacaagtgtccaaatgcggtactgaagatgcagcagcaactccccactactcatatgagaatggcatccgttctgtttgccgcgcattttaagctgtatatgcttattatgcatttgggcttgtacctcagtcgatatgaacgatgtatcctttgaactaacgcattataatttttgaaaccgttttagccagaaaaaaaaaaaaaaaaaaaaagcccctgctggtataccgcatgatcatctcggaaggggcccgtccgttcgaccgttcccctctcacaaactgctccagtactccaacccgttaaactgttgatggtgacatgatgccacattgccactgacagtcatatgcatgccgtcaccatcacat

SEQ ID NO: 7896 - DNA, 1010 bp, Zea mays
actccatagggcgattggttccctcgagcccggccgggaccaaaagttcaaaaccccatccaattccaaatcccacttctcgccagttcacctccgcctccgctccgctcctcccctccccctcccgtcctgccatggccaccgcagcacgcgccctcgtcgccgcacgcccggcacggccgctgctgccgtctcggcgcctcccgtcctcctcttccatccgtcccgcgcggcaacgtgctggcgtcgggtgcgtccgctgcatggctcggcggccggattccacctattccccgctgcgttcgggccagggcggtgaccgtgcaccgactgaaatggcgcctctgttccctggctgcgactacgagcactggctcatcgtcatggacaagcccgggggcgagggcgccaccaagcagcaaatgatagattgttacatccagacccttgcccaggtggtagggagtgaagaggaggcgaagaagaggatatataatgtgtcctgcgagcgctattttggattcggatgcgaaattgacgaggagacctccaacaaactcgaaggccttccaggggttctttttgtgcttcctgactcttacgttgatgctgagaacaaggattatggtgctgagttatttgtgaacggtgaaatcgttcagcgatctccagaaaggcagagaagggtggagccagtgcctcagagagctcaggatcgaccacggtacagtgaccggacccgctatgtgaagcggagggagaaccaatcttaccagagatgatgtttccgtctctgaagatgtaaaatgtcacggtttccacaagtgtccaaatgcggtactgaagatgcagcagcaactccccactactcatatgagaatggcatccgttctgtttgccgcgcattttaagctgtatatgcttattatgcatttgggcttgtacctcagtcgatatgaacgatgtatcctttgaactaacgcattataatttttgaaaccgttttagcc

SEQ ID NO: 7897 - DNA, 3367 bp, Zea mays
caccaacaaatactgttttcaggagtctaaaaactgcatgattaattagttcatgcagtagctttgtaacaaattgcacaagttccaccgagattgaatcttatataacaacaacaatgcaagaacaggagctcaccaacaacgtatgtgtacacaatacctgttctgttgtacctgttgcagcttgcgcctccatgttaccatcatcgtctgccacactctcacaagaaaattgtgtcgggaacatgtctggtagtagagcaacaacatttacattgatgttgtttgtcgaggcctgcgggtagacggtagagacaccactctgtggtagccgcatcggacgaggagcaccatggactggagggcgggctttcggagatgcggatggcgggcactgcatattattgtggaaggtgagcgatagtgcgcgatagaagcgagagcgagatggggaatgctgtgagccaggcggcttgcgcggttcaggcgaggaagtccggcggggacgcacctacatgctactggcggcactcacggagacgagctccgggatgacgagtagctagcggtggagcttcgcagggaggccagccgcgcgtggcagcgaggccgctagagaggggagatcggggctacgcgcgctaggttggcggagcgcgtggagaggggagttgggggcggcgagcgccagaagagggagggcggcacagatgtttcgtcgcggcaaaaaaaaaaaaaaaaacagcgattgcggcctcgggagctctgcgtagttatgcgccagataacactcgttttcatccgcctatccaccggtatccacgcgttccccaatcgagcaaaaatcaatcccagatcccaatccctacacccacctcccaacaaaccctaactttacccctccaccgagcgcaaccggctgcgaccaaagatgccggcgacggcggggcgcgtccgcatgcccgcgaacaaccgcgtgcacagcagcgcggcattgcagacgcacggcatctggcagagcgccatcggatacgacccctacgcgcccgagaacaacaagcaacagccgggccgcccctcctcctccgtctccgccgccgctgccgccgcggccgccaacgacgccaacgcagccgccagcgccgcagcagcttccggatccggctcgagcgatggcaacgcctacaccagcttccagggcctcctcgcgctcgcccgcatcaccggctccaactccgatgagacacgcggcgcctgcaagaagtgcggccgcgttggccacctcaccttccagtgccgcaacttcctctccgtcaaggacctggacctggacgacgcccaggccgctgcacaggcagccgcgcaggccaagttcgacgaaataaaaaagaaggctgctgctggtggggacgcagatgaggcttctgatgacctcgaagaggaggaagaggacagcgattcctctgattcagacgtcgaccctgagctggagaagataattgctcagcgcgagcgtgccaggaatggaggacggaggcacaggcaggaagagaagtcgttgagccaccgctataggagcagcagcagcaagagaaaatcaaagcacacaaggagttggagaagtgatgatactgaggatgaagaggaggaaggcagaagaggcagggacaggaagaagaggtccagcagatcgaaaaagcatgaaagatcagatgaggctagcagtgatgactctgactcagataggcagagacacaggaagagcaggaagaacagatcagatgaggctagcagcgatgactctgactcagataggcataggcgcaggaagggcaggaaggacaggaagagaaggaggagccaccgcaggagagacgactcatcggatgaggtgtctggaggtgaagaaaggagacgccaatgtcaccgcaagcggagccatcaccaaagggatgcatctgactgtgacaaaggtggcagtgattatgcagatgaaaagaagcaatcgagcaggcggaggaggcaccgccagtcagaaagcagtgggttggatgaggatgagcggcgtgatccccgaggagcaaagcgatctgaggagaagaacagggaccgcaagaggaactaaagaggagcattgaattggtaattcctattggatgatgttattgagttcctctatttgtcagctggttcgttgccttgccataagtttgacacatttgaagcatgatgcttaatatgtgtaccaatatagcatgccctgtattactgcatgtctctctgaactatacttcgagtctattatgtgtttaggatttgataattgatatattgtcaaggatttttaatatgatgcattcagttagccttcccccgcaataatattgcctgagagaattggcattagaacatttctcctacattgatggatcctttctagctatgtaagagagttattgagcattatatgagaggaataacgaggatctctacgagctaatttggttttgtgcccagaaggcccgcccgggaaaaccattttcttaattagacgagtgatcatgtagtatagggagcaaaagagggaccttcccattgtttcaattgactggaaaaggcttattacaaaataccaagaaatgttatgtggtgaactttggacaaacataaggttccaacaaaatatgttggactcatttagggcattgtacaacaatgttgtgactagtgttcgaactactgatggagacatgaatgacttcctgattagaataggactatatcaaggatcaattttcatcccttaccttttttccttggtgatggatgagataaaaaggggcaacaaggggatacctattggtgtatgtttttttgctgacgatgtagtgctagttgataaaagtcaggtggggataaataggaaactagagttgtaatgggaggctctagagtccaaaggttttagacaattagactcagtagaactaaaattgaatatgagatgtgatttcaccgctgtacatgagaaaagatatgcttgtttggaagatcaagtggttcccagaaagaatactttcgttatttaggatcaatgctatggagagacggagatattgatgattagtcaaacgacttggtgactattcacaattggtccaaatcgacttggacggttgatcgtgactaatctcgattaatcggacggcttgaaagcattgatgttagccatagattcaaaataggggtgggtaaagtagcgtcaaggatatggtattctatgcgacaagagagtaccacagaagctaaaaggtaagttttataggacggccattagacctatattgtatggcgcagaatgttggcc

SEQ ID NO: 7898 - DNA, 2114 bp, Zea mays
cccacccttccttttccggttcgactttcgacctttcgacgcgttccccaatccagctgaaatcaatccctgatccccaatccccgtccaccctcccaacaaaccctaactctacccctcaaccgagcgcaaccggcggcgatccaagatgccggcgacggcggggcgcgtccgcatgcccgcaaacaaccgcgtgcacagcagcgcggcgttgcagactcacggcatctggcagagcgccatcggatacgacccctacgcgcccgagaacgacaagcaacagccggggcggccttcgtcctccgtctccgccaacgccgccgccgcagctgccaacgacgccaacgcagccgccagcgccgccgcagcttccggatccggctcgggcgatggcaacgcctacaccagcttccagggccttctcgcgctcgcccgcatcacaggctccaactccgatgagacacgcggcgcctgcaagaagtgcggccgcgttggccacctcactttccagtgccgcaacttcctctccgtcaaggacctggacctggacgacgccgacgcccaggccgctgcacaggcggccgcgcaagccaagttcgacgagataaaaaagaaagctgctgccggtggggatgcagatgatgcttctgatgatgtggaagaggacgaggacagcgattcctctgattcagacatcgaccctgagctggagaagataattgctcagcgcgagcgcgccaggaatggagcaaggtggcccaggaaggaaaagaagtcgtccagccaccaccataggaacagcagcagcaagagaaaatcaaagcacacaaggagtaggagtgatgatagtgaggaggatgaaggcagaagaggccgggacaggaagaagatgtctggcagatcgaagaagcatgaaagatctgatgaggctagcagcgatgacactgattcagatagacagaggcacaggaagagcaggaaggacaggaagagcaggaaggacaggaagaggaggagccaccgcaggagtgacgacacgttggatgagaaggatgtatctggaggtgaagaaaggaggcatcaacgtcaccagcggagccatcactggagggatgcatctgactgtgacaatggtgacagtgattctgcacatgacaagaagcaatccagcaggcggaggaggcattgccagtcagaaaacagtgggctagatgaggatgagcgacatgaccaccggggagcaaagcgatcacggaagaatagggaccacaagaggagctaaagaggagcattgaattggtaattcatattcgatgatgttatcgagttcctgtagtcatcagctggtctgttgtcttctcataagttggaaacatttgaaatatgatgcttaatatgtgtaacaatataacatgttggtgtattactgtatgtctgaactatacgtcgagtctattatgtgttgatgattcaataattgatacattgacaaggattttttaagacaaaaaaaaaaaagagccgccccccccatctagactgcataagataactagtattagaacttttttcatacattgatggaaccagctagctgccaagtttattgagatggaccttataaagaattggattaggccctatagtaactgcttttatttttaagggacatgtttttttatggagtgatggcttaggttatatagcatattgtgttattcattctccatgccaattaattcaattctatgcaaattgatgctaggctctgcttttgtggtatttgaacaatcagcttttggggtatccttgtatgagatttttgaggtaacattgtgtctttacagcattatgcatgagttgtggtgtttgccagagtttaatgatcaatataatgtaggtgcttgtagagcgaatttctttcctactgtgctgattgtacacattagtatgttggaggatgcttgtatagaatcattgagacctttgttaggattttgacatgtctaggacgactttccgaagtctcctattgagctattaacttcatattacaacatttcatgctgcaatccatcttgatttagggactgcaaggcaaggcttgccagggg

SEQ ID NO: 7899 - DNA, 1238 bp, Zea mays
ccaaatttgagaggaggggagcctggtccaagtcgccgcgaaaacgacctcatcgcctcgcggcccgccgcggcaaatcgccgagagcccgagacgaataaaccgatgcgacgcgtcttcaatccacctgtccgtgatccgctcacctagaacctactagaaggcgaaccaacccgcacattcacttctcttcccatccgtacgaactcgcagatcagagagaccgaggcgcccgcggttctgctttccttccttgccccgttcacgagagaattttctggagtcttcgactcgagcagggttccgatggcgctgcaatggatgatcctggcgtgcgtggtggcggtggaagctgcggtggctgcgctggtcacgctcccggtgccccgcgctgtgcggggccagatcgtcgcgctcacgtccttgttcctgcagcccctgtccagtgtgatacccttcgccgccttccagatcctcgatctctactggaagaaggagcacagactgatgtgcacctcggagatttgcaccgccgaagagcgcattcgcttcgagaaatctatgtttaaagctcagagaaatgtcattctttgtgtttcagcatgtctcctttattggtgcatttatcgtattgtaaaattgaacaaggatattaaggctttggaagagaccgagaagcgcctcaaggaagagtagatctattgtgttttaaggtggctgttgtctgctcctggtcttcagaagatattgttaaaatatcatggttcataggatatctagtgtatagtcttcttgcagcaaagaagataatgttttgctgtttcagcaaacatctgaagtatgagtcttattattaagaggtcttttctttaacttatggcgagtttagcatcggtcagttatcaaacagttaaagcgttttctgaaatcttgtttgaatatccgcagtcctttttttggtttggcatgccgaattattctgaaatgtttagtaccccgttgttcgtatttaaaaaaaaaaaaaaaaaaagcacatgcgggcgcgcggtggatccgatacgaaatggatattgcaaatatgtctgcaactatatccgcggttgcaactaatatccgcccgtgatcatacccgcgggtagaaatttatatccatgtccgtgtccatcagattttggatatccattggatatgaaatacacaatcatttattcaagaaaaaaaaaaaaaaaaaagcggcc

SEQ ID NO: 7900 - DNA, 844 bp, Zea mays
gggtatgctatgcaataatatctgctgactttgagactgtgcagagaaatagaagaagaagctatgttatataagttatgattacaaacgagaataccagctaggacttgagaccacaatccttgtgaaaagttacactcttccagatggaagagttattaaagtaggcactgaacgatttcaagctcctgaagctcttttcactcctgaactgatagatgttgaaggtgatgggatggcggatatggcattccgttgcattcaggaaatggatattgacaacaggatgacgctctatcaacatattgtcttaagtggaggaagtaccatgtaccctggtctgccaagtcggttggagaaagaaattcttgaccgttatcttgatgtagttttgaagggaaacaaagatggcctaaagaaattacgactgcggatagaggatcctcctcggagaaagcacatggtgtatctgggaggtgcagtgcttgctgggatcatgaaggatgcacctgagttctggataaccaggcaggagtaccaggaagaaggtgtagcgtgcctaaggaagtgcgggcagtcataagtcttgccacatatcatccacagaagaaatggaggttgcatgtgtaaagaagagctctgttgttggtgttgtgtattgtagtgagctatagctgtcctgaacatgcttggggataaaccatgtttgtattggcctactcaatttgacctctgttattgatcatcctttttagatatggaacatgacggccacctttatttgcaaaaaaaaaaaaaaaaaaaaaaaaaaaaaaaaaaaaaaaaaaaaaaactcgaggggggg

SEQ ID NO: 7901 - DNA, 3253 bp, Zea mays
acggcgcgcgcacgcaacctaagaattcgaatcgaggggcgagccatttgcggcggagaataccctttccccgggggcccactttgtggtgtgttgcatagcccaacctctccccaggtcaccgaccatgcaaggaggtgtcgttgcgattgcgaggacgcacgaaaaatggaagaagcttttgcatccacccaggccgtgaaaaggtgccagtgaggacgaatccaagcacacgcccccactcgcttgaaactgccgcagagccccgcaaaggcaacgactgaaactgctccggcgaccacgagcgcacctaaaccccgcctgcgtctcgtcgccgagaagaatcttcgccttcgcgaagcctctccatctcccctctccgccgccgccgcttcctcgccgggactcgggagtcgggagcaatgcagctgtaccaccacccctattcgctggacagccagaaggtgcggatggcgctggaagagaagggcattgactacacatcttatcacgtcaatcctctcaccggcaaaaacatgaatgtggacttcttccgcatgaacccttccgcgaagctccctgtcttccagaatggagcgcatgtcatctatcgcgctatcgatattattcagtacatagacagacttgcagtgcatttaagtggtgaaatcccccctgtgaacactgaggtccaccaatggatgcagaaagttgatgcttggaaccctgagatgttcaccctcacgcacaccccggccaagtaccgtgcgtttgtctccaagttcataaggcgggtgctgattgctcgcatggctcaagcccctgatttagccagcatgtatcatgtcaagctccgtgaggcttacgagacggatgataaagtgaaggaccctgacatcatgaagcaaagcgaggaagaactaagcaaactccttgatgatgtcgaagctcagctcggcaagaccaaatatctcgctggcgatgaattctcacctgctgattcgatgtttgtccctgttcttgcgcgcataactattctggaccttgatgatgagtacatcaactgcagacccaagatacttgagtactacaatttggtgaagctgcggccaagctacaagattaccattggcagatactttagtgggtggaagaagtaccggactctcttcaagacatctttcttcctttgtgttcgaaccctgttcaggaagtactagatagttcggcggatgaaatatctgaatcagtaccttgtgaactgacatgtatagtgagtttcggttaaaaaataatctgtatatcttccatgtgccttttgtggtcttgagttcagtttttacctgtaaaatcaatatgtttgtttgattatatatttctgcttcatgctggatgcaaaaatgaaggttatagaactgtatacagaataggactaagtatatattttgggtttatcacttgttctagtccaattcatgtctaaaataaattgttgttagcttgtgattttggcattgtctaattgtttccctaatttataacttcaccaagttattatgtcttttttccttctatcttctaattgcttttaagggaggttatccctgatactctaatgcacaaggtatgttctatctatcctttcagcccactcctatcatacttaagtgcaagttctatgacactctgatattttcttttccattctaaatgcaggctttgatactgattggcattttagatatgaccatataggaagccagtggcaaatctagccaaacatatcgtcgaggtcatcaggattagcttcactatataatacattttttttgaattttaatagtgctttgctaaatgatttataaattttatcagggtcgctgacctcgataaacactcctaaattcgcccctgaggtaagcataagatctgcatgtgctctacatttaaaatgcagtacagtggcctgactatcacatgctccttttgctccaatgatgtaccatggcccaggtctgtactttgttttctctgcataatgttttctccagagtacactacaggtctatatatacctcagagagaaggttttctgttcaacaatccaagtttctttgctgtggagcatatggaaagctgtagctataggacttgagagtgagctgggaaagggaagagagggcctaagagcagtgggaatgggaacatggaggaaagcccatcctgttggtttcctcctccagaaaccgaggtggaagcttggttcggtgtttcccgatgcctcccattcctattgttcttaagcacttcatccttttccttttggcttactgtgcatccaaattatgctcctatttggatgggttgaatttgagagtgagcatggaagaggaagagagggtctaagagcagtgggcatgggaacacggaggaaggcctatgagtggaaagctcattttgggtcttcctgatgcctcccatgcctatcgttgttaggtgctccttcctcttgcttttggctcacatgacatacacgatgagtgttgtgcctccattcctgatttgacatttttttttcttttatgtttgttttggcatgccttagtagatgcatagtttacggtgttggctttgtttcctggaatgttttaagttcaaaattttggcatgtttggtcacagataaattaaaggtagcttagttagattgccaacagttcaagtttcagattccactagcacaatcatacaattgcttaactattgactgttctgaatatgaacacatatcatgcctacagggctacatctatcagctagcatatatggagtaagaaactaactagcacttcctcgaacttaacagcatgagacacagaaatgctgtttgacagaacataaaaagggcatgcattttcagccaacttatctttgacgaagtactgcaaaaggaagtacagagacaaggatgatgaaacatatataagaatataagatatgaacattgtacatctgactccatagcaggaacaaactcagcaacttccctacaagatttgaaccaaatgagctacactgaaatcacacaagcatggggcatagcaattcagaagggcaggcggtcaataagtttgcaagaagaaaatatgggagctagaacatttatgactaattgcatcctgtttgcactgcctaaacatatgcaattacgtctgtggcaaatgatttctcatcgcgtgagttcgtggtgatat

SEQ ID NO: 7902 - DNA, 2424 bp, Zea mays
cattgggtcccccggccggcccgggtctcttcgctggggagacgaagctgctagccgatcaggggagaattcttttgtaatggagctgctgcgaccacgcggcgatggttgttgcccgcgcgtgctctcggtttctctgctgctcctcgccgccctgctgtggaagcacgtctctgcggcggcgattaccaggggtgatttcccggaggggttcgtcttcggcgccggcgcatcggcttaccagatcgaaggcgcatgggcagaggacgggaagaagcccagcatctgggacacatacacgcacagtggatattcgattgaccgtgatactggagatgtggctgcggaccagtatcaccattacaaggaagatgtgaagctaatgcatgacatgggcttggacgcgtacaggttctcgattgcctggtcaaggcttattccagatgggcgtggagctgtgaacccaaaggggttggagtactacaacagcctcatagatgagctcctcagatatggaatacagccgcacgtgaccatctatcacttcgaccttccccaggctctccaggatgaatacaacggcctgctcagtccgagaatcatcgatgattttaccgcttacgcagacgtgtgcttccggagcttcggcgacagggtgaagcactggatcacggtgaacgagcccaacatcgagcccatcggcggctacgaccaaggctacctcccgccgcgccgctgctcctacccgtttggactgggcgtcacctgcacccacggcaactccacgacggagccgtacgccgtcgcccaccacctcctgctcgcgcatgcgtcggctgtgtccctctacagacgcaagtaccagggcgagcaaggaggacggattggactgacgttgctggcctggtggtatgagccagcgacgcagaagcccgaggatgtagaagcagctgccagagcaaatgacttctcgcttggatggttcatgcatcccctggtgtacggcgactatccgcccgtgatgaagaggaacgtgggggcaaggctgccgtcgctgacggcccgagactcggccatggtgcgcggctcgctcgatttcgttgggatcaaccagtacggcgcgatcctggtcgaagcagacctgggccagctcgatcgggacctcagagactactacggcgacatggctaccaacttcgtcacggtaccgtttgagagcacagtaacgaggaaccagcaggtgcctcgacttgggctgcggaaccatgaggcgccgtgggctctgagcaaattgctggaacacctgcagacgcactacgggaaccctccggtgatgatccacgagaacggagctgggcacgagcccgacccgtccggcgggttcctgtacgacgacgagttcagggcccatttcctgcgggtctacgtcgaggcggcgctcgcttccgtccggaacggctccgacctgcgcggctacttcgtctggtccttcatggacgtgttcgagtttctcttctcctacaggttccgcttcggtctctacggcgtggacttcgccgccgacaaccggacgaggtacgctcggcgctccgcgcgatggtacgccggcttcctccgcggcggagaaaaaaaacaaaaactaaaaaataaattttttttatttattaatattatttttttttttttttaattattaataataattaaaaaatatattaaataaaaaatttatcattataaaaattaaaataaaataaaaataaaaaaactaaaataaactaattaaaacataaatcaaaaaaaaaaaaaaaaaatatttaaaattcactaaacttaaacaaatttatataactttaaattccccgactttaactgcttcattaaaatattttcatattataaatatattaacatctttttatatatttgctcatagatgtcacctttgtaaaatatttataggcttatatatatatccatgattcaagttcaaaatcttatactgcaaaagtctgttccgctttatgtataaactaactcaaatttcattgcttttctgttattaatcaatttttaagagagagatttttctttaaatatttatattgattaaagaatttcgttaataaaaaactctctctattgatctccaaagaattagtttttttcaaactgatactttcagaaattaatatactttatcaatgatctaataaattaaataagatggttaatctatttttattatgttactataaaatatttatactgaatacaatacagattttaaaaagcttgtatgcattattggtatttatttctacttacatatcaaatctttaccttgttcacaaagacttatttattccgttgttactaatctaggatgaaaatagaagtataattataaaattaaattaaatg

SEQ ID NO: 7903 - DNA, 810 bp, Zea mays
  misc_feature (699)..(699): n is a, c, g, or t
attgggacctcgagccggccggaacttcgctggggagacgaagctgctagccgatcaggggagaattcttttgtaatggagccgctgcgaccacgcggcgatggttgttgcccgcgcgtgctctcggtttgtctgctgctcctcgccgccctgctgtggaagcacgtctctgcggcggcgattaccaggggtgatttcccggaggggttcgtcttcggcgccggcgcatcggcttaccagatcgaaggcgcatgggcagaggacgggaagaagcccagcatctgggacacatacacgcacagtggtcagcgagcgagctagtagctcctcccatttctctcgctcagctccatatggtttggaaatccaagtcctgtatcgtctggttttttgtgcttgcgttgtgtaggatattcgattgaccatgatactggagatgtggctgcggaccagtatcaccattacaaggaagatgtgaagctaatgcatgacatgggtttggacgcgtacaggttctcgattgcctggtcaaggcttatcccagatgggcgtggagctgtgaacccaaaggggggtggagtactacaacagcctcatagatgagctcctcagatatggaatacagcctcacgtgaccatctatcacttcgaccttccccaggctctccaggatgaatacaacggcctgctcagtccganaatcatcgatgatttcacccgcgtacgcagacgtgtgcttccggagcttcggcgacagggtgaagcactggatcacggtgaacgagcccacatcgagcccatcggcggcta

SEQ ID NO: 7904 - DNA, 1925 bp, Zea mays
agtcccacttcgctggggagacgaagctgctagccgatcaggggagaattcttttgtaatggagctgctgcgaccacgcggcgatggttgttgcccgcgcgtgctctcggtttctctgctgctcctcgccgccctgctgtggaagcacgtctctgcggcggcgattaccaggggtgatttcccggaggggttcgtcttcggcgccggcgcatcggcttaccagatcgaaggcgcatgggcagaggacgggaagaagcccagcatctgggacacatacacgcacagtggatattcgattgaccgtgatactggagatgtggctgcggaccagtatcaccattacaaggaagatgcgaagctaatgcatgacatgggcttggacgcgtacaggttctcgattgcctggtcaaggcttattccagatgggcgtggagctgtgaacccaaaggggttggagtactacaacagcctcatagatgagctcctcagatatggtcgtcatttggtacttcattaattgcaacgttaatattaacggcgcctccgattccgaatggttttatttccgcgcgtgtaattaacgtgtggcaggaatacagccgcacgtgaccatctatcacttcgaccttccccaggctctccaggatgaatacaacggcctgctcagtccgagaatcatcgatgattttaccgcttacgcagacgtgtgcttccggagcttcggcgacagggtgaagcactggatcacggtgaacgagcccaacatcgagcccatcggcggctacgaccaaggctacctcccgccgcgccgctgctcctacccgtttggactgggcgtcacctgcacccacggcaactccacgacggagccgtacgccgtcgcccaccacctcctgctcgcgcatgcgtcggctgtgtccctctacagacgcaagtaccagggcgagcaaggaggacggattggactgacgttgctggcctggtggtatgagccagcgacgcagaagcccgaggatgtagaagcagctgccagagcaaatgacttctcgcttggatggttcatgcatcccctggtgtacggcgactatccgcccgtgatgaagaggaacgtgggggcaaggctgccgtcgctgacggcccgagactcggccatggtgcgcggctcgctcgatttcgttgggatcaaccagtacggcgcgatcctggtcgaagcagacctgggccagctcgatcgggacctcagagactactacggcgacatggctaccaacttcgtcacggtaccgtttgagagcacagtaacgaggaaccagcaggtgcctcgacttgggctgcggaaccatgaggcgccgtgggctctgagcaaattgctggaacacctgcagacgcactacgggaaccctccggtgatgatccacgagaacggagctgggcacgagcccgacccgtccggcgggttcctgtacgacgacgagttcagggcccatttcctgcgggtctacgtcgaggcggcgctcgcttccgtccggaacggctccgacctgcgcggctacttcgtctggtccttcatggacgtgttcgagtttctcttctcctacaggttccgcttcggtctctacggcgtggacttcgccgccgacaaccggacgaggtacgctcggcgctccgcgcgatggtacgccgcgcctctgtttcaacgcggacacacggctccacctattcggagtgaaaatcagccgcacgtgtctgtgttatagattcatcgcgagtgaacaagtacatgatggatgttcttcaccctcatccatgtctgtcgtatgcggcattttcccgtcagttgtgtatttgtttgcatttgaggaataaattcagttctgtagtaaaaaaaaaaaaaaaacggccccacgcgtccgcggacgcatgga

SEQ ID NO: 7905 - DNA, 2397 bp, Zea mays
ggaatcgcatcccgggggccgttgataatattacagaagagcagcggtccctgcttcgtttgcacgcgcatcagtgaaaaaattggatactacagttgaatttcagtccatgatatggtcggtggatgcatgcaggatggaacaaaggtcttagcagcccatagggcaaaaccgccacttccccagatcaagcaaaagcaagctaattacagaaaggctcagattgtctgctgcgctgcatttgatctgcacaccgcaggctttgttctactccctctgttccaaattattagagaattcaaacatcttaaatttaattaaaattataaaaaatataaatacttattatatcaaatacacaataagaatataattaataaaaaattaataatacttatggtatcacaaatattattactttatcgtattaaatatgagacagtactacctaactaaagtctgaaatatcctgtcatgtccgaaagatctacatccttctattctacaagtattcgtaataagaagaaactgaaacaaaaaatgggcaacaccgacataccgatttttttttcggacgatttgtcaatgactcacacctcaaactttatctttaggagagtgatccatagaaataacaaattcacaattataaggtggaatctataagctgatccatgcaaattgattgcaccttatttaagcaataaaatacataactgattgatcctgaacatggactcatgttcttgaccctgccaacaccgcacgttgcaggttctgacatacagtttctgaggtcgcctcccactccatttaagcacccgcgccctcctcactcctccgcacgccacattgatcgatcgaacgatctatcagaagttcagaatctatctctctgctcctggttcaccattgcgcaaattggagcaagatgggaaggctagccctggctgtgccggtgatgcttctgctgctttgcacgacgtgcagactgacgctcggaattacagacggtaacgtggttgatcttgattcgctgtcgttgttcgcatgcgatccttggtgtttgccgctggatgaagcttcttggcgcgatgtgtgattggttttctgccacggcgcgcgcgcgcgcgtgaatgcaatgcaggtctgctcccgaacggcaacttcgagcggagcccgctgccgtcgcagctgcgggggacccgggtggtgggcgcgtcggcgatcccgtcgtggcagacgtcggggttcgtggagtacatctcgtcggggcagaagcagggtgacatggtgctggtggtgcccgagggcgcctacgccgtgcggctcgggaacgaggcgtccatccggcagcggctccggggcgccgcccgcggcgcgcgctactcgctcacgttcagcgcggcgcggacgtgcgcgcaggcggagcagctgaacgtttctgcgtcggggcagtcgggcctgctggccatgcagaccatgtacagcagcaacgggtgggactcgtacgcctgggcctgggtcgccaacgccgacgaggtcgacatcgtcatccacaaccccggcgtcaccgaggaccccgcctgcggcccgctcatcgattccgtcgccatcaagacgctcaacccgcctcgtcgcaccaacaagaacttggtcaagaatggtgacttcgaggagggcccgtacatcatcccggggaccaagtggggcgtgctgatcccatcgcgcgtggtggaggaccattcgccgcttccggggtggatggtggagtcgctcaaggccatcaagtacatcgacggcgagagcttcgccgtgccgcggggtcggcgcgccgtggagctgctggccgggagggagagcgcgatcgcgcaggtcatccgcaccgtgccggggcgacagtacgtgctgtccttcaccatcggcgacgccagtaacgcctgccgcggctcgctcatggtggaggcatacgcgggccgggagtccaccaaggtggcgtacgagtcggcggggaagggcggcgtgaagcgcgccgtgctgccgttccgcgccgcgtcggcgcgcaccaggctcgtcttcttcagctccttctacagcaccaggagcgacgacctcagctcgctatgcgggccagtgcttgatgacgtcgtcgtcgtcagcgtgcgcacgaagcgcggctagagaagcgtgctctgtggagttggggcgtgccctgtgcgtgcgaaacggaggaatttttcatgctgctgtcatcgcacgggtactttactaccgtgtttgtaggtgctcgttgggggcatcagaaaattgctccaaccatcggaaatttgttgtgttagattattgacagtctgtttggttaacagcccggcgtgatccagagtgatccggacctgt

SEQ ID NO: 7906 - DNA, 2933 bp, Zea mays
  misc_feature (537)..(537): n is a, c, g, or t
gctcactagtccccccccccccccccccgggcgcacgcaagggggagtccgtcgccgtcaaagtcatccccaaagcaaagatgactacatccattgctatagaggatgtccgaagggaggttaaaatcttgaaggctttgtcaggaaacaaaaacttggtgcaattttatgatgcctacgaggacaacgacaatgtatatatagtaatggagttgtgtgaaggtggagagctacttgacagaatactttccagaggtgggaagtactctgaggatgatgcaaaagctgtcctggtgcaaatattaaatgtcgtcgctttttgccacattcaaggagtggttcatcgagatctcaaaccagagaattttcttttcacatcaaaagatgagaattcccatcttaaggccattgactttggcttatcagactttgtaaaaccagatgagaggctgaatgacattgttggaagtgcttattatgttgctccagaagttctgcatagatgctatagcacagaagctgatgtctggagtatanggggtaattgcatatatccccctttgcggcagtcgtccattttgggcaccgcactgaatctggcatattccgttcggttctcaaagctgaccccagctacaatgaggcaccatggccttcgctgactccagaagcaatggattttgttaagcgattgctgtgcaaggatccacgtagaaggatgactgcagctcaggctttaagtatgttgccattcattttattctggtggcttctattgaatattgcattgttgtgtgtattcatgtttttttctaggtcatccgtggatccgattcggcacgaccattaggctgccgttggacattcttatattccgacttatcaaagcttatattcgttcctcatctttacggaaagccgctttgagggctctatcaaagaccttaacagttgacgagcttttctatctgaaagcacaattttctttattggaaccagacagaaatggatgcatcactcttgacaatatcagaatggccttaacgagagaagctactgatgcaatgaaggaatcccgagttcaagacattcttgtttcgttgagcgcccttcagtacagaagaatggacttccaagagttctgtgcagcagcagttagtgtgcatcagcttgaagcattggatagatgggagcaacatgcgcgatctgcttatgaatattttgagaaggaaggcaaccgagctattgtaatagatgaattagcttctgaattgggcctcagtccttcagtgccactgcatgtcgttctgcaagattggatcaggcatacggatgggaaattaagttttcttggatttgtcaagttgttgcatggcatgtccagcaggtccctgtcaaagatgagatagctgtcgataatctctaacgacagcgcgtgtttacaccgtcctgttgacttggttcacaggcaaattaacagggctaaagaatcgtacgattggagcttgcatatcaagggcgtctgagctctaacagcacctgatccgacactaatttaactatagagttatgtttattgttgcctgcctactgatcatttagccgatagggaaatgaaagaaaatctcacccatgtctgcaacatgtgatgtttctaacaaccttagattaggcgtcatcttctgttatgattctagaaattttgtaatgcttcttttctcgaactggagcaagttagctgcagtcaccaggttggcgactggagcatggacatatcactgtcattgtgacattgttactgtatcattgtaccgacagatgaaagtgcttgatgtggtatgtccggttctctccgtgtatatattgattgatgagatggaattgtgccatttttaaatatcggaatattagtatgtcaacttgcactctctaaggctcttttggaaagcaggattttagaaaaaatcatataaattttttacaggaatcagttcattttcgaaggcatgtactccaaaagactctaattgtacatcttataataaactgaaatgcgtgcaataaaattattttaatctttactggatatgtgaagatatttagaatgatctgggctatgacaataaaactgtattaattttgagaagacacaggaaatgattttctttcttgttttgtgaggattccagagtttattgtataaaaatcagtgctcgtacatatcttgaaagtgcatttatttattcatatgtgttgatatttttttctgtaaaaattgcgaaatggcctcaatctctaactggttagatggtatgctctaactggttagatggcacagtggcggtcataagattttggggtccatgacaagatctgaaatagtggctcttctagtttttttatataaatattactaatataaacacttaagatacatctaaaaatatttatatcaattaataagtaaataaaaagacacttattacaatattaccttaaaatttcttctaacatatttagataagattgattgtgaacacgttgtagccataaactctttagtacttcatggctaaactattatgtcatacactgatagtttaactacttaatttatatctaggattagggccctatggatctggggctcgggggcggccgtccttctgccctactccgaggcctgccgctgagatggtacgagtagcattccttacgtgtccaacatgttattcatattttctaaaatactaatttgcactgtttgcagagtgaaatttaaaataggaaacgatataagagatatgatgtgtaaactgctacttataggtagaccctgagttatggatggtatagtggttcgagaattttttcgcccctgtgagaatactttcttcttaatataatgtttgaggctatttttacctagaccg

SEQ ID NO: 7907 - DNA, 1592 bp, Zea mays
cccacgcgtccgcccacgcctctcgcgtgcgggtggagagctacttgacagaatactttccagaggcgggaagtactccgaggatgatgcaaaagctgtcctggtgcaaatattaaatgtcgtcgctttttgccacattcaaggagtggttcatcgagatctcaaaccagagaattttctttttacatcaaaagatgatgattcccatcttaaggccattgattttggcctatcagactttgtaaaaccagatgagaggctcaatgacatagttggaagtgcttattatgttgctccagaagttctgcatagatgctatagcacagaagctgatgtttggagcataggtgtaattgcatatatccttctttgtggcagtcgtccattttgggcacgcacggaatctggtatattccgttcggttctcaaagccgatcccagttacaatgaggcaccatggccttctctgactccggaagcaatggattttgtcaagcgattgctgtgcaaggatccgcgtagaaggatgactgcagctcaggctttaagtcatccgtggatcagaaattataatgacattaagctgccgttggacattcttatattccgacttatcaaagcttatattcgctcctcatctttacggaaagctgctctgagggctctgtcaaagaccttaaccgtagacgagcttttctacctgaaatcacagttttctctattggaaccagacaggaatggatgcatcactcttgacaatatcagaatggccttaacgagagaagctactgatgcaatgaaggaatcgcgagttcaagatattcttgtttcgttgagcgcccttcagtacagaagaatggaattccaagagttctgtgcagcagcagttagtgtgcatcagcttgaagcattggatagatgggagcaacatgcgagatctgcttatgaacattttgagaaggaaggcaaccgagctattgtaatagatgaattagcttctgaattgggcctcagcccttcagtgccactgcatgtcgttctgcaagattggatcaggcatacggatgggaaattgagctttctcggatttgtcaagttattgcatggcatgtccagcaggtccctgtcaaagatgagatagctgttgataatctctaacgacagcgcatgcttacaccgccttagcccttgtcgacttggttcgtgggttggagcttgtgtatcaagggcgtatctagcagcacctgatctgtcactaatttgagtatagagttatgtttgttgttgcctgcctactgatcattagccgataggaaaaaggaaaatctcacccatatctgcaacatgtgatgttatctaacagtgttagattaggcgtcattttctgttgtgatttttggaaactttgtaatgcttccttcctggaactggagcaagttaactgcaagttaccaggttggcctttagagcatgaacatatcacttaccgtgcgtggtcgttatgtggtactacgtcaggttctcttcgtgtatatattgatgagatggaactgtgcattattttgaatctcaatattagcatgtcaatttgc

SEQ ID NO: 7908 - DNA, 821 bp, Zea mays
cattgggtacctcgaggccggccggactcgacaccgcacggcctcaagcagaggaagctttccgcccgggaacgccatggggtcgcttcctctccttgctgcctgctgctccctcctgctcacggtcgcagctcctgcccgggacagcactaccagcgtctgcgcttcgcaaatcggcgatttcccgcaccggaacagttcgggcctccacctgacgctgcaccacccgcagagcccctgctcgccggcgccgctcccgtccgacctccccttctccacagtcctcacccacgacgatgcgcgcgtcgcccacctcgcgtcgcgactcgccgccagtgatccgccgtcccgccgtccgacatcactccgcaagcagaagaaggccgccggtggtgcttccggcggccaccacctcgacgacgactccctggcctccgtgcctctctcgcccggaacgtcagtgggcgtggggaactacgttacccagctcggcctcggcacgccgtccacctcctacgccatggtagtcgacacgggctcctcgctcacctggctgcagtgctcgccttgcgtcgtgtcgtgccaccgccaggtggggccgctcttcgaccccagggcctccagcacctacacctctgtgcggctgttcgggcgtcgcagtgcgacgagctccaggccgccacgctcaacccgtccgcctgctccgcctcaaacgtctgcatctaccaggccagctacggcgacagctcccttctccgtcggctacctcagcacggacaccgtctccttcggctcccacagctacccgagcttctactacg

SEQ ID NO: 7909 - DNA, 5632 bp, Zea mays
  misc_feature (4902)..(4902): n is a, c, g, or t
gatgctccaagtctttgacttgctcttcactcttgcaactagttcatcaaagccaagccatgcctcttaatcttatccactagccatatggcaccatgtcacgtctcatatgaaataagattctccattggcacttagttgaacatttccacaaatcaaagacattttcacctccatggattaaattgctcacactagtgtacttgtggactaatctatttgtacctcaacataatcatttattagtccacttaagttaccactcaattaccaaaaccaaacaaggacctttcaaatgatgaggcatagagtttggtgaatttttgtgccttcctgaaaggtctttctatattatgcacaatgctcacggagtgcccctcccccacaccacccagatcgaggaacaattatgttcatagtataaacttgaagagtaaataaaaaataaaataaaaattgttgtaatgctgaacaagtgaagtaattaggaagtaaatggtttgtccatcgataaagtcagtgtggaagtgaggaacaacttgagcctagtagagaaaaatggaggcccttacaatttagtagcaaaccaacttattgctgtaaaaatactctcctggttcaaaaaaaaagaatacaattctcatttttaagaagtcaaacaattttaaatttagaaaaactactaaaatttatagtacaaaaactgtcattgaatatattatataatatacacatttagattcattatattaataatattttctataatcaaacttaaataaggctctatctaaatccagaatcatatattttattttttatatttatcagaacaagagaaataataaaaactatgattatattactcattagtatatttttataatataactatttagagtcgtaagtattaataatattttctataatcaaacataaagaagttggctctatctaaatctagaattatattttttttgtttaattatagtttgtacttactccacttcctgattgccttaattaatatctggccattatgctagcaaggccactggtggctggtttataatcacgatgcgaaggttacaacaaaaattaatcatgtttcattgtttacgtacgacaccatttaattaattaccacgtaattaggcatgccatagataacctctagagatgtttatgtttatagatagattttaaatgcttgaaatatttatatatatttaggggcggagagaacagagtttcgcagtttggctcttggcttcttaaaataatatactcatgtgtagctagatacacatacgtacgacgtactgggtcaataccaaaactgtggggcaaccgtccttctgaatttagaaccagggcggtctcagtgcaaagcaaccatgttgatgcacaaaagtgatgggaccgggccaaacttgtctcactgcgagcaagttgcttcccctttccatgggactatttagttcagcttttttcttaataactttctgtgggagaatcttgtgaataaaatttgagtctatagggtttatatatgaaaaaaaataaaagagtatgggatttaggatataaaaagttacactttcttgctatcacaacaattaagctgattttatacttacattaatattaaatggttttgactaaagtgattataatataaacgagctagaaaactaaacgtttgacaatcaccagaggctgaaaaggctgaattaaacacggcatatcgtcgtcactcactggttcagtgcgtgctagctgcatgcgtgcacgcctctgacgagtcaataatctcatccaatagttgctgggtcgccgtcacatttcgcgatcggtcggcgctggacgacataccacccaccagaatttaggggacgacactgccacaaccacaatcatcaacggggcaacagcacacggcaactagctaggcagctagctacatggcaccttagagcaactctaagagactaggtatatggttttataaagttaaatttagctaatattaaaagaaaattgtatccaatagactctgtaaacgactctccaaatttagtgactctctatttctccatcttcgctcttcgattttggatagtctgcttcactctctattcattccgtagatttaccgagtctgttggattagcctacattttttctctaaaatctattttagagagtagctaaatcagtaaatttggctagtctttttagctaatcttttggagttgctcttagcttgctgctgctgttagctataataagctagcctgatgcattgcattgttctagtataatgcactagtagaataaaaaactctatgcctacatcagagtatcatttttatagattgctttagttatctagcgtctcataaaataaaatggtccaacgatcaaagaaccgtaagtggaaacacatttttttctttacaaaactgtaagtagaaatgacaagggactcggactttcacccttcgaagcatgcaggttgagctttgtcacaagaaaacgatgtgatagttctatagaatatattattatttttcaatagcaaaatgtttgatactaatggtcaataatatgtatcggaggctagctatatcgatatgccaaaccattggtaaaaaaaaatgaacgaggtaactagccaggtgtgtgtgagtgacactatgacatccttggtgcacctcgtgcccgcgccggaacagctcgggcctccacctgacgctgcaccacccgcagagcccctgctcgccggcgccgctcccgtccgacctccccttctccacagtcctcacccacgacgatgcgcgcgtcgcccacctcgcgtcgcgactcgccgccagtgacccgccgtcccgccgtccgacatcactccgcaagcagaagaaggccgccggtggtgcttccggcggccaccaccacgacgacgactccctggcctccgtgcctctctcgcccggaacgtcagtgggcgtggggaactacgttacccagctcggcctcggcacgccgtccacctcctacgcaatggtagtcgacacgggctcctcgctcacctggctgcagtgctcgccttgcgtcgtgtcgtgccaccgccaggtggggccgctcttcgaccccagggcctccagcacctacgcctccgtgcgctgctcggcgtcgcagtgcgacgagctccaggccgccacgctcaacccgtccgcctgctccgcctcaaacgtctgcatctaccaggccagctacggcgacagctccttctccgtcggctacctcagcacggacaccgtctccttcggctccaccagctacccgagcttctactacggctgcggccaggacaatgaggggctcttcggccgctcggcggggctcatcggcctcgcgcgcaacaagctctcgctgctctaccagctcgcgcccagcctcggctactccttctcctattgcctcccgacggctgcgtcaacggggtatctctccatcgggccctacaacacggggcactactactcgtacacgcccatggcctcgagctctctcgacgcctcgctctacttcatcaccctgtccgggatgtcggtcggcgggagcccactcgcggtctcgccgtcggagtacagcagcctgcccacgatcatagactcgggcacggtgatcacgcgcctgccgacggctgtgcacacggcgctcagcaaggcggtggcccaggccatggcaggggcgcagcgcgcaccggccttctccatcctggacacgtgcttcgagggccaggcgtcgcagctgcgcgtgcccaccgtggccatggcgttcgcgggcggcgcctccatgaagctgacgacgcggaacgtgctcatagacgtcgacgactccacgacgtgcctggcgtttgcgcccaccgacagcacggccatcatcggcaacacgcagcagcagacgttcagcgtcatctacgacgtcgcgcaatccaggatcggcttctcggcaggcggatgcagctgaatagctgatgggtgaaaagtgaaaactgattattgagctctatggagtgggcagctcaagcttggtaatagaaaatgcgtacaaaacacaagtaaattcgctgaagtttatgaaatggtaatgttacaagctattgtattgttgattttacactcctggcaaattgtacatccttttacaggtaaattggagtgtctagatttttacatgtgtacggtcaaaaacagaaatctattttggatgatttggtctattatttaaaaaaaaaaagcggccttatcattatgataataacaagtgatatattgccaaaagacactactgacagaaaggtacaaagaaagcatacatgagtgatactccctcgtctcaaaatagtagtcattttagctcttggtttaatgtatatattttaatggatgatgatgaatctaaacacatacatcaagtttttgatgaatccattattttcctaaaacaaatggttatgttgattatcaaacaccaaaactcaataattaattgggcctcgaaccattttccttacaaaaggcatgcaaagaaatgaattggaacacatgttgtttagtagcactatacgcactatacgagtctgatgtggcatgagacaacaatagtgatatgccaaagaagagcaactgcaactagaagcaccaaacatcaaggtgtgctccatacctcaggcacaaggtgtatctggtggtgcaccataccccgcaccgacaatagctattttagacaaagaggatgtagagaagaattggagacatcgacaaggcaatagacgtatctatgtacataggatgtagcactagacttctcagtctccaatgattggcactgtagcantagtgacagggacatcgaacatttctagtgggtgcactagatatgtctagtgcctacacaaagagttgtgcagcccaatagctacattgccagttggggctatatgtaccctcttgattggccaaatgagagtttgtgaagctaaaggaagacttgtgtgaaccaagactaatctctagaagctatagccaccagattgcttagtacaatattcgatgattagtgtaggtgctttgtgtagtactcagattagttaggtcacaacgtatgtgccttttctaggtttaggcctagtttttagtgagattttcatacctaatagccgtttaggtccttgcacacaccattattatactcagaagggcttatagtcttacgatataatactaaaacatttgtggtgtggcagccaccatgtactaggtggaatgaggcatgcagcagtttggccagaaaccttagtaaccgagaactgggaacgtggccacgttcctcgttccgggaacgttcattccgttccgggaacgtgggaacaatctcgttcccgtagtgttaaaacatagttttagtagcgtaccgtgtaccacgttcccgttcctcgatcccatcgatctgggaacctagttactaagccagaaactcaatagtgaagatgactaagaggagtatgggagaggctattttggagatcgacttggtttggggaaagtccaatggagttacctaacta

SEQ ID NO: 7910 - DNA, 1855 bp, Zea mays
cacacacgcaaacatcatagaagaacagaacctttctctttctcttatataacattgggtagcgcgcgcccggccgggactcgacaccgcacggcctcaagcagaggaagctttccgcccgggaacgccatggggtcgcttcctctccttgctgcctgctgctccctcctgctcacggtcgcagctcctgcccgggacagcactaccagcgtctgcgcttcgcaaatcggcgatttcccgcaccggaacagttcgggcctccacctgacgctgcaccacccgcagagcccctgctcgccggcgccgctcccgtccgacctccccttctccacagtcctcacccacgacgatgcgcgcgtcgcccacctcgcgtcgcgactcgccgccagtgatccgccgtcccgccgtccgacatcactccgcaagcagaagaaggccgccggtggtgcttccggcggccaccacctcgacgacgactccctggcctccgtgcctctctcgcccggaacgtcagtgggcgtggggaactacgttacccagctcggcctcggcacgccgtccacctcctacgccatggtagtcgacacgggctcctcgctcacctggctgcagtgctcgccttgcgtcgtgtcgtgccaccgccaggtggggccgctcttcgaccccagggcctccagcacctacgcctccgtgcgctgctcggcgtcgcagtgcgacgagctccaggccgccacgctcaacccgtccgcctgctccgcctcaaacgtctgcatctaccaggccagctacggcgacagctccttctccgtcggctacctcagcacggacaccgtctccttcggctccaccagctacccgagcttctactacggctgcggccaggacaatgaggggctcttcggccgctcggcggggctcatcggcctcgcgcgcaacaagctctcgctgctctaccagctcgcgcccagcctcggctactccttctcctattgcctcccgacggctgcgtcaacggggtatctctccatcgggccctacaacacggggcactactactcgtacacgcccatggcctcgagctctctcgacgcctcgctctacttcatcaccctgtccgggatgtcggtcggcgggagcccactcgcggtctcgccgtcggagtacagcagcctgcccacgatcatagactcgggcacggtgatcacgcgcctgccgacggctgtgcacacggcgctcagcaaggcggtggcccaggccatggcaggggcgcagcgcgcaccggccttctccatcctggacacgtgcttcgagggccaggcgtcgcagctgcgcgtgcccaccgtggccatggcgttcgcgggcggcgcctccatgaagctgacgacgcggaacgtgctcatagacgtcgacgactccacgacgtgcctggcgtttgcgcccaccgacagcacggccatcatcggcaacacgcagcagcagacgttcagcgtcatctacgacgtcgcgcaatccaggatcggcttctcggcaggcggatgcagctgaatagctgatgggtgaaaagtgaaaactgattattgagctctatggagtgggcagctcaagcttggtaatagaaaatgcgtacaaaacacaagtaaattcgctaaagtttataaaatggtaatgttacaagctattgtattgttgattttacactcctggcaaattgtacatccttttacaggtaaattggagtgtctagatttttacatgtgtacggtcaaaaacagaaatctattttggatgatttggtctattatttatattgttaccctgcctttatcattatgataataacaagtgatatattgcc

SEQ ID NO: 7911 - DNA, 1578 bp, Zea mays
agtgcctattgatgcagggaaggaacaaagctctaccactgattgcgaggctccaactaaacttcagaatttggtctgttcaaagagtacacaaaaccattcccaatcccatgttaaattgggtctgtccaaagaacctggagacatttgtgcaaatatcacacaatattcccatcgaaagaagcactttgcagaacatagtgcagtgaattgcaatgcagaccaacactgtttagcagtgatagatgattgcataaagcgatctggcctaaactctgctgctcctgattttgttcccttagctgttaggaaatcaaataccagcgatggttcctgttcttcatctggaacgaacgtatcgggaattctgaaagagatcaatagtttgtcggaggtgttatgcaataattattctgatgaaattaagctagaggagcatgaccacagcctcctccaatcagtaattgggaatcttcagagttatcttcacaaagcaagcaaggttcctgctatggttgattctgacaagtcagggggactaaaggcttgctatgctcagaatgcaatttcaaaacctgtcgcaggagactacaatggtagtttcactgccgataatggaaaaggcataagtatctctaatcttggtgattctagtcctttggtcggtgacttaaggaaaaagagcgtgacagggtaccagcagcctgcactcagcaattttccaaaggagctctcatgggaggagcggtcacaggctcttatctataagaaactgtggtttgatgcagaacgcacaaactgtgctttgaagtatcaacttaaacaaacgcgtgtggaaatcgacctagagtcaagcacggctcatattggcgggggtccaagaaacagttctttccatctatgtgatgtgggtgtagatccaagtagttcctatggatctgccataacttgcccaccgatgatgctcaagggccatcctggagaaagaaagagtcataacctcctttctgctgctgaccacattcagtcaggagacagcagtgctctgtcaagaccaaaaggttacatagccgtgccagagaatattgaggatggatatttcttgtcagggtcggaagaaaccggtgtccgccgccatgcacgtcctggtctacaaagtaggcccctcggaaggttgaacacaagtacgtcagatggaatgtcatcctcgtatgtcactggaagggatgacattctgcgtggcagctgcgagtttggatcttcagattgggagcatgtgctgaaggaagaaatcggctcaacctaaattttttttgaagggatctggcaataagtatatagtactgtacatgtatgagcaaccacgaagctaggaattcgggtcttcttgatcttttttttttgcttgacaaggctgatgaatgggcactggttggaatggtgctgctctagcctacggaaaaccccttatttatcttgtcttgggaacaatgcctataaatcataacttggatggctatgctaattttctactgcgccgaatgcagatgttattttggccaaaaaaaaaaaaaaaaa

SEQ ID NO: 7912 - DNA, 1260 bp, Zea mays
  misc_feature (598)..(599): n is a, c, g, or t
ttagaattagagttagatttcttgaaagatcaacatgcctatgaggaagacttcccgtctgtactaaatgtatccatactggaaccagaatcatccaaacaggctccagagccagtggaacaatcattgttatctgaactttcatgtagacaggctgagaaccgactcaggtcagtgttgatgcaagtcttcattgctgttatgatggtggcggcggttgccgttatattagtttaaataaaacagtcattctttggatttcatgattttcctaatatttagctcacctctgctacacaaaatactgctaagcatcattttcacttttctttgcaggatagcgtcagaagcttgttatgatggtgaaagttttcattgggcatcatcatctttccacataaatgatgctgcccgccacaaatctggtttgaagtctatagggaagcacaaagcagcatcggaatctggtagacctcccaaatccaaagtccagaagattactgaattgcatcaggaagggccaattgccatgagtaattttctctgtatgcctgctcgactattgccaagtacagcggacttccacattagtgactcnncctatctgactttggtatcagagattctgaattctatttttccgaggatctcttgcaagaggttgacgcccttgagttcttcccagatcagggtgactctggtctccttcctggtattgaagagttagaatctctttcggatttcacagatatcggatgaacatagatgagcaaattattgttgatgggatgccctcctataccaagaggagacaagattgcctctggcaggagcccaaggatacaggttgaattgctcagccgtgcacagatgtgttgcaagcagcaagctatcatcatggctggctggagcaaagcactggcttggtgaggtcacattgatctgacaagctcggaggatgggtttgcactaatggcggcatttgggtaatttccatacatgtatgtatattggtagtctagaatcgtaggatgtagaaatgcctccctcatttgtgtttgagggtaggaccttgtaactcgaccacatggaaattttgttgagcaggtaccaacatagaagggaaaagaagaggccctcagcatcacccatttgtcgctgtatctcttgttatgttcattctctgtttaatccaatgctgtttggctatcttgccattgaaaacatctcagatgtcaaaaaaaaaaaaaaaaaatctat

SEQ ID NO: 7913 - DNA, 1660 bp, Zea mays
caaacctgctacacatgggtacaaaaaaacagaacgagccttcacttccgttcccctggcctggccccgtcctctgttccagcgtttgccgccgctctgcacaagccctgcctaccgatgtccgtcgcgtccgtggccgccctccggacggccggctccggccgccgccgcggcgcgggttcccagcagaccggccttaacgggggcaggttcctgatgatgcagaggagggagctggtgaccaaggccgggatcccgctcgccgtctcctgctcgatggctacctcaccggcttcagccaacggcgctgctcaagggctggagattttgccgttcaaagctgacgggtacaacttctggacgtggcggggtcgccggatacactacgtcgagcaaggcgcggggcggcccgtcgtgctcatccacggcttcggcgcttccgccttccactggaggtacaacatccctgagctggccaagaagtacaaggtgtacgccatagacctgctggggttcggctggagcgagaaggcgctggtggactacgaggccaccatctggatggagcaggtctccgacttcctccgggagatcgtcaaggagccagccgtccttgtaggcaacagcttgggaggcttcacgacgctgttcacggccaccgaggtgccggagctggtccggggcgtcgtgctcctcaactccgccggccagttcgccgaccccaacaagccggccgccgcgccggccgaggaggaggaggggggcagcgcgctgtccaggtacatcgtgcagccgctcaaggaggccttccagcgggtggtgctggggctcctcttctggcagtccaagcagcccgccagggtcgagaaagtcttgaaaagcgtgtacatagatcccagcaacgtcgacgactacctggtcggctccatcacggcgccggcggcggaccccaacgccggcgaggtgtactacaggctgatgtcgcggttcatgtcgaaccagagccggtacacgctggaccggctgctggggaagatgtcgtgcccgctgctgctgctgtggggcgacctggacccgtgggtcggcccggccaaggccgcgcggatccaggagttctacgccgacaccgccgtcgtgcacctgcaggccggccactgcccgcacgacgaggcgccggagcaggccaaccgcgcgctgctcgagtggctcgcggccctcgacgcccgcgctaagtcggccgagcccagcctacagaccgtctgatggatcgagcgcaaggggcttagcgtatgctagtcaaagaatacaatttggtggcctatatctatagtttgatgtagtatgtcctgtagtaggaacagtaatttcttactgtgagttagtttactgttctacagctgttgcacccgtttgatgtagttatagatgaccaataagcacgaggcccgcgagcccggcacgaggcccgcgagcccggcacgaagcccactgtttagcctcgatccgagtccggcacggcacggttctatgcaggcccgggccgggctcggacaggaaactaggcacggtgggctagtccggcacggcccgtttaactctaagcccgttaagcccgctttttgcactaaaacgtgtttaccggcccgtttagcccgttttt

SEQ ID NO: 7914 - DNA, 1675 bp, Zea mays
acttccgttcccctggcctggccccgtcctctgttccagcgtttgccgccgctctgcacaagccctgcctaccgatgtccgtcgcgtccgtggccgccctccggacggccggctccggccgccgccgcggcgcgggttcccagcagaccggccttaacgggggcaggttcctgatgatgcagaggagggagctggtgaccaaggccgggatcccgctcgccgtctcctgctcgatggctacctcaccggcttcagccaacggcgctgctcaaggtatctgatgatatgaacatgcctcggccaggaccaggaaaggcgctctcaagtctgagccgtgcgattctcagatcctgtctgttctaggcatcgtcagcgactccgtctctcctgtcgtgcgtgcagggctggagattttgccgttcaaagctgacgggtacaacttctggacgtggcggggtcgccggatacactacgtcgagcaaggcgcggggcggcccgtcgtgctcatccacggcttcggcgcttccgccttccactggaggtacaacatccctgagctggccaagaagtacaaggtgtacgccatagacctgctggggttcggctggagcgagaaggcgctggtggactacgaggccaccatctggatggagcaggtctccgacttcctccgtgagatcgtcaaggagccagccgtccttgtaggcaacagcttgggaggcttcacgacgctgttcacggccaccgaggtgccggagctggtccggggcgtcgtgctcctcaactccgccggccagttcgccgaccccaacaagccggccgccgcgccggccgaggaggaggaggggggcagcgcgctgtccaggtacatcgtgcagccgctcaaggaggccttccagcgggtggtgctggggctcctcttctggcagtccaagcagcccgccagggtcgagaaagtcttgaaaagcgtaacgttaactcagcttgatgtctaagtctaatcgcatcggctactgccatggcatatatatatacacacaccaaagttcatcatcttagatcgtcatactcatacctgcaggtgtacatagatcccagcaacgtcgacgactacctggtcggctccatcacggcgccggcggcggaccccaacgccggcgaggtgtactacaggctgatgtcgcggttcatgtcgaaccagagccggtacacgctggaccggctgctggggaagatgtcgtgcccgctgctgctgctgtggggggacctggacccgtgggtcggcccggccaaggccgcgcggatccaggagttctacgccgacaccgccgtcgtgcacctgcaggccggccattgcccgcacgacgaggcgccggagcaggccaaccgcgcgctgctcgagtggctcgcggccctcgacgcccgcgccaagtcggccgagcccagcctacagaccgtctgatggatcgagcgcaaggggcttagcgaatgctagtcaaagaatacaatttggtggcctatatctatagtttgatgtagtatgtcctgtagtaggaacagtaatttcttacggtgacttagtttactgttcaaaaaaaaaaaaaaaaaaaaaaaaaaaaaaaaacccgcggcctgttgcagccgtttgatgtagtacaggcgtacagctgaaccg

SEQ ID NO: 7915 - DNA, 2092 bp, Zea mays
atacatacatctggcctcccctcccgcacgcaaagacgacgtgctcgctaccctccccctcgccccaactcgcaagtcgcctgccagcccggttagcaaggaagcacgcaggatatttggtgcgcgcgggcggtgtgagcggtgagcctgcaaaagccagcagcagcgagcgtcggtaggggagcccgggcagcggagcacacttgccctctccacctggaaccccgcgcaggctccgccggccgcggccggtgccgcgacgactcggcacgcgctagctagctagctgttcctctccccgagggccccaccactaccaccatcctgccgcccggcctcgcgtggcggatgatgattcctagggagccgtggcggccggagcacccttccaattcctgatcccgagctgacccccgcccatcgcagcggcggctctgccgcagcgtctgtgtccagacttatgatgatggagacccctcaaatcgagatgggcggtttcaaggtcaacagcccgcaagtgcccaacggcgtgttgcggcccaccgtgtcttcctcctggaactcgcgagggacggtcgagagggcgctcaagagcatcaggatcgtcattttcacttccaagctcaacttgctcatgccgttcgggcctgcgtccatcattctccacttcacgactaggaggcatggattgattttccttttcagcatgctaggaataacacctttagctgagcgtttaggatatgcaactgagcagcttgcaatatacactggtccaacagttggtggccttctgaatgctacatttggaaatgcaaccgaaatgatcattgcagtatatgctttgaaaaatggaatgatccgagtagtgcagcagtcactattgggttccatattgtcaaatatgctgttggttatgggttgtgctttctttgctggtggtgttgttcaccgcaacaaagaccaaatcttcagtaaggcaactgcagttgtcaactcaggtttactgttgatggctgtcatgggattgatgtttcctgccgttcttcatttcactcattcagaagtgcgtcaaggggcatcagaggttgcactttcaaggttcagtagttgtattatgcttgtggcgtatgccagctatctctatttccaattaagtggacggagcaacatttacagtccaataggcagtgaagaggcgcctattgaggatactgcagaggaagatgaagaagctgagattggcatgtgggaggcagtaacatggcttgcggttttaacactctgggtgtcttttctttctgagtacctagttaacgccattgagggagcatctgattcattgaacctaccggtggcttttatcagtgttattttgcttcctattgtgggcaatgcagctgaacatgcaagtgcaataatgtttgccatgaaagataagcttgacataacactgggtgttgcaattggttcatcaacacagatatcaatgtttgtgattccattttgtgttgttattggttggatgatgggacaaaggatggacttgaattttcagctatttgagacagcaactctcttcataacagtgcttgtggtagcatttatgctacaggatggcactgcgaactacttgaaaggacttatgctgatcctatgttatctaatagttgctgccagtttctttgttcatgttgatccacaatcaagtgatggttgatgccgtagatgctgtaagtaatgcgtcaaataccttttgaaacttgttaatcctttcttgtggaggtgctactccatagcaacgttccacctgtttcaagcagcatgctggcaaaaaaaggcgggaagatcacacattgtcggttccttcatgaaccgcaaaaggaattcttgtattgtgtggatactgaggtgtactaggggtagtctcaatgtatacagaaacaagaagtgccagcatgttacattcgattaattggatgggtgagtccccctttttttttcgggtacaaaaaaaaataaaggtagacggcggcatccggtctgaggctaagatctctcatccttttttgtggtgatgatgtccgcgcac

SEQ ID NO: 7916 - DNA, 2091 bp, Zea mays
gcccggccgggaaaaaaaaaaaaaaaaaaaaaaaaaaaaaaaaaaaaaaaaccggccgggcgaacagtgcccctgccccccgcacgcgcagacgacgtgctggctaccctcccccaacttaggcctctagcgacgaagcaggcgggatatttggtgcgcgcgggcggtgtgaacaatcagcctgcagcgatcgagcaaaagccagcatcagcgagcaactcggcgacgtcggcgtcgccaggggagcccgggcagagaagcacctgccctctgcatctggaaccccgcgcgggctccgccggccgcggcccgtgccgcgacgactcggcacgcgctagccagctataggtagctgtttcccttcccgccactatcctgccgcccgggctcgcgtggcggatgatgattcctagagagccacggcggccggagcacccttcctcctcctgaccccgagctgccccgcccatcgcagcgggcggctctgccctccgccgcagcgtctgtgtccagactggaggatggagactccgcaagtcgagatgggcggtttcaaggtcaacagcccgcaagtgcccaacggtggcttgcggcccaccgtgtcttcgtcctggaactcgcaagggacggtcgagagggcgctcaggagcatcaggatcgtcatttttacttccaagctcaacttgctcatgccgttcggacctgcctccatcattctccacttcacgactaggagacatggattggtttttcttttcagcatgctaggaattatgcctttagctgagcgattgggatatgcaactgagcagcttgcagtatacactggtccaacagttggtggccttctgaatgctacatttggaaatgcaactgaaatgatcattgcaatatatgctttgaaaaatggaatgatccgagtagtgcagcagtcactattaggttccattttgtcaaatatgctgttggttatgggctgtgctttctttgctggtggtattgttcatcgcaacaaagaccaagtcttcagtaaggcaactgcagctgtcaactcaggtttactgttgatggctgtcatgggattgatgcttcctgccgttctccccggcactcattcagaagtgcggcaaggagcatcagaagttgctctttcaagattcagtagctgtattatgcttgtggcgtatgcaagctacctctatttccaattaagtggacggagcaacatttacagtccaataggcagtgaagaggcgcctagcgaggataacccggaagaagatgaagaagctgagattggcatgtgggaggcagtaacatggcttgcggtgttaacattctgggtgtcttttctttctgagtacctagttaacgccattgagggagcatctgattcattgaacctaccggtggcttttatcagtgttattttgcttcctattgtgggcaatgcagctgaacatgcaagcgcaataatgtttgccatgaaagataagcttgacataacacttggtgttgcaattggttcatcaacacagatatcaatgtttgtgattccattttgtgttgttattggttggacgatgggacaaaagatggacttgaattttcagctatttgagacagcaactctcttcataacagtacttgtggtggcatttatgttacaggatggcactgcgaactacttgaaaggacttatgctgatcctatgttatctaatagttgctgccagtttctttgttcacgttgatccacaatcaagtgaaggctgaagccatatatcctgtaagtaacgcgccaaataccttttgagacttaataatcttgttttgttccgcctgtctcaagccgggttccttcatgaactgcagaaggaatttttgtattttgttttgtggatactgatgtgtactagggtagtctcgatgtatacagaaacaagaagtggcagcatgttatattcgattaattgcaaaagaaaaaaaaaaattttctgttttccttgaaatttaactattgggctgaatgtaaatttgggtatatgatttgatgatggcagagatctttcatcattttttgtagttgatg

SEQ ID NO: 7917 - DNA, 899 bp, Zea mays
gcacgagctgaaacatccgtcggatcggtggatcaaaggtgcagatcgtggcgcgtctcctcgttgccgtagggttgtcccctcgcgctccctgccagagccacctcctcagcaggccgcagctactccacggtgacggccgccatgagagccctcctctccctctcccgtctcgcccgacggcttccagcttctctcagccctgtaagggcgccgacaacattactcctccggcacatccatgcggatgcccctccgccgccgccatctcatgactcgacgcccttcgtctcccgcatcctcgaatcggagccgtgcctgaccccgaacgacgagtcggagccggcatccgatccgaccctcgacgagttcctcgcgcgcttcgtggctgccttccgcccgcgactggcggctgccttccccaaccatgaccgtgacgtgctcgacgagatgctccgcctcgtcgcggacgccgtgctgtgccgcctcaccgggaccgaccgggggggcgatgctattgagctcaatgacgacctctgggcggccgtatgggaggtcagcgcctccgtgcgcgaggctatgcgccgggatcaggtccgcgccgaccttcgccaataccttcactgcgacgaggtgaaggagatgacgcggttcgctgtcgatgtcggcatccgcggttccatgctccgggagctccgcttcaagtgggccggcgagaagctcgacgaggtcgagttctatcgcggccttgatgacaagcacgccgatgccgaggccggcgccgaccgggcgccagtggccgaggctgactgctttgccgaagaggaagggagaggtgaagttcacgatgtacgggctggacatgtctgacccaaagtgggctgaggtggcggagcgag

SEQ ID NO: 7918 - DNA, 1146 bp, Zea mays
  misc_feature (3)..(3): n is a, c, g, or t
ggntcggccgggctgcgcggcctccagccggccggaacaaattgaccgccattgtgcaaaccagaaccccttcgccattttcaccaactccctccgatcccggccatggcgggggaggactgccgctccggcgcggaaatggacgcgctcgtacgacgcttgaagctccaccggccgtccccatccccctacgaccccgatccggccgcggcccccgtccccgccaccgccggcgacggcgagctgttccggccgcggagagctgccgtgcttgtctgcctcttccggggagacggcggcgagctccgcgtcatcctcactaagcgctcgtcctccctctccacccactccggtgaagtttcattgccaggaggaaaagtcgaggagggtgatgctgatgatgtagcaacagcgttaagagagtcaaaagaggagattggacttgatccagctctggtaactgtggttgcctctcttgaacacttcttgtccaagcatcttctggtagttgttcctgttgttggcatactgttagacagacaagcatttaaacctgctcttaatattgctgaggtagacgaaatatttgatgtacccctggagatgttcctcaaggatgagaacaggacatcggaggagcgagaaaagatgggccagacattcacagttcattacttcacttatgagaacggaatccagaagtacttaatctggggtctgaccgcccgcatcttgatccatgctgcttcagttgtatacgagcgaccgccagactttacagagcgaagagcacatttcaaattgccaaagttcacaaaggactgctcttcaatgctagcaggacctgctaaacattagtgcacactgcctacgctgctatctcagctacatgctatttggagtacgggatgttgcaccaacatagtttatagaatcgaagaggcgtccaaatcacttgatgtcatatgaatttagattctttcgacaaaacactatagtggcatttatgttcagaacaatgttcgtatatgatgcaccacaaatcatccatgttgatgctgttaatgacatggagcacttgctcggatgcaattggctcgtatatacacataagattgttctactgaatcaaaaagaaaaaaaaaa

SEQ ID NO: 7919 - DNA, 1832 bp, Zea mays
cattgggtacctcgaggccggccgggaaaaccagcgcggcgagcagatatcccacgagaaagccctcgaccccttcaattctccagcaaactagtcaccggcgtgtgcactggtgcagtgcacgcacgccgccggcagcatggcgggcagggccagggcacggcggctcgtgctcgccggcgctctgatgatcgcctggctcctcctctgtcttctcccacgggccacggcggcggccgtccgcaggagcgacttcccgccgtcgttcctcttcggcaccgccacctcctcgtaccagatcgaaggcgcgtacctcgagggcaacaagagcttgagcaactgggatgtcttcagccatactccaggaagaatcgaagacggaagcaccggagatgtcgcggatgatcactatcatcgttacgaggatgacattgagctcatgcactctctcggcaccaacgcctacagattttctatatcatgggccagaattcttccgagagggagattcggcgaggtcaacccagcaggcatcgcgttctacaacacactcatcgactcgctcctgctcaaagggatagagccgttcgtgacgctgtcccactacgacatcccgcaagagctggaggacaggtacggggcgtggctcggcggcgccgaggcgcggcgcgacttcggccacctggcggacgtgtgcttcgcggcgttcggcgaccgcgtcaggcactgggccaccttcaacgagcccaacgtcgcggtcaccaggggctacatgctcggcacctacccgccggggcgatgctcgcgctcctgcgcccggggcaactccgacgccgagccctacgtcgccgcgcacaacgtcgtcctggcccacgccgccgccgtccagatctacaagaccaagtaccagaagggcttgatcggcatcgtgatgtccactgtctggttcgtgccgctgacggacgcgccggcggaccggctggcgactgagcgggcgctggccttcgacgttccatggtttcttgacccgataatctacggagactaccctccggagatgcgccggctcctgggctccaggctgccgaccttctcgccggaggataggaggacgctgggctacgggctggacttcatcggcatcaaccactacacgacgctgtacgccagggattgcatgttctcgccaggttattgcccgtcggggcaggagttccaccaatcgctggcggcctacacgggagaaagagacgggattcccatcgggcctccgacagcgatgccgacgttctacgtcgttcctgacgggatagagaagatggtcacctacatcatgaacagatacagcaatctccccatgttcataaccgaaaatggctacgcacaaggtggggatggttatactacccgtgccgaggactggcttgacgaccagggcaggatacagtacctcgagggctacctcgcaaaactcgccaaagtcatcagtgacggcgccgatgtccgtggctacttcatctggtctctcattgacaatttcgagtggctatatgggtacaccctccgcttcggccttcactacgttgactaccaaacgcaggagagaaagcccaagtcgtcggcgctgtggtacaaacggttcctccagagttcacttcaagctcaatagagagagggtgccttgttcgaagtacaggcacgcagcatgagcttgcgagtgtgtgacgactgagcatgccgcttcttcaattcagaaaatgaagggcgtgatctttgtatgaatttattgatccttaataaagggggccactacagttgccaaaaaaaaaaat

SEQ ID NO: 7920 - DNA, 1920 bp, Zea mays
tgggtccctcgggccggccggacccacgcgtgactggtgccgctcaagcaagcgagcaagcttaagccccacctcctagcaacatggagacggcctacgttgtcgttctgtcgttcttcttcatcgttgctatccaccgccttctcaaccgcggcgaaagcaagaatatgagcaagcagccgctgccaccgggccctcgcgccatcccggttctcggccacttacacctcctcgagaagccgtaccacctggcgtttatgcgcctcgccgcgcgctacgggcctgtgttctccctccagctgggctcgcgcgccgccgtggtcgtgtccaccgcggactgcgccagggagtgcctcgcagagcacgacgcgacgttcgcgaaccggccgacctaccccacgctgcacctgatgacctacggcggcgccacgatcggccacagcgcctacggcgcgcactggcgccacgtccgccgcgtcgtatcgttgcacctcctgtccccgcaacgcgtgctgtcctccatggtccccaccatcaccgcggaggtgcgcgccatggcgcggaggatgtaccgcgccgccgcgggcggtgccgcgaggatcgagctcaaggggaggctgctcgagctctccctcagcaccctgatggagaccatcgcgcagaccaagacgtaccgtcccgcggacgacgcggacacggacatgtcgccggagacccaggagttcaagcagctgttggacgctatcatctcgcttctcgggctgaccaacgtgttggaattcctgccggtgctacagacgttcgacgttttgggactgaagaagaagatcgcggcggcggcgggcagaagggacgcgttcttccagcggctcattgacgcggagcggcgcaggctggacgacggcgtggagggccagaagaagagcatgctggccgtcctgctcgctctgcagaagtcggaaccggagaattacacggacgagaagatcatggctctatgcttctccatgttcattgccggaacggactccacggcgacggcgatggaatgggccatgtcgctgctgctgaaccaccccgaggtcctgaagaaagcgcgggaggaaatcgacgcgcacgtgggcagctcccgcctgctgggcgcggacgacgtgccgagcctcggctacctccactgcgtcctcaacgagacgctccggctgtacccggtggggccgacgctgatcccgcacgagtccacggcggactgcacggtcggcggctaccgcgtgccgagcggcacgatgctgctcgtcaacgtgtacgccatccacagggacccggcgacgtggccggaccctgacgtcttccggcccgagcggttcgaggacggcggcggcagcgccgaagggaggctcctgataccgttcgggatggggcggcgcaagtgccccggagagaccatggcgctgcagatcatggggctggccctggggaccatgatccagtgcttcgactggggcgcggtcggaggcggaggcgctcccaaagttgacatgacccaaggcggcgggctcactctcccgcgggccgttccgctggaggccatgtgcaaaccgcgccaagtcatgcttgatgtcctccagaagctgtgacacaatctacgtacgtactctgagcgcactactgaagaaagttgatgagtatcatcatcaaaagttgttgccttgctatcgttattaattcgtagggctatatgtatttgtgctccttccgtcgcttctagaaacaccgtacctgaatatcacagctagtaataatcaaataagataccttttccagttatataagatgcatgcatgcatccatgtaagtgccgctttcctttaatttgtcaggatatgatgaccgaatatatcacatgcaaaaaaaaaaaaaaaa

SEQ ID NO: 7921 - DNA, 2361 bp, Zea mays
tttctttgcccaagcgtggagcatggaccctaagcaaggcaggcgggccgcccttctctgacgcggagcaagcctattcattgggtccctcgaggccgggccgggagactgtgtgccactcaagcaagcgagcaagcttaagccccacctcctagcaacatggagacggcctacgttgtcgttctgtcgttcttcttcatcgttgctatccaccgccttctcaaccgcggcgaaagcaagaatatgagcaagcagccgctgccaccgggccctcgcgccatcccggttctcggccacttacacctcctcgagaagccgtaccacctggcgtttatgcgcctcgccgcgcgctacgggcctgtgttctccctccagctgggctcgcgcgccgccgtggtcgtgtccaccgcggactgcgccagggagtgcctcgcagagcacgacgcgacgttcgcgaaccggccgacctaccccacgctgcacctgatgacctacggcggcgccacgatcggccacagcgcctacggcgcgcactggcgccacgtccgccgcgtcgtatcgttgcacctcctgtccccgcaacgcgtgctgtcctccatggtccccaccatcaccgcggaggtgcgcgccatggcgcggaggatgtaccgcgccgccgcgggcggtgccgcgaggatcgagctcaaggggaggctgctcgagctctccctcagcaccctgatggagaccatcgcgcagaccaagacgtaccgtcccgcggacgacgcggacacggacatgtcgccggagacccaggagttcaagcagctgttggacgctatcatctcgcttctcggcctgaccaacgtgttggaattcctgccggtgctacagacgttcgacgttttgggactgaagaagaagatcgcggcggcggcgggcagaagggacgcgttcttccagcggctcattgacgcggagcggcgcaggctggacgacggcgtggagggccagaagaagagcatgctggccgtcctgctcgctctgcagaagtcggaaccggagaattacacggacgagaagatcatggctctatgcttcgtaagttgcaaaactgtgtatcttatcgttcgataaaacaaaaatctagaagacgatcgaccgatcctctgcgctgcgtctctggtttttgcacagtccatgttcattgccggaacggactccacggcgacggcgatggaatgggccatgtcgctgctgctgaaccaccccgaggtcttgaagaaagcgcgggaggaaatcgacgcgcacgtgggcagctcccggctgctgggagcggacgacgtgccgagcctcggctacctccactgcgtcctcaacgagacgctccggctgtacccggtggggccgacgctgatcccgcacgagtccacggcggactgcacggtcggcggctaccgcgtgccgagcggcacgatgctgctcgtcaacgtgtacgccatccacagggacccggcgacgtggccggaccctgacgtcttccggcccgagcggttcgaggacggcggcggcagcgccgaagggaggctcctgataccgttcgggatggggcggcgcaagtgccccggagagaccatggcgctgcagatcatggggctggccctggggaccatgatccagtgcttcgactggggcgcggtcggaggcggaggcgctcccaaagttgacatgacccaaggcggcgggctcactctcccgcgggccgttccgctggaggccatgtgcaaaccgcgccaagtcatgcttgatgtcctccagaagctgtgacacaatctacgtacgtactctgagcgcactactgaagaaagttgatgagtatcatcatcaaaagttgttgccttgctatcgttattaattcgtagggctatatgtatttgtgctccttccgtcgcttctagaaacaccgtacctgaatatcacagctagtaataatcaaataagataccttttccagttatataagatgcatgcatgcatccatgtaagtgccgctttcctttaatttgtcaggatatgatgaccgaatatatcacatgcatataattttccaatgcaagcgtgacttggggcatcacgattcacgcgacacgcgcggcacggaagcaaggaccaaaattattatatcgtcatgatctggtggaaaactgtggccgttcacgctgcacgttgacacgcaactcgacttctcggcgacttgccggtggtcggcccagtggcgaagttagagcaataacgtcgaagaaaaaaaaacagggtgagaaagaagacggagtagtattacgtaatggatgtgtatataagataaaaattacttattattca

SEQ ID NO: 7922 - DNA, 3396 bp, Zea mays
ctgcaggtgcttgtgcttgtgatgatcgtgagggacttcgtgccgggacggaacgcgttcgaagcgctcctgggagagctgagccggcaggggcggtgggctgacgccatggccgtgtacgccgccgctgtgaagcgaggcgtggtggtctcgtggaagcacctcggcagagaggcgcactcaccggaggagcccattcggctgggcgtccctgtcccgcagtgaccgtttgtctggggctctgggcgcggccgggatcaccatctttctgagcccattcggcttgcgttctgtttccgatgctgtagacggaaaattctgccagtttggaccgcttgcagatggcactgaggaacaagcgtagctgatggttcaggtattcgcgttgtcgctaattttcgtgacactcaccgcaaatgtaccgaaattatgtaaatcatttctgcttctacgtaaatcatctctgcttctattatccggccgggagcattggcgtccagcttacgagttacggatgataatcctgatttcatagctgtaaacgcacaaagcacttttatttatagacggcgccacgaaaaaaaaaaccaacaacacgtcactgacaaggcgcagtaacaagagtagaaacactttccggtggcgcgcgcgcttctgaggaagccaagagtccaagactgaaagatcaagcagctcactccgccgccgcctgctcgacaaccatcggcagtgactcctctttctccctccctttcttcccatgctcctcctcctccttcccaggagaggacggcataatcagggcctcccgttgcgcacgcaccagcttactgaactccttttcgcgagcgccgaacgcggcggcgatctccggccctagcatggtacggagcaccgaggaggcgccgaccaggaactgcggccggttgcggcgcgccgaggtggtgaagccgaagaactcgaagggcccggcccgcgccgccacctggcagaaggggaagtagcgcgggatccagaacacgtcgccggggcgcaccacctcgctcatcgccagggacccgttcgggtacaccacctggaccgtgccttccccgcccagcaccacgccgtactccgtcgcccgagggttcacgtgcggcgccagcatcgacccctgccatgcagatggaggaacagaacgatgatcagcttggctgcgcttgcgacgagcttaccagcagcaacccctcctctgccatgacgcgaaacggcgaaagtaatccaacaagaaagcgggcaggtcgatatgattcaggcagggcgcgcaccgcggtgaggttcacgaggtagacgccgatgtccgggtgcttgaggggctcgtactggtgcttgtcgacggagacggtccagccgtacgcgttccggaacccgggctcgctgtcgtagaggttgtacggctccggcgcgccgcccttcttcttcttgcccttcctgttcgcctccgcggcgccgccgccgccagccgcccctccgacgaccctgttaaccagcttcgtccaccaccacgtcgcctcacgcgcgtcatcgctgccgccgcactcgtcgcctccgtctcccctgccacccggcacccacgcgccggcgccctcgcgtcgcgctcccctgtccagcacaccgtcgtgcccgtcgacctgcccgcgctcctcttcggcggcaccgctctctggctccgcgtccgcggtgtagtacacgatggggccgccggttcgtggcaacaggatacgcgccaactcgtcgtaggtggcctagcagaagacatgcaagttatgggtactgctagctgctaccgcctacctgtgtcaattagagcacgacgatccatgcgaaatgttcatattagattagtatatgtatctcacgttgaaggcacgggtaagcgtcttcggcccaaaaccggcaatgaccgacgccgggtcccctgcgccgccgaggaagaaggcctgtattggatttgttggatcatggttcatcagtgctgggaatcgcggattgcatgtactatactatatgttctcttgcctgcaagcaacaagaacaggaagacgacgagagtgcaaaaaggaagaggagggggcgagacctgataaggaggtccaaagccaaggctatcggaggcgtccacgctgcatatgatctgcagcctctggcctttgccggggttgaccatgtagaaggtggagccggcgtcgatgtggaggacgtcgcccatcttgagcttcctctccacgagctcgtccttgtgaatatacccaaccttcgcttcccctgctcatcatcacaataccacgcgattgcaatctcatatcgaccgggaacgacacgagcctccgccacgcgcatagatagaaataataacagcatgtaccccgctgcacgaagagagtgatgctggagtcgaggtactgcggcacgaacagcgtcttgggctccatggtgatgaagccgatgtgcatgagcccctcgcggcaggcgaaggacgccggcggccacggctggccgcgcaccacgcgcacctgcccgccctccgactccaccaccttctccacccggtgcagcaggaacagccccctccctttgcctttgcccttctcttcctcctcgctcggcctccactccccctcgccctcctcccaccagcccccgccgcgccgtggcgccgccgccgagcaccgcgagaggagcagcaggaggaggacgagcagcggcggcgccatcacagtgaggcgatccattcacgcgcctagctggcttcttccaagattaaaacttgctagatcgcttgcactctctgcctctctggtcagctgtgtagactgtagatttctttctggtgctacggcggtggggcggtggatatagaggcaacaggtgagtgtggatgtgtgatggcatcgcacgtgtcgtcgtgcatggtgaggaggcagcctggttgagaagaaaagtcggtggacgggtggagctggagcctggagcatggctagcatagcaggtccgtgcataacccacctggcctcgcgacgcgacgcgtgtccgcttttctgatgacacgaccgctgggtctcactggaaatgacgatgtatttttttagataatgggaaaagaggttccggcctacatccaaaggatgacagcccaccacaaccgatcaaacaagtcttacaaccaaaaaaggccacatgtgacaatgcaaactcaaacgcagttggggaaagacagaaactaaaagcaataactcatagagcaattctgttactaaattgccacccatgcgaagcgaagatctgcatcaccgatgtataacaatgtttgcaaatatatatataattatatatatataatatagaataaaatagaag

SEQ ID NO: 7923 - DNA, 1881 bp, Zea mays
gcacgaggctagtctcgatttttttttttttttttttttgctggaaagctgtaaacgcacaaagcacttttatttatagacggcgccacgaaaaaaaaaaccaacaacacgtcactgacaaggcgcagtaacaagagtagaaacactttccggtggcgcgcgcgcttctgaggaagccaagagtccaagactgaaagatcaagcagctcactccgccgccgcctgctcgacaaccatcggcagtgactcctctttctccctccctttcttcccatgctcctcctcctccttcccaggagaggacggcataatcagggcctcccgttgcgcacgcaccagcttactgaactccttctcgcgagcgccgaacgcggcggcgatctccggccctagcatggtacggagcaccgaggaggcgccgaccaggaactgcggccggttgcggcgcgccgaggtggtgaagccgaagaactcgaagggcccggcccgcgccgccacctggcagaaggggaagtagcgcgggatccagaacacgtcgccggggcgcaccacctcgctcatcgccagggacccgttcgggaacaccacctggaccgtgccttccccgcccagcaccacgccgtactccgtcgcccgagggttcacgtgcggcgccagcatcgaccccgcggtgaggttcacgaggtagacgccgatgtcggggtgcttgaggggctcgtactggtgcttgtcgacggagacggtccagccgtacgcgttccggaacccgggctcgctgtcgtataggttgtacggctccgacgcgccgcccttcttcttggccttcctgttcgcctccgcggcgacgccgccgccagccgcccctccgacgaccctgttaaccagcttcgtccaccacgacgtcgccacacgcgcgccatcgctgccgccgcactcgtcgcctccgtctcccctgccacccggcacccacgcgccagcgccctcgcgtcgcgctcccctgtccagcacaccgtcgtgcccgtcgacctgcccgcgctcctcttcggcggcaccgctctctggctccgcgtccgcggtgtagtacacgatggggccgccggttcgtggcaacaggatacgcgccaactcgtcgtaggtggcatgtatctcgcgttgaaggcacgggtaagcgtcttcggcccaaaaccggcaatgaccgacgccgggtcccctgcgccgccgaggaagaaggcctgataaggaggtccaaagccaaggctatcggaggcgtccacgctgcatatgatctgcagcctctggcatttgccggggttgaccatgtagaaggtggagccggcgtcgatgtggaggacgtcgcccatcttgagcttcctctccacgagctcgtccttgtgaatatacccaaccttcgcttccccccgctgcacgaagagagtgatgctggagtcgaggtactgcggcacgaacagcgtcttgggctccatggtgatgaagccgatgtgcatgagcccctcgcggcaggctgcgaaggacgccggcggccacggctggccgcgcaccacgcgcacctgcccgccctccgactctaccaccttctccacccggtgcagcaggaacagccccctccctttgtctttgcccttctcttcctcctcgctcggcctccactccccctcgccctcctcccaccagcccccgccgcgccgtggcgccgccgccgagcaccgcgagaggagcagcaggaggaggacgagcagcggcggcgccatcacagtgaggcgatccattcacgcgcctagctggcttcttccaagattaaaacttgctagatcgcttgcactctctgcctctctggtcagctgtgtgtagactgtagactgt

SEQ ID NO: 7924 - DNA, 1868 bp, Zea mays
gagctcactaacctcggtgccccccccctttttttttttttttttagctgtaaacgcacaaagcacttttatttatagacggcgccacgaaaaaaaaaaccaacaacacgatcactgacaaggcgcagtaacaagagtagaaacactttccggtggcgcgcgcgcgcttctgaggaagccaagagtccaagactgaaagatcaagcagctcactccgccgccgcctgctcgacaaccatcggcagtgactcctctttctccctccctttcttcccatgctcctcctcctccttcccaggagaggacggcataatcagggcctcccgttgcgcacgcaccagcttactgaactccttctcgcgagcgccgaacgcggcggcgatctccggccctagcatggtacggagcaccgaggaggcgccgaccaggaactgctgccggttgcggcgcgccgaggtggtgaagccgaagaactcgaagggcccggcccgcgccgccacctggcagaaggggaagtagcgcgggatccagaacacgtcgccggggcgcaccacctcgctcatcgccagggacccgttcgggaacaccacctggaccgtgccttccccgcccagcaccacgccgtactccgtcgcccgagggttcacgtgcggcgccagcatcgaccccgcggtgaggttcacgaggtagacgccgatgtccgggtgcttgaggggctcgtactggtgcttgtcgacggagacggtccagccgtacgcgttccggaacccgggctcgctgtcgtagaggttgtacggctccggcgcgccgcccttcttcttgcccttcctgttcgcctccgcggcgccgccgccgccagccgcccctccgacgaccctgttaaccagcttcgtccaccacgacgtcgccacacgcgcgtcatcgctgccgccgcactcgtcgcctccgtctcccctgccacccggcacccacgcgccagcgccctcgcgtcgcgctcccctgtccagcacaccgtcgtgcccgtcgacctgcccgcgctcctcttcggcggcaccgctctctggctccgcgtccgcggtgtagtacacgatggggccgccggttcgtggcaacaggatacgcgccaactcgtcgtaggtggcgttgaaggcacgggtaagcgtcttcggcccaaaaccggcaatgaccgacgccgggtcccctgcgccgccgaggaagaaggcctgataaggaggtccaaagccaaggctatcggaggcgtccacgctgcatatgatctgcagcctctggcctttgccggggttgaccatgtagaaggtggagccggcgtcgatgtggaggacgtcgcccatcttgagcttcctctccacgagctcgtccttgtgaatatacccaaccttcgcttccccccgctgcacgaagagagtgatgctggagtcgaggtactgcggcacgaacagcgtcttgggctccatggtgatgaagccgatgtgcatgagcccctcgcggcaggcgaaggacgccggcggccacggctggccgcgcaccacgcgcacctgcccgccctccgactccaccaccttctccacccggtgcagcaggaacagccccctccctttccctttgcccttctattcctcctcgatcgggcctccactccccctcgccctcctcccaccagcccccgccgcgccgtgacgccgccgccgagcaccgcgagaggagcagcaggaggaggacgagcagcggcggcgccatcacagtgaggcgatccatattcacgcgcctagctggcttcttccaagattaaaacttgctagatcgcttgcactagctctctggtcagctgtgtagactgtacctcgtgc

SEQ ID NO: 7925 - DNA, 1569 bp, Zea mays
aaagcaccaaagatgttgccgtggcctcgccgcacaagaaaatcacagcagtacagcaccagaaacagaaaggtagtagatcaaggaacgccagtgcggcgacaatgaccggcagtggaagcacgggcgccaatggcaagagccagagatccagggccaaggcaatgctgttcgccttgggcaagagctttcctgaccaagttctgcctcaggagaaggttgtggagagctacctccaagaaagcagctgcgacgatcccgccaccagggccaagcttcagcgcctttgcacgactacaacagtgaagacaaggtacactgttatgtccaaggagctattggataagcacccagagctgaagatggagggtactccgacactgacaccccgccttgacatctgcaatgccgcggtgatcgaccttggtgctgccgcagctcgcgctgcccttgacgaatggggtcgccctgcagctgatattacccacctcatctacatctcatccagtgaccttcgtctcccaagggggcgaccttcacctggctgctcgccttggccttagcccaaacaccgtgcgcacttcccttctcttccttggctgctccggtggtgctgctgccctccgcactgccaaggacattgctgagaacaatccagggagccgtgtcctagtaacagctgctgagaccactgtgctaggcttccggccaccaagttatgaccgtccttatgaccttgttggtgctgcgctgtttggtgatggtgcatcagccgtgattataggagcaggtcccatgacaccagcagaaaatcctttcttggagcttgagttctccacgcaggagttcctacctgggactgataaggtaattgatggcaaaatctcagaggaaggaattaattttaaactagggcgtgatttgcctgagaagattgaaagccgcatagaaggtttctgcaggactctcatgaacaaggtagggataaaggatttcaacgatatattttgggctgtgcatcctggtggaccagcaatattgaacaggcttgagttctgccttaaacttcagccagagaagctcaagattagcagaaaagccttaatgaactatggaaatgtgagcagcaatacaatcttctatgtgctggagtacttgagggacgagttaaagaaaggggcaataagtgaagagtggggattgatcttggcttttggcccaggcatcacctttgaaggactgctagttcgaggtgtaaagaaaaccttcacaagctaatataatggtgggtacatggcaagcataaagattaattatatatacagaaacatcacataaagagcatagatgtctcggtggaagctgagcaccacatagcacatcgctaatattttactgtatttgtgttcttcatctatcaaacagtgtaaggtacttgagtttgcttcctagacattgtagaaataaggcactatacagcctgttgtagtgttgttccactgtactatgcaatgattgcaggattactttaatactgcttgtatggatgagtgaactgattacagtgcc

SEQ ID NO: 7926 - DNA, 4881 bp, Zea mays
aaagcaccaaagatgttgccgtggcctcgccgcacaagaaaatcacagcagtacagcaccagaaacagaaaggtagtagatcaaggaacgccagtgcggcgacaatgaccggcagtggaagcacgggcgccaatggcaagagccagagctccagggccaaggcaatgctgctcgccttgggcaagagctttcctgaccaagttctgcctcaggagaaggttgtggagagctacctccaagaaagcagctgcgacgatcccgccaccagggccaagcttcagcgccttttgaagacaaggtacactgttatgtccaaggagctattggataagcacccagagctgaagatggagggtactccgacactgacaccccgccttgacatctgcaatgccgcggtgatcgaccttggtgctgccgcagctcgcgctgcccttgacgaatggggtcgccctgcagctgatattacccacctcatctacatctcatcaagtgaccttcgtctcccagggggcgaccttcacctggctgctcgccttggccttagcccaaacaccgtgcgcacttcccttctcttccttggctgctccggtggtgctgctgccctccgcactgccaaggacattgctgagaacaatccagggagccgtgtcctagtaacagctgctgagaccactgtgctaggcttccggccaccaagttatgaccgtccttatgaccttgttggtgctgcgctgtttggtgatggtgcatcagccgtgattataggagcaggtcccatgacaccagcagaaaatcctttcttggagcttgagttctccacgcaggagttcctacctgggactgataaggtaattgatggcaaaatctcagaggaaggaattaattttaaactagggcgtgatttgcctgagaagattgaaagccgcatagaaggtttctgcaggactctcatgaaccaggtagggataaaggatttcaacgatatattttgggctgtgcatcctggtggaccagcaatattgaacaggcttgagttctgccttaaacttcagccagagaagctcaagattagcagaaaagccttaatgaactatggaaatgtgagcagcaatacaatcttctatgtgctggagtacttgagggacgagttaaagaaaggggcaataagtgaagagtggggattgatcttggcttttggcccaggcatcacctttgaaggactgctagttcgaggtgtaaagaaaaccttcacaagctaatataatggtgggtacatggcaagcataaagattaattatatatacagaaacatcacataaagagcatagatgtctcggtggaagctgagcaccacatagcacatcgctaatattttactgtatttgtgttcttcatctatcaaacagtgtaaggtacttgagtttgcttcctagacattgtacaaataaggcactatacagcctgttgtagtgttgttccactgtactatgcaatgattgcaggattactttaatactgcttgtatggatgagtgaactgattacagtgcaaatatcatattttctaaggaaaagcagagcaattatgtgatgaggcatgaaatacacattacaacaagcatgttacaatgatagatagtagatgtatcatctatcatgatgccctaaacacttcaacaaatgttaaactttaacatcatttcgaatattattacaagacataaaattaagcaagttttgaagtaaacggagcatccattacatcctgatctaaccgcaaaccttgcaaaatgcagtccagtgacaacaagaaggcaacattggatcccacgttgaacgcttatcttcttcaccatcatcattcaaactccaaaatgcatgaattaatgagaagtaacacagatgcctctagcaaatcatggattcaaattcggtgatccctcttcaaaagaaagttcaccaacaaccttcccccaagcaagtttggcatcgcctttcacaagaaactccatcttggcaacaacatccttggcctctgttgacctgcctgccttcaccaaaccctcaaccaaacccttaacagcctcaaacggtggtgctgccttcattgcaaagcagctcttacaaatccacagcgcgtcatcaagcttctctttctccaccaaactcctaaacagcaccacatatacctgtgaatgtgcagaaacacccaaatcactccttccctcccgcctcttcatcactttcatcctcttgaacacacgcatagctgccccaacatttccctccttgcagtacccctgcacgagagcattgtaggtaacgtaatttggcgctatcccctttgattccatcacatcaagcagctcctcccccttgactgtctcgcctttcttggagaaccactgtatccggcagttgtaagtgacaacatttggctccaggttgctcaagctgatctccttcaaaagcttcccaaacccatcctcatcgtcctgcacggagtaaccagcgaggacagtgttgtaggatatgatgtctggggcagggcggtgcttcaacttcttgttggccatttcgtcgagcagcttccgggcagcagcaagctcagaattcttgaccaatgcatggagcagcacattgtgggaggcgcggccgggcgcgaccccgtgggaggattccgccagggtaatggtggacttgatgtcatcgaggcggccggcgcggaggaacgccgaaaggagcgccgagagggagacgtcggagtgggcggcggggggagacgaggagaaggcccggagcgcgtcgtcgggtcccgggtagagggagagtgcccgcgctaggagacccggggagggcggggtggaggcaaggaggaggtcgaggagcgaggcggcgaggtcggcgcgccggaggcggatcaagcgggaagtggccagggaaaagagctggcgcgaggtgtggaggcgcggcatgtcatggctggagagcgcggaggcgacgagggagtggatgcgggctgggtcagactcggcgcggacggcgagctggaggtcgagcacggaggcgcgggcggaggtggaggtgggcgcggccgggctagggcttgcggtggaggacgccgagggatcgatgtcggggagcgcggagaaggcgcggaggaggcgagcgcaggccgcggcggcggcgcgtgggtgcgcaccgtggcggcggtgtaggaggagggacgccatggtggggaaccgaggactgaggtactgggtttggcagggttttgggcctggcctatttgctctccttctcctttcctcccgccgggcccgcggggcgtacccttagcacggtataaagcttggaattgggcgggccgggccgtaacaaggtagtgtttggttagtagggactaatttttagttccttcattttattccactttagtctataaattgtaaaatatgtaaactataactctattttagtttccatatttgacaatttagtgactagagtggaataaattaaagggactaaaaattagtctctaaaaccaaacaccctccaagtcaagcctacaatactttaggattagagtcaagaaggtaaaaaaacttttaagccatgtcgtgctagtctaaagtaaagaaacagtagcctaggctggctctaaagcacgccgtgccttcattggcccgtgtcgacctaagctcgacccatatatttgaaccgcataaaatccaaatattacaactacataaagtcaatagcttacgaaattaagatattaaacatgtgaacaacgtttgaccacatgaagtctaaatatcacaaccacattaagtctatatcttactaaattaaagaaattaaataatatagacctcattgggccatgccggcccaagcccgacccatgcatgtgtttcgtgctagggcccaacgagccagaatttgaggtccggctcagtcccgccttcaggccgtactaacatgatccatattcagactggtttgatggctacgcgtccatgcgcaggttggcgtcgttctggccagccacatacgataattttgagtgtatgagtggatgcagattaatgacatcaaaatggcttattttgcatccactcatatagtctgtgactcccacatacaagcaaccaaacataatctcaagtaaagtcaacgcatgcggtgatccaaaatgagatgatgcgggtaaccaatcaggtggattatttcatatcggaccgtgtttttggcttctgcattcgggacatgcgtgtgctaactcaaaaaggcctacccatattcctaccacttgccacggtgtcacattagatatttgaacgcttattataaatattaaatataatctaattataaaataaattatacaagtaaatactaaacagctagacaatatttttaagcctaattaattcatggttaccaaaagtttactataacatcatatgagcgaatcatggaataattaggtttaatatgtttgtcttattgtttagtctctatctgtgtaattagtttcctaattattctataattaatacttctaactagcttctaactagcatccaaacatctgttatgctaggtactaaactttagccaggaaacaaacggaccctcggtctgtaaaaatgttattgcgtgattacagtgtgtagtgttagaatgtctctagcaatacactagcttacgtggtgatgtggtatagccggcgcgaacctagtatgtagacataggtattcaaatgaatacttgagatttttaataaaaaataaatgtatatgaaggaccggtgagacgatccgagggcgtgtgattggaagccacataaaattttccacaagagagcaca

SEQ ID NO: 7927 - DNA, 921 bp, Zea mays
aaacaaacacttccgcaaaccgcgccacccattaaaagcaccgaagatgtgtttgccatggcctggccgcaccaagaaaaccacaacagtacagcactggaaacagaaaggtggaccaaggagcgcccgtgcggtgacaatgacggacactggcagcacgggcgccaacggcaagagccagggctcaaggggcaaggcgatgctgctcgccttgggcaagggcttccctgaccaagtcctgccccaggagaaggtggcggagagctacctccaagaaagcagctgcgacgatcccgacaccagggccaagctcgagcgcctttgcacgaccaccacagtgaggacaaggtacactgttatgtccaaggagagaaatttgctattatggagatcctcacgtgcggcttcgacgttttggaggcgtaggcgagggattagctgatatggaaaagcagggaataggccacccgctaaaacgaacaagaacactccattacttgattctggaagcacttacagcaaagaattgccgagaggacttttcgcaggaatcattagagacacttggggattcttttttcaactatattacagcccaacacttttttggcaaatacaaaaatcagcatgaaggcgctctgaccaagatgaataaaaacgtgatctcgaatgcagctttatgccagcttgcttgcagtaacagtcttgcggtagtcttacctaacctggcttcttttttgaaatcttaagttttgtttacgtgagttgtccctagaatcgtagatttgcaaacataatctaccgaatacagcagtttggatcagcatagtatctgaatttgctcctgattgtattctatgcaatgtcgtgtaatatacttgcctgatttattgtgtttcccttacaaaaaaaaaaaaaaaa

SEQ ID NO: 7928 - DNA, 4833 bp, Zea mays
  misc_feature (745)..(745): n is a, c, g, or t
  misc_feature (4624)..(4627): n is a, c, g, or t
  misc_feature (4629)..(4629): n is a, c, g, or t
  misc_feature (4631)..(4631): n is a, c, g, or t
  misc_feature (4636)..(4636): n is a, c, g, or t
  misc_feature (4638)..(4638): n is a, c, g, or t
  misc_feature (4641)..(4641): n is a, c, g, or t
  misc_feature (4644)..(4644): n is a, c, g, or t
  misc_feature (4649)..(4649): n is a, c, g, or t
  misc_feature (4654)..(4654): n is a, c, g, or t
  misc_feature (4657)..(4658): n is a, c, g, or t
  misc_feature (4662)..(4662): n is a, c, g, or t
  misc_feature (4665)..(4665): n is a, c, g, or t
  misc_feature (4670)..(4671): n is a, c, g, or t
  misc_feature (4675)..(4676): n is a, c, g, or t
  misc_feature (4679)..(4680): n is a, c, g, or t
  misc_feature (4684)..(4685): n is a, c, g, or t
  misc_feature (4687)..(4688): n is a, c, g, or t
  misc_feature (4693)..(4694): n is a, c, g, or t
  misc_feature (4696)..(4701): n is a, c, g, or t
  misc_feature (4704)..(4704): n is a, c, g, or t
  misc_feature (4710)..(4710): n is a, c, g, or t
  misc_feature (4713)..(4713): n is a, c, g, or t
  misc_feature (4718)..(4718): n is a, c, g, or t
  misc_feature (4724)..(4726): n is a, c, g, or t
  misc_feature (4733)..(4733): n is a, c, g, or t
  misc_feature (4736)..(4736): n is a, c, g, or t
  misc_feature (4745)..(4745): n is a, c, g, or t
  misc_feature (4749)..(4749): n is a, c, g, or t
  misc_feature (4751)..(4751): n is a, c, g, or t
  misc_feature (4764)..(4764): n is a, c, g, or t
  misc_feature (4770)..(4770): n is a, c, g, or t
  misc_feature (4772)..(4773): n is a, c, g, or t
  misc_feature (4775)..(4775): n is a, c, g, or t
  misc_feature (4779)..(4779): n is a, c, g, or t
  misc_feature (4781)..(4783): n is a, c, g, or t
  misc_feature (4785)..(4785): n is a, c, g, or t
  misc_feature (4791)..(4791): n is a, c, g, or t
  misc_feature (4799)..(4799): n is a, c, g, or t
  misc_feature (4803)..(4803): n is a, c, g, or t
  misc_feature (4816)..(4816): n is a, c, g, or t
  misc_feature (4820)..(4820): n is a, c, g, or t
  misc_feature (4825)..(4825): n is a, c, g, or t
  misc_feature (4832)..(4832): n is a, c, g, or t
atatatcacaacttatatcgagactaaagtaaagtcggccatttgtttacaatcaattgttatacttaaacatcatgagcacgtaccaatcacatgtttgcaggcatagacgtgacgcaaccacaaactaagctgggtgactggatgcctggatccgcgaggcgttgcatacttgtgttccgatccaataggatgcgcggtggagctgctcacaacttagcaaatgactgatctggtagaaggcaacaatcttaaaccctgtttagtttcgcttctccctatcacgcttagattctaggaaatgcaaaaattctcgtgattatttgattctcgcttattagtttaacaggtgaacggtcgattatgattatgtgaaaagcaaaaataatctaggcatctagtgagattctcacttatttttgtctataaacggattataaacaaaatcaaacatacccatagcctcacgtatcatgtctataaaaattagacactgatggtgtttggttcacaaaatataacataaatgataatgattcacacttgagtaccggtggtaacaagtttgaataggccgatatctatttttagtatggtatccaattacggttggacttaaacaaatatgatttaacgttatcggttatctattacgttatcaatatatgaatcaaacggtaccttagattgtctatcagttacccattacattaccaatatgtaaatcaaacagcaccttatgttntcattggtgggtagtgtaaaaattagacactttaactatagatgatattatttgacattgtttgcatagtaaaatttcaaatagaagatgagataaaactgctacagatggccttaaaattcatacatgacttagactactcaggcagcttcgcctgggctcaaataaaacatattacgtagagcacgctatcacgcaaacccttgtgcggtcatgcaccccgccgagcacgtaagaccatgagcctatttggtaggctgtctcgggcgtcacaccgcgccacactccggtcgccgcaccttaggcgtgctgcggcgccgtaggcgcctgtccaaacaggcctcatgtccaacaggtctcgtaaacactctcggatgcagagtttacacgacgcttggccactgtagcagtgtccagaaggtctcgctcgcgagcacgtaaaagaggggagtgtggttaccgatgtcagggaatacgtgatctgctagaacgatagctcgcatctccgtgtcgtgaggtggggtccactgtggaaaccaatctgtttccgcgttcgcattagggaatccactggactcagtctaacactgtctcaaataaaatgagtaaaataagagacgtgtaattatagatgacactatttacagagaaaagtttaaaatagaagatgacataaaagatgagatagagaatctactggagataatctaaggcgtattttgtttcaccggaccaacaggatatttattttaggccacgtacattctaataataattgtaatttagatagcacatatcaattaagctaatatgattttatacaaaatatatttatatattaacattgattatataaagaaaatatgtatgtgctatatttctgctataaggtattgcctccgtttataaatatatgacaccgctgacttttttaaaaaaatttgccactcatattatttaaaaatataataagttattattatttttatttgttttatcatttaaggtggtttatgcctaacttaaaattttacatttttaaataaatatttcgaataatacgagtgtcaaagttttcaaaaaaacaaggatatcatatatttgacgagtggtcaaagttttcgaaaaaagttaacgatgtaatatatttgtgaaccgatatagtagtaagctaaaaaacatgttataagttttagagtaaaaacatagcctcataatatatgagaatcgatttctatcctataaatttgagataagcttgtatctgaactttggaaagtggtggaatgttaaatttcaagtcaaatagtctactctattaggacatgttcgtttctatcctaatccatatggattaggatatgtattagagtggattggaagggtttaatccctaataaatcaaaattcatcataatccatatcaatcatcttcaatcctcaatccatatggattacaaataaccgaacacactccaatacacatggattgggagaaattagggtgtaaattaaactaatttacacctcaatcaatatcaacccatgtatattggattgaatactagagtatccacacatagcctaaaaagattctaattcctctaaagtgaacagatccaaacggcctcttacgtttctgtttcttttcacttctcttcagttctcatagatcagttcgacggctgagacctttgtacatatgtacaatcccttctatatggaatgcaacggcagaacacctgccacattgcgctaaaagaaacatctccagtaaaacattatagaacatgcaccaacagggaggtttctgcatcgaccacaagaacacatgtagatagcattacaaagggaaagtattttctagcatcacttactcgtataaggacaagtaataaagatcacaccaactggatgggcaaaaatactgggcagactaaagaaggggtggaaagaatgaaccatctcccctcgacggctcgacctaccgtgttttcgctcatgccttcgtctcctgcagaaccgaaaccaaacaaatgcctgcgcagccacgccgcctattaaagcaccaaagatgttgccgtggcctcgccgcacaagaaaatcacagcagtacagcaccagaaacagaaaggtagtagatcaaggaacgccagtgcggcgacaatgaccggcagtggaagcacgggcgccaatggcaagagccagagatccagggccaaggcaatgctgttcgccttgggcaagagctttcctgaccaagttctgcctcaggagaaggttgtggagagctacctccaagaaagcagctgcgacgatcccgccaccagggccaagcttcagcgcctttgtaagcttctttgtttcatcacagttgctgttctataaattcatcttgtcttcacgttgaaaattttaggttgacaaatgcagcttagctctagtcataaacatctatggtctaaacaacaacgctcactgaataaggaaaggacaatgagtacaatagatcaccatatacagccttcagtatttatgtgatgattcgatttgcctccgataaacagatgagtattgcccaaatgattttattttccaggcacgactacaacagtgaagacaaggtacactgttatgtccaaggagctattggataagcacccagagctgaagatggagggtactccgacactgacaccccgccttgacatctgcaatgccgcggtgatcgaccttggtgctgccgcagctcgcgctgcccttgacgaatggggtcgccctgcagctgatattacccacctcatctacatctcatccagtgaccttcgtctcccagggggcgaccttcacctggctgctcgccttggccttagcccaaacaccgtgcgcacttcccttctcttccttggctgctccggtggtgctgctgccctccgcactgccaaggacattgctgagaacaatccagggagccgtgtcctagtaacagctgctgagaccactgtgctaggcttccggccaccaagttatgaccgtccttatgaccttgttggtgctgcgctgtttggtgatggtgcatcagccgtgattataggagcaggtcccatgacaccagcagaaaatcctttcttggagcttgagttctccacgcaggagttcctacctgggactgataaggtaattgatggcaaaatctcagaggaaggaattaattttaaactagggcgtgatttgcctgagaagattgaaagccgcatagaaggtttctgcaggactctcatgaaccaggtagggataaaggatttcaacgatatattttgggctgtgcatcctggtggaccagcaatattgaacaggcttgagttctgccttaaacttcagccagagaagctcaagattagcagaaaagccttaatgaactatggaaatgtgagcagcaatacaatcttctatgtgctggagtacttgagggacgagttaaagaaaggggcaataagtgaagagtggggattgatcttggcttttggcccaggcatcacctttgaaggactgctagttcgaggtgtaaagaaaaccttcacaagctaatataatggtgggtacatggcaagcataaagattaattatatatacagaaacatcacataaagagcatagatgtctcggtggaagctgagcaccacatagcacatcgctaatattttactgtatttgtgttcttcatctatcaaacagtgtaaggtacttgagtttgcttcctagacattgtacaaataaggcactatacagcctgttgtagtgttgttccactgtactatgcaatgattgcaggattactttaatactgcttgtatggatgagtgaactgattccagtccnnnnanantttantngantangattntgatnatnnatanttnttganntttnnttnntatnnannatttnnannnnnngantctgtnccngggancttttnnnagggccnccngggggaccntttngnctatggggtgatnccctgngnntnaggnannngncctggnaaattttncccnaatcccaatatancganatatnatcgggnc

SEQ ID NO: 7929 - DNA, 1645 bp, Zea mays
  misc_feature (2)..(2): n is a, c, g, or t
anaaacacatcacaagagagccaagggctagccgatcaacaacaccactagcctctcctatcctagctagctagcttccaccggccggaagaaaaaaaaatggtggcgagcaaggccgccccgttcgacgaggtgtcctcggtggaggcgggggcctacgggggccgcgacgacgacgggcggccgcgccggacgggcacggtgtggacggccagcgcccacattatcacggccgtcatcggctccggggtgctctcgctggcgtgggccatcgcgcagctgggctgggccgcgggccccgccgtcatgctgctcttcgccgtcgtcatctactacacctccacgctgctcgccgagtgctaccgctccggcgacccagtggcggggaagcgcaactacacctacatggacgccgtccgcgcaagcctcggcggcgccaagcgccatcaagagggcggactgcttccacgccaagggccacaagcacgcgtgccgcagctccagcaacccctacatgatcctcttcggcgtcgccgaggtcgtcttctcgcagataccggacttcgaccagatttggtggctctccatcgtcgccgccgtcatgtccttcacctacgccaccatcggcctcgtcctcggcatcatgcagaccgtcgccaacgggggcttccagggcagcctcaccgggatcagcatcggcgccggcgtcaccccgacggagaaggtctggcggagcctgcaggccttcggcaacatcgccttcgcctattcctactccatcatcctcatcgagatccaggacacggtcaaggcgccgccgccatccgaggccaaggtgatgaagagggcgaccatggtgagcgtggccaccacaacggtgttctacatgctgtgcgggtgcatgggctacgccgccttcggcgacgccgcgccggacaacctcctcaccggcttcggcttctacgagcccttctggctgctggacatcgccaacgtcgccatcgtcgtgcacctcgtcggcgcctaccaggtcttctgccagccgctcttcgccttcgtcgagaagtgggcagcggccacgtggcccgacagcgccttcatcgcccgggagttccgcgtgggccccttcgcgctcagcctgttccgcctcacctggcgcacggcgttcgtgtgcctcaccaccgtcgccgccatgctgctccccttcttcggcgacgtcgtcggcctgctcggcgccgtctccttctggccgctcaccgtctacttccccatcgagatgtacgtcgtgcagcgcgccgtgcgcaggtggagcacgcactggatctgcctccagatgctcagcgctgcgtgcctcctcgtgtccgtcgccgccgcagcgggctccatcgccgacgtcatcggcgcgctcaaggtgtaccgcccgttcagcggctagttcagataggggcccaacgaggcgtgtgccgtgcacatgagtagtgccagtggtatctctactggtcggggtgctacattgactgtggggtcccgggttgttgtaacttgtaagatatagccaaatgaaaaacaaagctcccaccctcgtgtggagttttgtcatgtagcaaaaaaaaaaaaaaaaaaaaaaaaaaaacaactcgagggg

SEQ ID NO: 7930 - DNA, 1581 bp, Zea mays
tgaatttgtgctagctagccaacagacattaccatcgttcaccccgccaggttcctacaccctcacgatgaagttgctgggggacagcaacgaggaactgacctgcatctctttcgggttcagcatcgggtttgttgcgccgaatcccgtcatctgaacccagtatcgaatgtcatggatgtactttacatgaaccttgtagtgcaacattctccagtaagactcggaactcccaggctgggcgcctggaattggttaattcggtcttctcagccttaccaatgttcatcatgtgcacgctcaagattcctaaaaccatcattaaggaaattgatattttcagaaagcactgcctgtggagaggaaatgacatcaactccaagaggccacctttgattgcttggaattcggtcactcagaggaaagtgaatggtggcctgggtgttcttcgcttagaaacgcagaacgaggctcttctaattaaatttttgcataaatttttcaaccacagcgacttaccttgggtccatctgatctggaacaattactatcttactcgaggtctccctggtaatagaagcgttggatctttctggtggaagagcattgtaaagcttctgccaaacttcaaaggactggctacccccgtcattggcaatggcagatcaatttcattctgggatgatcagtggagtcagggcatcccgaggcatattttcccacagctcttctcctttgccaagaactcaaaaatgaccatcaaagaggtcaacgatcaagagcagttccatgatctttttcatttacctgtctctgatcaagcgtttgatcaatttctggtactcaaggggtcttgggagcaaattattcttaataatgttcatgaccgctggaagtacatttggggatcggacaaattctcgtcccaaaaagcttacagatctctcatgggccagatgcagactcatcctatctacaaactagtttggaaaagtaagtgtcagcctaagcatagagtcttctattggctgtggctcaagaacaggctaaacaccagaaatatgctgagaaggagaaacatggagatagattcctattcttgcgaaaactgcctttggcaaagagaggagaccctttatcatcttttcctcagatgcaacttcgcgaaagcctgctggaactcaattggcattaccccacccagaatttccaaccctgaagaggcatctgtgaacctcaaacaccagctcaacgttcccttctctatggagatcactattcttatgacttggagcatctggaaaagccgaaacgagtggctgttttcaaacagagatccctccgtgccccgctgcactcaggaatttagtagagaattgcgactaatcattcacagagcacggggagaattcgacacctcaatcccgaactggctaaatttgtggcaaatatagaaatagctcttccttttttctttctttctctcttctttttattgattgtaaaaggaccagggcctaaccctttaatattcgctttctaataaaatgcgcagtaggggtttccccctcctgatccttc

SEQ ID NO: 7931 - DNA, 3546 bp, Zea mays
cggcacgaggcctcgtgccgccacacgccgcgatggcctccgccgaaatccccaactccagccctgatgccaccaaccccgccgccgccgccgccgccgccgccgccaccgccgccgccactgccaccggccccgacctctcctcttcgccgccactcccgccgcggaagcgccgcctttcgccttcctcatctcccacgcgctccgcgtcacgctctcggtcgccccgctcccgctccccgcccggccgccgctcccgctcccgcagccggagccggagccgcagccgcagccgcagcccgcagtacccgcccgacggtaagcggcagcggcacaacgaccttaccgtggaggcgtgccgcgacttcctgcgcgataggtgcacccgctccgacctcgagtgcagatacgcgcaccctcacaactccgcttccgtcgaccggcaattgctgagatcaattggcatggaagatccaaaggtgaagacgatctgcagagattttacacgtgggaagtgttcaagatcagctaatgagtgccgattcttgcaccattcatctgttgaagatgctgcaattgtttgccaagattttttgcgtggacaatgcaatcgcatagcatgtaggtactctcatgtagtagcacatccggtgccaccaatgagccatgttcctatgccataccctgagatgctttacatgccaccaccaccaccaccacctcttggagtaccaatgatggggcctccgccttcaccatttactgataataagaacagagttgaagtttgtagggacttcttgaagaacatgtgcaatagagaatcctgccggtttgtgcaccctgagacacatacaacggcggtgaacgccaatgttgaagtatgccgtgattttaaacgaggagaatgcaatcgatctgcctgtcgctttttccacccaactacaagctgaagttttctgttgcctaaagtatactgtgccgggccctgttttcctcttcataatacaaatggctgccaaatacatatagatgaaagaacgctcccctaagaacacctagttatagagttaacttcaacgtcaacttgtggatcttttgtccattcaaaccagctagagcaaaatagagtttaagtttggtaatttttgtcatttgggtaaattaaggtattttcaatgaaatgcaacttttatctgatctgaacaggcatgcgaatgaacatgttggttctctaagatttccaattggctaagatagcatgcacttgttgaagtgatccactgtttgaccaccttcattgtcttttactccacatcaattctgttccttctgggaaagctcttctgctaagtttgatcttagatttatgaaccacaagtccacaacaatggcaaatgacctcttatatgaaaaaaaccctgacctgtggggggtaagattgcccccacgggccatggcattatattaaaagaccttctcacgtaggtcgagaaaacctctaaacccttgttccacccacatacaatggcatcatagcacatgtgagaatgaccgcgagtggaccgaaccttagacatgtgctttggcctaagcctgaaatttgctcccatgacgtcaaactcaggatctgaggagtgctactcaaaccacctaatcaattcagctagaggccctttcgcatggcctcttgtatgactccacttttagaatttattactagtttatggtgggctattgataaaatattaaaatttgtatggtctgatctgctcctgtgtatttctctcgcacgaactaatttcctgaagttagttgataaactaatgagagtatctttcaagtgactactattattttgctaaccgggttatctgacatgtgtcaatgtgtcatacctaatgttgggtcttataagatgtaagactaacagtagctgttgctatatgttttttcatttgagaaatcatcagtggcaaaatgtagaatctgctttttattttttccctttactgaaccagaaactgcaggcaagtccccatatttagttttcagtcttattaacaatgctgttagctgtctttaacatatgggtactgcttgtttcctcagcttgagtgctctgcccaccgccgccgctactgctgtgctgctgctgctcccccccccgccgccgccgccgctgctgcgccaccaccacccattctgcttctgccaccaaagagctgctgcgctggctgttgcgtcgctaaggtgccatagagcaaggaagccatagaaggcgctatatgtatgcatcgaataaaagatactaatatcctgtgatattcagatggttgcttgaacttgctttactcaatgcttgagcagtgcccccttcactatgggggctgtgtgtggttttgtatttgttgtcataaaagatattttttgactctagctaatttgatgtctgcgctattgacttccccttagcatcacactttattgtttgtataagttattgagcaaatgtttcgccacggcaggcctgccgctgtttcaaacaggcaccgccagagaacattctgatgtgctttgtgttactaaactatcatatacagtaccagctaccgagttgattgaaacggcaaggtatctgaaaggctggttggttgatgggctcctatgcaaagcgtgaggcagagctgctgttcggatgcggacacaaattctacaggagtacgggtaagcgattttaagcatgagctctggggacacagattcagacattgcaacggttttatgggtagcctgcctgaagggtcgccacctaatccctgccgatcggggcaatgctattctgggaaatgctatgcttgcacttgtaataactgccgcttctctgactgagcttcgtttgcagctgctggacttcaatcatgccgcttctctgtgattgagcttcgcttcctttttgctgcagccacgcttcgtcgtacaagtggttaccaacagctgcagtagatttggtgtgccgctggctgctttttctgaccccctctacgaacagtaggtgtacattacaagcggaaggtggcgtcacaggacaggagaaagcaagcacggtccaaggccgttctagctgtcgacgccgctttggataaaaaaaaagaggtgacgcgagagcgggagaaaaagccagattcatctgcagtgtcactgatccggcgtcgacgccgcctcgtagagcggggaaatgacatgggctacgacttatacgtcactgcttaagtaagtaacagtaacgtgacggcctgactggtgaactcgcaaccaccgcttttgttttagatttatctcttttccaagttcgataggtttgcgttattttgcctccaattgtttttttgggggttcattaatgtatgtgatttgatgcgctgaggcatcgacatcacgggtgtaagcagctagctgctgaggtctgccttgccttatcgtcgcgattaataaagctgtttctttctctgcttgcattgccaaagccgcggtttgggctctgca

SEQ ID NO: 7932 - DNA, 1439 bp, Zea mays
ttgggaccctcgagggcgggcgggggacctcccaactaccattcccagtgtcccacggacgatgggctccggcgaaatccccaactccaggcccgacggcaccaaccccggccccggcggcggcggcggcggcaccgggcccgacctctcctcttcgccggcgccgctcccggcgcgcaagcgccgcctttcgccttccccaccaccaacgcggtccgcgtcacgctctcggtccccccgctcccgctccccgcacggccgacgctcgcgcagccggagccgcagcccgcagcagtacccgaccgatggcaagcggcaacggcacaatggccttaccgtggatgcgtgccgcgatttcctgcgcgacaggtgcacccgctccgacctcgagtgcagatacgcgcaccctcacaactccgcttccgtcgaccgggacaacaaggtgacggcgtgcgcggattctcttaggaacaattgcttccgggggatgacatgccgttactaccacccgcctccacaaatccaggagcaattgctgagatcaattggtatggaagatccaaaggtgaagacgatctgcagagattttacacgtgggaagtgttcaagatcagcaaatgagtgccgattcttgcaccattcatctgttgaagatgctgcaattgtttgccaagattttttgcgtggacaatgcaatcgcatagcatgtaggtactctcatgtagtagcacatccggtgccaccaatgagccatgttcctatgccataccctgagatgctttacatgccaccaccaccaccaccacctcttggagtaccaatgatggggcctccgccttcaccatttactgataataagaacagagttgaagtttgtagggacttcttgaagaacatgtgcaatagagaatcctgccggtttttacaccctgggacacatacagcggctgcgagcgccaatgttgaagtatgccgtgattttaaacgaggagaatgcaatcgacctgcctgtcgctttttgcatccatatacaagttgaagttttctgttagctaaacttgagtgctctgcccaccgccgccgctactgctgtgctgctgctgctgctgccgccgccgccgctgctgcgccaccaccacccattctgcttctgccaccaaagagctgctgcgctggctgttgcgtcgctaaggtgccatagagcaaggaagccatagaaggcgctatatgtatgcatcgaataaaagatactaatatcctgtgatattcagatggttgcttgaacttgctttactcaatgcttgagcagtgcccccttcactatgggggctgtgtgtggttttgtatttgttgtcataaaagatattttttgactctagctaatttgatgtctgcgctattgccttccccttaaaaaaaaaaaaaaaaaaaaaaaaaaa

SEQ ID NO: 7933 - DNA, 1827 bp, Zea mays
gggacccctcgagccggccggggaccgattctcgcttaaacggacctcccaaactaccattcccagttcccacggcacgatggcctccgccgaaatccccaactccagccccgacgccaccaaccccgcccccgccgccgccgccgccgccgccaccggccccgacctctcctcttcgccgccgccgctcccgccgcgcaagcgccgcctttcgccttccccaccaccaacgcggtccgcgtcacgctctcggtccccccgctcccgctccccgcacggccgacgctcgcgcagccggagccgcagcccgcagcagtacccgaccgatggcaagcggcaacggcacaatggccttaccgtggatgcgtgccgcgatttcctgcgcgacaggtgcacccgctccgacctcgagtgcagatacgcgcaccctcacaactccgtttccatcgacctggacaataaggtgactgcgtgtgcggattctctgaggaacaattgcttccgggggatgacatgccgttactaccatccgcctccacatatccaggagcaattactgagatcagttggcgtggaagacccaaaggtgaagacgatctgcagagattttacacgtgggaagtgttcaagatcagcaaatgagtgccgattcttgcaccattcatctgttgaagatgttgcaattgtttgcctacctcattgaaatttgtgtgttattattactataaattacatatcagaatacaaatgagaacagtttttctgcccttttctatatgcagtgtacttagagcaagaacattgtctatttctaactgattcccccatttggcgcttcctaactcttgaaaagtattttggctgatttagttttttctactttgtttctttgaaaggtttgccaagattttttgcgtggacaatgcaatcgcatagcatgtaggtactctcatgtagtagcacatccggtgccaccaatgagccatgttcctatgccataccctgagatggtatgtacttctgctgaatacatccccagatgtcccactgttactttttatgggaagagtttttttatctattcttcatattttaatgatagtgttatttggagaactgagaagcttacccttttttgcctgtatttttagttgagtgttcatctttgcattatgtattataatctaaatgtaagatgaaatgagtaacatactttgtatctctttatatgcattattacgaagctttacatgccaccaccaccaccaccacctcttggagtaccaatgatggggcctccgccttcaccatttgctggtacatatggtcaatgatcagttcttcccccttgtacagttattgttgtttttgacatttaattaagtaccctgaaaaacatactcctttgcaaaaacacagataataagaacagggttgaagtttgtagggacttcttgaagaacatgtgcaatagagaatcctgccggtttttacaccctgggacacatacagcggtttgtatttgtgccttttctttggcctttttcggctagtttgcaagctactaatttgcaagtttttattgtctgcatctctttgaccaggctgcgagcgccaatgttgaagtatgccgtgattttaaacgaggagaatgcaatcgacctgcctgtcgctttttccatccacatacaagctgaagttttctgttgcctaaacttgtgtgccctgcgccgctgctgctgctgctgccgccgtcgccgcagcctccaattctgcttctgccaccaaagagctgctgcgctggctgttgtgttgctaaggtgccat

SEQ ID NO: 7934 - DNA, 1947 bp, Zea mays
ggatcgagtctcgtttgagacaacttactttaaaggtaccttgagtttcttaattttgtgcaccatgacttcaactgttacttttcttggttagatatctggagttaacataaaagcatggttgtattatatttactgaaaaatataatttacttgtggtgtttgttcttctaaaatgcagattgagcgggatactaaaggaattttgcagtgccatccgtacccatgcgagtattcagatcccacaatagagtgtgcacattgtgccttctacatgggcttatcaaggaaagaggggttgaaaaaacgtggtcaacagtttgatatccgtgggacagtagatgaatttatgcgtgaaattggcatgtattcattgtggaagcctgggatggatctggctgtcacccatgttcatagggagcaggtcccatcttatgtatttgagcaaggatacaagaaaccctgccctacaatgcatgcaaaccaacaagagcagtctgatggagatggaacatttagcccatatctggagagtcagcttaagagaaagtacatttccgatggagatggtcatgtggatctttgcaaatctgtaaaaagggcttcagtaagcccacctggtgtgggaaccccacctcatcttggaaatagtgtcagtaacgttgtttgtgacagtccagtcaaattcgtttcaagtgtcgtttgcagcggagcgcatgcttcctcatcatatgatgatataaatatagaacaagcacaattaactacttcaccatatggatctgaggatacctcagcatcaggtacaagctgtgcagcagtgggagcagttattttggctgatgaatccagcaagctcggtaacttgacatcagatcttgaagttgatacaattcagacaatgccactgcacacatctttagaatgcgtcgctcaaaagggtgaaacaaagcttgaggaaatcagaaggttggcgagcaacaattgtgctgagtttctagagagctaagttcttgctgacaaggtacacttagacttaggtgggcatgaagtgaattgaaacatcattccagacaaggtttttcttcctatacttcctgtcaaattaagattgtagtttgatatgatctgaactctatgcctgcctttctattcttttcattgattaactgtttggatccattaaaagtcaatgaaacatgtgattcgaagcggtttcgaaaggtgatgcaggtgtgaagtttgcatagcatcgataggccggaaatcggatttgaggcatgtctagtatcagaatccttcattcattccttaagaattaaaaatatgctttggtatgtttattttgtgccttttggtcctaatttttttttgcacaggacccaatgatatgccgctgcatggaaagtttcatcatttcatgcctgtggtcggtttgctcgtgaagattgcttttgttcgctgtggaagcgggtgcaagtattacacagcagcaatatcgggactgttgtgaaggatgaagttgagagtcaacatctgagaaccatggagctcaccatacgccacaaaggaactaaagctgctagtttaggcatggttaagagagtcagtgctggtcctttaggttaaataaaaactttgcggggccgcacagtgtgcagaaaaggttgagtctagggcactaggctgatggtctatgtatgtgatgtacgcagataggcagatacctatgcgttcaaagtagcgcatcaaattttggccccattattttcactgcagtatcatgatgtgatgttgatagtagagatagagcaagtatgatactccctccgtcctaatgtttgtcgttcttgctttttaaggagtcaaacatctatttttatagtaaaattattcgaagatacaaatgttactaatatattttatattaatggctgtaatcgcatt

SEQ ID NO: 7935 - DNA, 1199 bp, Zea mays
gcacgagaccattacctagaacatcctaatcgaaaatgtttgtgacagtccagtcaaattcgtttcaagtgtcgtttgcagcggagcgcatgcttcctcatcatatgatgatataaatatagaacaagcacaattaactacttcaccatatggatctgaggatacctcagcatcaggtacaagctgtgcagcagtgggagcagttattttggctgatgaatccagcaagctcggtaacttgacatcagatcttgaagttgatacaattcagacaatgccactgcacacatctttagaatgcgtcgctcaaaagggtgaaacaaagcttgaggaaatcagaaggttggcgagcaacaattgtgctgagtttctagagagctaagttcttgctgacaaggtacacttagacttaggtgggcatgaagtgaattgaaacatcattccagacaaggtttttcttcctatacttcctgtcaaattaagattgtagtttgatatgatctgaactctatgcctgcctttctattcttttcattgattaactgtttggatccattaaaagtcaatgaaacatgtgattcgaagcggtttcgaaaggtgatgcaggggtgaagtttgcatagcattgataggccggaaatcggatttgaggacccaatgatatgccgctgcatggaaagtttcatcatttcatgcctgtggtcggtttgctcgtgaagattgcttttgtttgctgtggaagcgggtgcaagtattacacagcagcaatatcgggactgttgtgaaggatgaagttgagagtcaacatctgagaaccatggagctcaccatacgccacaaaggaactaaagctgctagtttaggcatggttaagagagtcagtgctggtcctttaggttaaataaaaactttgcggggccgcacagtgtgcagaaaaggttgagtctagggcactaggctgatggtctatgtatgtgatgtacgcagataggcagatacctatgcgttcaaagtagcgcatcaaattttggccccattattttcactgcaggaaaaaaaaaaaaaaaagggggtggagatagagcaagtatgatactccctcggtccctccgtccaaatgtttgtcgttcttgctttttaaggagtcaaacatcttgaactttgaccatatttatataaaaaatattaatatttatagt

SEQ ID NO: 7936 - DNA, 4318 bp, Zea mays
cgtccgagtggtctatactattgatttaataaatagtagaacactctgaaagaaaaacaattagattcccacttgcgtcgctgtcacactgcggacccaacccaacgagccctgtggagtcagccactcagcctgcaacgagggcggaggcggacgcctcaggatctatgccaacgaccatttccaagctgacgtggcaggacgtgtcagcatcgtccgacgcggatcgcatgtggcggtgatgataccggttccggatcctacgaccaataactgccacgagtcttccgccgcctgcaagtccgagcggcaggctatatataagcaggggccagggagaggagcgtcgccggccggaccacccgagccagaagcgcgtcgccagctgataactaacccaacccaacccaaataagctcgatcctgctctctgccgacgcggccggattcgaatccgaggacgatcgatgacggtgggcgccggcatcgccgtccaggacggcagcctcctggcgctgggcgccaaggtcctgcgggaggtgcgcggcaacgtgctcgtgacgccggccgccggcgggggcctaaccaacggcgcgttcctcggcgtccggtccgcgcccgccgccagccgcagcatcttccccgtcgggaagctccggtacgtatgtgccgtgagggcaatccagatttacttccctcccttgcaatgctaattccacatgttcctatcgcttcccttgcaatgccatctgacggacgctgctgctgcagggaccagcggttcgtgtgcacgttccggttcaagatgtggtggatgacgcagaggatgggctccgcaggccgcgacatcccctccgagacgcagttcctgctcgtggaagtgtccggcggcggcgagcagcccgccgtcgtgtacaccgtcttcctccccgtgctggagggctcattccgtgccgttcttcaggggaacgccgacgacgagctggagatctgcctggagagcggtaagcagcataagaatatcttctctggcctagcaaatgtgtattgtattgtattgtattgtattgtattgtattttattgtattgtattgtctctttccctgattcaggcgacccggacgtggaatctttccaaggctcccatctggtcttcgttggcgccggatcggacccgttcgaggtcatcacaagttcagtcaagtaagccgatgccatctcttgcttacgatgcaccttcttgtttttaccgttgccagtttgccgactacgattaatctcctcgctcacgaaacggcaccgatcaactcgctgcagggctgtcgagaggcacttgcagacgttctctcacagggagaagaaaaaggtagcgagattggcatctgcttattagatctgggtcgctgtctgtctgtctgtcagtgtcacaggattctgtgctttcaacttgctgcagatgccagacattctgaactggtttggctggtgcacgtgggacgcgttctacaccaatgtcaccgcccagggagtgaagcaaggattgcagaggtacgtaacgtaacgtaacatctcgaaagttttcatcttttgccaaacctatagataataccaatctatgtatgttcttgtgtttttcccagcttggagaaaggcggggtttctcctaggttcgtcataatcgacgacggatggcagtccgtcgccatggaccctgtgggaatcgcttgcctatctgacaactcagccaagtaagcaagcagtcggggggacatggtttggttttctgtccaaaatccagagagtcggctcggattctgaacttcctctgttgttatgtgccttgtgttagcttcgcaaacaggctgactcacatcagggagaaccacaagtttcagaaaaatggcagggagggtcacagggaagatgacccagcgaagggcctagcacacgtcgtcaatgagattaaggggaagcatcagctcaagtaagtctgccaacaacaacattgatctgttcttattcattcattacagattatctggaaattcatctctatgacatcttgtatatatacaaaaaaaaaaccctcaggtatgtgtacgtatggcatgccatcaccggatactggggcggagtgaggccgggtgcagctggaatggagcactacggatcaaagatgcagcggcccgtgccatcgccgggggttcagaagaacgagcgctgcgaagccctggacagcatgacggccaacgggctgggcctcgtgaaccttgacagggcgttcagtttctacgacgagctccactcgtacctcgcgtctgccgggatcgacggggtgaaggtggacgtgcagaacgtcctcgagacgctgggcgccggccatggcgggagggtgatgctggcgaggaagtaccagcaggctctggaagcgtccgtcgccaggaacttccccgacaatggcatcatatcgtgcatgagccacagcacggacaacttgtacaggtaacaacgattgcttgtgctgagctgagatgtccggtcgtggctattccattcattcgcaaatcgcaatgctcttgcttctctgcagctcgaaacggagcgcggtgattagagcctctgacgatttctggccgagagaccctgcttcccataccatacacgtcgcgtccgtcgcttataacaccgtctttcttggggagttcatgcagccagactgggacatgttccatgtgagcatcatctctcatccctgattccttcaattcaattaatcccatgctcgcttgatgctacgacgaatgatgcccacactctcttgtttccacagagtgttcatcccatggctgagtaccatgctgcggctcgagcggttggtggctgtgccatatatgtcaggtaaacaaactataaaaacattgacgagtgatttacatggcattactaacttagacgttcatatattctgcagcgacaagcctgggagccatgacttcaatctgctcaagaagctcgtgcttcccgacggatcgatcctgcgcgcaaagctccccgggaggccaaccagagactgcctcttctctgaccccgcaagggacggcaaaaggttagattcgcagctctctacgatggctggtctgttcttgttcactaagagccgtctgctagctgaatcccgtttgatgctcttttcacagcgttctcaagatatggaacctgaacgaacactccggcgtcgttggcgccttcaactgccaaggcgccggctggtgccgggtagccaagaagaacctcatccacgaccagcagcccggaacggtgagcggcgtcatccgggcgcaggacgtggagcaccttgcaagggtggctgatcacggctggaacggcgacgtggtcgtgtactcgcacgtgggaggtaaacatcacctttttttttgctggtcctgatgaacagtcagatcattgtcaagctaggagacatcagtcgcgttctcgtgaccttttttctgtttcatcttgttaacaacggacaacgaaccatatctggcagcagattagtgacaagcaaccccttgttgtgtatgttgcgtcgtgtgaggtcggccccccccccctacctgccgaagaacgccttgctgcctgtgacgctgagatcgcgcgagtatgaggtgttcaccgtcgtccctctcaagcacctgccaaacggtgcctcctttgcggcgatcggccttctcggcatgttcaactccggtggcgcggtgagggagctgagattcggtggtgaggatgccgacgtcgagctcagagtgcggggctcgggcacggtcggagcttattcctcgaccaagccaacgtgtgtcgccgtcgattccaaggcggttggtttctcctacgatgccacctgtggcctcatcagcttcgagctcggcattcccgaccaagaaatgtacttgtggacggttacagtagggtattgaagttacaactgagaattgagatagattttctaatgcgtcagagaacgcccggtggtgtaggtattctgatttattcagtgttgtactttctattgttagttatatatattctgtacacatcccgggattttatgacaaatctagataaggggcggtccttagattttaggagcctagaacgacctcttaaatgtgatttttggtggaagcccttgttaatattgtatattgattttaccaataaaaatcaaatgtgatcaattaaaaatcacaaccttgataagttttttatactcccgcgagtgtgtgaaagatgtcttccgtcaccgtcttagctgac

SEQ ID NO: 7937 - DNA, 4427 bp, Zea mays
  misc_feature (4390)..(4390): n is a, c, g, or t
cccacgcgtccgcccacgcgtccgatggcagggagggtcacagggaagatgacccagcgaagggcctagcacacgtcgtcaatgagattaaggggaagcatcagctccagtatgtgtacgtatggcatgccatcaccggatactggggcggagtgaggccgggtgcagctggaatggagcactacggatcaaagatgcagcggcccgtgccatcgccgggggttcagaagaacgagcgctgcgacgccctggacagcatgacggccaacgggctgggcctcgtgaaccctgacagggcgttcagtttctacgacgagctccactcgtacctcgcgtctgccgggatcgacggggtgaaggtggacgtgcagaacgtcctcgagacgctgggcgccggccatggcgggagggtgatgctggcgaggaagtaccagcaggctctggaagcgtctgtcgccaggaacttccccgacaatggcatcatatcgtgcatgagccacagcacggacaacttgtacagctcgaaacggagcgcggtgattagagcctctgacgatttctggccgagagaccccgcttcccataccatacacgtcgcgtccgtcgcttataacaccgtctttcttggggagttcatgcagccagactgggacatgttccatactgttcatcccatggctgagtaccatgctgcggctcgagcggttggtggctgtgccatatatgtcagcgacaagcctgggagccatgacttcaatctgctcaagaagctcgtgcttcccgacggatcgatcctgcgcgcaaagctccccgggaggccaaccagagactgcctcttctctgaccccgcaagggacggcaaaagcgttctcaagatatggaacctgaacgaacactccggcgtcgttggcgccttcaactgccaaggcgccggctggtgccgggtagccaagaagaacctcatccacgaccagcagcccggaacggtgagcggcgtcatccgggcgcaggacgtggagcaccttggaagggtggctgatcacggctggaacggcgacgtggtcgtgtatttgcacgtgggaggggaggtggtgtacctgccgaagaacgccttgctgcctgtgacgctgagatcgcgcgagtatgaggtgttcaccgtcgtccctctcaagcacctgccaaacggtgcctcctttgcggcgatcggccttctcggcatgttcaactccggtggcgcggtgagggagctgagattcggtggtgaggatgccgacgtcgagctcagagtgcggggctcgggcacggtcggagcttattcctcgaccaagccaacgtgtgtcgccgtcgattccaaggcggttggtttctcctacgatgccacctgtggcctcatcagcttcgagctcggcattcccgaccaagaaatgtacttgtggacggttacagtagggtattgaagttacaactgagaattgagatagattttctaatgcgtcagagaacgccggtggtgtaggtattctgatttattcagtgttgtactttctactgtagttatatatattctgtacacatcccgggattttatgacaaatctagataagtggcggtccttagattttaggagcccagaacgaaattttaaatagaagcccttgttaatattgtatattgattttaccaataaaaatcgaatgtgatcaattaaaaatcacaaccttgataagttctttatgctcccgcgagtgtgttgccagatgtcttccgtcaccgtcttagctgacgtggtgtttttagtttgagaggtcactttattctagactagcaaagtatccatacattgttatgatttttatttgtacttaagtattgaatataaaaaacaaaggcaagtgtattgtattggctaagtggatgtgaatataggtgtagagccaacaaccattgttcaattctcatttatgcataattttaatatttttttactatttaaatgtgggccacgaagtacaacgacggtggaaaccgtgaaatcagaaaaactagtgctttaatcacttctttctagataagttgatttatcatgggtttatcatataaatttgacagaatgactatatttcttatgctagtaattattattattagcttgtaaagaataaggtagcagtggatcaatccatttaattcactaagcaaactaataataataataataataataataataataataataataataataataataataataataataagtaaaaagttaatatagacatatagtactcgttcttcaaaacatacacataaatatagcaattttatattattaatgttatttatgtgtatcagatggatccctacggcctgagggccccagatctgtcacaccatccgaaccccctcccccttcaggttcgacactgatccagtgtatcatggataatttttacatatatgatgatttagtatatagaaactcgtgttacgaactttattatataaataaaatatctttataaaaataactaaatgaaagaaactaagcaatgacggcgacaatcttgataacaagccacaggttgatcgaagcgacgacaacccaaaactcttcatagtagtcttcatcttgtgtccttgttctgggtagtgatgtggttcatgtattctgtgcatagatacgtgattcataaatgaaagcatagatacatgattcatcatcccacttttgtgatgtggttcatgcattctgtgcattatatccctacaatatactactctttaaatatctctcactattttattacaacattcactcccaccgaaatactcttatatgcatgatattatatacatggtagttcatgtttttccccacccactggaatactcagtctgcaccgaaatactcttatatgcaatgtcaatccatattgcaaccaccagttttatagtttgataagatattggaggcaaacaaatcattttgtcgtaaaaaataggatgttaatcaattgttcatatgtaagaaatgacaagatgtcgttcctattatgatcgtttgcggcccgggatcacccccctgtgacgagtaagccaacctccatatcatcacggtagtgtattgtaacccactggggattccacctctgcttctttaacttcgacgtcgaccgtaatcaccaattagttaagtctgaatttcctcagggtcgcacacgcatgacatcacctccgcggacttcgtggtcaagatcgatcgctgtcgtgctgtcattgattagtgatttgtgaattctaaatttaaaatacattatatatacagtgaaataaattttaatttatttttatctttatatacaacatgtttggcatttagatgtagaattttgaataatttaatcacccctattattgagaataaagttttgtttatattctattttctatcatgatacacatgtgagaaatatttttctcaaccccgccaggtacactcacggtgcgccgccatagccctaaccgcctacaatagaaaaacgtcatcaggaaaacgctgcttgtgcatggctgctttttccactgctgcaaggacgctctcgtaggatttgatattagggtttctgtcataggatctgataaaataaattcacgagtgtgaaaagcttagatgaaatagatggagataaaataaactcacgagagccttatgaaatatcttatgaaacagatgttctagccattcgatgctcttttcacaacgttctcaagatatggaacctgaacgaacactccagcgtcgttggcgccttcaactgccaaggcgccggttggtgccgggtagccaagaagaacctcatccacgaccaccagcccagaacggtgagcggcgtcatccgggcgtaagacgtggagcaccttgcaaaggtggctggtcacggctggaacgacgatgtggtcgtgtattcgcacgtgggaggggagccggcgtccctgccgatgaacgccttgctgcctgtgacgttgagatcgcgcgagtacgaggtgttcaccgtcgtccctctcaagcacctgccaaacggtgtcgcctttgtggtgatcgaccttctcagcatgttcaactttggtggcgcggtgagagagctgagattcggtggtgaggatgccgacgtcgagctcagagtgtggggctcgggcacggtcggagcttattcctcgaccaagccaacgtgtgtcgtcgtcgattccaaggcggttggtttctcctacgatggcacctatggcctcatcagcttcgagctcaacatccccgaccaagaaatgtacttgtggacggttacagtagggtactgaagttagaactgagaattgtgatagattntctaatgcgtcagagaacgccggtggtgtaggtattc

SEQ ID NO: 7938 - DNA, 2130 bp, Zea mays
cattgggtacctcgaggcccgccggggggggcacccccggcgtccgcggcgtcgtcatcggtagcgcgcggtcgcgactggcttctcgtagcagcttatctacagtaataatcacaagagcctactaggtggtgggagcagagcagcacttgcaattgcaaccagcaagcgcaagagaggagggggctcaagagtcttgacgcgtctagccttcgcagaaaagggttcaagcgagaagagggggggagagggcacgggttcagagctggaggagatggagagcccgcgcagccccgaggcggagatcggccaccgggtggaggacctctgggaggtggcggagccgcagctctcgccgtcggagaagctcaactcctgcttcgaggacatccccgtcgcgtccttcccgcgcacgcacccgtcccaagtcattgagattccttcagatgcaagtcttgctgaaactgtagaaatattatccaaaaacaaaatcttgagtgcacccataagaaatgttgaggctccagaagatgctagttggatggacaaatacatcggcattgtggaatttgctggtattgccatgtggttgctcagtcagtctgatgctgcagttaatgggacggttggttcgggaccaggatcgcctgtctccagtctagtttcgaggttgggttctttcacattcagaaggacatcatctggaagattagaaactgctactgattctgaatcagacgaagcagcatcggttggtgggagcttttttgaaaccctgacttcctctgaattctacaagaatacaaaggttggcgatatctcagggagcttccgctgggcaccatttcttgcactgcagacatctgacacattccttaccatgttgctgcttctatccaagtacagaatgaagagccttccagttgtagaagtgggaggagataagattgagaacattatcacacaatcctctgtcgtacacatgcttgcagagtgtgttgggctctcctggtttgagaactggggaactaagaaactctctgaactggggcttcctgtcatgaaaccatcgaaacttgtcaaggtaagcgaagatcagccagttctgaaagctttccaactgatgagggaaaagggagttggtggcttgccagtcatggacacaagtggagcaaatgccattggtaatattagcatcagagatgtccagtatcttttaactgctcccaagatatacaaagagcacaggtcaatcacgacaaaggatttccttagtgctgttcgacaccacctccaggagcagcgtgaggcctcaccgttgctgcatgatgtcatcacttgcaaaaaggatgatacaatcaaggacatcatactgaagctggactctgagaagatccacaggatctacgttgtggatgacaaagggaacaccgagggagtcatcaccttgagggacataatctccaagctggtgcatgagccacgccattactttggggatttctttgatggtgttgttcccctgcctgcaaacagcaccgtatgacacatcttcgcggtccaatcacactgatgtatctgtgcaaatgtacattttgagctattctcttctgaagttgcttctagtgtattccttttctcagccttctcggttctcaggtaaacagaccattgcctacatggagaaaaggactaatgctctaatggatggatggcaatgttgtacattgaataatctgtgaacttacctgagtttctttttcatgttctcatgatggcaattgttatctgtcttccttcttgctgaagatgctgttcactagattcagctttgtcatgctgcaaagcaaaattctgcgggagaagatgtattttatcttgtttttaaccttggagtcagactctttcgctgtcatatacctgggtaacttcatcattcacctggtggagtctactacatgtcgtagggtcaaccaaaatatcctcgtgctgcagtgcatccatatattttttccgtcgtggcagcataacgaggtactacctttgaagaagtgtatagtgtataagtggattgattatatttttcatcagtttaaacttttaagttgaactgattagtgcattcaccct

SEQ ID NO: 7939 - DNA, 1363 bp, Zea mays
cattgggtacctcgaggccggccggggaacaaaaccaaagacagaaggaaccaccacaatcaatacagaaatggtagggttcttcggcgcctctgctgcatctgatcactgtcgtttgctgacaacaaatggatcagttcaccatgaactgattagacgacaccatggcagaccaagaagtgcgatcaggtgctgcagcagcacggcaaggggaaggaccagggactattactaccaggtgctgggcatcgcaattcaatccacacctcagcagatcaaggaggcttacaggaaactccagaagcaacaccatccagacatcgccggctacaagggccacgactacacgctgctgctgaacgaggcgtacaaggttctgatgcgggatgtttccagttccaggcacgccgatggaaggggcaggagtagggtggggtcaggagccggttacaccggggacggatacagttcttgggaagggcccgtgagaagccaagctctcttcgtggacgagaacaagtgcataggatgccgggagtgcgtgcaccatgccgctaggacgttcgccatggacgacgttctcggcagcgcgcacgtggaggtccagttcggcgacctggagcagcagattcagctggctgtggagtcctgccccgtggactgcatccactgggtcgagagccacgacctgcccgtgctggagttcctgtcccggccgcagccgaaggaaggccacggcgtattcggcggcgggtgggagcgccccgggaacgtgtttgcggcggcgaagaacttcgccaggagactggagagggagaagcagcgggaggagctggaacgggatcagccctccgggggcctcgacggggacgcaggccgcgaggcggagacggaggcgcaggccgaggcgaggcgcagcgcgtgggaggagctcaggtggaagcccctgcttgatgcttggaatgggctgataggtggtcgttgacgctgcaggaggttgaagagaagctcagcgctggaagctgaacccgtaacatctgcagctgcagaaatagtggatgtgccaaggacaaaatagcacctttgtggccgtgggttatcaaacagtaggtgtcgtcgtaactcgtaaatgatcatgtgtaattacagattacaaaaaatgtgtaggaatagtagtcaaatatatgtgtgtagatgttggcatattgcacaggattatgtcccctttatatatatggtggttaatggaaatggcagggtggtacatcactgtatactacagacactagtagtttccggagaaaatctattcaacggtatcgaaacttaaaaaaaaaaaaaaaaaaaagggcggccgccaccg

SEQ ID NO: 7940 - DNA, 1449 bp, Zea mays
cccccgggtcgaccccgcgtcagatccttctccagttaaggtagtcagtgtgaacaatgacgcgaagaattcagtgagacggtgtcttctaaactcttattcagataaagtagtacaatccaatgaagttattgggaaatttgagcaagataaatttcctatcgtgtcgattcacaaggagactattctgagttctgaaaggtcttcacagctaaagctaaaggcggctagtgagaatttaacagtaagtccaccaccaagtgtggcgaagttcaatccacttatagattcaccggtgaagcctgctgacgagagttcagcgaaaaggacagaagattgttccagtggtgaaaattctccagtgttttatacagctagggctggtaatgaacatgataattgtcatgataatgattccgagaagagcagtattacttcaaattcatgcgccggtgatgattatagagacgaagtcttgccagacgagtcgtccagctgtaactgtgaggataaaaccgtctcagaagcaatagagtctggagcaaatgtaggtcaagctagacccttggagaaaaccatggtacctaatgaaagaaagccatttattaacaagctgcagtggctgttgaggtttggcagaccatcagctgaaggcaatgtggtggagaagggcagtgctcaggcatcatcggatgataaacatgacgcggttcctccctgcccttcacctgctgatgcgagttcagataactcttgcagcggcataaatttggcttatggcgataataagaaggtgatgggcactctgaagaatatcgggcagaacatgctcgaaaacatccaggtattatacttgaacccattttgtcgcccttgggcgtcaaacatccaggtgatcgaaacggcgttccagcaggaccgcgcgcagcccagcgccatggagaacttgtcgaacaacatcctgggaggcaaagggcaggtcaccgcgatggctgccctgacagagctccgcaagatcagcaacctgctgcgcgagatgtgacccatccaaggcgtgtgcaggctcctcctcctcccccattcttccccccccaaatcattagctcctcagaatcagataagcaaggcctccgtagttgaagcccaggcacctagccaccccccaaacccccctgtatatatagaccccattcgattattccattgagcctctgctcggcaggtatgctaaggctctcgttctttttctttctttctttcttgtaactaaggattggtcagctgctgtcaactgagttgcgggaggtgagggagtaaaaaactctcttgtctcctgcgttaggagcaactttttgatggaacaattttggacgcgaaaatgtctctcgaggttcagtaaataaatggaataagctatgtccaaaaaaaaaaaaaaaaaaaaaaaaaaaa

SEQ ID NO: 7941 - DNA, 2062 bp, Zea mays
ccctttctttcttaatatatgctgtttttaacttttagacatcgtatcgtatcttactattcttctgatcaaaatttaatgtgtgcatattatttattttattaaaatttattttatcgttactctaacgataatttgatcattttattattaaaaaatcgaataaaataaatagtacgagacggatgaagtaaacgagactccaccgcctcctccttaatcatggaaaacgacccactcatgaaattgcacccaaaaaagctgacatcgccatgcgcaccgaatactggaataccaccgtcgtcgtctaaacaaaggcacaaaagaaacggcctcgtttcgtttgtctccttgctcccgggtttcccggctaacagtgacacgccacaggtgtgcagatgccagcaaaacgcatcgggaccctcgaggccggcagcggcgcagcacagctgacagctcacactccactcgctcgctcaaagcaaaactgcccctccacgactttagcgccgatatcaaggccgcgccaaagcagtcctcgatcgatgcaacaatggcttcggttagtcgtcgcgtcctgctagcgctgctgtcccttctcctgctcgcgctccggcacgcggcgctgtccgctcccggggccacattcccgggcgacaaggcggcgctcgcggcgctgaggtccgccgtggccgcgtcctcggtcccgccccactcctgcctctcgtcgtgggacttctcccgcgacccctgcgcggcgttcccgtgcggcgtcagctgctacgctcctcccgccgccaactcctcctacctccgcgtcaccgccgtcgcgctcgaccccgcgggctactccggcgcgctcccagcggcgcttctgtcctcgctccccttcctcgcgtccttgtccctcgccgacaaccggttccacggcgcgctcccggcgggggtcccgctgccgccgaccctccgcatcctcgacctctccggcaacgccttctccggcgccataccggcgtctctgttcaccgcctcctccgcgctgcaggagctctacctctcccgcaacgccctctccggagggataccgccgcagctggcgctcctgggcgccctgacgcggctcgacttgcagcacaacgcgctcacggggaccctgccgagcctgggcgcgatgcgctcgctggtccacctcgacgtgagcggcaacgtgctgtcggggtcgccgctccgcgtgccagggacgctgccgccgtcgctctggtccgtcgcggcccggaacaactccttctcagggccgctcagcgccgcggcgctggctgcgctccccgcactgcgggtgctggacctcactggcaacgcggtgtccggcgcggtcccgggcgccgcgttcgcgcacccggcgctgcagcagctgcgcctgggttccaaccggctcgacgcggtccaggatgctcccgacggtggatcctcgagccagctcgtggagctggatctgagcggcaacaggctcgctgggcggctgccagcctgccttggcgcaatgccgcggctcgcggcggtcgcgctcgacaggaaccggttcaccggcggcattcccgaacggtacgccgtccgtgccgcggccgaggaatccacggaacagtgggtgccgttcgtcaggctgatgctgcaaggcaactatctgtgcggagccctgccgaggcagttgaggcagatccaggagggcagcgcagtggtgagcttggcggacaactgcctgccgaggtgtccacacaagttcttcttctgccaaggggccccgcagaaggaccacgccacgtgtcccaagtgcgatacttcgatccgtcgtcaggacattctgctgcggatgccctgattgtacattctgagctagtactaaaatctttgacaaaaataaaactacgtagtatgcattcttgtacgtgtgtaccaaaacagcaaagtagaagctgcctatcaattgaatgtgttcaactgcattcttgtacgggtgtaccacatgcattcggtaaaaccatagtttacaaaaaaaaaaaaaaaa

SEQ ID NO: 7942 - DNA, 1377 bp, Zea mays
  misc_feature (1345)..(1371): n is a, c, g, or t
  misc_feature (1373)..(1373): n is a, c, g, or t
tacctcgaggccggccgggcctcgggtccctccgggagccccggcaaccttaccttcttcacccaatctcccctccaaacgtcgtcaagatgtcgggtaaacagcaagacaagagcttcatgggcatgcccggtttcgtggtggacttcttgatgggtggtgtctccgccgccgtctcgaagactgctgctgcccccatcgagcgtgtcaagctcctcatccagaaccaggatgagatgctcaagtccggtcgtctcgaccgcaagtacggtggtatcgtcgagtgcttcagccgtaccgccaagaacgagggtgtcctctccctctggcgtggtaacactgccaacgtcatccgttacttccctacccaggcgctcaacttcgctttccgcgacacctacaagtccatgttcgcctacaagaaggagcgtgacggttacgccaagtggatggccggtaacttggcctccggtggtgctgccggtgccacttccctcctcttcgtctactccctcgactacgcccgtacccgtctcgccaacgacgccaagtcggccaagaagggtggtgagcgtcagttcaacggtcttgtagacgtctacaagaagaccctcgcttccgatggtattgctggtctctaccgtggtttcatgccctccgttgctggtatcgtcgtctaccgtggtctgtacttcggtatgtacgactcgatcaagcctgtcctcctcaccggtaacctcgagggtaacttcttggcctctttcgctcttggttgggccgtcaccactggtgccggtatcgcctcttaccctctcgacaccatccgtcgtcgtatgatgatgacctccggtgaggccgtcaagtacaagggtaccatggacgccgcccgccagatcgtcgccgctgagggtgtcaagtctctcttcaagggtgctggtgccaacattctccgtggtgttgccggtgccggtgtcctgtccatctacgaccaggcccagctcattctcttcggcaagaagttcaagggtggatctggttaagcgcctttcttccctcttcgatacccccaacctgcgtttatgtggtggaagcagctaatcgcgacgtgagagatggggatggggtgtacgtgtatgagaacgacaagaagccctgcgggcggaaggttgttcttggtaacgaaaagcacgatcccggggtggtaaaacactcttgtactttatacattcacacgtcatatccggcttgcaatgcttttgtctcttgcctgtacttcctctttttatcgcttggtgcaatggggaaaatagtggtctatagaaagtcatgggtttctttgtacgcnnnnnnnnnnnnnnnnnnnnnnnnnnnancaag

SEQ ID NO: 7943 - DNA, 1345 bp, Zea mays
  misc_feature (1214)..(1214): n is a, c, g, or t
cactccatagggcgattgggtttctcgaggccggccgggatcctcaatctcccctcaatcctttcttcttgttcaagggaaagcccatcacagccgcaatcatgtcttccgctgaaccccagaaggtcttgggcatgccccccttcgttgctgacttcctcatgggtggtgtctccgccgctgtctccaagactgctgctgcccccatcgagcgtgtcaagctcctcatccagaaccaggatgagatgctcaagaccggtcgtctcgaccgcaagtacaacggcattggtgactgcttcaagcgcaccatggctgatgagggtgtcatgtccctctggcgaggaaacaccgccaacgtcatccgatacttccctacccaggctctgaacttcgctttccgtgacaagttcaagaagatgttcggttacaagaaggacaaggatggctacgccatgtggatggccggtaaccttgcctccggtggtgctgctggtgccacttctcttctattcgtctactctctggactacgcccgtactcgtcttgccaacgatgccaagaacgccaagtccggtggtgaccgtcagttcaacggtctcgtcgacgtctacaagaagaccctcgcctctgacggtattgccggtctctaccgtggtttcatgccctccgttgctggtatcgtcgtctaccgtggtctctacttcggaatgtacgactctatcaagcccgtcgtcctcaccggtaacctccagggcaacttccttgcctctttcgctcttggttggatcgtcaccactggtgccggtatcgcctcttaccctcttgacactatccgccgacgtatgatgatgacctccggtgaggccgtcaagtacaagaacaccatggacgctgcccgccagattgtcgccaaggagggtgtcaagtctctcttcaagggtgctggtgccaacattctccgtggtgttgccggtgctggtgtcctctccatctacgatcagctccaggtccttctcttcggcaaggccttcaagtaagcgattcgtacaacataccctgtatagatgagtgtgggggataaggattcgaggagaatcttaattagcgggctggacatggtgtccgctggttgaaacaaaaaggcgagatcgaagtgcagatcgagggaagttgtcacagatacccgacgtggtcctctgaaacagcagctcttntacgggttagagtggcataggcacggcgtctttttctaatcttgctttgccttccgttctaggccgctgtaatttatacaccaatgcaaattccctttactggcaaaaaaaaaaaaaaaaaacccgcggcc

SEQ ID NO: 7944 - DNA, 2448 bp, Zea mays
  misc_feature (567)..(567): n is a, c, g, or t
  misc_feature (586)..(586): n is a, c, g, or t
  misc_feature (760)..(760): n is a, c, g, or t
caaacgcaatccgcaaacaaccgtggtacgaaacgacgagatctgctgactcaaagtatggttaagatcgagtgagcagagagcgctgttctaggggatagcccggcctagagtgttgcctacttgtccagggggcgcatatagcggttttaccgtgatcagaccattcccgataaaatttatatatctttcaacaaaacactgttaaatttaaaaaaatacaagaccctataataatatcatataatgaggttgacctagtgtcctaaaatgctagattcgatcgagaggacgcaactgttgaattaatatgggtgtgagccaaattaatattcaataatagtaattgctaaaggctttctttaatgctacagtgtaataatattttagtattatacaggaagtttaagagacaattcaatcaacttaaataggtggatttttgatgcatctattgagaagctgagaaacggatgaattactgccacacgcgcgcgccacctgtgtgaccgtggtagatcgaaacttggtccgaatattcattcctaatggttgcacattttgttnggagtgatgaccgtctatnactgtcgtccgttattggtcgtttccttgttatggctagtaacggacgagttgtaatgactgtcaattaataacatatgtcaatgatgacgtcagtttctggctgactgtaacggtaggtctgatggcgaccgttactgtccgctaatctcatacgcgttgcacacaaccattncccgtcccaccttttgcgagcccagagagtgtgggagagcaggcctccaaacaaagcgacatgtgcaggcgatccggtttttggggagcgtactcgcgactgctcgcttcatctgctagaccaccgctgatcatgtttctcatcgccgacgctgttcgagggactgcactgcgtacatctgcctgcatcgactgcgtacgactacatcgaacatacacatgagatgtctcgtgtgaatggagtcactgattgtctcgtgtgaatagagtcactaatcttttgagcatcgatccctccgcagggcacattatgttcctgataattgtgcatgttgtactgttgtttactgcttatatgagtagtaatacacacatacatttaacctatgctcaagatatcgtcacacacgttactgtaattttctggattaaattaaaactaaaaatatctatttctctaacataaaggaaacagttgccctagaaaaaaactataataaaactctacaaaaatttatgacaccaaatagttatcataagtgtttcattttatatccattttgggttataaaatctaatacttcatactgaccctaccaaaaaaattaattaaaacctaaaattgcatggactacacgcacgcattttgcaggaaatgctagcagagcatcacgccttcttgtgctctgtttaaatacacaccacatttaactattacttgcagttgcagctaagcggctggtacatgagcacacattaactggatcccccacacaagcacactgctaagaactacccggactcggacctcaaacacacacacaagccctaacgtgacgaacacacggccagacatgctgcacacttgcacagacagcgctacagcgaaacgaactctacacgtacgatataaattattgttacgtgccatacccacgtaccacgcgcaacacacgcatgcatctactagaccaggcacctcccgcagcccagggccagctcaaggcgtgacgccgccagcgccagcgcccccgccgccgtagccgccgaagggggtgccgccgccagcgaagccgccaaacgggataccgccgccaccgccgccgaggggcccgaacccgccgacgccgcccagcgggccgacgcctccgacgccgcccccgacgccgcccagcgggcccgtgacgccgctgaagacgcccccgccgttgttgccgaagccgccgccgtacccgccgcccacggccgggaagcccgggaggtcgcccatgcctcccacgcccacgaagaggttcttcttgtccgccacgccggcgccgcccgagccagagtcgtcgttcttggtgccggccgcggccgggagcgacgcggtgctgccggtggacgtcgaggaggcgcccggcataggcacggtcctggccgccgccgccgtcgccgcggcgtgcagcatcagcgcgacgcagagcactgcgaagccgatgctgcccctgatggccattgtatcagtgatttttctctgcgcgtttgctgctgttgcgttgggtgtgatgatcagagatagatcaggcctgcgcgtttaaatagaggcgggaggaggctggcaggtggagagcggtgaatgagagtatagttggccaaatgacactaacacgacgggccggcccggacacggcactaaaaagcacggca

SEQ ID NO: 7945 - DNA, 1314 bp, Zea mays
ctgattgaaaaagaaaatggtcttgcggtcttgctctatttcctcgtggtcggcggccggtgcagctgtagccacgcgcgcctcggcaaaccctccgcctcctctcccatcctcccctccatcccgtcccagccgcagggccatggactcttctgccggcgcaggccgccaccgcgttcgaatcgcagtcgtcggcgacgtgcacaatgattgggcccttgaggaagattcaaaggcgcttcgatttcttcagccagatttagtgctttttacaggcgattatggaaatgagaatgttgaacttgtcagaagcatttcagatcttcagttaccaaaggcggcaattcttggcaatcatgattgctggcacacacatcaattctcagagaagaaggtcgatcgtgttcggcttcagctcgcaagccttggtgagcagcatgttggatacaaatgtttggacttcccatcaattaagctgagcgttgttggtggacgaccattttcttgtgggggtgataggctacttagaccaaggcttctgtcaaaatgttatggtgtcaatgatatggctggaagtgcaaagaagatatacgatgctgctgcaggtgcaccagagggacattctgttgtattgcttgcacataatggaccaacaggtctaggttcaagaatggatgatatctgtgggcgggattgggtacctggtggcggtgaccatggcgatccagatcttgagcgagccatctccgatttgcaaagggaagccagagtttccatcccgctggtcgtttttgggcacatgcacaagagcctggcctacggtagaggcttgaggaagatgatcgcctttggagccaaccacatcatatatctgaacggagcagttgtgcctagagtgaaatttgcccaaacaactcctgggcacgagcaaaatcagcccgaaggatcgggatccatagctccaacgttgcgcgcgttcaccattgccgatctctatgaagggcgtgtggagaagatctctgaggtctgggtgctggtgagtggcgccaggaccgaggtcgaggaggaaatcgtcttgtacaagcatcctcgagagcagcatatgtgatggttatgagaccattatcttaccaaaaaaaagatgtggtgttgtgagacgaaaatgtgactgttgtgaatgccgtaaatgtgggggcgatgctgaagttgtgtgttataaagtgccttgtattcgaactgaaaggagcacttctgttataaagagccttgtattcgaactgaaaggagcacttcattatagagatcttttacctc

SEQ ID NO: 7946 - DNA, 2412 bp, Zea mays
ggtttgaaagtgctattaccgcaggtgggctccatgttactgagggcagcaagctatgggcagcctatagagaatatgagatggccattttgatcaccatcgctgatgccaatgatgaggagagggaaaagcaagttcagcgtatacgcatgctattccaccgccagttatctgttcctttggctgatatggaatctacacttgctgagtataagagctgggaggctgagcaggggaatgcaaatgatcctggtgcagattttgatggtgtcccctcaaatgttgtatctgcttacaaaaaggccaatgatatgtacaatgaaaggaagcaatacgaggatcaactaagcaatgcaggcacatttgaaggtgacaaactgcagcaatttatgaagtacatcaaatttgaggaggcttctggtgaccctgctcgtgttcaagttctgtatgagcgagctgtttcagagcttcctgtttcaagtgatatatggatgggatatacaagttacctggatagaaccctgaaggtgccttctgtagtcagaagtgtttattacagagccacaagaaattgtacatgggttggtgagttatgggtccattatttgttgtctttggagcgtattcgtgcttctgaagaagagctgcagcatgtatttgaacgggcaatacaatgtaccttttcaaccatacaagagtatttcaatatttatcttactcgagttcatggtttaagacggaggatttctgatggcttggattttcaactgattaggcagacattaacggatgctgcagaatttctctcatctcaactgagtaccaaggagttactgcgcttatatgcttattgggccaaactagagcttagtctcggcaaagatctttctgcagctcgtggagtttgggaaaacgcgatcaagaaaagtgggtctgtttttgaagtttgggagcagtacattttaatggagataaaaatggaccatgtacatgaggcgagatccctttataagcgttgttatagcaaaagatttgctgggtctggatcagaggagatatgctactcatggataagatttgaagaggagaatggcaccttggatgattatgatcttgctgtaaagaaggttacccctcggctaaaggagcttatgacattcaagtctcaagaggaggctaaagttgaggcttaccctaacctcaatgataattctaatgcaaatgattcctctcagaaaagaaaaccaagtaacaataaacagcagccccctgctaagaaaagaaaagagaatccaccaaaaagtaccatgccatcagatgaccaaggatcaaatgtgcaaagtgggcacagtggtgctgttactgatgtagaagtcggaggggccagcagggagaaggtcatggcatctatcgagatgaaagtggacagtgacagccgaacagggaaatcaagttcaaatgaaccaaagccatccttttataatgacaactgtacagtttttgtgtcaaatattgacttgaaagcaaatgaggatgatctcaggcgattcttctctgatattggtggtgccacagcaataagattgctgagggacagattcaccaaaaaatcaagggggttggcctatgtggactttttagacaacaagcatcttgaggcagctattaagaaaaacaagcagaagctgcttggaaagaaagtgagtatcgcgcgatcagatccaagcaagggtaagaagagccgtgaagcaggtcaaacaagccaggataatttacctccgagtggtggtgatgatgcaaaagcaacaggatccagtggaccagacaatgaagtacccaagggtgatgcaaaaaccatagggaagaataccctttttgcaccacgagctctggttaaacctcttggatggacaaacaaggatgagaagaaaccagatgttgcaggggagttgaaatcaaatgaggagttccgaaatctgttactaaagaagtgatatcagttggcaggtgtggatctccatgccccaatccagtgccaagatttgtggtgccttcatctctatgttagaatgatggacctgtagtagcagcttgaactggggatctacaaccgttatgtcttaccccgatgtagacatgaatatttctttctgctagggagattatacaagccatgccgaattgcagggtggtgaaggtgaaaacgggacgttgcgttcgagcagaaaaaccctgcccatgtgaaaagaaaacattgaccttacaatatgtgttcacttttttttttgaaccatacgtacgcattgccggtgaaacatcactgcatctcaaaaatgtgtaatctactctacgcggcttgattggagatgcggaaattttgatcgtaaaaaaaaaaaaaaaaacgttgggacc

SEQ ID NO: 7947 - DNA, 2396 bp, Zea mays
  misc_feature (247)..(247): n is a, c, g, or t
gaatgtgacaaaataatatgtttggctgattcagctttactttttgtttagtgacgagctggagagatgcacaagcagttttctgaagttgaccaagcatcatctttcctatttcaaggttgttggttggatatatgctgtttaagcattgtattattggagtatatattttattcagtttctcgtatgcatcttttttcttgggcaggaagttcttagcccgtcaattgagcggatacgcacatangtggataatttggcagtcttaaactctaggttgttcaattgttctttgcaatgtcttacatgcacccttccttttttttataaccaaaatagaactaattgtttttcaatctgtgttctggaccaaatcttatagggaggagtcaatagaacatgaaggggatgatgagatttctgtgcagacaagtccacaaaagtcccttgaggaggaatatttggaaactgaaaagaaggttcatttttagtacctgacattgatattacacctgaactcttaactagatgttgttaaggtcacacacacacctgctcgaataaatagctgtcttgtttttataattcatgctatgaacatatatgtgtttttagcccattagcttttaacagatagctggttgacaatttttctacattttcagatcgtgattgccttcagcattgtagatcgcatgaagaagatgttttattctgagcaagcggctaattctaggtactctctgactcttctcatctctacttactgaatctcttttttgtacccatgatccctgcagttagacaaaccaccttaccctctctatttttcaggcaagatgatgcagaggtcaggaccttattttctgagattgagaaactgagggaagtgtttgagtcggtagaaaggccgacactagacattgaagtccgcaaggcaaaggatccaatgaaggacaagtctggatcgaatcgttcagccaaagacaaatctgaatcgagccattcacctgttcaggtgccctcttcacctaaagatgtgcccgtggagtctccgaaatctccagtgaaacctgagcagacgatggacccagattcagagtttgcaaagttagagctagaattcggaaaagttaacagagaccatgaggagataggcggttgggatttcgacgagcttgaagaggagctgcgagctgacctatctaaatcaaccaatccaaaataaccacgctcaacccgacatctctgaacgcgcattccacctaactttccttgtgctggcttcttctgaaaatttgtagactttgaattgttgaatgtacatagtattgttgtttcattgtgtccatggacgttctatagattatactcactacatgggaggtggagattgttacactgtagactgacatttcattagcttatttgtttggtcttgtcatgtgcattcatacatgaatgaatgaatgataaacattatgtagcattccacattttggacattggaacatatattaactataacgataaaatgctcttggtcttggatgtccctgccaggttttaattaagcagaattgacaagaaattatgtactcgtaatctagtctccactttactcgttctacagtgattgaacatagaattgtttgattcagcataaacttagacattttatattttagaacaggagtacgatttctgaaaacatgtatccgtattatgtaacaagtagtagtagcaacagcagctagtaatacatcaacttttgcatgcaactcattgctgcatcacacaacacatcaacctaagttgcacgcacttgccgctccttgaacagcatcacccgcagtcgtcgtcgtcgtacatgcgcgcacacacacaggctcatacattacacgaggaacacggtgaactggagtacggactcgacgccgtcggtctcgagcagcgcgccggacgccgccacccctccgggcctcaccacggccaccttggcgaagcccttcgcaccgacgtacttccccgtgccgccgacgacggcgaggtgcgactccgagtccgcggtgcggtgcacgccgaagaagctgacggtgtcgtcgaacccgccttccttgaacatggcggtcaccgccaccgtctggctgacgccctcctccgagctggcgatgtagaagccctgcgcgcggcccaccgcggcggaccccagctccggcgcctccgtcagctcgtcgtccaccacggtcatggtcccgaagaggagcttctgcagcgtggtgccctgcgggaggctgcctccggcgaagaccggcacgccgttcccgtttccgttgccgttgctgccgacggacttggcggcgttggtggcgccgcccaggcccgcccaacacaat

SEQ ID NO: 7948 - DNA, 3536 bp, Zea mays
  misc_feature (1275)..(1275): n is a, c, g, or t
cgccctcctccgagctggcgatgtagaagccctgcgcgcggcccaccgcggcggaccccagctccggtgcctccgtcagctcgtcgtccaccacggtcatggtcccgaagaggcgcgcctgcagcgtggtgccctgcgggaggctgcctccggcgaagaccggcacgccgttcccgttcccgttcccgttgccgttgctgccgacggacttggcggcgttggtggcgccgcccaggcccgtgaggaagggaatgttgttgttgtcgatggcgcccgccgcgccggagttgacgttcacgccgctgttgagcggcagcacggcgccgttgggccgcgcgaagggcagctgcccggtgaccgcggcgttgtccacgatgccggccacgatgcgcgccgacgggttcgtgcccccgaggatgtcgtgcatgaagaagaccatcccgtggccgtcagcgccgccgcccgctgcacccgctcccgcggccccggccccggcccccacagggatggtgctggctgcgaccggagctgccgcagcagcagcggggatggcattggcagcgaccggtgcgtcagctgccacggcgcctccgggcgccgccaccacaccggcgcctcctaccacaggtggactggcatcggcagtgaccggtgcgtcagcagcagggtgcgctatggccggtgcggcagcgggcgccgcagcaccagtgccgtcgtcgtcgtcgtcggaagtcaactggcgcgtcggtctcgccgccgtagcgctgggcgcgacaaggaggaggacaaggatgaggagaagggaagagagtccgatggccgctttcttgaacgccattcgagcagggcaggctctctctgtttctagctcgccccgctggtggtgatgcactaatactgcaactgtttgtgctctggctgagctgcgactgtgagtgtgattgagccacccacaatagatctccatatatatgggatggcgagcatatggacgtgttgatggcttcatcgtttagtggttagctgtgtggactcgtggagttgctcacttgctcattggaggaaccaatggtttagttgcaggacacgcgccgtgctgtagctccgttttgggcttttggtactgaaacgggaaactactccacgttcatgctgccgctcaaaaagaaaacggaggccgtgaaaggcccagcaaggtcgattccgtgcgagcagcggcccagcccgccgccgccgccgtgctagcatttatctagcaggcaggaccgcaaggangcagcagatgaacacgcatgctgatgcagagacgcacatcagtagtggccaccccacctgacccccagactgatgcttactctagaagacacgtctggaccgtggcgcagtcgcagcacctcgtacgtttttttttcgttggtgtttggccgcttgctaggggcgacgagtcgggatcgggaactcagtgcgtcgcatgaaaaaggcagcgttgaattccacggccgaagcacggcggcgggcggcaggccacggtgaaaagacccaaagcactggacaccaacaccatcaaccacgccgctgcgactggacgaacacggcaagtgccgtcgccatcggcaccgagacgggttttctcgtcagcggccggccggctgcccggcttggtttctggtccagctccaccccgcgccgtccgcactcgtcatctcggcgacggtcttgcacgtgggcgcccacgtccacatgttaaaccccacctgcgttctagcgcagccggcagccccctcccgtttcaccaagtaccaccatgtctgtcgctctgcccatcgccgtcgtcgggctcctcgccctcgtcggcgcgtgccgctcggcggccacggacactctctcgccgcgccaggtgctcgccgggaacgacacgctcgtgtccaacaacagcaagttcacgctcggcttcttcaaggctcccgacggcgccgccggctcggccgacaagtggtacctcggcatatggttcaccgcggtccccggccggaccacggtctgggtggccaacggcgcgaacccaatcatcgagcccgacacaggatcgccggagctcgcggtcaccggcgacggcgaccttgccgtcgtgaacaacgccaccaagttggtgacgtggtccgccaggcccgcccacgacgccaacacaaccaccgccgcggccgtcgccgtgctcctcaacagcgggaacctcgtcctcctcgacgcatccaactccagctccaccgcggcggcggcgccacgccgcacgctgtggcagagcttcgaccacccgaccgacacgctgctgcccagcgccaagctcgggctcaacagggccacgggcgcgagcagccgcctcgtgtccaggctgagctcggccaccccgtccccggggccctactgcttcgaggtcgaccccgtcgctccccagctcgtgctcaggctctgcgactcatcgcccgtcaccacctactgggccaccggcgcgtggaacggcaggtacttcagcaacatcccggagatggccggggacgtgcccaacttccacctcgcgttcgtcgacgacgcgagcgaggagtacctccagttcaacgtgaccaccgaggcgaccgtgacgcgcaacttcgtcgacgtcaccggccagaacaagcaccaggtgtggctcggcgcgtccaagggctggctgacgctctacgcggggcccaaggcgcagtgcgacgtgtacgctgcgtgcgggccgttcacggtctgcagctataccgcggtgcagctctgcagctgcatgaagggcttctcggtgaggtcgccgatggactgggaacagggtgaccggacaggagggtgcgttagagatgctccactggattgcagtactggtaacaacagcaatgccagcgcgccatcttcaacgtccgatggcttcttctccatgcctagcattgggttgcctgacaacgggcgtaccttgcagaacgcgaggagttcagctgaatgctcaacggcatgtctgaccaactgctcctgcactgcgtattcctatggtggcagccaggggtgcctcgtttggcagggtgggttgctcgacgcgaaacagccgcaaagcaacgacgccgactatgtttccgacgtagaaactcttcatcttcgtctcgctgcaacagagtttcagacatcaggacgcaggaaaagaggagtgaccatcggtgccgtcaccggtgcgtgcgctgctgccttggttttgctggcgctggcagtagcagtgatcatccgtaggaggaagaaaaccaagaacggtcgaggggctgctgccggtggtgggctcacggccttttcataccgagagctgcgttccgcgaccaagaatttctctgaaaagctcgggcaaggtggcttcggctccgtcttcaaggggcagctgcgtgactccacgggcgttgcggtgaagaggctcgacggcagcttccagggagagaaacagttcagagctgaagtgagctccatcggcgtcatccagc

SEQ ID NO: 7949 - DNA, 2116 bp, Zea mays
gttaattcaatgatgctatcctcgctgtcaagaactcaagataccatctgcacctgtatttgtttttacccaacaagaaagcacttgctgtagtaggtctctgttgtttcttgtaccgcactaccgctgctacaagttaagcatggcttatctttcgttgtccatgattcttgaagctcctaaggaagaagaggtttcccttcttctagaaattttcggaatatgtcttacagggggcaaagaagttaataatgctatagtgagcagtatacaggacctggcaaagtcattctcaaattaccatgatgaggtcctggtgaaacgtgaagagttacttcagttcacacaaagtgccatttcaggtctaaagaggaatgctgacattgtgaggatagattctgaagctctagatttgtggaagaaactacatgagaaggaggcatcacgagctcaatcaattggcgatcctgataaagttacagaaaagacttcaactattgagtctttcaaagaagcactcaacgaagtccgattttgctctagaatggaggaacttctattgaagaaaaaaacaattaatactggggattccttagagatccactcccaaaaggttgagaaattaaaggtattggcgacttcccttgctaattcatcctccaaggcagagaagcgtattttggatcacagacgccagaaagaagaggctcttaactttcgtgctaaaaaggagaacgaagtgattgctgttgaaaaggatttgactgctgagatttctgaattggagaagcaaagggatgaacttgaggctcagttgaagaaggtcaacatttcactgaatgctgctgttggtcgactaaagcagacaagagaagagagggaccagtttcagggagcaagcgatcagatgatatttactttacaagcaaaggagaatgacctgtcaaaatctattgactcatgtaacatggaggccagtgtagtcaagacttgggtaaatttcctcgaggatacatggcaacttcagttgtcatacaatgaacagaaggaaactaaaacgaatgacgagctggagagatgcacaagcagttttctgaagttgaccaagcatcatctttcctatttcaaggaagttcttagcccatcaattgagcggatacgcacatacgtggataatttggcagtcttaaactctagggaggagtcaatagaacatggaggggatgatgagatttctgagcagacaagtccacaaaagtcccttgaggaggaatatttggaaactgaaaagaagatcgtgactgccttcagcattgtagatcgcatgaagaagatgttttattctgagcaagcggctaattctaggcaagatgatgcagaggtcaggaccttattttctgagattgagaaactgagggaagtgtttgagtcggtagaaaggccgacactagacattgaagtccgcaaggcaaaggatccaatgaaggacaagtctggatcgaatcgttcagccaaagacaaatctgaatcgagccattcacctgttcaggtgccctcttcacctaaagatgtgcccgtggagtctccgaaatctccagtgaaacctgagcagacgctggacccagattcagagtttgcaaagttagagctagaattcggaaaagttaacagagaccatgaggagataggcggttgggatttcgacgagcttgaagaggagctgcgagctgacatatctaattcaaccaatccaaaataaccacgctcatcccgacatctgtgaactttccttgtgctggcttcttctgaaaatttgtagactttgaattgttgaatgtacatagtattgttgtttcattgtgtccatggacgttctatagattatactcactacatgggaggtggagattgttacactgtagcctgacatttcattagcttatttgtttggtcttgtcatgtgcattcatacatgaatgaacgaatagataaacattatgtagcattccacattttggacattggaacatatattaactataacgataaaatgctcttggtcttggatgtcccaaaaaaaaaaaaaaaaaaaaaaaaaaaaaaaaaaaaaaaaaaa

SEQ ID NO: 7950 - DNA, 1897 bp, Zea mays
gaaagagttaaatgtatggtaggcccttgaacttgtgaggatgtcacttaggtccacaaactatcaaaatgcatttttggcatcctaaattcctaacattgcttaagtgtgcgacttaggtccataacggttcggaaggtgggttttggcctacatggcttcgccagtgtcgcagtgactgtcgttgcgcatgtaaggagcgtgtgaggttggtttgtaccatggaaataaccagagaagaccctcttcttcctttctttttgtttctgtggtccaagatggtggagtagaaatgaagggaagaagagggtatctttgcttattttcatggccaaaccaacctcatgctctcaccttgtgcgcagcgacacagttggtgccatgctggcaacggcatgtagaccgaaacctaccttcagtaccgttatggaccaaagtggcacacttaaacaacactaggatgctagaaatgcatttgtcacccacactggctacgtgtcattgccagtgtgggtgacacgtagccaaaacctagcttccaaaccgttatggacctaagtgacacacttaaacaatattagggtgccaaaaatacattatgagagttcatgtatctaagtggcaccctcagacaagttcaagggcctaccctgcatttaactctttgataaaacatttgtggcataggattattcaataaacagcagttgtctgatgaaatatgtgtactttgttcttgcatcgtctgcagacagaacattctatacatattggtggactggtgcgcctggacgtagaagagttaactgtaggatcgatctatgttacagtttgggcatcaccacttgtcccacttcacatgggaaagacagaaaacacggcaacattgataaaagaacactttggcttgcaattacagcctcccataggccaggagcgggtaaaggagcttggtaaatgggtgaggaaacagttcaaagtttctgggaacagttgggatacaaactctaaggatatagccatcgctggtcttggttggtttggaattgggctgaaaggagaggcagtgttaggattatggacatatgatggtgttgatgtcatctccaggagctccttagtccatgagagggcttcaatttttgaggaagctggtttcacagtttcacagattgtttctaaggcagatagcatgaccaataagctgaagagcaccaagaagccaaaaaaggagagaatgaaacgtacttcttcccccacagagccggaagcttcagacctgcttccaccgatagatacttgagtcttttcatccagtcctgtgactggagtatcattttggtgatcatgttacacaatgttccgcattggccctagaaactgttaattgaattcagaagcagcggctgagtatacaatgtattgttctccagaaggaacctgccctaatcggagtgtctatgttttacaaagctctaaattttgatcctttgctagtttgctgagctggagagtcaggaagtattctgagatgtcagtcagttacggaacacctatctggagagtcagtcagttaggaaatactctgtgagatgttttgatgttaacttataaaatccaacatgaggacttgtgttccagcattaaagggaaggtgtggagacattccagattgcatttgatgttatcattcagttttaggattcatgattgtgcctccttgtaaagttgtagctgaactataatgatgtaggttccacagatgcatatcctgtttttcgtcaacattgcctgcattatagattccgtgggcatcgttctcagaccacagcttgttttctaatgaactttctctcaattgcttgttgagctattggatgcaatgcgttttgtattg

SEQ ID NO: 7951 - DNA, 686 bp, Zea mays
aatttttttatttctcataccacgacatgaaaggaaaaaaaaaagatatatatgcactcagtgatgtacaacagtgtctatggcggcgggtggcgtgcggcgagccctcgtggcgctgcgctccggttccccgtctactatctctgcaacgctctcccgccaggcggcagctcgctcctcggagctggcgggtgcgcccctgccgcgcgcctctcgccggcgcctcgggatctcgaggtagcctgcctgccgcctggagcttttgaatctctagcggagcatttctattcttctccttggctcagatccggtggtgcagggtgccggttgtggcgctcggcggcgtgcagggttcgctgatgccgatgcacagcgccaccgcgtcggcgctgctcacctccatgctcgggcttaagcctgactcttggggttggctctccgagggatttgctacacctctataacaagacacaagagcctgatttttcgcctttgtactagaggattccaataacatttttacatgccttgcgggagtacgcccttggacttttgctgatggaatctgcgaccgaaaacttatggtcttatttccatgatatgcatcgatttttctcggattatctcttttttttcccccttgtatggagccatgggaagtatcaggatgtgttatctggagcatc

SEQ ID NO: 7952 - DNA, 784 bp, Zea mays
gcacgagaccattacctagaacatcctaatcgaaaaatactagtgggcttatgtccaccgagtcactcagcgcaaatctgcaagcagcccaagaagggtttagactttagaggaaggggacaacggaacccgtcgatggcggcggctgctggcggcgtgcggcgagccctcgcggcgctgcgctccggttccccgtctactatctctgcaacgctctcccgccaggcggcagctcgctctctggagctagcggccgcgtccctgccgcgcgcctctcgccggcgcctcgcgatctcgagggtgccggttgcggcgctcggcggcgtccaggcttcgctgatgccgatgcacaacgccaccgcgtcggcgctgctcacctccatgctcgggcttaaacctggctcttggggctggctctccgaaggatttgctacacctctataacaggaaaaaggagtatccgtgataagtgcctgtttttaaacctttgcactagaggattccaaaaacatttttacatgccttgcggagtacacccttggacttctgctgatggaatctgtactaaaatctgcgacaaaaaacttatggtcctatgtcccaattatcttggttctactatatccatcgaattattcgctttcaaaaaaaaaaaaaaaaaactcgagcccgcggcattgccatgggattctaatatgacatcagcatggctagtatcaaatatttgttatccgaagcatcaaagcacaagtatgaatgatatatttacatgttttgtgttgtt

SEQ ID NO: 7953 - DNA, 629 bp, Zea mays
  misc_feature (582)..(582): n is a, c, g, or t
  misc_feature (584)..(585): n is a, c, g, or t
  misc_feature (610)..(610): n is a, c, g, or t
acggtactacaaccaaatttttttatttctcataccacgacatgaaaggaaaaaaaaaagatatatatgcactcagtgatgtacaacagtgtctatggcggcgggtggcgtgcggcgagccctcgtggcgctgcgctccggttccccgtctactatctctgcaacgctctcccgccaggcggcagctcgctcctcggagctggcgggtgcgcccctgccgcgcgcctctcgccggcgcctcgggatctcgagggtgccggttgtggcgctcggcggcgtgcagggttcgctgatgccgatgcacagcgccaccgcgtcggcgctgctcacctccatgctcgggcttaagcctgactcttggggttggctctccgagggatttgctacacctctataacaagacacaagagcctgatttttcgcctttgtactagaggattccaataacatttttacatgccttgcgggagtacgcccttggacttttgctgatggaatctgcgaccgaaaacttatggtcttatttccatgatatgcatcgatttttctcggattatctcttttttttcccccttgtatggngnnatgggaagtatcaggatgtgttatntggaaaaaaaaaaaaaaaa

SEQ ID NO: 7954 - DNA, 3168 bp, Zea mays
ataagcaagaaaggcccactaaagggcaattgacgctgggcctagcagctagcgcgtggcggcgacggcgacggcgacggcgggggaagactgagcggccgaggagccggtgcggcatcggtgcatcgcagcggcctgaggtcgcgagcagcacagcagggtgcgccaggcgccgacgcggcacggggcaccgcgcgacgcgtgagcgcgtggccggtctcagcaccaagacgcatcaaagccggcgctaggcagggcactatcgcgctgctgcgcagctgtgcctgcgctggtccctggaggattagtgacatcactcaccaatttgtgttttgcagaattgggagaaatcaagtaagtactaactaggtgtataaatgcaattacatttcactgattcaattagcccctattcaattagtccgtggatagtgctgcattggtttaaggaagaacctcttcctgaatctaccatttcttagttttagcctttggggtaaggtccgtaaggatttagtgtttctagacctaagttagtgactctagtaagggtttgtgggagcttatcaatcatttttttacttatccaaccgctacaaatagatggtgtagtgatttgtctgatcaagtttgcttttgtcctgttttctataatcatatggtgatttggaggaaaaaaactgggatgttatttttcacatgttgcgggatggttgcagtaaaggtggttagattactttggaacaaatagttcaatgttgataagcattgggttttctcaagttatggtcctgaattaattctgattagtgttggagcacaggagtgggattcaggtgtacgcaacttacttcaaaatggcgaacaaaagaacaagagatattaataaaaacaagttatgttctctttgtcaaaggccgttctgggctgtgtgcagccaacttcacaacagatcaggaagctttagagcttggcaatggagatgagagcccgggaatctgtaagcatgtcgaaggatctaactggggaaatcgcaccttttgccactgccctacatgatgtgttcctccactcccattgctcatcatgcttcaccaagttacttccacaagccccttgtgtcatgtcttgcatgacatgctgttctcttcgatactgctgttcagagtgcttacgtgcggattcagtggtgcatgtttcctctggtgaatgttgcttttttgtggatcacctcaagagagcctccccttcctatgttactgaaggaacaagtgatttgcgtgctgccctccgccttctgtgtgtgcttgagatacatggtcttgtttcgcctgattcaatcaatcactacagtagaattggtggactttcaacaagtggtattgaggaagctttgaaggaaggtgaggttattgctgagaggatactggaggggagcttattgatgtcatctgctagaaaatcgagggcacagacttctgctattttttcagacaggcttaaacttgagaagatggcattatgggcagtgattatcaatagcgttgaggtgcaacttagtgaagggttagctttgggagttgcagtgtatggcccgagtttctcatggttcaaccatagttgctttcccagtgcttcttaccggtttgtactggctccaaggaatgaagactgtgcttcacagaaatcaaaatcctgtgtagtccctgctagcaaaggagttgcagctgatgtggtaaaggagaataatgaccattttgtttaggacccgctacaattttgctcgtgtcatacaaagaataagattaaatatttgaatactgttcacaacatactttcattatcataaacaagtgctatttgaatgtttatacagaaatggttcctcaaacactttcataggctgaatctaaatattcatgaatatactcatcaactcatgtttaaatttcaatagttagacaatatttatatagcatttacttgagagaaaatcattaagcttattattgtgcttgtttttattgcagtggcatgcttggcaatacgacgatcattctactcatggcgctgtattgcatcaccagagccatacactgatcttattctgaattgtgatgtgagggacttggataaagcagaagcagagggtactgttacacctccagcaattgagaatttgggtgatgtttttgagtggtttgaagcaagaggatatttcagggagaaaacatatactacagcctcttcaccatatctgtcttactgcttacatgacacttgcctctgcttaccggtttcgcgccttaagtttagaagaagctgtccgttcagatggagaaaatactgatgacttttttagaatggctaaagcagcagcagcgtattccctggtacttgcagggagtgcacaccatttgttcctatcagaatgtcctcttatgatccccctgtctcattttttgttaaacactggacagtctctgttatatcttgctgagtctatcaagggaaagacaaggcaaaatatatccgaggccaggctcagcttttcttcatgtccagcaagttctacagacaatgattctccaccgtaccatgtgttcagatcaacctgtgaagcgtttggcaagcaaatgttatccctgtcactgcggtgctggtcatttctagtgcgaggtttaccctgcctggaaaagataaagagccccatggaatttagtatgcccggaacaacaatatttcagtctgtcctttctgaggaagaccatgccaacctttccgcgcacgagccagtaggtttcacggagagacaagcggggtgcatccttagtttggctctatgttgtatcacctactgcaaatatcttgctaccatatgctacggcccacatcattatctggcagaccatgcaaaatatctacttgaaggtatcgatcctgcacaatgaatcttctttcttggcataggtgtgttgtgaaatcttatgctcttatgagttaatgtaaaacgtgtcgtgattatcaaggctgttgagcttattttctatatgattgtatgctgagctcgttatttattattttgtatggaagcaccatttttctaaaaaaatttggtcactgggaagttgtatcaactgatcttgcacctttcctggctttttctgg

SEQ ID NO: 7955 - DNA, 1637 bp, Zea mays
gtttggatcgggacgttggtccttcggttcctgctgctgaggaagtacatgtgcctgaatttactgacgctgaccccaatgggggtgatccatctatcgctgatcccaatgggtgtgctccatctgccgctaatcccaatgggtgtgctccatctgccgctgatcccaatgggggtgttgtctgtgtcgctgatgaagacgacggggaggaagaagatgaggtccctctgactcggaagaacagtcggcaatatgtcgccagtggggaaagtagtggagttccttctccttctctgtctgccctcattggtctacaagaattgtccctagcgaactttgatcagactcttgaagatatggttccagaggaactgttatcagagccggcggatggtggtgcgacggatgtttgtcctgatgtgctcgacgccgggttggggtcatcccgggcagcgtcccgcgcctcatcgaccttggagcgcggtcttgagggtcaggaaactgacttggatcgtcttgttcccatggaaataactgagggaccttcagccttagaggcggctgttgctgagaacttggtcctcaaggatggtgttgacacttacccagcccccgagggtgttgccggggatgattcggctcgggtgggaagcgcaagccactgcccagcccccgagggtactgccggagatgatccggctcaagtgggtagcgcaaactatggcccagcccccgagggtgtccgagcggggtctccctcttgtacttccatggatgttcatgcaggatctcctccacactctggttgcatggtggtagcccaagctttgggccagggagtcgctttagaggctagcgttcccgccgaccaagttttgggctctgttgatggcactgaattggttcctgctggttcattgcgagctgcttcgggtggtgaccctatgccaagtcatcaattgatctctcacgatttgggagtcccttcgttcttctccaatctccaggtactgtgatatattctagcctgacttttacaccgtatgaactgctgtcattacactcatctgttctcaatatcaggcattggtggacgggatggctagtcagctgaggttgcaaggtgtttctgttccagaaggagcttcgtctctggcacgttggaatccggtgctgcttcagcagcgtgtctctgacttggaggcggcgaatgctggttagtgctcttttgcttcccttcgtctgccttattgaactgcttcacactttgatcctttttgcttgattgtttctcgccagatatggctcgacagattcctgttcttgaagaaaaacattctcaaggtcaggctgaactggtccggcggtgttctgattttgaggaaaagtattctcaaagccagactgagctggcccaggtctctgctgctctgagtgacgctaacacgctgaactctactcttcgcgctcagcttgattctgaaaaggtgacttatgaaactgtgccttgtattgctgtgttcttattgctcgcttgatgtttgaaggagctgattcttgtttgcaggaagaaaaaagtgcccttgtcacttctcgtgacaatcttgatagactatatcgtgattccagcaactcgt

SEQ ID NO: 7956 - DNA, 3372 bp, Zea mays
cccattttggctgtggaagtacttgtatcactgtcgccctgggatggccggggggcagcatcagctggtgggggggtgcgagtttggagatgcgccgtgggaggaagactgactaccttgaaatcccactcaaggatagtatcaaaggatggcgcttggagtggtttattgttgagaaccacagaaattctctccccccacggtcagggagacagccggatgttcgtactccgagttggaccgagtcccccacggacctggaggtggctgaggcaggggctttgctggctgaagttggactgctgaaggagaggggtctgactgcagaggctgtggttgctgattttgtcttcaagaacattcagcctttgaaggacagggcatacccggcctatctgtgcagaggtctagctgactcaacccgggtcaccaacagaagaattcctgctgtagacttggtgaaccggcttgaaatgatacatagaggcaaggtatcaaatgttggcgcccctgtcgcatactcggtctggaacctgcttccttccaaggcctttactcattttgtgtcgaatcctcctgctgctgatggcggtttgggccttagagtgtgaccctctaccgaagaagttagtgctttggttgcttcgcttggagaaattcctgatgatgaacggcaggtccactttgaggtgcctttggatcctagtgatgcagagataagtgctatgcttgatatgctggccgaggactcttctgatgctgctcctgctgggacattggtggtggcgcctctccggaagctggtacaaccttggatattcagaggcctgtcagtgttcgcccgaagcgcccttgccgagccaatcaatttgattctcctgctgatgagcagaaaaagaaaaagagacgtcttcggcgagtatctagcttggatcaggatgctggtccttcggttcctgctgttgaggaagtgcttgtgcctgagtttaccgacgctgaccccaatgggtgtgatccatctgtcgctgatcccaatgggtgtgctgtctgtgttgctgatgaaaacaagggggaggaagaagatgaggtccctttgactcggaagaacagtcggcgatacgtagccagtggggaaagtagtggagttccttctcctgctctgtctgccctcattggtctacaagaattgtctctggcgaactttgatcagactcttgaagatatggttccagaggatctgttgtcagagccggcggatggtgacgcgatggatgtttgtgctgatgtgttcgacgccgggttggggtcatcccgggcagcgtcccgcgcctcatcgaccttggagcgcggtcttgagggtcaggaaactgacttggatcgtcttgctcccatggaagtagctgagggaccttcagccttagaggcggctaccgcagagaacttgggcctcgaggatggtgtcgacacttacccagcccccgagggtgttgccggggatgattcggcttgggtgggaagcgtaagccgcggcccagcccctgagggtgttgccggagacgatccggctcaagtggatagcgcaaactatgacccagcccccgagggtgttcgagtggggtctccctcttgtacttccatggatgttcatgcaggatctcctccacactctggttgcatggtggtagcccaagcttttggtcagggaatcgctttagaggctagcgttcctgacgaccaagttttgggctctgctgatgacactgaattggttcctgctggttcattgcaggctgctccggatggtgaccctacgccaagccatcaattgatttctcatgattttggaatcctctcattcttctccaacctccaggtactatgatctattctagtacgattatacaccagacgaaccgctgtcattgcactcatttgccctcaatatcaggcattggtggacggaatggctaatcagctgaagttgcaaggtgcttctgttctagaaagagcttcgtctctggcacgttggaatccggtgctgcttcaacagcgtgtctctgacttagaggcgacgaatgttggttagtgcttttctgcctcccttcgtctaccttattaaactgcttctcaatttgacccttttgcttgattgtttctcgctagatatggctcggcagttttctgttcttgaagagaaacattctcaaagtcaggttgaactggtccggtggtgctctgattttgaggaaaagtattcccaaagccagactgagctggcccaggcctctgctgctctgaatgacgctaccatgctgaactctactcttcgcgctcagctgattctgaaaaggtgacttatgaatctgtgccttgtgttgccgtgttcttattgcttgcttgatgtttgaagaagctggttcttgttgcaggaagaaaaacgtgcacttgttgcttctcgtgacaatcttgacagactatatcgtgactctagcaactcgttgaccatcctggagaggagtcatcgcttcaccatggaggagttagacaatcatcgctgtaagttgcaggaatccacagatgacgtgatctgtctcaggcagttgatatcggctaaggatgctgctatcaaggaactgtgtgcttccaagaagtccatcgcccaggagctagagaccgctcagttggctgtcaaaactgctgaagaaacttccgttactctgagggcccagcgcgacagagccatggataaagccattcgcgcggggcggatcttgatgatgagacccgacgtgattgttcccgacgatataagggctgatgtgaacgctgctcctgattcctcaagtcgcccttcttcgtcggttgctcctgagaagaatattgcaaaatagaaaaacactgtgtgctttgagcgcgcggttatcgtgctcggatattttgttagaggacaccagcttgacatttgaatgctactgttactctcctatcattttagaattcagcagtatctaaatttgcaggagtaaaatgctgtatgatgattttgaaacttcttcacgggacatagaggttgcccctatatgagtaatcataagcatgtgtaatcgtcttaagtcgttgctgacttagaccgattgcttttgttaatagggcatagtagtaatcccgagttaagtaagcgcgagcatgttgcaccgtcttaagtcgttgccgacttaaggcgattgctttgttagcagggcatagtggtcaccccgagttaagtaagcgcgagcatgtttgcaccgtcttaggtcgttgccgacttaagccgattgcttcgttagcaaggcatagtggtcaccctaagttaagtaagtgcgagcatgtgca

SEQ ID NO: 7957 - DNA, 1532 bp, Zea mays
  misc_feature (37)..(37): n is a, c, g, or t
gaattttaacaccaaatcgagttgaccggcggaaganagagttggcctccaccgtcaagtcaccaaccacccagagactcgcccggcacccccccaggccagccgccacgtttagccgggctaaacaaacacgggcgcacaatcggaactcgctgcactgcttggaatccaacgagccaatcattcaaatcctccccggaaccgcgttgagcagggcacggtcgattggatctagggtgagggtccgtcgccgaagaaactcgcaggcggtcacgaggaggcggcgggggagggcgggggagatggcctcggaggagatgacggcgacggaggtggccgctgctggacttgaagccgcacccggagggcggcttctacaccgagaccttccgcgacggctccatcacgctcaccacgtcccagctcccgccccactttgctctgggtggtgatccttcgccgagccaccagttgatctctcacgatttgggggttccctcattcttctccaacctccaggcattggtggacgggatggctagtcagttgaagttgcagggtgcttctgttccagagggagcttcgtctctggcgcgttggaatccggtgctgcttcagcagcgtgtttctgacttagaggcggcgaatgctgatatggcccgacagtattctgttcttgaagaaaaacattctcaaagccaggctgaactggtccggcggtgctctgatcttgaggaaaagtattcccaaagccagactgggctggcccaggtttctgctgctctgaatgatgctaacatgctaaattctactctccgcgctcagctcgattatgaaaaggaagaaaaatgtgcccttgttacttctcgtgacaatcttgataggctatatcgtgactccagcaactcgttgaccatcctggagaggagtcatcgcttcaccatggaggagttagacaatcatcgttataagctgcaggaatccatggacgacgtgattcgcctcaggcagttgaaatcggctaaagatgatgtcatcaaggaactacgtgcttccaagaagtccatcgcccaggagctggagaccgctcagttggctgtcaaggttgctgaagaaacttccgctactctgagggcccagcgcaacagagctatggataaagccattcgcgcagggcggatcttgatgaggagacctggtgtggttgtccccgacgacataagggctgatgtgaacgctactcctgattcctcaagttgctcttcttcgtcggttgctcctgagaagaatgttgcaaaatagaaaaacattgcgtgctttgagcgcgcggttaacgtgctcggatattttgttagaggacgcccgcttaatattgaatgctactattattcccaaaaaaaaaaaaaaaaagcagtatctaaatttgcagaagtaaaatgttgtgtgatgatttcgagacttcttcatgggacatagaggtggcccctagatgagtaaccgtatgcgcgccgagtgtgctgcgccagtttaag

SEQ ID NO: 7958 - DNA, 1126 bp, Zea mays
gaattttaacaccaaatcgagttgaccggcggaaggaagagttggcctccaccgtcaagtcaccaaccacccagagactcaccagtcaccaccccaggccagccgccacgtttagccgggctaaacaaacacgggcgcacaatcggaactcgctgcactgcttggaatccaacgagccaatcattcaaatcctccccggaaccgcgttgagcagggcacggtcgattggatctagggtgagggtccgtcgccgaagaaactcgcaggcggtcacgaggaggcggcgggggagggcggaggagatggcctcggaggagatgacggcgacggaggtggctgcgctgctggacttgaagccgcacccggagggcggcttctacaccgagaccttccgcgacggctccatcacgctcaccacgtcccagctcccgccccactacaaggtaaaccgtgctgttagcaccgcaatctatttcctacttcccgcagggagtgtttcccgtctccaccgcattccctgtgctgaaacctggcacttctacaagggagagcctctcacggtcttcgagcttcacgacgacggtcacattgaccttactgtcattggcccacaccttgaggcaggccagcgcccccagtataccgtgccaccgaacgtgtggtttgggtcgttccccacactagacgtcgagtcgttcgcatctgatggcagcgttcttgtcaagtctcggaagagggaccctgagctgcattactcccttgttggctgcacctgtgcccctggcttccagtacgaggattttgaaatggccaaatttgaggacgtgagatccatcgctcccaaggctgaacctttcctcaagtttcttattccctctaccgattaactccagagcagcctcagatgattgtggatgggttctcagcgactttctatactgcatactgtacggatggtgtttctagtgtgattccatgagagttctgctttcacgacagtgtagacagtaaactgtacctttgtggtggcaccggttgaaacgtttggtgcattgaaacagaataacagctgggtcttgatgttgaaaaaaaaaaaaaaaaaaaagtcgacgcggccgcgaattcg

SEQ ID NO: 7959 - DNA, 2142 bp, Zea mays
ggaaccactgcaaattttaagaatactgaacatttgccatcagtttggaaaatatttattgcttctctgttctgccctatattatacgatttgctgcagacaacctaaatgtgtagttggtgattttatttgcggggcatttggagccattcattttagaggaattaaaatttacttaataaagtaacagatttggcttgggatttgacattccaccactttctaaagttcagatattaagtccatcttaaattcatgaggtaaaggatgagaaatgattttatgcattagtagaaatgtagcacgtaaatatcgctggcatcttactaataatagtatacaaatatattttgcataaaattgtattagcttaattgatacgtgtgtaaattactatattattggaatggaattcaattctaaggatccaaacggggcttattagtgtatttctgagtggttggatcttttctatggagacaagttattgttccactaatatctgtgaccactaatttgaatttttgagtgcaatgctagacaacgaatgagtactaaactagatcatacatggatatgaagtcaagctgatattatctctctaatatccccttaatgtatgctgcagtagctgcggtaatcttcgtgctggtagcaccgacaatctgtttcctacttcccgcagggagtgtttcccgtctccaccgcattccctgtgctgaaacctggcacttctacaagggagagcctctcacggttagcatcacttcttgcttattctccatgcctaaagcaattagacaactactccctccgtttttttttatttgtcgtatttcagttttgaaatgaaatagcgggcgacaaatattcgagaacggagataatagttggcaatgcttgatccacgtgctggctacttctacaagggagagcctctcacggtcttcgagcttcacgacgacggtcacattgaccttactgtcattggcccacaccttgaggcaggccagcgcccccagtataccgtgccaccgaacgtgtggtttgggtcgttccccacactagacgtcgagtcgttcgcatctgatggcagcgttcttgtcaagtctcggaagagggaccctgagctgcattactcccttgttggctgcacctgtgcccctggcttccagtacgaggattttgaaatggccaaatttgaggacgtgagatccatcgctcccaaggctgaacctttcctcaagtttcttattccctctaccgattaactccagagcagcctcagatgattgtggatgggttctcagcgactttctatactgcatactgtacggatggtgtttctagtgtgattccatgagagttctgctttcacgacagtgtagacagtaaactgtacctttgtggtggcaccggttgaaacgtttggtgcattgaaacagaataacagctggtcttgatgttgaatagcaggtgcttttgcaaaaaaaaaaaaaaaaactaggatgctgggagcataggaggatctgataaggtttcacgtgattaaattcaaccgttcatggctctcgatcgtgcagagcttctcccgctgcaaagagtaagcctgcaaggcagaagccaagcgagtcgtgcttgtccaatccgtttttttcatgttctgcttctgctgcttgtcattctcacttgcacggtgcgatgatacggaggtcagattgtggcccaagcgcccaggtctgctgtaaaagacggcccagatgttgggctaccggctgacaggcagcattgattgggcgccctcgctactcgcggacatgactcagattattcgagctttcggccttttgggccttggtaccgtagttgatttgcacgcattacccagttcttccaaggaacggcaacagacctgggtgctgtttggttcaagaaatgtaacgcaaagggtaatggtaatggtttacattcgattactgtcggtaacaagtttgaatagtccggtatcaatttttagtatgatatctgattacggtgggactaaaacaaacatgatttaacgttattacttacccattacgttacaaatatctgaaccaaacggtcggttggttgagtaaaaatcagcttacgatcgcatta

SEQ ID NO: 7960 - DNA, 1564 bp, Zea mays
attagcacagactgaagcgcaactagaggatacagccatccattggtagtacacagggtcccacccacaagagaggcatggcggccacatcgtccctgaagagcagccttctcctcccgtctaccatctccgacttcagtggcgcacgcaggccgtctccatctcaacgcagcgccaccatggaatttgatttggcagaagaggagatcacggggggcgagggtgcaggtctcagcggctgcggactccaagaacattctggtcatgggggggactaggttcatcggggtcttcctgtccaggctccttgtcaaggagggccaccaggtcacattgttcaccaggggaaaggcacccataactcagcagctgccaggggagtccgacgcggagtacgcagacttctcctccaaggttctgcacttgaaaggtgacaggcaggacttcgaattcgtgaagacaagcttggctgccaatggatacgatgtggtttacgacatcaatggacgtgaggctgtgcaagttgagcccataattgaggccttgcctaacctgcaacagtacatctattgctcatcggcaggagtgtacctgaaatctgacattcttccgcactgtgaggttgacgcggtggaccccaagagccgtcacaagggcaagctggagacggagagcctgctgacctcgcgcggcgtgaactggacgtccatcaggcccgtgtacatctacggcccgctcaactacaaccccgtcgaggagtggtttttccaccgcctcaaggccggccgccccatccccatccccggcgccggcaaccagatcacgcagctcggccatgtcaaggatctggcaagagccttcaacctggtgctcgggaaccccaaggcgagcaagcagatcttcaacatctccggggccaagtatgtcaccttcgacggccttgcgcgggcatgcgcaaaggctggagggttccctgagccggagctcgtccactacaaccccaaggaattcgacttcggcaagaagaaggccttcccattcagagaccagcacttctttgcgtctgtggagaaggcgacgagcgaactcgggtggacgccggagtttgacctcgtccaggggctcaccaactcgtacaacctcgacttcggccgcggcacgttccggaaggaggcggacttcaccacagacgacatgatcctcgacaagaagcttgccaccgtttgatgcatgtctcgggctagctgtacgtacgtacgattagagaagagataaatgatagcaaatcaaaatttgttgttaagtaaagtgagctcttagcttctatcagggacgattattaaggatacccgaattattcctcccaagaacacactcagagaagtaaggtacctcttaggccgaggcttctcctcgagagtctcccaaaaaaaaaaaaactccgccccgccccgagctgatccccgacagataagataacagcgcctaaaaataggaaggaaaccctcgcatttaatgtatactagttgtgtgctcgtgcgttgcaacgggaacatataatacc

SEQ ID NO: 7961 - DNA, 1507 bp, Zea mays
atctctcgtcgtctttgtttgtatgttccattagcacagactgaagcgcaactagaggatacagccatccattggtagtacacagggtcccacccacaagagaggcatggcggccacatcgtccctgaagagcagccttctcctcccgtctaccatctccgacttcagtggcgcagccgcagccgtctccatctcaacgcagaagaggagatcacggggggcgagggtgcaggtctcagcggctgcggactccaagaacattctggtcatgggggggactaggttcatcggggtcttcctgtccaggctccttgtcaaggagggccaccaggtcacattgttcaccaggggaaaggcacccataactcagcagctgccaggggagtccgacgcggagtacgcagacttctcctccaaggttctgcacttgaaaggtgacaggcaggacttcgaattcgtgaagacaagcttggctgccaatggatacgatgtggtttacgacatcaatggacgtgaggctgtgcaagttgagcccataattgaggccttgcctaacctgcaacagtacatctattgctcatcggcaggagtgtacctgaaatctgacattcttccgcactgtgaggttgacgcggtggaccccaagagccgtcacaagggcaagctggagacggagagcctgctgacctcgcgcggcgtgaactggacgtccatcaggcccgtgtacatctacggcccgctcaactacaaccccgtcgaggagtggtttttccaccgcctcaaggccggccgccccatccccatccccggcgccggcaaccagatcacgcagctcggccatgtcaaggatctggcaagagccttcaacctggtgctcgggaaccccaaggcgagcaagcagatcttcaacatctccggggccaagtatgtcaccttcgacggccttgcgcgggcaggcccgccggctggagggttccctgagccggagctcgtccactacaactcccaaggaattcgacttcggcaagaagaaggccttcccattcagagaccagcacttctttgcgtctgtggagaaggcgacgagcgaactcgggtggacgccggagtttgacctcgtccaggggctcaccaactcgtacaacctcgacttcggccgcggcacgttccggaaggaggcggacttcaccacagacgacatgatcctcgacaagaagcttgccaccgtttgatgcatgtctcggcctagctgtacgtacgtacgttgctgagcggataaactatgtaggaatatgttgagcgggccggtgacgcgattagagaagggataaatgataccaaatcaaaatttgttgttaagtgagctctgcgcttcgctccgggacgatgattaaggccttgttcgtttgtatcggattagtgggtcggaacgattcctatagccgaattgcttctctaatttatataaattttgattagctggaaaaaaaaaaaaaaaaaagcggcc

SEQ ID NO: 7962 - DNA, 1562 bp, Zea mays
ggccgggccgggaggggcacctccaggcgacggaatcccacctgctctgctcctcagccccagcccaggccttcgctctcgctgccctgagccctccgcgttccccgcccgccacgcgatgccggcgtgggccgaagcggcgctcgtgctcgcctcaccatcccccgccaccgcctcctcgaccacgtcatcatgtggcgccaggccgcgcgccgccgtggggtccgtcaggctcttctgcaagggattcccttgtagcattcgttccaaagctggattccagattcataattaccgtacaaggatgtttaagattaaagcaaaagcagaatctggtgatggctacacacggcttgctccacttagatttgaatctccaagtggccagcttctgattcaaatactacaatcacaccctcatcttatccctgcaacagttgatcagcaacttgaaaatcttcaatcagagaaatctgcccaaagtgaagaagcctcaaaagttccccaggacctcctctacaagagaattgcagaagtcaaagagaaggaaaggcaaaatgccttagaagagattatctactgttgggttacatataggttcatggaaaatgacatatatatgacacctgcattatcaccagggggtggccctgtacgtgacatatccgcattgcctaatcaagaagacaaattgcgaaacatacactccgcagacgcctttgagatgatacaaaaccatctcaatcttatcatgggagaaaagatagcatcaccgcccgatactgttgttgagatcagcaacttgaatcttggaaagctgtatgcagcatccatcatgtatggttactttctgaagagagtggatgagcgattccaacttgagaaaactatgaagactctcccaccaaagcccaaccagcagatagtatttgaaaacctacagcctaatccattctgggatatggagtccttagtacagattacacctgatggggaggagataagtttggacgatgaaaaatcaaatccaaacaagttgaggtcttatgtctcacaactggatgctgacacattgcaaagatatgctactatcagatcgaaggaagccgtctcactgatcgagaagcaaactcaggcgttgtttggacggccagacatcaaagtattggacgatggttcggtcaatgcaaaggatggcagaatgataacaatcacatttacagagctcaatcatctggtcttggaggcagttgctttcggttccttcctttgggaagctgagagttacgtagaatcaaaataccattttgtcaacagttgaatgtgccttttcttatttgaattttggaaatggtttgtgtacatgtgatagggtaggatccatatctgatctattttttcagtgtattcatggttcttgctcgctatcagtaacagccaaagcatcaccacccatgaaccatgcctgtaacaggtttgagatttttcatcaaaggaagcgggcctgatccatagtgtaatctaaaaaaaaaaaaaaaaaacccgaacagttgatgttttcc

SEQ ID NO: 7963 - DNA, 1152 bp, Zea mays
ccggcccggccatctcaagggccccgccggattttcttaaaaaaaaatctcaatcgcaacaacacaaaaaaggcccgcaatatcgattagcgagagtcgttcctccaccaaccaattcgcttctccgtcaacatcacttcatcgtcgacgcctccggcccaccaaccatgccggcggccatggcggctgcggcggcgcagaggctcctcgcggcgagcacgaaaatcattggcgttgggcgcaactacatagcccacgccaaggagctcggcaatccggtccccaaggagcccgtcctgttcctgaagccgacctcgtcgtttctccacgctggtgtggccaccgccgccgtcgagatcccggagccgctcgagtcgctacaccacgaggtcgagctcgccgtcgtcatctcccggcgcgggcgcgacgttcccgaggcgtccgccatggactttgttggaggttatgcacttgctttggacatgacagcaagggaccttcagtctgttgctaagtctgcaggccttccatggactttggctaaaggacaagacaccttcaccccaattagtgcagtagttccaaaatcagctgtcactaatcccgatgatctcgagctctggctgaaggtagatgatgaactaaggcagaaaggaccgacaagcgacatgctattcaagattccttttctgataagctatatcagttccatcatgacattaatggagggtgatgtgatactaacaggtactcctgagggtgtgggtcctgtccgagtaggtcagaagattacagctggtataactgacctaattgatgttgagttcgatgttcagaggcgcaatcggtcattttccacatgatgcaataagcaagaaagtaatggtgaatacaaagtgcagtactcgtcctcgaccttgaatcgcattactggacctggagccattgcagatagctcttgagccttaccttgatttaatttacctgggttttgagagactatctatgaatatgctaactcgttcgtaaagtatctttttgtcccaattttgattgatggagctttaagcttgcttttctgtatgcaataaaaaaacttatcacatttttctttcaaaaaaaaaaaaaaaaaactcgggggggggcccggta

SEQ ID NO: 7964 - DNA, 1162 bp, Zea mays
catcggcccccgcgacgcgcccggcccggagaagcaaaagcaaccaactttcttctccgtcacctgactcacacctccactcacctccggtccaccaacctctgccggccatggcggctgcggcggcgcagaagctcctcgaggcgagcacgaagatcatcggcgtcgggcgcaactacatcgcccacgccgaggagctcggcaacccgatccccaaggagcccgtactattcctgaagccgacctcgtcgttcctccacgctggcgtggccaccgccgccgtcgagatcccggagccgctcgaatcgctacaccacgaagtcgagctcgccgtcgtcatctcccggcgtgggcgtgacattcctgaagcgtccgccatggacttcgtcggaggctatgcacttgctttggacatgacagcaaggggccttcaatctgttgctaagtctgcaggccttccatggactttggctaaagggcaagacaccttcactccaattagtgcagtagttccaaaatcatctgtcactaatcccgacgatctcgagctatggctaaaggtagatgatgaactaaggcagaaaggatcgacaagtgacatgatattcaagatcccttttctgatcagctatatcagctccatcatgacattaatggagggtgatgtgatactaacaggtactcctgagggtgtgggtcctgtgcgagtaggtcagaagatcaaagctggtataactgacctaattgatgtcgagttcgatgttcagaggcgcaaccggtcattttccacatgattcaataagcaagaaagtaacggccaaccgcttgaagattgctgctcgtgtcacgcgttcctcttgggtattcattcttccttgcgttgcagcgagattgcttcggcccatgagatgcgagtttagcctgtgcccccgcatggcttaagcaaaatacctgctggccaatgtcgtatacttgtactggtgatatattactgtgtaaaatagaaaaaagttttgtttttcaggtttttataaaccgtatcaaataattccaggccacttgttagccgtctccctttacagccatctgtcttgtcaccttttgtgagaaggttccttgtcaataaacaaataattcccctaacatactccctctgttctgt

SEQ ID NO: 7965 - DNA, 511 bp, Zea mays
aaacaggtgctattagattagcgagagtcgttcctccaccaaccaattcgcttctctgtcaacttcacttcctcgtcgacgcctccggcccaccaaccatgccggcggctgcggcggcgcagaggctcctcgcggcgagcacgaaaatcatcggcgttgggcgcaactacatagcccactccaaggagctcggcaatccggtccccaaggagcccgtcctgttcctgaagccgacctcgtcgtttctccacgctggtgtggccaccgccgccgttgagatcccggagccgctcgagtcgctacaccacgaggtcgagctcgccgtcgtcatttcccggcgcctcctgtcgccgccgtccgccaccgcggccgctcggcgggccgcgccagttgccgctgaggctgtttccagcgggggtggcgtcctcctacctaggggtggtgtcgccggggtagcggccaacggatggagtggtagcggcccagggctccgcttggctcgaaggctctg

SEQ ID NO: 7966 - DNA, 1406 bp, Zea mays
gggtaccctcgtaggccggccggagaccggcaatctcgatggccgggcggggttcctccaccacaccaaccaattcgcttctccgtcaacttcacttcctcgtcgacgcctccgtcccaccaaccatgccggcggccatggcggctgcggcggcgcagaggctcctcgcggcgagcacgaaaatcatcggcgttgggcgcaactacatagcccacgccaaggagctcggcaatccggtccccaaggagcccgtcctgttcctgaagccgacctcgtcgtttctccacgctggtgtggccaccgccgccgtcgagatcccggagccgctcgagtcgctacaccacgaggtcgagctcgccgtcgtcatctcccggcgcgggcgcgacgttcccgaggcgtccgccatggactttgttggaggttatgcacttgctttggacatgacagcaagggaccttcagtctgttgctaagtctgcaggccttccatggactttggctaaaggacaagacaccttcaccccaattagtgcagtagttccaaaatcagctgtcactaatcccgatgatctcgagctctggctgaaggtagatgatgaactaaggcagaaaggaccgacaagcgacatgctattcaagattccttttctgataagctatatcagttccatcatgacattaatggagggtgatgtgatactaacaggtactcctgagggtgtgggtcctgtccgagtaggtcagaagattacagctggtataactgacctaattgatgttgagttcgatgttcagaggcgcaatcggtcattttccacatgatgcaataagcaagaaagtaatggtgaatacaaagtgcagtactcgtcctcgaccttgaatcgcattactggacctggagccattgcagatagctcttgagccttaccttgatttaatttacctgggttttgagagactatctatgaatatgctaactcgttcgtaaactagcgtcttgtcccagcttccgagtggtggtgctttacggccgatctatgtaacgtacgcgcataagaaatggtgtcctacaaaatgccttccacttgcttgaaacgatatgtagatggacagcgacgacgaacaccttaactccctctcgctagatatcgagccagcttagttcggttcgactgagcttgagctgactcgttaaggtaaagagatgacttggttcgttaaacaattgagtcagagaattagcttggctcgtttgcaagtttgggctggctcgtttacctcgcgagtaaaaaaatacatgtatatataaaatagtatagtcaattgctagttaattttatacaaatttaacattagaaaagagtaattatactcataatttcatatatattacatcttttaaaccct

SEQ ID NO: 7967 - DNA, 2594 bp, Zea mays
  misc_feature (2316)..(2316): n is a, c, g, or t
ccattcacacgccatatgcatgattaacttgctcgagattattctttgaactggtggttagagtaccaacttgttgcaacattttatagcgaaaaccgccagctgaggtgatttggcatatcctacggtagggaaacaaatttttatatatatacatctctgaactgtccactccatagtacttcaaaataactccaacgaccatgtaaatctctcttacgtatgagctgcactgcaacctacgcgtgcttgacttgcttggtagtcgaccagcaattattgtaagggattggccctcatcgcactgctgtctccggcccaatgatttaggcttctcatcaatggattctctgtatgaccattgacaaattccaaaccgtggcatgtatagcctccgccaaagaacccttctccttctgcttgtataaagctacctatagcagaagaggctgatcggctgagctcatcgcacaaaagatatataagaaccaccaattggtaaccacaagcaagcaatatatagagagtcaaccttgcagcggcgatgaaggttcgcgtttaatttttcttgatccctccatcgaatcctcttcctctatggacttctcactgttttttctgcatctcatcgtcagatagtgcttaaggtggcgatcacctgccagaagtgcaaaacctgcgtccttgggatcacctcgaaagttaatggtaagccatggccaatctttatttctgtgttgccattcaagggtgttcgatgtctggctgatcgacatgctagctgtgtgatgaattctgaatgataacggtgcctgctacagggatcaagtccctgacatacgacgacgagaagagcactcttacggtggtcggagacgtggacgtggtggtcatcgtggacgcgctgcgcaaggcgaagcatccggcggaggtggtgtcggtgaccgacgagaagaaggaggccgaggagaagaagaagaaggaggaggaagagaagaagaagaaggaaaaagaggaagaggagaagaagaaaaggtgctgccccaagccgccgtgcaagccgtgccctccgcctccttgcagtccgtgccctccgcctccttgcacgccgtgccctcctccgccgtgccctctgccaccgtgcccaccgccgtacctcaagccgtgctacatccccatcgaagacgagtatcccgggccctgcaccatcgtctgagactgagagagcaacaccgtggccatccataccagttcctcgctgatggaaaagccaccacgcgctcttccagaagaaggcatttgagtttcagctgtagcgccatgcgtcaatcatcggtttggaagaaatggtttccaattttccatgcacattctctttccgtccttctcgttctatggttctagcgtgctctttctccatctaccatattattgtaaattgataggtgtctgaataatatgatataacagacacgttcaggtacataccatgtgtatagctctggaataagcttcccatcgaactccaagcatccaaagttgtttatgttacatttataggatctagcttttcaccattaatcgttagaacacatagatcaagctctattgccttcgatcatagatacgctaaaatccacgtgtccgcgtgattgcgggcttcgtccttgagccgtagatgtacaatgggtctgaggcttcggacaactacaccaaggccggtggtggcagcagtaagggtgcagaggcgatagcctttaccttactaactgtggataggatcttgtttaggtttatagggtcgaggaggtagtaccgaacattgatttgtgtgttacctcgtccccgttttatgtatgcactataaagggggtccgcaaccagcggtcgcgcttcctgattatgacgtgaaagatagagtcaggcttggttagttgattgagaccaacttgaaattaacccaagattctctcccattgatctcatgcttattcacttatacttagaactcaatttcttaattgctttatttttagcttacaatttctactccttagattagtacatcaagatcaaagctttacaacaactagttacatgccagtgaactaaatgactaatgcactttcctacatcaaagcagagaaattatttttgaggaagatggctgcatcatgactccttaatctagaaccataggtacttcatcaaacctatggctaggtattttctaaacatgttgggtgaaagtcctttagtgagctgatttgcaagtatttgctctaactttgtataattaaatacaattgtttgatnttaatgtttcttctttataaattaatacttgatgccaatatgttttgcagtagcacttgacttgttataggactaaaatattttcgatgtattatcatagtatatcttcactagttttgttatgttgtctaccatttttaaactagatatgaactttttaagccacaaccttcctcgttgcctcatgacatgcaaaaaaacttaacatacattgtcattgatcgatgtagtgatagtttgttttgagattttcccatgatatagatcctcgtgtgagg

SEQ ID NO: 7968 - DNA, 1475 bp, Zea mays
atagtacttcaaaataactccaacgaccatgtaaatctctcttacgtatgagctgcactgcaacctacgcgtgcttgacttgcttggtagtcgaccagcaattattgtaagggattggccctcatcgcactgctgtctccggcccaatgatttagcttctcatcaatggattctctgtatgaccattgacaacttccaaaccgtggcatgtatagcctccgccaaagaacccttctccttctgcttgtataaagctacctatagcagaagaggctgatcggctgagctcatcgcacagaagatataaaagaaccaccaattggtaaccacaagcaagcaatatatacagagtcaaccttgcagcggcgatgaagatagtgcttaaggtggcgatcacctgcaagaagtgcaaaacctgcgtccttgggatcacctcgaaagttaatgggatcaagtccctgacatacgacgacgagaagagcactcttacggtggtcggagacgtggacgtggtggtcatcgtggacgcgctgcgcaaggcgaagcatccggcggaggtggtgtcggtgaccgacgagaagaaggaggccgaggagaagaagaagaaggaggaggaagagaagaagaagaaggaaaaagaggaagaggagaagaagaaaaggtgctgccccaagccgccgtgcaagccgtgccctccgcctccttgcagtccgtgccctccgcctccttgcacgccgtgccctcctccgccgtgcactctgccaccgtgcccaccgccgtacctcaagccgtgctacatccccatcgaagacgagtatcccgggccctgcaccatcgtctgagactgagagagcaacaccatggccatccataccagttcctcgctgatggaaaagccaccacgcgctcttccagaagaaggcatttgagtttcagctgtagcgccatgcgtcaatcatcggtttggaagaaatggtttccaattttccatgcacattctctttccgtccttctcgttctatggttctagcgtgctctttctccatctaccatattattgtaaattgataggtgtctgaataatatgatataacagacacgttcaggtgcataccatgtgtatagctctgggacaagcttcccatcggactccaagcatccaaagttgtttatgttacatttataggatctagcttttcaccattaatcgttagaacacatagatcaagctttattgccttcgatcatagattcgtccttgagccatagatgtacaatgggcctgaggcttgggacaactacaccaaggccggtggtggcagcattaagggtgcagaggcgatagcctttaccttactaactgtggataggatcttgtttaggtttatagggtcgaggaggtagtaccgaacattgatttgtgtgttacctcgtccccgttttatgtatgcactataaagggggtccgcaaccag

SEQ ID NO: 7969 - DNA, 1824 bp, Zea mays
tacttagtagcactaggcagctgaccaagttgtccggtgctatttgcacgtcgcatggtagataatattttgtataccattaaggcattaataacttgtagcgttacggatctcgatccaactgaaatcaatcactaccgtacgaaccatgactgtttcttcctcgagtaccaacaaaccatgcagagatcgaggttcgctgaacagtagctagtgcatatgagtaaatctcaaggaacgtaacgtcgtcgtcaacttgtgcatgtcaactcgcaacatgttgcaagatgcgttgggtgaagtctcaaatgcactatatttcttataatatgaactagctagggctcctaaatgctaaataaaggtcgaccgatccatctgcaagctcggtgcctatatatggggcccccgaggccccccggcccgcgtccatgtcatgacgatactgcaggctccaattgtcagctgaactgtgtttgcccatcttcattatacattctgtctcaaatctacttgtcgacatagactcaataagcttgcttattagtacgtccaagaacgacgtacatggcttcagctgctgcggctagcagcgctgttaaggaggccttggtcgtcgtcgccgtgtgcatcgtgctgctgctccactcttcggcgggacatcagccgcccaagtcgccgcctccaccgcattgccattacacggggcagcagccaccgccctcgccggtgccagcgtcgttgtactcgccgccgccgccaccaccagtaccagcgcccatgccgtcgccgtcgccgccgccaccgccaccgccagtacaagcgcccatgccgccgccgccgccgccggcaccaacgccgacacctgcgccaacgcccacgccgtcgccgtcgccggcacccgtcaataactgcagctacatgtactgcgccatgcaatgtagcccggtctgccaagccaaccacgacgccggcatcgccaagtgcgaaagcgacctcgccaccaactacaacgggtgctacgacagctgcaccagccatgtctgccccggcgactcctgcgccggcagtggctgcggcttcggccactgcccctgcgacaacgccaacgcgaccagctgctgccaatcctgcggcaacgttctgtaccgcgaggagcagcgctgccggaattactacgacagggctgtggagtactgcatgatcgactgccaggacacctgctacaagaactgcactcagggcgcgtagagctcttgcttggtcttgtcatctcagttagtctgaatgtttctgtatgttcatgacgtttctacgatcgatcaaataaaacaaggtgatgagcattgagctctagatccgtttactgctaggtgctagctcttgtgtatggttgtatgaaaacaaggtgatgagcatgcgctgtcgtgtatgaaaaagattagatcgatcgttatggtaggacgataattaatataatatagaagtcttcggctatttttaatggttgctcaagatccaagtcgctaatgaagtatgaacccgtgtgtagatacaaaggacccctggctcttctgattttgaggtcacattaactatagcgcatgtggtggcgcggccctagctagctagctccattgggttgagtacaaaaccttccaattgtgcagcatcttcatcttatatggttcttcaacgggttgggcataggccatagatttgtgttatgataatcagagtagggtaggatcttatatggatcttcaatgcacaggggctccgaaggcttgtactacttgatgctcatgggtttagggtttaggg

SEQ ID NO: 7970 - DNA, 368 bp, Zea mays
atccgtgacacgtccagcagctccatcgagttcgaggactagccgccgccgccgcacctgcacggacgccaagggacggcggcggcggcggcggcgccagacgctgctgacagacagtagcaagacgacgatgcgtagcccttttttttctagtaccattgtaccattcaattcgttgtaaatacgtagtatagcaggtaggtaggccttgcagccggggtgggtgggttctgaaatctgttgcaccctgtcctgaaccccatgcagtgtgtaaaaagtagaacgctgtgtatgtaagctgttcaagttcgtctcagcttctatctcaggccctgtttgaattacaaggactaaaaaaaaaaaaaaaa

SEQ ID NO: 7971 - DNA, 1687 bp, Zea mays
gcacgaggcgtttctttaccctaacctttccacggcccctccggcgggactgagcctccgccatttcttcatctccaatctccatccttccatcttccgctccctcccctgcttgcgctcggcacgcaggcgacctcggcggcgctcgggctcggcctctcagcgacggcgtcagcagattcccctcctgcctctcgccagtcccctcgcctctggtcctctgcgaaccggccggtgactctgcgaaactattccagcacaggtacccaagtatggcggcaagacgcaatgttcggtactcgcctcttccttcagaggacggggatgacagcaattttattaaagaagatgttgacctccgatacacttacactccgaaatcgtacagaaggatcccatggaagtcaattgccctggcattgttcctcctcctcctaggaacttcacttctctttctttcttacttcatattcacaggtcacatggagggtgatagttctcaggcatatggtctcttgttcctgggtttcctttcctttcttcctggtttctacgagactcgagttgcttactattcatggcggggagcaccagggtacacttttgcatccataccagattattagcctttcagtttgcgctgctgatgcagtaaggataatgaacaagcaaacaacttcaaactttccttgggaaccaattttagtgataaaagagttaagcatgcatatgtagtggctcaaatgattgttgtgtttataggatgttattgcttcgtcggtcagtaaaagaataattccttgtgatattgtgtaagagcaaaggttgattttgcaatttcttggtatttccttgtcaaatataacagaaattagtgccaccagtatgtgtttgtgtgatggtatctgttgatgaagatagactatgtactccatttggggctttggagtatgtatataatgtggctgcaccagaaccaagtccaagcccttttttaaggggggtggtgtgcatacttctgtcatgcttagattgttgtgtgcaatactggattgaagagaagggccagtaacggatcacgtagtctagaattcaaatgcaatatgtgctcagaatgtattcgttatgtatggattcgtcaggcatgaagtcctccgggtaggccagtaactcgattagaacttaaaatttgatattttagtagagtgtataatagagcacaataaaaaaaatttatgtgttgggacgaaggtgaacacgccctcctcgaacgaacatcccacaccagcatgttaaagaccgaaggtcgagccgcacaagcaaagtgcccaaggtcgacgcccacgcgaaggctccagcactatttttgtcgtggcgaaccggagtgaagaccattaaagacttcggagctcggacatcaagacttcgaagacgaccatatgttgtgatcttcctcattgtaaaaggggatccgtgtatagtccggcccatactgcagggtcctgcctttaggccaccgtgccgacagggttagtaaagggttggcccacgtctgtaattaaatacattgtaatgacccgtcataatccctcaaagagaatattccgaggataaactaggtaactgagggtctaattgtctttgacaaggccggacagtctctcggttacttataaatacccctgca

SEQ ID NO: 7972 - DNA, 4423 bp, Zea mays
cgcttctgtctctcttctgcccttctccaagaaaccggataatccatccatccatccatccgcgatccgccccgcccacccaaggaaggaacccgatcccgactcgccgcgggctcgatcccccgcgccgacggcgacgcgtggcaggcacggcaagcgcgccgcttcgccgacgtccgcgccgcctgggggcggaatgcgtcagctgtagaggacggccacggcacctttcagccttttcctcgtctgctcctcctctcgcccgggctcggtcggtcggtaacgactcctgctgtgctgtgctcgtgcagtcgtgctccagcctccggcagcgcctgctccgcaaacagttgcctctcctgtgtgtgctcaccaagggtcaaggggccagtccatccgcccgtccaggaaggaaatcgttcatccccagaagacaaagcgatccacttggataccggataagccctgtcctcgcgttgtcgattcccgcgacaggtcgcagtgaatgacgccagaaatcagcggcccttgaggcgaagacttccccccgccttcgctgctctccaccgatccgacgaaggcagcgctcgggcactgctgctggttccccttcgcccaattcggtctgacgcaggatctcagtttctgcggcggcggagtagtagggggcagacggtgattttctgattctctcaccttggctctgtggactaaatgtgacctgcaagagctaaaagtggcagcgattgacttccagatgagtccatttgtgctggcccgggtgagcgttgcattcctcagcttgcggttcctgcaggctcatggaagcgggttgcttctgagctgtggctcgaacagcactgtcgatgctgatgggcggagatggaccggcgacataacccctgaggggaattttaccttgagcagccctgggcttgcggcgtcactggtcgggaagagcagttctgatgagatattcggaccgctttacagctctgcccgtttcttcaacgcggcaacttggtataccattagtgtgctgccaggaagttactgtgtcaggttgcatttcttcccttcgaccttcgggaatttgagcgcaaacaactccgtgtttgatgtcacggcaaatgatttcaagcttgtttcaaaattcaatgcgtcagaggagattgcttggagagcctctgtgagcaattcggtcaccagtgcagttgtcaaggagtactttcttgtagtcggtgctcgtggcctgagcattgagtttgatccaagacctgggtcgtttgcctttgtgaatgcgattgaggtcatgctgaccccagataatttgttcaatgatacagtgagcaaagttggcagtgcaggcacgcagcttcctcttggtttgagcggcagaggtgttgagacaatgtaccggctgaacattggaggccctgcacttaaatcgcccagtgatcagtatctccacaggccatggtacactgacgaagcgttcatgttttctacaaatgctgctcagactgtgtctaatgcttctgccgcgctctagccggccggccgggatgcgtcaattgcgccgattgatgtttacgagaccgcaagaatcatgggcaacaacatggttgtggacaagcggtttaacgtgtcgtggcggttctatgtccacccaaactttgattacttagtccgccttcatttctgtgagcttgtctatgacaagcccagccagaggatcttcaagatctacatcaataacaagactgctgctgagagctacgatgtgtatgctagggctggggggattaacaaagcatatcatgaggacttctttgacaactcgacgcagcaggcagacacactttggcttcagctaggccctgactccatggccagcgcttcaggtgctgatgcacttctgaatggtgtggagatattcaagctcagcaaggattccgacctttcttatgtgcttggtcatattgacacgggcaaccagatggattcttcaaaaggggggaagattaaaggcctatgggaagaacttggtattggctcagcatcttttgttgcggttacaagcgttgttctgttctcatggtgttacataagaaagaaacgaaaagctgtcaacaaggaggcccctcccggctggcatccgttggttctccacgaggctatgaaaagcaccacagacgcccgtgcagccagtaaatcgtcatcggctcggaatgcctctcccattggtcataggatgggaagaaggttcggcattgcggagattagggctgccacgaagaacttcgatgagtccttagtcattggaacgggagggtttggaaaggtctacaaaggtgagattgacgagggcgctacagtggccatcaagcgcgctaacacattgtgtggccagggcctgaaagaattcgagacggagatcgagatgctttccaagcttcggcaccggcaccttgtggcgatgatcggctactgcgaagagcagaaggagatgattctggtctacgaatacatggcgaaggggacactgagaagccatctgtacgggagcagccttcctcctctgacatggaagcaacggatcgacgcgtgcattggcgcggcccgcggcctccactacctccacacaggagcggaccgaggcataatccaccgggacgtgaagaccaccaacattctgctggacgacagtttcgtcgccaagatagccgacttcgggctgtcaagaaccggaccaacgctggaccaaacccatgtcagcaccgcggtgaggggaagcttcggatacctagaccccgagtacttccggaggcagcagctgacgcagaagtccgacgtgtactcgttcggagtggtgctcttcgaagttgcctgcgcgaggccagtgatagaccccacgttgcccaaggaccagatcaacctggcggagtgggcgatgaggtggcagcggcagcggtcgctggaggcgatcctggaccctcgcctggacggcgacttctcgcccgagtccctgaagaagttcggcgagatcgcggagaaatgcctcgccgacgacggcaggagcaggccgtccatgggcgaggtcctgtggcacctcgagtacgtgctgcagctccacgaagcttacaggcggaatgtggtggagtccgaatcgttcgggagcggcgagctggggttcgctgatatatcatcatccttcttcagccttccccacgtcatcagggagggggaggaggaacaccaccaccgctcgaagaagccgtcaagtatcagagaggaactagacacacgtgagaacttctgacttcagcaaaacaaaaacaaaaaaaaatcttgctttgtagccatgatcatgatgtaaagttgtgttacatcgttctctttaggtttttttttttttttgcttcttattccattggggcgttctcttgcttgacaagagtagcataatagatttttttttcttctccttgtgtgtgtagattaccaaccccctcatccctcccaacagaaagaagacacagaggtgtcaagagtttccttgacaactgtatgatgcaatctgcatggccaccgttcatgcgccgcggcctgtgtgacctgtataaatggcactgatataattactgcctttgaggttttgatgtagcaaacgggattgagaaaggtggtatggtagtgcagctcgagaatgtgtggtactctgttttgcgcgcgctacggaacggtatgtgtgcgagacatctgttttgcagtgaagtgaaccccggagcgaacaactgacactagcagcggctgagacatctattttgacgattcgatccgtggctggtgcctgccgacagccaacaggtgtgtgaaaggccgcggcgactttaaccgtgcatctgcttccgacggtccaccaggctgaccgcggctgctctgcgtcgcgcacctgacactgacatgccgctgccggtgcccagtcgcctgccgccgccgccagctgcttgcatagctgcatgcgtaataataaaccagggcaagtcgaaatggtgagttcaaaaggcggcagcgtcgtacgtacacgcacgagtgtcagaaaatgcgggagttctccggtcaatgaaatcttctttcttttccaacacaaatatgccccccctagctgcacctcaaaaacaaatgacttcaacaaatgtggcacgtgtttccagtttcagcacggttggaccgtacgggtcaatctgacggtacgggcgggcccgtttcgcttaaatgctgttcaaagataaaaccttataccctatctctactactttatatgaaggtattgtagacgtgcacagtaccgtgttctgccgcgaccgtcctgtcctcccacccgcccgcaatcagcgctccgtcgacaccgcgccgccac

SEQ ID NO: 7973 - DNA, 4532 bp, Zea mays
ttgtgcctatgtaattgtagttagcgtggcaagtgaggttgggtaggaagtaggattcaatgtgcctattagtctttagaggtaaaagaggatttttagggatccatgggtcactactcagtactcaccatgaatgggccattgatgctccatttcagagtatgttttgattgaagtggatagaatcagatgtttagtgttaatgtgaagattaagtggccacagaatgatatttctctatcaagaacaacttggctagtaatctaccatttagttaggcatcattttgattgctactgatatggcctaagtgatacattttcacaatataatgaaaggtgccctgtctttatcttttcttttgtacaagtcgagtctttatctttatccagtatgtgatcttcaacacttccaaaggaatatatttagtttagtgtgattcgagagctagcatcatctcatgctgagcgtcatgcaatatgttgcttttgttccgaaatagtcaactattgtttaatagtacacttttgcaagattacatttcccactttagtaatttctgtttttgcagtatgggagtaatgtttccaatagtcttgcactctcccttcattgatattttcatgttgccgttgcacaacctcccttttgtatgcctgagaatatctggtagggtattgttattgaagactgccaaccagcgatttctcatttctataccgttttcccttttctggatgtgttttaacatttttatgatgcaaccttttatttgttctcatatataacatcgccatgtctgacatgctgcgtcttacttcaaacccagagggatacaactggtctaactgctgaaaatagggagctcaagcttcggctgcagtccatggaagagcaggctaaactgcgcgacggtatgatctgctctttcctctgaaacattttggttcacctggctgccatcatcgattgctcttaaagcacaaaatttcactgccaaggtctctcgttttacagacgaatttatttatctgttactaaatgaaatagaaagttctaatgagctcacgggaacatttcatttgctacctcacctcacacagctttgaacgaaaccctgcgggaagaagtgcagcgacttaagatagctgcaggacaagtcgggaacatgaacgggaaccccttcaatggtggactccagcagcagattccatcctacttcgtgcagcagcagcagatgtcgtactttggtggccaccaggctcaggctcagcatcacagtcaaaaccatcatcaccggagtccatcaaacgggagacagtcgcccagtgatcagtccctaaacgactccatggatttcgtttgaggacaatataccggggcaagtattacatcgtataccaactgcagttcagcaccgtaaagatagctagtgtacaatgcatgcatatgcctcattggtagtgtagtttagttctttgtatcgttaatctggaagtggctccagtatgtcaaaatggtgttttattttcttctttcctgggttgtggagtaatgtgttagacagaactagccacctttagcaatttatgtaaatcttgttagcctttcttttctccatggtggaaggttcttgttatctgtcattgttttgtgcccctttcactgtctcgggtttctaagttactattagacctgagcatggccgctcgatccggtctaacggatggccggatgggtatgagcactgttataatttatgactcgtaataattcacatagcaatgattttttacctaaaacctgttccaacctgaaaaatatctaacctaaagtaaaaaaaaactgaaccaaatttacacatttaacaaggagacacgtgccaacttaactcgacaccacgggttaaacatagatcataccaaacaaccaataaccgacccatacctacggttgaataggtctagttactatgcaagtagcatgagactagttactatgcaagtagcatgagatacagttaatcaagtactaccaaagtgtctgtacactgcggttttcatttgtaaatatagaatataaaacataaaaaaaagcatgtatgttttattggataggtggtgtaaacgtagacttggaatcgacaactacggttcaaatctccatttatgcaaatagtgccaaaaaagacacgatggcccacatagtccaacactcgaatcgcaaacggaagtgtttttcatttttctttttgtatataatcaaacagcatactggtgtttttttcttaaacaccagtgagttttcttaaacgccctttttgagatgatactttcaccgtccaggcaggttggtggctggtctctccgtcatttcacaaatcagaaacagcatactggttttgaggaacagcgggctcctttttctatcagtaacgtgctttgtggcacgccattatattgaggagggcacttgttttccaacaaaaggtgcatgctctgtctactaatttcttttcatcgcattagctagtcatgttgttgcaggatcacaagttaggctggcaaagcagtaggaagtaggaaccaaaggctatgaatttcactgtctttcaccttcagagctcattatactcctgctgttttctacgtcaactgcttcaatactttgcatctttaatcacctgtccttagattaatgatacatatatcataggggtgccagatcgctgcattctattattccttcaggtattcttttggggctttcttgtttcggaaattgattggaagtgtggtacgtagactcgttccacaaggtgagaggggctgagctggacctataaggactcgaatccggctacgttgacagaagctctagcagcactcctacatggtgcatcctgcatttcccctcaagaactctatgttttccactaaacattttctgccagtagcattttggcaagtgcttgaagaaccataccaagtcatgtttttaatatgggattctacaaaattgtccgcatttgtgggagacttgtctcggtttatcacttctccagatcccactcatgtgggagctttttttgttgaaacttgacctattcaagccggcttatagttggcccaattaatataagaaagccaaagtaatgtgcagagatggtatgagaacccttagtctcgcattactcatctacatatatacgaggatgtactcttcacatgagacacacaaagggctatcgaagctactataaacctaccacatgtgcttgctcgcgatcgcgtcactactgaattcttctaattatttgattctatgatcatcatgttggtgcctctgccctaggagaaccaaacaactaggtttgtatatcatataaatttgtttcattatgctgattccatgactttcaaccagaatcattggtctggtggaatcattggtccaggtctgcatctatgatttatcacgttgcctaaaataatgtttcgcttctttctctggtaacattaggatgacaccaaggtctccatcggccggccttgactcatttgatgtcattgctggtatagagtatttcatacgcatggtaaacaatcaaaccacatactatacatggtcatggacgctgcagtcgtaaacttcttttctcggtttcaagataattactgccgtgctctacaaattacggtaccatgaaagtccttgttatcgatattattactttttttcttaagaattctactggtctataagcttttatcgtggatttcctcctggtttggttcattcatgcatgactgcagcgacagttgcggcaagcttcttcccttctccactgacaaaacaaattatatgccctaagctgccaataatgttttgctataaaagaataaaaacttcactttccaactgtttatgtttgtgttatcgtactttggtatccctagtattagcttcatcgacaatcccctgtataccatcggattttatactcacctcttatgtgttattgaatggcatataggggatgcttttttgtgtgtatgacatttgagtccaatggcacacaaaaaattagtataattttcgataggggatggtcgacgaagctaatacttggtgatgaacaatgcatgggagtactgacacagggctaatcacaaggcacccccttgttgacgccttggatgacacctcaccttgtcctctaacgccatccgtttttctgccactcggcaagtgagagcaagaaactgttcttttatcgttccagtttacagtgagcactgacgatttgtggtttttacatctgggcctcttcattcgatcttactctgcttacaataatctcagcatgtaaattacattgcagtagggttttcagtctttctggagccaactgcatgcaagtgaaaattgccagagagctagagaaaagttgcagtgcagattgatgcgagaaacgagaggtggcctggggccttggaccccagaacatctcagtggcccacatatgttct

SEQ ID NO: 7974 - DNA, 3401 bp, Zea mays
  misc_feature (2323)..(2323): n is a, c, g, or t
  misc_feature (2642)..(2642): n is a, c, g, or t
gctaaaaaatagctagtataattagctagctaacaaatagctaactaactattagctaatttactaaaaatagctaatagctgaattattagctagactgtttggatgcctttagctaattttagcaactaactattagctccagtgcattcaaacacccccttagtcatttcagtttacattcgtgcgcgcttccctgcagaacatggctgttcaggattgtttaggatagaagcaagtgcgacgaacggtactatatgcctaatcactgaccatttctaaatgaatgcacttgccagaaacaaagcacagatgcacggacgcaacccatgtctgaaaaaatatctcaatattgcaaaagcctattttatgtatggtcatttatacttgtgggcctagtatttgaatgtatcatattgttaggtgctgtttgaatatggaaataaattgtgactcgagtgtgcactggaatttgatctgtaatggaaagttagtaaggcatggtaaattggtttgctatttatatcttaagcatttattacctttgtggcatggcaaatgaagttggtaggattcaatgtatatatatctattagtctctagaggtaaaagggggtgcttatggaccaataggtcactacccatcatgaatgggccattgatgctccatttacagatagtgatttgattgaagtggatagaatcagatgtttagtgttaaggtgaagattaagtggccacagatagtagatatttctctatcaagaacaacttggctagtaatcaaccatttcgttaggcaactttttttattgctactgatagggcctatgtgatatagatacattttcacaatataatgaaaggtgtcctgcctttatcttttcttttgtataagtcccgtctgtatctttatccagtatgcgaccttcaacacttccataggaatatagttagtttatcgcgatttgtgagcaagcatgatctcaggctgagtgtcatgcaatatgttgtttttggtccgaaatagttaactattgtttaataatatacttttgcaggattaacatttctcactttaggagtttctgtttgtgcattatttgagtattgttttcaatagtattgcactcttgctttattgatattttcgtgttgctgttgcacatcctcccttttgtatgtctgagaatatttggtagggtattgttactgaagacttcaaaccaacgatctttatacccttttcctttttctggatatgttttaacattttacgatgcaaccttttatttgttctccatgtatatattatataacattgtcatgtctgacatactgtgttttacttcaaacccagagggatacaactggtttaactgccgaaaacagagagctcaagcttcggttgcagtccatggaagagcaagctaaactgcgggacggtatgctctgttcttccttcgaaaacatttatagttcttctggttgtcatcatcgattgctcttgaaacacaaaatttcaccgtgcaatttatttatctgttactaaggaaatatagcagttctaatttcgtcgaatttatttatctgttactaatgaaatagaacagttctaatttcccagttattcagggaatcagctcactgaaatatttcatttgttaccctcacacagctttgaatgaagccctgcgagaagaagtccagcgacttaagatagccgcaggacaagtcgggaacatgaatgggaaccccttcaatggtggactccagcagcagattccatcctatttcgtgcagcagcagcagcagcagcagacaccgtactttggtggccaccaggctcagcttcacaatcaaaatcaaaaccatcgtcaccagatctcgtcaaatgttgggcagacgctcagtggtcagtccctaaacgactccatggatttcatgtgaggagtacaatatcagggccagtattacatcgtataccgactgcagttcagcactgtaaaaaagatagctaaatgtacaatgtatgcatgtgcctcattggtagtgtgtagttagctcttctttgtatcattattctgaaaatggctcgtgtatgtcaaaatgatgtctcttttcttctttgctggtttctggagtaatgtgttagactgactagctacctttaacaatttatgtaaatctttagctttttttttaatggtggaaggttcttatacatacatacatacctgttaacttatttacagagtggagtttataagattttaccatttttttaacaacctaggaccgatgaaaaatgggtttacccaanaaataaggtcatgtttcaatctcacgagataaactttaactgtttttttagttacttttaatcatttggtgatctaaataggagaactaatgatggtgtaataaaatttagcatatattatcttataagctacttaaaaggtgctaaaagaagctaaatgtgggctagagaactccattttccacctatatcctccacccccattctctctccgcattaggggtatgagtgtctttttatttcaacgtgctaaactttattagagtagtccaaacacccaaggaactaaactttagcactttaattcatatgactaaantttagcaagaaggtaaagtttatcccgtgagattaaaacgagacctaagttattccaacctttttgagagttaaaacatcttaagtttagctaaatttgtataattatgatgctaagcaagtataattagattccttattgattatatttttatagtcataattttttgcatttttttaaaaaatgttaaacttaatatattttgattcttaaaaaaaagaattgtctcgacctctcaccgttgaggcagcaggttggtggctggtctctctcagtcatttgacaaatcagaaacagcatcccggacccggaggtcgacgggatgtgaatatgacgatgcatctttctcgttcgacacttctcacatctcacctttctgtaacgacagtagacctttattaacctttaatctggacaaaatatctatcctcacaaaaaaaaatgagtgcacaattattgcccgctttgttttctttataataaaaggacccccatcatgttgctattattttttcaccaaggtgggggcatatgctgtttgttcttcggttgctatcggtaacccacactcctttgactcacgttgctttattataagttctatttacgaaacaaaaccatagtggtgtttcgaataaggcttttatagcgatggaattttggatacaggattaccaatttaccaccccccatatgtaggagctagatgatgtctgatagggtttaggtgagaggtatcatttccatttgccagtcatg

SEQ ID NO: 7975 - DNA, 1692 bp, Zea mays
gcacgagaccattacctagaacatcctaatcgaaaaaatatagaaccctgttcccaccggcgctcactgcaccttccccagcggccaccacccgaggccggtccccgctgacccgcctccgtggaccggggacacgcggcggcgaccggcgaggcggtccctgcttcctctttctactcctcacaagtatgtatgacacgcaccacccgcaccgcacccacccaccaacccgaccttccgctgctctcacacacacacacacactctacacgcgagcgagaccacgcgccggaccgccgcaagccggtcgccgccgccgcgacctggagcttgcgagctagctctggcctcgctgcctgcgccgactgagatggacccgcggtttccgctgccggccgcggcggcgccgtccacgggcggcggcggcggcgccagagggcaccaccggcgggcccactcggagacgttcctcagcttccacgacgcggacctgctcctcgacccggacggcgacttcttctccgacctcgacttcccctccctctccgacgactctccggccgcctccgaccccaccccgccgccgcatccgcagcagcagccgccgcaggcttccccggccccacgtccgcccggcgggacccacacgcggagcctctccctcgacgccgccttcttcgagggcctcgcgtttcagggacccagtgggagcgccgggggtggaggtgggcccggccacaagaggagcggctcgatggatggggacacctcgccgttcgagggcgagtcggcgctctccagcggcctgccggactacgccaagaaggccatgcccgccgagaggatcgccgagctcgcgctcatcgaccccaagcgcgcaaagaggattctggcgaacaggcagtcggcagcgaggtcaaaggagaggaagatcatgtacactagtgaactggagaagaaggtccagactctgcaaacggaggccactacgctgtcagcacagctgaccctgctccagagggatacaactggtttaactgccgaaaacagagagctcaagcttcggttgcagtccatggaagagcaagctaaactgcgggacgctttgaatgaagccctgcgagaagaagtccagcgacttaagatagccgcaggacaagtcgggaacatgaatgggaaccccttcaatggtggactccagcagcagattccatcctatttcgtgcagcagcagcagatgccgtacttcggtggccaccaggctcagcatcacagtcaaaatcaaaaccatcgtcaccagatctcatcaaatgtggggcagacgctcagtggtcagtccctaaacgactccatggatttcatgtgaggagtacaatatcagggccagtactacatcgtataccgactgcagttcagcactgtaaagatagctaaatgtacaatgtatgcatgtgcctcattggtagtgtgtagttagctcttctttgtatcattattctgaaaatggctcgtgtatgtcaaaatgatgtctcttttctttgctggtttctggagtaatgtgttagactgactagctacctttaacaatttattatgtaaatctttagctttttttaatggtggaaggttcttcaaaaaaaaaaaatacctgttaacttatttacagagtggagtttataagattttaccatt

SEQ ID NO: 7976 - DNA, 3368 bp, Zea mays
ctgccgcagacccaaatcaacaatgtccatcagtagcagcatcagcccgaagacacccaccacagttacgaccagggttaccaaccgacaagaggaggtagggccccaaggggaaggggacgtgggtgagaaccacctcgcgaatacaagccttactgcatgtttcacaaaagctctagccattcaaccaaagactgttgagaatacaaagaggtgaaagaaaggatgaacgtagaaaaagggaaaagggactaccatgaacaaccatcaaaacgaccgaataaaacaagaaaaagcgatcggccaacaaagaaaccacgatcacccgctaaaacaaaacgaccaaataaaacgacctgaaaggcgacgcaacaagcatcacctattcatccagtgatgccaagatactttctacgtgcctactaatcgttggtatattgttctattcaaatgtggaatggtatgacgataaacccgtggtacatacatagtccatttgcctattcatgatggggcaccaccattctataatccttgatcctttgatcagatagtcatggccgagaaagatacaatcagaaacagcctttatgcattagagctctatgaatgatcaccctattggattgaaaagctggtgacttgcattgggattagtgtgtatgtttttggttcgtcaacctctatcaaaagacaggaggcatatgctgagcacacttttgggcagccggaccgtccgcccacataagtcgaaccatccacggtctggacagtccgtggtggtagcgtggaccgttcacgcatgcacaaaatcagttatggttccggatttcttgcgggatttgttagttcaacctgcgagattatctcgagaaccgacttgtaacgggtccagacctcccttttatatagataaagggctacaaccgattgaaccccccacaatcgatcccaatcaactctacttatcgtttttaccttatgcattagaagtaaccctagtttagccttcctccacctagaatcttcacatctcttcgtctctacttcgactagatacgtcttgggtggtctgccgacgccaagacacactctaagatctcttcttgccgacatggtccctcttgagagacgagatctaggtctgctgcgaaaaaaacgatcctctgcgccatcatggaccgtccgagccacagacgcggaccatccggacgtacgcagagaatgagtcgctgctgcggccagatcccgaaccgtccagtcatgtatcgtggaccatctgcatctctgcagagaggcggagagcgtcatcagatagttcatcctatgtttggtattcagatcgccccagcaaagtagaaggggaggggcatccagagatacccctcacacaatgccatgaaggccaccttgggatccttctcccaccgcgcatgtcatgccaactgccgccggcgccgcggtgttcggtcggtgtcccgcgtacgctttacagcatgtgcgccactgctccgtgcgcctcctgtggcaggccgtatgcgttgggccctgcatccacaaaaccgcagcaggaccccaaccgtcatccaactgacacgacacagcggcaccaaaaatacggcgcccgctccggcctcagtcacggaactcccgctggcatgtggacccagcggtcccggaggcccacgtgccatacagcaacgcaggctgatagggacaacgcagcaaggcattcttctctcgcggaaatgacaccgttacccctcgtggacttcagcttgcctggaccaagtccacgcgccgtgttgcctagggtggcgacccgaccttctcgacaagtcttgcgaccccagagccactggcccatgcaccgaggccacccaacctcccctcgttggccgtccacctcccgtccacagggccccgagattcccactttcccaccgcgctccttgcaccctccccaccacccgaggccggtccccgccgtccgtctgcctcgggatacgtgtcccggctgacccgcctccgtgaaccgagaccacgcggcggctaccggcgaggcgccctccccggctcccagcttcctccctctctctactcctcaagtcctgactcctggagtcctcacacgtatgagacgccccccacctgcacgaagccaccatcccgacattcgccgctctttctccacgcgccggtcgccgcagacgcaagcccgcccgccgcagctgacgccgcgatctgcgagggtgcaagctagctctggccccgctgccggtgccgactgagatggacccgcgcttcacgctgccggccgccattggcggcggcgccggtcgggtgcaccaccggcgggcccactcggagtcgttcctatgcttctccgacgcggacctgctcctcgacccggacggagacctctccttctccgacctcgacttcccctccctctccgacgactccccggccgcctccgacccaaccccgcccccgccgctgccgcagccggccccggccccccgcccggccggcggggcccacacgcggagcctctccctcgacgccgccttcttcgagggcctcgcgtttcagggacccagcgggagcgccgggggtgggcccgggcacaagaggagcggctccatggatggggccacctcaccgtttgagggcgagtcggcgctctccagcggcctgccggactacgccaagaaggccatgcccgcagagaggatcgccgagctcgcgctcatcgaccccaagcgcgcaaagaggtgggggaatatttttggcatttgatgctcgacccagagggagaatccttatccaaaataataatttagcgtgccaagcaagagtcctgggaatttagtaccgattgcttcaagtgataagggctgttgatctgtgctaagtttcgctgatggcgctgtcgtgtaggattctggcgaacaggcagtctgcagcgaggtcaaaggagaggaaggtcaagtacaccagtgaactggagaagaaggtccagactctgcagacggaggccactacgctgtcagcacagctcaccctgctccaggtatggggttatattttgtttcaaaatcagtttagttccaagagaattgttgtgcgaagaaattcatcaaatcagcctcatctttctgataggcccttgcttgctagtaacacatctatttctgtgtgggagcttggttcatgtttggttggactatggggtgtttgaatgcactagaactaatagttagctgctaaaattagctaagacatccaaacagtctagctaatagttcagatattagctacttttagtaaattaactatttgttaggtagctaattctattattg

SEQ ID NO: 7977 - DNA, 2032 bp, Zea mays
actcgcctcttcccgccacgcggatggcgtgcgcgcacgcaaggtccaaagaagcaggccatccgggacggcgcccgccccgcctgcgccggattccaccctcctcctcctccgtctccgatcctcgccttcaactccactccctcgctctctcgggccttcttccctagcggcgacgacggggtgatcactgattcactgccgcccgcgccaggttggccagaactagtgggcgccgccgccaagcatcgtagcgaccatggaggtggtctcttgcagccactcctgcccggcattacatcaaacaccagcaagcacatggaggcttcggggcagtgctcttggtcttggtcttgggcatgccaggccttcccggaccagaagatacacagttgcgtgtgtaggaaccacaagtggagcttcgaatccgggtggttccggcaaggtccatgcagcccagggattccatgtaagcgacgtggatgcagccctgcagggcattccttccatgaaagccggagaggccgagagggtgatgattcaaggccttccggaaggccctgacagctccccgatcagtactgggttctgggagtggaagccgaagctgactgtgtactacgagagatccggcatgaagaacagcaaggcacctgcggtgctcttcctgccggggttcggagtcgggacgttccatttcgagaagcagctgagggatcttggtcgcgatcatcgggtgtggacgatggattttctcgggcaggggatgtcgctgcctggtgaagatcctgctcctagtagcatagcgagcgaagaggcgttttggggctttggacaagattcgcagccttgggcagaggagctggtgtattctgtggatttatggcaaaaccaagttcagcatttcattgaggaggttatccgtgaaccagtttatattgtggggaactctcttggaggttttgttgctctgtattttgctgcatccagtccacaccttgtaaaaggtgtcaccgtgcccggcccggcaccgttttggggattctttcccaaccctgctacatctccccgattgtcaaagattttcccatgggctgggacatttccgcttccatcatttgtgaggaaaattactgaagcagtttggcaaaagataagtgacccaaaaagtattcaggacatactcaaacaagtatacgctgaccattcaacaaatgtggacaaagtattctctcgtattgtggagataacacaacacccagcagctgctgcatcgtttgcctccattatgtttgctccaaggggtcagatatccttccaagaggccatctctaggtgccaagaccaaggcattcctatatctctcatgtatggaagagaagatccttggattagacctatttggggccttaaagttaaacagcaagtgcccgaagcaccttattatgaaattagccccgctggtcattgtcctcatgatgaggtccctgaggttataaactacttgctccgtgggtggctgaagaacctcgagtctgagggctcagtcgacctgccgtttctagaagaacgcagctatgctgagcgtggtgtatccagggagctggagtttgtcagagaaggatcaaggaagtcagttagtgtgcggctctatggtaccaagatttccctatggagccagctaagctcattcttgaacacacgtgtccccaagtcacggatagtcttgagataatccatcctcaactccaatagatctcaatcttagaagctttgattcagatattgtatttattactttattaaattggtcagcagacagtgtttccagaattcctagcgcatgtaaatattggcactacagtggtagtttcgaatttatcatgattcatatcatgtcaagatatgcttgaagttctgttcatagctacaagggaacatttcatctatgtatacgtactcagcaaaatgatacaaattgagcgtggataggcgtcagattctacgagacgaccttatattgcttcctgtc

SEQ ID NO: 7978 - DNA, 1971 bp, Zea mays
aggccggccgggccgggacactgggttccgcgagccccgcccgcctctcctccactcgcctcttccacgccacgcggatggcgtgcgcgcacgcaaggtccaaagaagcaggccatccgggacggcgcgagcgcgtcctgcgttccattccaccctcctccgtctccgatcctcgccttcaactccactccctcgctctctcgggccttcttccctagcggcgacgacggggtgatcactgattcactgccgcccgcgccaggtcggccagaactagtgggcgccaaacatcatagcgatcatggaggtggtctcttgcagccactcctgctcggcattacatcaaacaccagcaagcacatggaggcttcggggcagtgctcttggccttggtcttgggcatgccaggccttcccggaccagaagatacacagttgcgtgtgtaggaaccacgagtggagcttcgaatccgggtggttccggcaaggtccatgcagcccagggattccatgtaagcgacgtggatgcagccctgcagggcattccttccatgaaagccggggaggccgagagggtgatgattcaaggccttccggaaggccctgacagctccccgatcagtactgggttctgggagtggaagccgaagctgactgtgtactacgagaggtccggcatgaagaacagcaaggcacctgcggtgctcttcctgccggggttcggagtcgggacgttccatttcgagaagcagctgagggatcttggtcgcgatcatcgggtgtggacgatggattttctcgggcaggggatgtcgctgcctggtgaagatcctgctcctagtagcatagcgagcgaagatgcgttttggggctttggacaagattcccagccttgggcagaggagctggtgtattctgtggatttatggcaaaaccaagttcagcatttcattgaggaggttatccgtgaaccagtttatattgtggggaactctcttggaggttttgttgctctgtattttgctgcatccagtccacaccttgtaaaaggtgtcacactgcttaatgcaacaccgttttggggattctttcccaaccctgctacatctccccgattgtcaaagattttcccatgggctgggacatttccgcttccatcatttgtgaggaaaattactgaagcagtttggcaaaagataagtgacccaaaaagtattcaggacatactcaaacaagtatacgctgaccattcaacaaatgtggacaaagtattctctcgtattgtggagataacacaacacccagcagctgctgcatcgtttgcctccattatgtttgctccaaggggtcagatatccttccaagaggccatctctaggtgccaagaccaaggcattcctatatctctcatgtatggaagagaagatccttggattagacctatttggggccttaaagttaaacagcaagtgcccgaagcaccttattatgaaattagccccgctggtcattgtcctcatgatgaggtccctgaggttataaactacttgctccgtgggtggctgaagaacctcgagtctgagggctcagtcgacctgccgtttctagaagaacgcagctatgctgagcgtggtgtatccagggagctggagtttgtcagagaaggatcaaggaagtcagttagtgtgcggctctatggtaccaagatttccctatggagccagctaagctcattcttgaacacacgtgtccccaagtcacggatagtcttgagataatccatcctcaactccaatagatctcaatcttagaagctttgattcagatattgtatttattactttattaaattggtcagcagacagtgtttccagaattcctagcgcatgtaaatattggcactacagtggtagtttcgaatttatcatgattcatatcatgtcaagatatgcttgaagttctgttcatagct

SEQ ID NO: 7979 - DNA, 2199 bp, Zea mays
gggtacctcgaggccggccgggcccgtgttggcctggcagcacgacctcatcacggcacggcgtccttaagctcatcggccgccccgcccccgcctgcgacccgcgatctccgcgaccgcaagcagctcggcaggcaggcctccaccgctccaccacctccactcggtctacgtgctccgtcaccaaacccacccgggccaacgccgaagcaaccccccctccgtcctccccagatccggcgccgcctccgccctcacttacactagcacgcacggcggacacgtcgcctcccccgcgcgatctgatgcaggcgcacgcggtggccagcggcgatgcggtggaagcttaactcctccgtctacaagcgcgtgccgtccagggaaaccgccatggaacccgacgtcgagacgccaatgagaatgacggacggcggcggcagcggcgcggggccgtcgtggcgcatgtcgttgccgcatgtctgtgtcgccacgctcacctcgttcctctttggataccactccggggtggtgaacgagcccttggaggtcatctccgctgaccttggcttcgccggcaacactcttgctgaagggctcgtggtgagtatctgtttgggaggagcttttgttgggtgcctcttcagcggctccatcgcagatggtattgggcgacgccgtgcgttccagctcagtgcgctgcctatgattattggtgctgccataagtgctctctccaatagtttggagggtatgctccttggaagatttttggtaggaacagggatgggattgggtccaccagtagcttcactttatataacggaggtttctccttctacagtgaggggtacatatggtagctttgttcagattgcaacctgccttggaattatagtatcactactcattggtacacctgtcaaagatattgatagatggtggagagtgtgtttctgggttgccgttatcccagcaactttacaagctctcggtatggagttttgtgctgagagccctcagtggctttataagtgtggaaaaataagtgaagcagagatgcaatttgaaaagcttttaggtccccttcatgtaaaatctgccatggcagaactttctagatatgaaagagtagatgatggagaaagtgtcaagtactcagagttgttctatggtcgccacttcaatgttgtttttattggcacaacgctctttgctttacaacagttatccggcataaattctgtgttctatttctcatcaactgtattcagaagtgtgggggtgccctctaaccttgccaacatatgcatggggatttctaatctatcaggatcaattgtagcaatgcttctaatggacaagctaggtagaaaagtgcttctttcagggagttttcttgggatggcttttgcaatggggcttcaggctgttggagcaaaccgtcagtatcttggttctgcatgtgtatatctttcagttggtggcattctgttgtttgtcttgtcattttcactaggagcaggccctgtcccaggacttcttttgcctgagattttccctaataaaatccgagctaaggctatggctctctgcatgtctgtacattggatcgtgaacttctttgttagtttgatgttcttgcgtcttctggagcaacttggtccacagcttctctacacaatattttcgtcagtctgtgtggtagcctcaatatttgtgaggcgccatgtgttggagacgaagggaaagactttacaagagatagaggtttcactcctgcaaccacaataaaggtacatatttgacgtggctggaaccttgggcaggctgtttgctgaacagaaacaagctggccctgcagaagttgattcctgaagtcatcggcaacgccctacaaatggtctcagggaagttccagatatgcgcctgcgacagctagggcggtgtttccatagagcatcatgtactgaagttatgcctgtatcgcccgccctagataggatattttcatacttgtgttgtcatctgttctatctatgagtcgtaatatcagaaaaaaaaggtactactgttttaccgttgatgagcacagttgaaaaaaggaactatcatcttcattttacatgtatgtactcagtaaccatactccgaataataacactgcatggagattccttgttagtaaaaaaaaaaaaaaaa

SEQ ID NO: 7980 - DNA, 1703 bp, Zea mays
gcacgagaccattacctagaacatcctaatcgaaaacatgtggttgtgggcactgtgaaagctctttggccactcacagaagccctagaataagaatattgctaatgatgagaagtaactaaaacaatatcatacaattgcagtgctctctccaatagtttggagggtatgctccttggaagatttttggtaggaacagggatgggattgggtccaccagtagcttcactttatataacggaggtttctccttctacagtgaggggtacatatggtagctttgttcagattgcaacctgccttggaattatagtatcactactcattggtacacctgtcaaagatattgatagatggtggagagtgtgtttctgggttgccgttatcccagcaactttacaagctctcggtatggagttttgtgctgagagccctcagtggctttataagtgtggaaaaataagtgaagcagagatgcaatttgaaaagcttttaggtccccttcatgtaaaatctgccatggcagaactttctagatatgaaagagtagatgatggagaaagtgtcaagtactcagagttgttctatggtcgccacttcaatggtacaagctgttctatatcctttttgttgtgtttatggacttctaataacctgagttcagtctgtctgtgaagtttgttcattacaagttccttttttggtacagttgtttttattggcacaacgctctttgctttacaacagttatccggcataaattctgtgttctatttctcatcaactgtattcagaagtgtgggggtgccctctaaccttgccaacatatgcatggggatttctaatctatcaggatcaattgtagcaatgcttctaatggacaagctaggtagaaaagtgcttctttcagggagttttcttgggatggcttttgcaatggggcttcaggctgttggagcaaaccgtcagtatcttggttctgcatgtgtatatctttcagttggtggcattctgttgtttgtcttgtcattttcactaggagcaggccctgtcccaggacttcttttgcctgagattttccctaataaaatccgagctaaggctatggctctctgcatgtctgtacattggatcgtgaacttctttgttagtttgatgttcttgcgtcttctggagcaacttggtccacagcttctctacacaatattttcgtcagtctgtgtggtagcctcaatatttgtgaggcgccatgtgttggagacgaagggaaagactttacaagagatagaggtttcactcctgcaaccacaataaaggtacatatttgacgtggctggaaccttgggcaggctgtttgctgaacagaaacaagctggccctgcagaagttgattcctgaagtcatcggcaacgccctacaaatggtctcagggaagttccagatatgcgcctgcgacagctagggcggtgtttccatagagcatcatgtactgaagttatgcctgtatcgcccgccctagataggatattttcatacttgtgttgtcatctgttctatctatgagtcgtaatatcagaaaaaaaaggtactactgttttaccgttgatgagcacagttgaaaaaaggaactatcatcttcattttacatgtatgtactcagtaaccatactccgaataataacactgcatggagattccttgtt

SEQ ID NO: 7981 - DNA, 4411 bp, Zea mays
  misc_feature (357)..(357): n is a, c, g, or t
aaaaaagaatcctcccacatgcaatggcaccaaatagtcaatcgaacaaattgattgtattacgggaacaaccttgattaggagtaggtccgtaacgcaacgggagcaaggaaaaccaaaccagacagtagcacagtggcgcgtcacttgtccgcgagcatggtagtactccctccgtttcttttatttgtcgctggatagtgcaaaattacactatccagcgataaataaaaagaaacggagggagtacttatcactgccaaatcaaatcacggatttattggcatgacaacaccggccggccactggcagattgtacactggccgtgaagggcagaagcgtgctacggagatttntgggacagattggcctgtggcagctgcagtgctgcgcggcagcacagcagtgcggtcgaagtcgaaccacttccgctgtgcaggcaagtccgtggattgggattgataggatgccagcggttttgtgtttgtttcgcgcgaaacggcaagcaggggggaatcgcaggcgtttctgggagtagcagtagcttgcttgcttgcaagcaacgacaagcgtagatacttggaggcgcatgcacctttgcactccccctgcagatggactggagtcaagtgtgcttgctctctctctctctctctctctctctctctcatccagcgtttacaagtggtgtgccggaacgatgagttgctcgttgtcgaaccggtcgaggaacgcctttcctgttcccgcggcgccactccacactcttcctcccgacaggtccggatcgaccgaccgaccgaccgtgacgtccagtcgcgcgtggtgccgccgcgtggcacatcctggttggaggatctccgtcccctgagattaaaagcaacggggggtttaaataaccaacttgtactggtcgctgccgtttttatccggttgtttaaccggcaagcgttttagattcggataaaaagcggaaaagggtggtgactccgcaccaacaggcaacagcggggagttcatctcttcctccacagacccggtctctctgtctgtgggtcaacaggactcctggcccgcacgtcggtgactgcgtgccgaactctcactggtgccagaagtacgcttgtggtgtacgcaagggtgcggaggaggcccgggccccggcgcagcggcgctggctgggtccctcctcgcaggcgggagcgggacgcttgggttgggagttcctctttccccacggccacggcaaaggcctggagtggccccgccccgcggatgggccacgggcggagagtggaggggacgggagcatgacacgcgggcccaggatggcacggcgggccctgcggtccagcactgtttctccgtcgcttttgtcccctcagggctttttcccgcttttgcgctgaaaagaagaaggcacgcggcacgggatcgggatgggagtcgggacgggacgggactcgggagaagacgacggagccagggaggacccgtgccacgtacactcggtctataggcgccgcgggtgggctttggaattcactcagatcctgccgtatttggagtccacatattttcttctgccgcgtaaagcgtcagatctctgagatgcagtcttgcagatcatgcaaaaaaggagtgtcgccggcctgtcggtgtcggctttgctgatgctggtctatggaacggctccagctggcaccggaggagcgggagccggcagggatggggcgtcggcgttgggagggatttgatcagacgacaagggccggccgtgccgtctttctctgcgctcctgctgggcctgctggttttgctgcagtgctgcttctagttctggaaggtacttgcacgtccggcgccacggccacgcatgaatctttttctgccaggtggccactcggcgcgctagctcgctcgggctcgggggacgggacgacgaggctggcactgccacacagcgccatcggcaaggcagtcagcgtgcatatcacaaggagcgaagtattcccaacggcgaaccagcgacgggcgtggggtagcgtaggcatgggagttccggtttctcgtttcggtccgattcggttcttcagagaatttggtttcagagaaactgaaccgaaatatacattccagagcataaggaccgtgcggtgcaaccgtacataaaaagtcgatgaaataatagtgcacagtaattgcattcacaaattctttgtcaacaactagtagaaaactaattaaactcaggattcagagcgtctcgtcctcctctctctcaactattcaactacatctagagacgcatgccagcggagagtcgagacagtggttcgagacgcttgtcgatggagaagataaagtcgtcaccgcgagtcggacacgacagtggggggttggcgagtccatggcctccaggaggaagggctcgcggtggttgcattgttgcttgcgcatgtaagagacaagacttatcttatttgattattatacaagatatgaaggagaaaattagatctgcgtgtgacgcacgacgcacgagtttcgtgttttagaggcggaactcagaactgtgacattagtatgagtaatatgagctatgatgatgataatgatgatgatgatgatgtggctttattatgttgctatgctcaactagtgtgatgaatgagatcatgacatgacatatagtgtcatatggttaggtggagaagatgtggcttcgctatgataggctagattgctagtgtgaaggccaagtcaagaggcatgggagcgatagaccatgtggtggtgatactagagcaaggattttgtgttgatggaccaggtgcaatggtaaagagcaaaaaaaagttgcgatatacgaaccaatatgactgtatgatgacatggagtagattatatcaactacaaggtgtgaagccataactagtgttgattacaagcggatatatagaggttgatgactgtgtagcaccattattgaaggagatgaaatataatggataagacaaatgtataacttgtagacaattttatttcaccaatcaaaggttgtgtagagaagtgcatgaccatatttaagatacatgatcatacttgtcgagggcaaatatcacgggtatgacatgacatgggattaagagataaacaaatctcttgttgtttgagttcgcccgaccaaggctccatctcgctcaacccccaaccatggggcgaggtcagggatgcgaagcatcttagccttgccgacctcgactatgaagggaccgaggctcgaacatatttaactcagatttatgcatcacctgacctctgaccactcgggagctaaccagtttaggtcggacgactctgcctcagagttccgcctcacccgacctccgaggataatgggtaggatacttcgcccgaccacctgaaaagcagggttcccgggttcgtactgcttcaaccataacgaacatggaaacattagatcacatatgatcttcatggaagacaccaaccctgccttttccctgtaggccgcgcgcgtcggcgtcggccctcacttcagatggacgcgtacgtcgtcgctttgcgctttacctgcctataaagaccactgcgttcctcgccgtgcatggcaacgtcggccaagcacgtagtagctcactggcacgagacgagcgagaaagcatacacacagtcagagcagcaaccaagcggggatgcggggcggcacccgactagcagctagctgggctagacaacaccaaccagctgctagctataggcatgaggtcgctgctcccactgctcgtggccgcgctcgtcgccgtcaccgcgttccccgacggggccgacgcggtctggacgccgatcgccaacccggggactctgctggtcaagcaggtgggcaacttcgccgtgatcgtctacagcaacgccggcccgcgcaagcaccgtcccctgcagctggtggccgtggtgggaggcgacacccagccggtaggcaacggcgtcaccgactaccggctcgtgctggccgtgaacaacacggacaccgggagcacagcgatgtaccagtgcgtcgtgcgaggcaagcccggctcgcgcgccaccacatgggtgctgcgcagttcgcgctatatacgcaggcggcatagctagctcatcgtcattcttctgcctgctacaagcagctagctagcgttttcataagagcataataaagctttaataagttttaccgttattatttagagggtgtttggtttctagagaataacattagtttctctatttcattttattttagtccttaaattataaaatacagaaacatatatttaaattttccgtatttagtaattagtaatttagagactaaaataaaataaaataaaatgataaaaatta

SEQ ID NO: 7982 - DNA, 3607 bp, Zea mays
tatatatatatatatatatatatatatatataatacacatacattaaatattgtataggcccattattaacaccctaaaaggaatgctattttatatggagggagaattaaaaaacccatccaccaaattgctcatacacctataatctccactaaatctaccaaataaattataaacagacttaacacatcattaaaacctacaattcagattgctagataattctctttctcctactcacttaaatctaatagtcaatattatttgaattttgaaacatatacctcgttcctccggacggcctgccgccgccctctctctccaacgtcgtaacgttataaagaaaaaaaaaacaaaacgagatcaatcaatccttgcccagtaaagcatctcctttgggcctatatagatccctctttggttggtggtcgcccagcacgactgagcgaggcgcgtgggctaaaataagcccattggaccagagttgagacccaaacatcgtggaggcctgcttctcgtctgcttgatgaatggcggcatccatcccccagtgacccagttccccaaagttcccaacgccgccgcgacggcgctgctagctagtctttggtgttgcaggtgttcgattcctgattccaaattccagactccaaactcggttcttcaatcgacagattccgatttacatcccaaagctcttcggattgaaatccagccgcgacccaagagataagagtatttgggattagtatttgggattagtagataggatagtagaatagaagaggaacactttcgctgatgattacggcggaggagaagagccccgaaagggaggaggaggaggaggcgaacccgcgcgcggaggcttttctggagatcatctgccgcgtcccggcgggggaggtggaggcggcgctgtccgcttgcggcatcggccccacggccgaggtcgaggaactggtgctcaagtcccgcgaatgctacaagcgccctaagtccgccgtccgcttcttccgctgggcggggcagtccgtgtcgcacaccgcctacgcatggaacctccttgtcgacatcctcggcaaggccgccatgttcgagcccatgtgggacgccatccgctccatgaagcaggagggcggcggcgggctcgtctccgtcgccaccttcgcctccgtcttcgcctcctactgcgccgctggcaacatcaaagatgcaatcgcggccttagacgtcatggaccgctacggcctcaagcacgacgccgtcgcgctcaactcgctgctctcggcgatttgccgcgtcgagggtcgcgcgcaggatgcgcaggacgtcttcgagcgtaccaaggcaaccatcccacccgacggcgacacgttcgcgatactgctcgaggcatgggagaaggaggggaacgcggtgcgcgccaagagcgtctttggcgagatggtcgtccgcatcggctgggacgcagccaacgtatccgcgtacgactccttcctctccactctcgttcggggcggcctgttggacgaggccttcaaatttctgcaggtgatgcggagcaagggctgcttgccggggatcaattttttttctacagctgtggatctggtcgtccgcaagggtgactacctcaacgccgtagccatctggcacatgatggtctctgaagccggcctcgttcccaatttctcaatgtacagcgccatgattggtctccactgcaatgctggtagcatagacgatgctcttgggttgcttgatgaaatgcccctcaacggcgtctttgcaaattctgtcacatacaacaccatactggaaggattcatcaagcatcgcaaggctcgtgaggctgaaagtttcctaacggagatgagcaagaatgagcaactgcctactgcatccaattgcgctgctgctatcagcttgttctttaaggagtttaacccatctgcagcaatcgacgtgtggcgctgtattgtggagcacaacattaccccagctgaggactctgccaaagagctaatagcagggctgcttgaatttggcaggtttactgaggtgacgaagcgtgctgatgagatgattgacatgagagttgagttgtcacggtccacaatggagaatatgaagcgtgcttttgctaaggctggcaggcaccaatcatatgacaacattgcaagaaggctaaagcgatattagctgcacatgaatgctttaatcagctggtacgtttgcggcttccatatgggtgtaattgattgtgtacttcagtaccactgtttgtatgtgattgctgatcatttgcttgtgtcactcacttcctaattatgcactgtgacatttgttttttgaactaccaagtggtagtattaactattaagttcttgtatgtgtcaagttttggttggtgttactctccttgtcttggtaaatagggccctttaacacaatgcaagacctatagaaaggactgtaatatgttaacatatttttttgattgcctcacacctctttctttgccaagccattgaatgtttattccttttttccattaccatttatggaatgtcgaatcagtttgcacccaaaccttttgaggaacttgaataaagagagaactcacagttgattcactgaatgtagcttgttccctcgcctttgatctaatgactccatggttatgtccttgttctaggcttttccgtttttcctcttataactatcataagctatcttggtcttaccaaaatttcttacaagtcaagcgatcttgatattttgattacctcgcaaggcaagcgattcatgatctaattcaattctttgagaagaaaacctaagaacctacaatatggactggacaacaactttgagaagaaaaaaggcaaatagaaggtgggaagatacacatacatgagcaaatgtactccaactgtgatcacagtcagaagtcgaacaagaaaggctcacaattatctttgctagacattggagctcgaatgtattagcaccatatgatccccatcagttaactgcatgtattaccaccatatactccaaaatagccagataatacttataagcagagactggtgataggggaagtctaaaaatcacaacgtattaactgaaaaattctagcagccctagaggaggacgcatgagggcttgtccgattagaggtggattgaaggggattagagaggattaaatttcttcatagtcaaaattgaatagaaagagatttaatccccttcaatcccctccaatccagatgcaatcgaacaaagcctgaaagggaagactgacatgctggcctaactgacaagcatggcacaaaggagtggtagcacttttagtacaggaaataacacaagactgtgctaggtgagataaggcgatgtgatcgggggtgcccaagacgctggtgccacaaggacgaagtggacacatggagtgtagaagtaggaagccacagaggctagagggtatgtgcgatgaatatgcagaccaagcgtgaggaagcgctcattgaggccttggacaatgttgaggacgagggtcctgttagagacaggctcgccaaggtcgcggaggtcc

SEQ ID NO: 7983 - DNA, 2085 bp, Zea mays
ccggcccggagttccccaaagttcccaacgccgccgcgacggcgctgctagctagtctttggtgttgcaggtgttcgattcctgattccaaattccagactccaaactcggttcttcaatcgacagattccgatttacatcccaaagctcttcggattgaaatccagccgcgacccaagagataagagtatttgggattagtagatagggagggtagataggatagtagaatagaagaggagcactttcgctgatgattacggcggaggagaagagccccgaaagggaggaggaggaggaggaggcgaacccgcgcgcggaggcttttctggagatcatctgccgcgtcccggcgggggaggtggaggcggcgctgtccgcttgcggcatcggccccacggccgaggtcgaggaactggtgctcaagtcccgcgaatgctacaagcgccctaagtccgccgtccgcttcttccgctgggcggggcagtccgtgtcgcacaccgcctacgcatggaacctccttgtcgacatcctcggcaaggccgccatgttcgagcccatgtgggacgccatccgctccatgaagcaggagggcggcggcgggctcgtctccgtcgccaccttcgcctccgtcttcgcctcctactgcgccgctggcaacatcaaagatgcaatcgcggccttagacgtcatggaccgctacggcctcaagcacgacgccgtcgcgctcaactcgctgctctcggcgatttgccgcgtcgagggtcgcgcgcaggatgcgcaggacgtcttcgagcgtaccaaggcaaccatcccacccgacggcgacacgttcgcgatactgctcgaggcatggggagaaggaggggaacgcggtgcgcgccaagagcgtctttggcgagatggtcgtccgcatcggctgggacgcagccaacgtatccgcgtacgactccttcctctccactctcgttcggggcggcctgttggacgaggccttcaaatttctgcaggtgatgcggagcaagggctgcttgccggggatcaattttttttctacagctgtggatctggtcgtccgcaagggtgactacctcaacgccgtagccatctggcacatgatggtctctgaagccggcctcgttcccaatttctcaatgtacagcgccatgattggcctccactgcaatgctggtagcatagacgatgctcttgggttgcttgatgaaatgcccctcaacggcgtctttgcaaattctgtcacatacaacaccatactggaaggattcatcaagcatcgcaaggctcgtgaggctgaaagtttcctaacggagatgagcaagaatgagcaactgcctactgcatccaattgcgctgctgctatcagcttgttctttaaggagtttaacccatctgcagcaatcgacgtgtggcgctgtattgtggagcacaacattaccccagctgaggactctgccaaagagctaatagcagggctgcttgattttggcaggtttactgaggtgacgaagcgtgctgatgagatgattgacatgagagttgagttgtcacggtccacaatggagaatatgaagcgtgcttttgctaaggctggcaggcaccaatcatatgacaacattgcaagaaggctaaagcgatattagctgcacatgaatgctttaatcagctgaaactttgcggctcacggggtagacgtttaacgcctggactgcttaattgcatgacaaccaagaatttggactagcctggatcctggaatgtaagtctggaaatctggaactgtactctgatcccacaagcagtggtcgggatgttagtgtagctcttgtagattccggaccccatttgttagctggttactcatcgagtgtaataagtggctagtttagtgaggctgcacattatcgctgtttatttttcagatatattttatgaatatgaaattgggttatgtaagtatcagatattcctggctgtcagcagcgtcaggcgcctctgctgatcctttgaccatattgtttttcgtggaagaagctttttaacttcttttttttccgggaaggtttg

SEQ ID NO: 7984 - DNA, 987 bp, Zea mays
tcagctacgtaggccccccccccatactctgttccacccccaggttctcatatgcctggagttccacacatgatgcctcacatgcatctgcctccacagcagatacctggccagccgccgatggttaggatgccaggtcaaatggttcatatgccaaccagcattcctccgcctcctggccaaactcagtttatgcctggtccaccacgcacatttgctatgcccccatcatcgcacatgccacccatgatcaatcccattggaatccctcagcctccagcaccgcctctgcctccacagcctcctgctgaagagcaaccacctccacccgatgaaccagaacctaagaggcagagaacagatgatgcttctctcatcccagcagagcagtaccttgttcagcatccgggtcctgctagcatctctgtatctgtacccaaccttgatgaagggaacttgcgaggccaaattttgcagattcctgtccaatcactgtcagacacagttggtagtctgaaggagcaaattgctggagagttgcaactccctgctaataagcagaagttgagtgtgaggactagtttcctcaaagacaaccttactcttgcttactacaatgtgggtcctggagtggtgatcaatctaacactgagggagcgtggtgggagaaagaaatgagtcttttggttctcagttggcagtttaatgcttacaactataattcagcagctatcatggagaaccagttcgtatctttcatattattttcttttgtatgctatatgcaatcatttgtgttatgtgaacatcgtactttcctctatattatgatacagttaaatcttgtgagtggttctgcctagtatgttacttgaggttgctaaatgctaatggatactttcttggccacttaatgttaaatcagtatggcttctctgccttcttttgtttggtctttgcgagatgccttctatataaagagttcgg

SEQ ID NO: 7985 - DNA, 3014 bp, Zea mays
taattttacgaatgtgtttgatggtgatgacaaatatcaaattgtctgaacgaaaggctgccgtatggaggaggggaacagctgaaatttctccaaaaataccaatccgccttccatgttctcgtcgctgcctccgtctgacggctcgaagctccctccagttccgatctaaacccgccgaaaccctaatccccatggctgccgccatgggcaaccccatcctgaccctccccgcaccggagggcaacggcaccgggggcggcgacgccgaccagcagctgcagcaggcgccgcctaagccgcctcctcccggcgcgaagacggaccccccggcgacggtggccacccacacgcgcaccatcggcatcatccaccctccgcccgacatccgcgtcatcatcgagaagacggctaccttcgtcgccaagaacgggcccgagttcgagcgccgcatcatctccctcaaccagggcaacgccaaattcaacttcctgcagccctcggatccctaccacgcctactaccagcaccgcgtttccgagatagccgctgcgccgcccggcgcggacggcccctcgggcgccgatactggcgcggctcccgacgaatcgccagcgtcggccccggccgacggcgccgccgccgcacccgtagatggcgctgctgcggacgcaaaggccgatcactccgcgcccttccgcgtggggccgccgcccaaggtgctggtgccacccaaggctgagctgtacacggtgcggctgcccgagggtatcacaggggaggagctggacatcatcaagctgaccgcccaatttgtggcgcggaacgggaagaacttcctgacgagcctggcgcaacgcgagagcaacaacatgcagttccacttcatccggcccacgcacagcatgttccccttctttacggccctcacagatgcgtactccagggtgctgaggccggcagagggggtgcctgcactgctaaaagagctgagggaggggtcaaaggacctgactacagtgttggagagatgcttgaaccggttggagtgggatcggtcgcaggagcaggcaaggcagcaggcagaggatgaggttgagcaggaacggatgcagatgtcaatgattgactggcatgattttgttgttgtggagaccattgaatttgcagatgatgagtatgaggggcttcctgtgccacttacactggaggagttgaagcgccagaagaggatggagaacttgggagaggaggaagcgatggatttgactgaaccttctaaggaggttgagatggaaatggatgaagaggagccgcaacttgttgaggaaggaatgcgggcagcacggcttgaggagaatgatggagcagcacaagttagcttgccgggtgatgacgaggcacctatgaggattgtcaagaactacaagaggcctgaggagaggattccggcagagagagacccaactaagtttgttgtctcgccaataactggggaactcattccgatcagcgagatggaggaacacatgcgcatctcactcattgaccctaagtacaaggagcagaaagagaggatgttagccaagatcaaggagactacccttgcacctgatgatgaaatatcacggaacattgttggccttgctcgcactcgccctgatatttttggaaccactgaggaggaggtgtctaacgccgtcaaggcagaaattgagaagaaaaaggatgaacagccaaagcaggttatttgggatggtcattctggtagcattggacgcactgctactcatgcattatctcagcctcagggtggtgaggaacagtttgatgctacgaatgttgatgggaggcctgttcctggtccagctccacttgtccgacctggcatgccgttgcctcgacctcctcagccacttcctcttgttaatgttcctcgttttatcgctccaccagcaccatactctgttccacccccaggttctcatatgcctggagttccacacatgatgcctcacatgcatctgcctccacagcagatacctggccagccgccgatggttaggatgccaggtcaaatggttcatatgccaaccagcattcctccgcctcctggccaaactcagtttatgcctggtccaccacgcacatttgctatgcccccatcatcgcacatgccacccatgatcaatcccattggaatccctcagcctccagcaccgcctctgcctccacagcctcctgctgaagagcaaccacctccacccgatgaaccagaacctaagaggcagagaacagatgatgcttctctcatcccagcagagcagtaccttgttcagcatccggtaatggctctgggtgtccatctttctttaatctttcttccttacttttcatgctttaggtatttttgttatatggcaagctaatatggtctcttgcctgcagggtcctgctagcatctctgtatctgtacccaaccttgatgaagggaacttgcgaggccaaattttgcagattcctgtccaatcactgtcagacacagttggtagtctgaaggagcaaattgctggagagttgcaactccctgctaataagcagaagttgagtgtgaggactagtttcctcaaagacaaccttactcttgcttactacaatgtgggtcctggagtggtgatcaatctaacactgagggagcgtggtgggagaaagaaatgagtcttttggttctcagttggcagtttaatgcttacaactataattcagcagctatcatggagaaccagttcgtatctttcatattattttcttttgtatgctatatgcaatcatttgtgttatgtgaacatcgtactttcctctatattatgatacagttaaatcttgtgagtggttctgcctagtatgttacttgaggttgctaaatgctaatggatactttcttggccacttaatgttaaaaaaaaaaaaaaaaaaagggggggccgccgataattaacctcgtcaccccggaa

SEQ ID NO: 7986 - DNA, 794 bp, Zea mays
tgagagtaaatataacgcctctaactttgaagttagcaatgttataaacgaaagaggtccagctgtttcccggagcatgggcaaagtttctggtaaagaagccttaccttatgacacaaatgaggaaaatagctccaagaatgaggtcaaaaaaatgcagagagaacaaaagaccaatgcttcgagatcttctgatttcctggaggatgagaaacacattcgttcttctgctgcagttaaggagaggaaaagtgacatgcaatccaaatctagccatactggaaagaaacccaaaacaaaatcacatagagatgttagggacaacctgcctgaaggatctcacggaagcaaggaaaaagacacattggagaatgaaagtgcctttggagatctccgaccaaaggaaaagccatggaaatatgacatcgagagggattctgatgcacctgggatctctaggagggagatttcttctagtgtaaagcatgataagcacttggcttctgaggagcagaagatgcatatacctccaccttccactgtatcaactgcaaatgcagctccagttgtgataaaggagcattgggtgagctgtgacatatgtgataaatggcgtctcctaccttatgagatggatccttcagatcttcctaagaagtggaaatgtagcatgctatattggctgtaagtttaagtccattcatactttccacatcgtggatgttttatatttttagacattttccggtccattcttggtttgggccttgtttcctatgctgttcaaaaaaaaa

SEQ ID NO: 7987 - DNA, 4027 bp, Zea mays
ctcggcgagtgccagggcactcttttattgacatatccgttgatgcaaacaacaagctagttcccctagcatttgctctggttgagaaagagaacaaagacagttgggggttggttcctgcgactggtccggatacatgtggttggcccaggacgggaagttggtgtaatatcagatcggcaccagggaatactcaacgcggtccgtgagcagatcgatgggtaccctcctttgcatcacaggtggtgtactcgacaccttgctgagaatcttctgcgtaaggatggtgtcaaggataactttgagcttttccaggagacatgtcgccagctggaagacaagttctttagagaaaagttagaaaagctcaaagtcgcaacaaatgccgaaggcagagattggttgaatggattgatgccggatttggagaagtggacgagagctcacgacttaggtggatggagatatgagttccagtgtagtaacatggccgagtcattcaacaaattattgttgggcatacgtggtatgccggtcactgctatagtaacatttaccttttacaagcttgtggcatggtttaatgatagacacacccatgcagttggattgcagaatgagggagagagatgggctccaaaacctaagacctttctagagaaggcaaaggaaagggcaaacacacacactgttgattgttttgacttacagtcagggacatatgaggtattccttcaagctggtactacttccgacggcgagtcacaagagtcgaggaagcatgtggttgtccttaatgacttgtcatgtacttgtggcgcacccaggcagtaccattttccatgttctcatctaatcgcagctgctcgagctcgcaactttgacttagagaggaggatacctcaagagtttactattgataaactagtgttgacttggagtccaagatttattccttatcgtgacgcgggtgagtggcctccgtacgatggcccaaagtatgtcgccgatccaagcagtcgttggaccaagcgtggatccaggaagaggacgaggcacaagatggttatggatcaggttggtggtaggagtagaaggggaaggagaacaccatttcttaccgaccccgagcagtatgagtgtggcaagtgcggtagacttggtcataattcacgcacttgtcgttggcagattagcgaggtttgtattgtttagtttaatgatactaccttaattttatttaataaggctatattacttactaacattaatttcattttgtaggatggcacagttccacctcctcgacccgttctacgacgagagccaccgggggcgccttcgggcgcctcgccgccggccgggttgtgaatttcttttgtagatttgttgttgtacaaatggtgttgcttatataatatttttccgtgtaggacctagcaacgcttcgttctaggacacacaatgggttcctagacatggtgttcgacgacaggtacactaattacctcagacgagcaggtctagatgtaatatcgtaccagttacgacgcgggttgcctactattgactcggcggccattactgcacttgtggacaggtattgttatgattttataaaaatattcttgaatcattgagctcttttacactattttttttaattatgtaggtggcgtcctgagacacatagttttcatcttccttttggtgagatgacagtcacattagaggatgcacagaagatacttggactcaatgttggtggcagagcagtgacaggccaatgtgactctgacggatggagggctagagttgaggcctttcttggtagggagctccctgctgagggcgttgaacggactgctggagtaggcatcacatggctccgtcagtcttttggtgtgtgccctgctgatgctgatgaggctacagtccagttctattgtcgagcttggatcttgcacatggtttggttgtgtcctcttcccagacgccacaggagactgcgcgtcctggatgtacatcccatgtctaaccgactgggatacagctggacagtacagttggggctccgctgtgctttcttttttgtaccggcagctttgtgaagcttgccgtcgtacgtcctcctcttcgtctataggcggttgcgtctacctcctgcagatatggatgtggtttcgcataccagttggtcgaccacgtgttttccagcctagaccctggccatggatgattcatggaaatgatcgtcttcgaccgacgtatgcttatatttgggaccaagtggcagctccttttgcgagagctaagagggcatacatggagtatgttaacgagtttgacaccctttctgcctctagcgtcacatggcagccatacaacgcacctgagtatgctgggatgatctttagtgtagtatgcagcagtgaagatgaactctatatgatgcaatgtcctttggtctgtttctggtgtgttgagtggcacctacctcacagggttcagagacagtttggtaggaaccagctatggccggttgaagatgttcctacttcaaaggagctacacaaatttgaccggcggaagcaaaagaagataacggactttcgtcaacatcatctgatattagtaaatgattgggaatcgggtgctgagaatgtatattccaacgatgagttgcacaacaatagtgattacaggcggtaccaagcttggtaccagggtgcgactcgttgtaagcttcgccagcagtggacagcggaagactacgccgacattgattcttctgaagatgaagaaacggagtatgacctgtccacaagactgggaacccaagtggaggcggcacccatattagatcgagtgggtaacacattgcgacggtcggtagaggacattgatcgccaacttttgactgcgggcgacagcagcatgcgcagcttcttgcagcgtttatctaggcgcctacgtggagctgctgctcgctgtggctgcaggactactgttgcacatgacgtccatgtaccatcgtgtaccgacacaacaacgccctccacaggtcttggtgctggcttcgactacgatcacgacgagataggaccttcacagcttcagggggctccttcgacacagccattacaaccacaggatcgtaggcgacaccgctctccacaacgttacactccaggcaccgacgctttaggcaagggtaagactaggagacgttgaattggtttggactctatggacttgttatgtaacgtatgaattatatagacttgtaatggactcatttggcctctacgggcttgtatgacattttaatggacttgtatgaattctatggacttgtaatgaacttgtttagacttttatgagcttgcttggaattgtttacaattgtatgcacttgtatgttatgcttgtctatgtgtatatgttggattgacaaaaaacagagaaaactctgccgaaattttgtaaaatctgtgattatgtcatgtagcctttacagaactattacatagccttttcagaagcatcaactttcggactagcatctaaacttttcagatccatttcgtagccttttcaggactatatatatagccttttcaggactgcatatatagccttttcagaatcaacaatatcctacattatcgtaggacatgtagcctttgaagatccagaacatagccttttcagagtttttgtacatatctgttatcataatccattacattacctttcctttcacctatatatacacgatcctttgtacatttgcttcattgtgcaatacaatggcttcagggtcttctaggggcaagggtgcgggaaatgagagacgaaaggatggagggaagttaactccaatgtgtttcgatggccctcttggtccagatttttttgaagaggcggtttttaactttccagttcaaagtaaaaaagatttcaacaaagaggttagacttaggtcctacgataataggagagaagattggccgaagtgcatgca

SEQ ID NO: 7988 - DNA, 1026 bp, Zea mays
  misc_feature (139)..(139): n is a, c, g, or t
tctggaaaattctgaaaagagcatatcaaacttagtagtgagcactgaacagaaacaagatggttcacattccaatgcagctaaggatactgaattggatgaagcttccaatgaaacacaaccagaaacaggttctccnattaagaaaaagtataacaagcacatatgcagatgctgatcaacatggattggaacctagattttgctcagtccagggtacgaatgaagaaccttctggtggagtgaccctgacagagatgcatgcaaacaattccaggtcaactgaggtcagcacaatcacagaatcattagttaacagggaaaaagaaaaacaagggctgtatgacagaatgaatgagtttgatcctatcaagcagcaccggacgttctgcccttggacttcccctgattacggcgaacccttgcctggatggaggcttactctctcggcattacttgctggggacaagagatctgatggggacttgcaagtggatattcagaccagccttctcgatgaggaggatgaccctcttacctctgttaggaagcttttcatgacaccacctccgaaaaggcggaggatacagcaatctgaaaagagctgagaagcgaactggatccacatgttgggaaagctggggtcaaactcatacggttggacattatcatggggcagatccagaatgccatatgaattgaatattggaactggaaatgtttacgctgcacatctgtgcgatgtacaaattcttgaggcagcagctgggaaaatgatttatgacatggttaattgttccaggacgatactgctgctgtagaagccattgttgtggtggttaaggaatgtagaagttgggttacctcttccccatttgaaaccacctgagcatatacaccgtgatttcgtagcttagtaatgttgtcaacttgttatattgcattctttatattgctgtacgatcacctgttaactgttaaaccctcggggaattttgattggcaagagcgaattcgtttgacgcc

SEQ ID NO: 7989 - DNA, 1522 bp, Zea mays
gttcctcattcagttttgtgtttcttatttgttagtctagttgaataatgtgctttaaattcttcatcggtatcctcggttccagggtcatctgtgtccatcacagttagccctcattaaccctaactgtgaatttatgctttctttgacagaaaaacaagggctgtatgacagaatgaatgagtttgatcctatcaagcagcaccggacgttctgcccttggacttcccctgattacggcgaacccttgcctggatggaggcttactctctcggcattacttgctggggacaagagatctgatggggacttgcaagtggatattcagaccagccttctcgatgaggtagaggtgctttcattgaatcaagccttgcatctctagaacgcaacctcacagtttgttttctatgattcaggaggatgaccctcttacctctgttaggaagcttttcatgacaccacctccgaaaaggcggaggatacagcaatctgaaaagagctgagaagcgaactggatccacatgttgggaaagctggggtcaaactcatacggttggacaatatcatggggcagatccagaatgccatatgaattgaatattggaactggaaatgtttacgctgcacatctgtgcgatgtacaaattcttgaggcagcagctgggaaaatgattcggctcgtggttaactgttccaggatgatactgctgttgtagaagccattgttgtggtggttaatgaatgtagaagttgggttacctcttccccgtttgaaaccacctgagcatatacaccatgatttcgtagcttagtaatgttgtcaacttgttatattgcattctttatattgctgtacgagcacctgttaactgttaaaccctcggggaattttgattggcaagagcgaattcgtttgacgcctttgctggctgacttacctgtaataactgcttaaagatctgatcggcttgaaacgataggttctaccattcaatagcctacaatgaatcatttttgtaaacaggtctgccgtgcgtgtcttccagaaaaaaaaaaggataaacgtttgtgccgtgctgcatcactgcatggcttcttcacgccaatagcgtgcagctgcagaaacgatactcgcgacatgccgatcgcgtcggaatgattgatgtccgcctcgtattttgcttgtatactccctcgtataaccaaatgtcggccgagacagttcgaagacgaccagctgctcgtttaattcgatcttgctgaagcgattgccggcaccaagatttaggccgttttcatcagcaacggaaatcgccagtctttttgccatccagatctagcttggctctgaatgttgggccaggctgccgggcttagcgaaacaggctgtctggaacggtctagctagaactagcccaacctcgccaaaaacgagcaagctattcattacgttgcggatggcgatgaatgggttaccacagatcatatatatatatatatatatatatatatatagtac

SEQ ID NO: 7990 - DNA, 1743 bp, Zea mays
cctctcagcgcctcagcggcgttcccgtctcctcgttctctcgctcacccggccccgtcggccatgaacacacgagccagcgcgccaagcaccggccaccgtctccggccttacctgatctgacctgacctgaccggctgcatcgatggttccgcaaatacccgacccctgcgaggacgatggccaagatcaccggtgcccgcctgctgcggctctacctcccccgtggccttaccctcctcttcctccccccgcctcccacggccgcagcaccttcgtcaccgctctcatcatcgccacctcggtgcttgtcttcctcgccctctgcctctccatacttgtcttcgtccggcgcaggcggctgcggcgtcgtcgagaggcgctccttgaagccgccttggcaccggcggcggccgccaccttccccgacgaaggcgacggcgacggtggtccccggcggagaggtcgtgcaccacgtgtggcacatccggaccgtcgggctcgacaacgcggcgatcgagtccatcgcgctcacgcggtaccgcgccggcggcgtgctcggcgcttccgactgcaccgtctgcctcggcgagttccaggatggcgagctcctccggctgctccccaagtgcgcccacgcgttccacgttgagtgcatagacacctggctccgggcccacgtcagctgcccgctctgccgcgccgacgtgatggacccaggcgccgcggccgccgacgccgacgccgagcaacccccggggaccgacgccgccgacgcctcggccgagcgatccgcaagcaataccccaaccacggaactggagcggctcgatcagcaggccaacgagcaccaccaagagctgcgagtccaaatcgatcagcccgaccactccagctcgatggaactggaacggcgacgtcggcaggttcggcaccacggagcacgggcacagaacttccggcgggtggcttccatggactcgcggtcgccgccgccggtgtcagccgaggtcgatcctgaaggcgagccggccggcggcgaggagcaggggacatgcggtgctgtttgctgcgaggtgtcaccagagcctgctgagctgaagaggtcatggtccgccagcagccggtggacgctcctctagcggcattgccgcgcacgcagctcgctcctgccgctgtgatgggacggaagatctgtatctgttttttgcctgccactgatcacgcttgtttctgctgatactctgtacagttttcaatttcagcgcggaggttcgctgaacagtcacacctgcattctggtgttcagcttgcttgttctttgcaagattcagaggaatgcttcggctgctgtataaaaactcaaatatgtccttcctgtaactgaaactccatctgttttatatttctttttttctttatccgagctcagcgtatctctaactggaacatgaaactgtttcgatacgaaagtgatctgtaaatattgatatgatttttaccattcggcatgatgaaaaaaaaaaaaaaaagcttcgagtcctggcgagcagcggacactgctagttcacggaagcgtgatcctcaagcacggagtccctgttaggtcatgttaggaatttatgcatttttagatttaatttaatttaaaatatagcgtaataaaataaatgtgatgacaaatatatatgtgtgaataattattcatagtagtagtaaacaacaaaataacatgcacaaaaa

SEQ ID NO: 7991 - DNA, 4873 bp, Zea mays
  misc_feature (3344)..(3344): n is a, c, g, or t
ctttttttattaagtcctagcagtttgtttccgacagatgttgtcccacgaataattatttataccgacagatagtctatcacaatagctacaaatttttgccgacagtttgtttgacaccaaaatactatatgccgacggatgctgtgatggtattatgttgcgacagactggctgtcgccaaaagcctatttttaccgacaaatgtttgtcgctaattttatgtcatggtatagtggaatataattaaaccaccccatcttcattattaattcgatgacatatatatatagcagcaggcacactatatgcatgctatctaaatataatgtttggactggacatatttattaggcgttggtcttggaggaggagcttggaggccaggggtggtgtgggtccttgacggtgcagcagcacttgaagggcgcgacggcaggctcgcatgctgacgcgtagttgctgctgccctcggcgcgggccttgtcccggcacgagtctccgcactttcgggaacctgggaaacggttgcagtcgtaattcacatcggtgcactccttcttaccgatctctgccgacacaagagcggacgccatcaggacgacagcgacgaacacttgaagggcggcagccatcgagcgtgtactgcacgcacatacaatacaatggctgagtagtcgtgtaccctgacccccgttttatttccttatatacagaaggaacggccacatatatctatctcatgcacatgtacattatataatttatttatgttgatctcaatctactacatatctctatttcttaatttctgctatacatatctgatatctatctgtccctgactctctgtatatgtctatctacagatctatctatctatcctaatctaatctaatctatctatctatctatctaatctatctatctatctatctatctatctatctatctatctatctatctaatctgatgctcaattgacgaggatgctcacatatagaaactaaacccacagaattaataatgtggctctggtgctgggtttttattcacgactgctttattgttccatacatcatcacactatgacatgccgaagttacgctttgatttatagcaggccttgtttcgcttgagagaaactgaataagctcgctttttaataggcctggcccaagtatacttgctccgtaaaagatttgacacactgtttgtttccttggatgaccatctataccgaacatccaaatgaaacaaaaaaaagctgctagttttttcaggggatagatttccatgacttgacattcaaacagcgtacgacagtgtgatattcattcattctactgaatctgcacgcatcgctcagagaaagaacacacacactcacacaacatgcaggtaggcggtcatcatgcatcgagcacccggcagcagcaggtggggtagtactgtcccggcgtgcagtaggtctggaagttcttgtagttgttcttctggcagtagtagaagcacgtctcgtctgagcacggcacgatcgcgtggcagtagtctgtacatatgcatgcattgaagcagaatcaggccaggaaatatcaaagcattacttgcatgcgtgcgtgcgtgctgttttctgctgaactacatacaataatatgcaatatatatactactggcctgatgcgttgcaagatgataagaacatggccatggcgaccacaagagctgctaccgccggcaggaggcggctgctggcggtgctgccctttaccttgacatggtgcgccatggccaccaagtccccttctcgatcgtcgtctattgatctctgattggatttgcaaatgaaatgatatatagcgagccaggtactgccagtctgagaaacgggatatcacctttaccaccataaccttctatcgtatcgcaagtaaatcggataccttaatctcatatggttggaatgtcatttaccagcggctgcatatgctatgctactctttgcttttttatgagatagatctgagggtcaattttggctgcaaacaaaatacaaaataaagtgatgattcgatattctcccctcctctccacttctttccctttcatttccctttccatatggaccgtcgtggccaaaagacggagctgatcacactagtggacccgcctatcctaccattaacatacaataaccattaacagcttactgtacatgtttacacactcatgcatgataacaaaatatattacatagaaagcatgaagcaaatggcatgggaaacaattaatagctacttgattggaggaggaggaggaggaggagaagagaacccttgtcctgtttcttcccaagaatctttcaatatcacaagcgcactcgctacactcaccatagccggtctttcattaacattgtccttcaaacacctcatggctagtttggcaatttcatcaagcataggtatatcttcttcagcagcaatatccttgtcaaacaactccttcccagtgttattatcatctgcttgttcataaacactcttaaactgcctgacgatgctgctttcactaccatctacagcgggccttctagagatcagctccaagagaacaatcccgaagctatagacgtcgctcttcggagttaacctccctgtttccttgtacaccggatccatgtaaggcaaacaccctaccacattcttggtatagtccttgcccaccacagaaaccttggacagcccaaagtcggagatcttcgggaccaacccgccatccaggagtatgttgtctggcttcacatctgcatgctgtatgccattttctgtgtacgaatgcatgtaagccaagccctgggcacacccaatggcgatgtctaggcgtgacctaagcgtcagaggctcacgcggctggccatcgtcgttttttccatggagaaggtccttgagactccctttggcagcgtactcgtacaccagcagtgggacatcgacccgcaggcagcagcccaggagcttgaggatgttcttgtgcatcatccctgactggatctctacttcctccacaaacttgtccagcgtacctttagtcacctcgatcgaggccttgacagccacctcggtcttgtcgggtaaaactcctttgtgaacctcgccaaatcctcccttgccaagaggcaccgagttgttcatggttattttgtcgagttcctcttttctgaatatttgtagagtcctcacgtttttaagcttctcgcttccattcttcctttcgatcgcttccagttctatccgcttcagcatatagcataccccagtcccaaggataatgaaaaacaatanggaagcaccaacagtgattcctgtaaataaaaaacaaacatatttacataaattttcatatattagctagggaagaagaagtttaaataatcaagattcatgtgtgtcaatacctatgataagcttcgctgaagtagaaagttttggacggcacggcttttcctttggatcaccatcactctcatagccagcacgacagctgcattcgtaggatccttgggtgtccttgcactcgccattgcatgggaaatcagtcggccgcgcacactcatctatatctgcaaaatgtgcaagagtgactactatatccatagtatgtactagcttgtttgtgagaaattaagaaggaacagagacttgtgcagccgtcgtcagggccggtggcgtagggattgcccgcgtatccttgggagcatttgcacaggtacccaggcccttgtgtggcgttgacacagtagctgttggaactggcacatgctgatgatgccgactgacaagaaccgttcctgatggcccagtccagcacgactgggatagaacgcttcccgaccctgctagcgaatgtgtctgtgccgttgcgaagaagatctcgccggctgaatctgtacctagaacaccacataacaagaagccaattatttacattacatgaagtcacattgatatagtatttattgcttaccatcctttctcagccaagaaggcatacccacaggggctgtagctccacgcgttgtttatgggggtttggactagattgttcttccagtagatgtggacgtagctaaggtttcccgccaccctggtctggcagcagccgagcccggtgcagtcgtcgccgtctccagcggcggcgtccagggtgatgctggaggtgacgcagccggtgtagtaggtcaggtcctccctgccttccatgaacgccagcgtgttgcctccgatggccgtgaactggttgcccgtcggcgagacgaggaacggcgacccgctgtagttgaggtaccagcctctcatttcgtcggtggtgttggacgaggcgaagcagatggacgcgaaccccgagaaaatccgcacctctcccgtctccactgagatgttgatgatctcgtacagatggtggttgtcgtaaaccgaaaggtatggtcttggggggctgtagctatggtcgcaagtgacggtgaagttgtcactgccgcctggccaggcacagtcgtcgccgatgccaaacgggtaggtgatgttcacctcgccacacgtgctagggcagccggaacgtggagccgagctcggtggcggcatgctgttggcaacgacggcggccgccagcaacagtaccaccatgtggaaaggtaccgtgaccagtggtaccagaagccgcatccattgtggcatggtcttcaggtccatatgtttcagtcagtctctcgctcaattcgtgtgtgagtgagaggaaacagattgaactgggatctaggtttttatagggagtgattatatatataatctagatacctagattatgataatcc

SEQ ID NO: 7992 - DNA, 2479 bp, Zea mays
  misc_feature (957)..(957): n is a, c, g, or t
gaacgcattgattcacacccacctatacgccacaactgatttagcgtgctccattttgacgtcgtcctgaacttacagtagtgctgtttctcaggtaatattgactgtgctagattggattattttcaaataatacctggaatcactttacttaagggatgctattggttctaaaatgaagtttggcaatccattttacagcaactagggaagaagaaagaagattccgagttctctgtacatttgaagtcacatgacacggtcatttacacattatacacattcaggatgcatgtacttacattagatttgtcgaggggttgatgttttttcacctcatcctgagttatttagtcctagctacggattcaagttccaggtccaatcgtctcatcaggcatataggattgttatccagcataaagagacctcccattattttgtggagacaggcatgggtatgagtctatgagaactttggttgaatcttctgtattgctactctcttttgcatgctctctatgttacatatgttatttgaatatctgtcattgtactgtaaatatttcacagttagacagtgatgggtaggatggccaatagcattggccatgccttgttggcacagctggattacgtgtcagtttgacacttataagcattgttccttgtcaacccaaacagggatgacggtgacaggtgatgtttattatgtagtaacgcgtagttccaacgtttgaaaatggttgtgggcctgtcggaactcggaagtcgactccctttaaaccaaaccgatgtattgtactttaacctattactcgtatcagttttgtggaatacacaacagaattagcactgttgggcgttctaaatagaaaacaacataatagtaagtctgctttatttgaagcatcatgctatttgtgctgagaaagtcaatctctggaaggaactgtntcagactggttttgtcatggaatttcttttaaacaagaccattttgacaggaaaaaaatgcatcgcaacacatacacacttctcaaatcgtgattgaccctgagagttcttctgttatcttgtatgtcgacacagttgagtgaattacatttagctgactctgcgccttgttctcctgcccaggttgtttggtgctgtgaatgacatcttctgcttgttccaagggcacattgagaacattgccaacctgaagcagcattatggcctgagcaagactgcaaatgaggtgactatcctcatagaggcctacaggaccctgagggacaggggccctgtcccagccagccaggttgtgagagaccttagtgggaagttcgcgttcatcctgtatgacaccctgtcgaagtccacctttgttgctgctgtaagttcacctattgtaatccacttgtttcttgaaccttacctttggttggttgtggcttgagccttgagttgcaatggctcatatgtttagaggctacaggaccctgagggacaggggccctgtcccagccagccaggttgtgagagaccttagtgggaagttcgcgttcatcctgtatgacaccctgtcgaagtctacctttgttgctgctgacgctgatggtagcatccctttcttctggggcgttgactacgaaaaccaccttgtgttctctgacgatgttgggatcctcaagacaggctgcggcaactcgtacgctccatttcctaaaggttgcttctacaccacctccggtgggctgcagagcttcgagcacccgttgcacgaggtcaaggcggtgccacgcgtggacagccaaggccagatgtgcggctccatcttcaaggtcgacagcgagagcaagaagaagcaggacgctagcatcccccgcgtcggcagtgctgccgactggtccaaccagttctgaccatcttcttgccatccattgtcccggctagtacgaggtgcagagctgtgtatctgatgaatccatgagacgatttctgctacgtttcttgcacgcttgtcgaacactgtgagactcacatcgcgctcatctacgctacgtgtaactgatactaatgatacggagtgttccaggtggtggtagatgtactgcagaatctatctcccatgtttcaataaacctgaataaggtgctcggtttggatctatgcatttatgattctagtacttctgaatcgaaaaaaaaaaaatacattcctttttcttcttgttctcctgttctgcatttcagttctgtctggcggacggttacccgttaccgtggtagttgggcaactgggcatacggttgttaggaccagctcggtccgtgacaaccattgaacaatactgcatgggttctacttagctagggtgtattagactcgtcttattaattaaactattgttacggtttctatatatcacatatttagatattgtttaaatgtaatagttgtttaaacacgtttcaaaccttgtaatgagcaga

SEQ ID NO: 7993 - DNA, 1277 bp, Zea mays
gggtacctcgaggccggccgcgcattaagagtttccgtgccgtagcaacagacaagggagagtgggagactagcgcaacaggacagcgcacggaaagcgaggggaggggagacggagagggcgcatcggacggcggcgagatgctggcggtgttcgatcccacggtggccaagtgcccggagggtctccgcagccccccggtcgccggggcggccgctggagcaggcggggccggcgcgggcgcgctgatgaagggcttctccgactcgcacgacggcgccgtcaccgtcagcctgggcccctccggcgcgctggcctactcggcggccaaccagagccccctcgtgccaaggttgtttggtgctgtgaatgacatcttctgcttgttccaagggcatattgagaacattgccaacctgaagcagcattatggcctgagcaagactgcaaatgaggtgactatcctcatagaggcctacaggaccctgagggacaggggccctgtcccagccagccaggttgtgagagaccttagtgggaagttcgcgttcatcctgtatgacaccctgtcgaagtctacctttgttgctgctgacgctgatggtagcatccctttcttctggggcgttgactacgaaaaccaccttgtgttctctgacgatgttgggatcctcaagacaggctgcggcaactcgtacgctccatttcctaaaggttgcttctacaccacctccggtgggctgcagagcttcgagcacccgttgcacgaggtcaaggcggtgccacgcgtggacagccaaggccagatgtgcggctccatcttcaaggtcgacagcgagagcaagaagaagcaggacgctagcatcccccgcgtcggcagtgctgccgactggtccaaccagttctgaccatcttcttgccatccattgtcccggctagtacgaggtgcagagctgtgtatctgatgaatccatgagacgatttctgctacgtttcttgcacgcttgtcgaacactgtgagactcacatcgcgctcatctacgctacgtgtaactgatactaatgatacggagtgttccaggtggtggtagatgtactgcagaatctatctcccatgtttcaataaacctgaataaggtgctcggtttggatcaaaaaaaaaaaaaaaaaaaaaaaaaaaaaaaaaaaaaaaaaaaaaaaagaggagcagctcgcgatctagaacaaaaaaaaaaaaaaaaaaaaaaaaaaaaggggggggccgtttttaaaagaac

SEQ ID NO: 7994 - DNA, 4930 bp, Zea mays
ttctgggatagtgttatggtatagtctaataagcctaagatgtttgtacataggatattgtttatgttgttactaattaaggttaattattacaggtgactgtcttaattgaggaacacacttgtacttccagtgctagaaggaaaaccacgatccttactagcgcttgagtagcatcaaaggttgtccatctcttaaaggagttgaacatgggtctgagggagctgcggaaaaggttggaagaaaaatataagtgtgaaatttactgtggcatccacggttggaagatgggagattctggaacaggggcaagattggaagagcgtccacggtaatcgcgtccaacgtcttcacaggcgcggttacgtcaatagagacaaccatgcattcgaagtaccaaagtggcgatatgtgttcagagtaccaaactggcgaagacaaaaggcagaggtattataatgccaaataactcaaagtagcatcatggcgccccgatgcccatctaggttgcctatggcggtatggcctgtcctagcctctcactcaggtgaccgcaacccttccacagagagcaagcgaatggtacacaagaatttgttatcagcgaagtagacaaagtaggatggccccgaattcttttgacttgagctataggcatcatcaccgtcaccatcctagacccttgtagcaacaaaaacgagggtgctttttttttttctgacacgagaaaatgagcgccgttggattatcttcacctttcactccccctctttctgagatctgctttttaaacactgattgtatgatggtggttgcatgcagcctttggccgggttcgtgcgcctgacacagacacagatctggagacagatgggttggctacttcctcctccagtggtaagcacaacgctgtaaccagctcacagttttggattcttactagtgtctcaatcgatctgagagcaacctgaccgccctttaaaacgagctagtgttgttaagcttctgcagcctttgccgagcggcaggacgacgaagcggaggagttgctgtgcggggtgaaggaagaggagtcggctcaggtacaagaaccggccaagaatccggcaggacgtcccaccccactaccccaggtactgtattaatcttgagtcttgcaatccgttgaattgtgcggggttgcagttgcccattttgtatgcttgtatgttgttcgaaagaatgccacaaccaaccagtggtaccacactgaggttattgttcttttgcatggtaggaaggggtcgaaacagcggccggccccggccttacttgacctcggcagcactgggttaattccacggagccacgttttctacaagtttcgtgattggtggtgtggggttgatgaacaaaggacttgaagcattactcatccggtcagacgtgtttcgtagaccttgacgctgagctatcggagttgggtttccaaaaaaaggtggagctctgagagagttccgcattcttctaaaggaagtaggagatacccaggaagcagcatggcattttcttacagcaatgggaggacattgccctcgaaatgggaggatgcagagaggtggatcttcagtcccaattccagcgacatgcgtggaagaactacggttgctcatggtcggaggccaaagtctaaaagtggccccctggggcctccaggaagacttggtggacagtattcatctgtttcttcggtgtcattgcttgatagtgggagagttggacctattacatcaaattcccatttttcagcaggagtactaatgccaggacatgtttgtggaggaaaaaatacaaatggggcctattcaggtagaccaattggtgacgaaatcaacattggagaaggagtcagaatttgtccactgaatggtgggtctcatcctattcgaactcccagagttcgcaagcgattagattctgcagtcgaatcatctgcttcattgcctagcacacaagaatctatccaaggtatttaaaaatggtttcttgtgcacagagtgcatatccatcattatttttagttttagcctattgtttagtattgaaatttggtttagtagtaattagcaaagcacaaaacactttgtttgagttatcatctatgtttgttgaagcatagaaggcatgaattgcgttatgaaaccattttttttcagtaacaagtcggaagttatttaccttaagttgtgcagcagatcttcatagaaagttatcatattgtagactgaaaagtcagtaaatcttgacccgttgcctttttgttgttgccttgttcagacgagcaggttgaaatcacagaagattcagcttcaactattgcctgtataatttccaggaaagatgttgcaacacagaccagcccagagctaagtaggtcctcttcacccaacaatagaccaacatttaatcgttccctgtcgacggaacaaatgaaagagagggggagctgtttctcagatcttgatatcagggatgttcagatggatgatcgagtgactctgactaggtggtcaaagcaaaatgtaacacggttgcctaacaagaattcaacaaacataatagagtggaaggaaaaagctgtggaatcaaaatctttgtcctggggctttgccgaagcgaagtgcatatccaagtaagagatcacagatcactacatattcaattattgtgctgcttgaagcctaatttcctaatacttgttaccttatgtgtcatgaaatcttctgtaatgcttatctggtctaaatgtgtccaagccttaaccatctctcgagtttttttttaaacatcagtgtatatttacaccaacaaattgtgaaagctgataatctctacaatattataaggattggtagagaggacacaaaaattactgcatgggaaagtattcaaaaagcaaaagctgaggcagcaattcagaagttaatggtatgttctttgttctatttcaaactgtgttgcgctatttttaactgaattgatggtaggattgtttacaggacatcttatttatatctaatgtatctagttaaccctgaattgtacacacacttctatatctataatatcagattaagatggagaagaaaggatcatcttcgctggataagattttgaacaccctcaagtctgctcagagaaaagcccaggtgatgcttgagcatgagcttgatgcagtaacagcaaaccaagatggaaaaggctctaggaaggcaaaaaagggagcacagcgtagcaagaatggccaaatcagttccctgagtggctgcttcacttgccatgctttttgatacatgtaattccaaaactgagtaagttgcaatcagactgttaatgtgcattgaatgtatttttgtattgcattttcaggcaatttgatgttctgttccttgaagcagcatctataccacacactttctgttacataaggcaatacagtggcatgccaactacaacgaaattgtcaatcatccttttgcctataacacgacgacagactcatatttgcatactgtgctagaagttccctgactagtgttcaaatttgttgtagccgatgtgaacttaccatggttatttttacattttgcagattgtgctagaagtgctctattgatgtatacataatttttataattattcccacataaagcacccaatttttcgtatgtggaactttctgtacgacaatatatccaggtctttaggttgtaaaattacgttcgataatatactttcatctatcgatgacttgaccgtaaatacaagacgcatttctaaggcttttagtgttacttgtggtcaaatgcggtgtttttcagcaccagtttcattttcctagaactcatcaagacattttaattgcaggaatcaggatctgagaaattccttcgtactgcctacatcaccgtcatgttctccacatcgaaatctaggtgaacttcagatatctatcagatgtcagtacataatacgataatcccacagctggaaatcagactcggatctttccaagatgctagctgcaggctcttcatctgccatgatagggataatgcaatatctgcagtgccgctctgtgttagtttcgattctgccaatgagacagagaaaatggagcacgaaggaaaaggaggaacggttctgcgtacacctcatgtgcccggttgatgtctcctttatcattgtgtcattacctggcctgccttgtagctaggcactgctgatgtcgatcttgttgccaaaaaggctgtatggatcatacattcacacaaagtgcaattccattccaagatacagcgaaatcttcaggtacgaggagaaagcatggcctgcttgtgcgtgtgactagttgggcaccctgctgggtactggaatggaaccacgctcccttgttgcttttgtttggtacagtgctggttgttgctacctatatttgctttacagcagcgtcggtgtgtagctcttttaggaaactgagatgttggtttggcctggaaacttaacaatatcgtcacacacatatatgtacatatggggatgaagatatgatcgtcagtatgccatcctttaaaaaaaaagattctcattttacggcaggggttcatctgaaatgttagggagtgtttaaatgcactagagttaatatttagctgctaaaattagttgaagatatctaaacagtcttgctaatagttcaactattagctactttaacaaattagttaatagttagctatgtatttgttagctacctaattttgctaaaaattttgtagctaactattaacatattcttcacttgcttgcctcccatattttacattatcttcgagtggaccatttggtcggatcggataagatcctttcgttatagactctagttatcaat

SEQ ID NO: 7995 - DNA, 1163 bp, Zea mays
  misc_feature (1)..(1): n is a, c, g, or t
ngaagatcagcttcaactattgcctgtataatttccaggaaagatgttgcaacacagaccagcccagagctaagtaggtcctcttcacccaacaatagaccaacatttaaccgttccctgtcgacagaacaaatgaaagagagggggagctgtttctcagatcttgatatcagggatgttcagatggatgatcgagtgactctgactaggtggtcaaagcaaaatgtaacacggttgcctaacaagaattcaacaaacataatagagtggaaggaaaaagcagtggaatcaaaatctttgtcctggggctttgccgaagcgaagtgcatatccaagattggtagagaggacacaaaaattactgcatgggaaagtattcaaaaagcaaaagctgaggcagcaattcagaagttagtgattaagatggagaaaaaaggatcatcttcgctggataagattttgaacaccctcaagtctgctcagagaaaagcccaggtgatgcgtgagcatgagcttgatgcagtaacagcaaaccaagatggaaaaggctctaggaaggcaaaaaagggagcacagggtagcaagaatggccaaatcagttccctgagtggctgtttcacttgccatgctttttgatacatgtaattccaaaactgagaatcaggatctgagaaattccttcgtactgcctacatcaccgtcatgttctccacatcgaaatctgggtgaacttcagatatctatcagatgtcagtacataatacgataatcccgcagctggaaatcagactcggatctttccaagatgctagctgcaggctcttcatctgccatgatagggataatgcaatatctgcagtgccgctctgtgttagtttcgattctgccaatgagacagagaaaatggagcacgaaggaaaaggaggaacggttctgcgtacacctcatgtgcccggttgatgtctcctttatcattgtgtcattacctggcctgccttgtagctaggcactgctgatgtcgatcttgttgccaaaaaggctgtatggatcatacattcacacaaagtgcaattccattccaagatacagcgaaatcttcaggtacgaggagaaagcatggcctgcttgtgcgtgtgactaattgggcaccctgctgggtactg

SEQ ID NO: 7996 - DNA, 1071 bp, Zea mays
gcacgagaccattacctagaacacatgccctgccatgcatggtcagtgatctcctcctcctccttttcctctctctctctctctctttctctcactcccgcgcgtacctgttgggaaaaaaaagtacctactacagcttggctacagttttgataaactacacacacatggacagcagtcagcagcagcagaaacaagacgacgtcgacgtcgacgtaatggaggtcccggaggtccacggcgacctcctcatggagctcctggacgcgtccctcgccgccgagaacgctgcccaccaccaccaccaccaccaccaccaccaacagcttggtctagcgcccgacggcgacggcgacggcgactgttggatcgacgacaaccaagagaactacgacaatatgcacgcgcaccagggctgcgaggactgccgcggcctcctcgacggcatactgtccgacttcgacgactacgacgggggcccatcacggccgaggtccccgccggcgccgtaccgcgtcgtcttcggccacgacgacgacaccctgctggagctggagtgggcggaggaggccgccatggacccgttcgccaccagcgagtccgcggggggctggtacatggacggcctggtcatggccatggcgtgggacgagcagcaggacggcggcggcttcccgttcgagccctgctacggatacgaaggggaggcgggcgccgccgggcagctctatgatgccagcccgctgtgggagtgagagtgaagtagtgtacccggttacgtcgtcgatcacacgtgtccgcgtcgtctgggccgtgccgcgctgccgcgccggcctaactactcctccgtactttacttttgcgccgcttttgcaaatttttttgaggatatgaatttgctgaagagaactggacttgtgtgcctcttgtgctcattagtgttgtgtggctcagattatcagaagcattctagtttttgttctttgttttattttttttgtttgaaagctttgtgctaaatgaagtgcattgtccaaaaaaaaaaaaaaaatactcccggcggggctcggt

SEQ ID NO: 7997 - DNA, 842 bp, Zea mays
ggggaccctcgggctcggccgggccgggagtgacgcgagcctgtgtgcggcccgctttcgttcgccggggccccgacgcgccgcgacgcgacgataacgcccagttcgtggaagattggaagaacactagagcgagaagcgatcagagcgaggcacggcgagggcgacgacagagccatgagttaccagaaggtcccggagtcctatccgccaccagggtactcgcagccgtacccaccgccccaggctccaccgcaggggccttactacccgccgccgcagcaaccacctccggggtaccagggctactttaacgacggccagcaaccctacggctatccgccgccgcagggtgggtattaccatcacggtcaccaccaccataacgaccaccatcaccatcatcatggtcaccaccaccaccaccacgaagatgatgactgctgccttggcttcttgaaaggatggctggccgctctttgctgctgctgcatgatggacgagtgctgctgctgctgcttctgacatacatgcacctgaagctcgctgtgtctgggcatcgtggcacggcaacatttgagtgattatggttgctggatagtgtttacttgaattttctctttgttattgttcgtaaataatctgaatagtacatcgtgttaataaaagggtatttgcagtgtttctttctgtgtgttctgagctgattggtcgtccatggaaaagacccggaatcctttcgtagatccctgtatcgttgaataacatatttgttttttttttcaataataccagttgtttccatcggaccaaaaaaaaaaaatctaattcatccatatagc

SEQ ID NO: 7998 - DNA, 1444 bp, Zea mays
  misc_feature (1408)..(1408): n is a, c, g, or t
  misc_feature (1426)..(1426): n is a, c, g, or t
ggtaccctcgggtttggccgggcttgccgtgttctggatctcctgcgaggcaggtacctacgtccggactctctgtgtgcaccttgggctgctccttggtgttggtgcgcatatgcaggaactgcgccgtgtcaggtcggggatcctcggggagcaggacaacatggtcaccatgcacgatgtgatggacgcgatgtggtctctcgacaactacaaggatgagtcatacttgaggcgtgtcgtgatgccactagaggtactgcttactagctacaagaggcttgttgtgaaggactccgctgtaaatgctatctgctatggtgctaagcttatgattcctgggttactccgatttgagaatgatattgagaccggggaggaagtggttctcatgacgacgaaaggggaggctatcgcgattggtatagctgaaatgactactgctgtgatggcgacctgtgaccatggtgcagtttcaaagatcaagagggtagtgatggacagagatacatacccaaggaaatggggacttggcccggtggcactcaagaagaaaaaactggttgctgagggtctacttgacaagcatgggaagccaaatgagaagacaccaactgagtggcttcggaatgtggtgcttcccactggtggtgatgtttcaattgccagcattgcagctgctcctgagccagagaaggtgaaggtggagccggacacagctgtgactgaagaggtcaaggagaagaaaaaaaagaggcagaaggatgatgctgagggtactgatgcttctgttcctgcgaagaagatcaaagttgaggaagccactgaagcagtggaaggggagaagagtgagaagaagaagaagaaaaagaaagacaagggcgagtcagagccagctgaggtcgttgagggcaaggaggaggttgctacgggtgacgagaaggggagtgagaagaaaaagaagaaaaagaagagcaaggaagcaagtgatgctgcagaaccagagagtgctcagattggagatggcacaggtaccgagaagagtgagaagaaaaaagagaagaagaagaagagccgagatacagaggaggcacaataggtgtagtttatgttggctagctacccttgtttagagatgctgggaagtttgagatgcagatgcctttcagatgctggggaagtttgagatgcctttcttggttgccttgtatctgttgcaactgctatgcctgatgtaccatccttaggttattgctattctactgcttaaaactgatatgccaagtggtggcattttcattgaaactcttgaacagcgatggttgtattgttgtttcacttaccagataatgcaatgagttttgttttgctctcaaaaaaaaaaaaaaaaaaaaaaaaaaataaaaanaaaaaaaaaaaaaaaaanacaaaaaaaaaaaaaaaa

SEQ ID NO: 7999 - DNA, 1402 bp, Zea mays
ctactttacacctcctcttcttcttcttcctcgtgcagcagctgtccatcgccgctgggttttctttgttggcattgggttttggaggagaggtcaaggctgagactcggagacgaaatgggtcataggatgttcagtcccttgggcttccttcttcttgccatcgtcgtcctctatggtggaacagagcagaggcgagcggaggcagcagaaggagggagcccgcacaggctgctggccaccatctcggtgtccaagccgtcctaccccacggtcaccacgcccatgtcggcctacggcgacccggtctccacgccagccaccccgtactcaacgttcccgtcgctggcgaccgggaacggcggtgccggtgccggtgccggtgcaggcggcggtgctggtgtaggcgggggcggcggcgggggcgctggtgtaggcgggggcggcggcggcggcgggacgtggtgcgtggccagccagagcgcgagcccgaccgcgctgcaggtcgcgctggactacgcctgcggctatggcgccgactgctccccgatccagcagggcgggagctgcttcaaccccgacaccgtccacgaccacgcgtcctacgccttcaacagctactaccagaacagcccccccccaaccagctgcgacttcggcggcacggccaccatcaccaacaccgatcccagttcagggtcgtgccagtacccatcgtcaagcggtggcgctcagagcacgatgccgccgccgtccccgacgagcatgccgccgacagtgcccaccgccccgatgaccccgacgccgatgacgccggacaccaccccgaccaccggcaccccggtctacggattgtccccacccgactacggctcattgtccccacccgactctggctcgatgtcccctcccggctacggatcgacgtctcccccggactacaacgacgtcggcgccgccgcgacgacggggcagggcggcgcggcgctggcgctggcgcttctgtgcgtcctggtcgcgacagtatctctgcacgtctccaaatgagagcggcggcataggaggaaattatgcatgcctgtttcggttgagacgttacatggcgcgccccgtgcgtggtggctgaaagacgcacgcacaggtccatcgccgaggatctccggtggtgtgctgcccggcgccgggggagcattcgagcagtgttgcaagtctgcttagtgttgtataagaaatgaggcgagcttctagcagcgcccgagttctagcagatgcaccagatgtttatacatacatacatacatgcttaaatatataatggccattccactaaaaaaaaagaaaatttgtttccttgccctctccatttgctcatgctaaataatatagttatgattaggtaagc

SEQ ID NO: 8000 - DNA, 2805 bp, Zea mays
ctctgctctgcgctccgcttcccaccgctcctccccctgccgtctctcctaccacaaagccgcggcccgtgggcgctgttcgcggcggcgacgggtctctcatctcctctaccctctctcgcgcgcaacggcctaaaaaaaccctagcgactcggtcggtgctcgacttggatcgtgccggggggcaggggcagctctcttctctcgtcgtcgtccaggacattgttgacaacttgatactggattttcttccttctcgaacctgtagacggctctgctttatttgattagagcttatatggtctgaatgctacaactgaaactttgcacctaaaacctgaggccaagttcactactttattatatccttccatacacagaaagtggagagacatggatcgtgatgacatagctggtttcgtcagtggaggttgctatgagtcctgaatttctaacccagtatatataacagagttatgatatccagaaggcagacaattgtttcttttcgttttcttgttggtttgcacttgatgtttcataattggaatggataaaactactcaaggccttgagtttggtggtggtatcaactctccgaagccatattgctattggagcacaactcaagacactactgtgcacaaagatagtacaccagaggcatattccaccttttctatttccaactcaaaagcgtcaaaaaggaagcaaggtgccatgtctggagcaaaaggtggaaaccctttactcactttgggtctaggctgctcaccaagttcatcttataacagcaagctaagttctggcactgcttgcataacatcatcatctctattaaaggagattgatgaagagtcttcaatagatcttggccttaaccttgggttgtatattggaaatgatattggacactgccaacagaaatcccatgctggttttgaaaatgtgctctcgacaaactctcctaaactggatcttcagttgagtttgtctaccagttcgcctgaatcagttgtcattgatacaaatagatcaccagatggcttggcgatgccgatggccaattcaccactcgccattgtagaagaaggatcagtaccgcatagttgggttttcgagcattcaattgtttcgtcatcacatgcttctaaggcaacgcatggctttccattatcaaagaaaaccaatggaggcaatgcctctgtgccttctcatgtcatgtcatcaactatgtttacaagtgtgaaaggtccagttgcctctgcttctgagacaactaactcccaacaacgcaacagtaacgctaaaagctgtcagtttccaggatgtgtgaaaggagcaagaggggcatcagggcgttgcatagcccatggcggcggtaggcgttgccagaaacctggttgtgagaagggcgctgaagggaggacaatctattgcaaggcccatggtggaggcaggagatgtcaatttctcgggtgtacaaagagtgctgaagggcgcacagaccactgcatagctcatggtggtggccgccgctgcagccatgaaggttgctcccgagctgctcgtgggaaatctggcctgtgtatcaagcatggtggtggcaaaaggtgtcagaaggagaactgtaccaaaagtgcagaaggccattctggattctgcattgcccatggtggtggaaggcggtgccagtttccagactgcacaaagggtgctcagggaagcacaaagttctgcaaggcacatggtggaggaaagcgctgcacattcgtcggatgcaccagaggggctgaaggcagcacttcattttgtaagggccatggtggaggcaagcgctgtgcctttcagggcggtggcgtgtgcccaaagagcgtgcatggtggcactcagtattgtgttgcacatggtggtgggaaaaggtgtgctagctttggttgcactaagagtgctagagggcgcacagagtattgtgtgcgccatggaggtggcaagaggtgcaagttcgagagctgcaccaagagtgcgcaggggagcactgatttctgtaaggctcatgggggaggtacacgatgcctgtggggccaggcggacacaagctttggtgctggtgcacagcaatgcgataaatttgttcggagcaagaccggtctctgctcagctcatagtgctttgatccaggaccactgtgttcatggtggtggtacattaggttccgctatctaccagtctgtgcatgtcaaacctactgagatgatcaatggtgataaaactttactggatccggctatccctgttccaaacagtggtgttcatcctcctgtcctagctcagtctatgatcgatccgctgccagagggcagagttcatggtggtggcctgttggctttactttcgcggggcggaagcagaacaagcgctggtggctcagaattgtgcttcgggcaagatcgtgtggatctgaggctatcaggatctccatgaaactgatgactgcctgcagttttgatccaaattgtgttgctcatgctcgggttccataggatctacccggacgtgtactgtgaatctacccagacgtgtactatgaaaataagagggtagctcctagagcagatgtgttgttttattttagttaattgtttcagtgcatgtaatcacttactttaatgctcatgtttggacttgattaactctcagcaacttaaggttgaaatataatgtgcattttgctttttaaaaaaaaaaaaagcttaaaaaaaaaaaaaaaaaaaaaaaaaaactcgagagaagggccgcggtacc

SEQ ID NO: 8001 - DNA, 2793 bp, Zea mays
ctgcagctcccgcccgaccaggcccccggctacaaggccacctaccacctcagcaagaaggccgacgaggctcgcgaagaggccgcgggcctcaaggacaaggccgacttccacaaggtcgccgacgaactcgtccaggtccgcttcgaggagatgccgagcgcgccggtcctcggcagggacgcgctgctccacgagctccacacctgcgtccgggacggcgacgtgggcatcgttggcatctacggcatggcgggggtcggcaagaccgcgctgctcaacaagttcaacaacgacttcctcatcaactcccacgacgtcaatgtcgccatctacatcgaggtcggcaaggacttcgatctcaacgacatccagaggatcatcggcgaccggctcggcgtgtcatgggagaaccggacgctcaaggagcgcgccggtgtgctctacagagtgctcagcaagatgaacttcgtgctgctgctggacgacgtttgggagccactcaatttccggatgcttggcatcccggtgcccaagcacaactcccagagcaagatcgtcttgacgaccaggatcgaggatgtgtgcgaccgcatggacgtccgccgcaagctcaagatggagtgtcttccctgggagccctcgtgggagctcttccgtgagaaggttggcgaccacctgatgagcgctagccctgagatccggcaccaagcgcaggcgctggccatgaagtgcggcgggctgcccttcgctatcatcactgttggccgggcgatggccagcaagcgcactgcaaaagagtggaagcacgccatcactgtgctaaagattgccccatggcccccccccccccccccctttgatgttcttgagcctctcaagaagagttatgataacctgcccagtgacaagttaaggctctgcctgctatattgctcattgttcccagaggagttctctatttccaaggattggatcataggctactgcatcggtgaaggtttcatagacgacttgtatactgagatggatgaaatatacaacaaggggcatgaccttcttggtgatctcaagattgcctctttgctggagaaaggtgaagatgaggatcatatcaagatgcaccctatggttcgtgccatggctctgtggattgcatcagatttcggcaccaaggagaccaaatggcttgtccgtgctggagttgggctgaaggaggcaccaggcgcagagaaatggaacgatgctgagcggatttctttcatgcggaacaacattcttgagttgtatgagaggcctaactgccccttactgaagacattgatgctgcaaggaaatcctgggctggacaagatatgtgatggattcttccaatacatgccatctctcagagtgttagatctgtctcatacctctatcagcgaattgccttcagggatcagttcattggttgagttgcagtacctggatttgtataacacaaacatcaggtcacttccaagggagctaggatctctatcgactctgcggttcttgcttctctcgcatatgccgctggaaacgatcccaggtggtgttatatgcagcctcacaatgctgcaagttctgtacatggacctcagctatggagattggaaggttggtgcaagtgggaatggtgttgattttcaggagcttgagagcctgcgtaggctcaaggcgctggacatcacaatacaatctgttgaggctctggagcggctgtcacggtcatatcgcctcgctggttccacaagaaacctactgataaagacatgctcgagcctgacaaagatagagcttccttccagcaacctgtggaagaacatgactaacctgaagagggtgtggattgtcagctgcggcaacttagctgaggtaatcatcgatagcagcaaagaagctgtgaatagcaatgcgcttccccgttccatcttgcaagctcgggcggaacttgtcgacgaagagcagcctatccttccaaccctgcacgatatcatccttcagggactgtacaaggtaaagatcgtctacaaaggcgggtgtgtacagaatctagcatcactgttcatctggtattgccatgggctggaagagctgattactgttagtgaagaacaagacatggcggcaagcggtggcggaggacaaggttcggcagcgtttagagtcatcacacccttccccaacctcaaggaactgtacctccatggcttggcaaagttcaggaggctcagcagcagcacatgtacactgcacttccccgcgctggagagcctgaaagttatcgagtgcccgaatttgaagaagctgaaactctcagctgggggactcaacgtgatacaatgcaacagggaatggtgggatgggcttgagtgggatgatgaggaagtcaaagcttcttatgagccattgttccgcccattgcactgaactcagttttggttgctagagattcttctgttattttagaggttgctcttccccgtgcatgcagtagatcgcgtgaattcagagatggccagtctgcactctgcagtgggtgtgattgtttgtattgtccatcttgcaagtacaagttgggcgattctttcttttttacccagctcgtgttctatagaaagaccagtcagcatgtgtggcagccaggaaactggcagatgtaactgtcgaaatctcctgaacagaatggctggtggataccggtacaaccattttctctaattctcaaacccccaaacctatgagaaaaactcgaggaaggggcgcggtacc

SEQ ID NO: 8002 - DNA, 2126 bp, Zea mays
  misc_feature (2038)..(2038): n is a, c, g, or t
aggatcccgttctcagtcgccagccactggtcacagccaccgtctccctccttccccaacctcgccgctatcaggtggtggatgcagcagcgcggccgctccttcaacagccgctctcggagcttctcccgcgcccgcgtcgccatcgagggatcttaatctcacagccatccctcgatcatttcgtttgaactcggttctgaaattctgactgacgaacgcacgcaacgacctaccgtgatggacgccgccgccgccgccaccgttgtttctcttaacgggaagatgggggccgaggagaggaaggcgcagaagagctactgggaggagcattccaagaacctcaccgtcgaggccatgatgctggactcccgcgccgctgatctcgacaaggaggagcgccctgaggtcctgtctttgcttccttcatatgaaggaaaatctgtactagagcttggtgctggaataggccgtttcactggagaactcgctaaaacagctgggaatgttcttgctctggattttattgaaagtgcaattaaaaagaatgaaagcattaatggtcactacaagaatgcatcctttatgtgtgctgatgtgacatcccaggacctagtgcttcaagctaactccatcgatctgatattttcaaattggttattgatgtatctttcagatgaagaggttgaacagctagttcagagaatggtaaaatggttgaaggttggtggctatatcttctttagggaatcttgcttccatcaatctggagattcaaaaaggaaagttaatccgacacactatagggaaccaagtttttatactaaggttttcaaagaatgccatacctttgatcaagatgggaattctttcgaactttctctggttacttgcaagtgtattggtgcttatgttaaaaacaagaaaaaccaaaaccagatatgttggctatggcaaaaggtccattctacagaagataaaggatttcaaagatttttggacaatgtgcagtacaaagccagtggaatattacgttacgagcgcatttttggagaaggttatgtgagcactggtggagttgagactacaaaagaatttgtggacaagctggatctcaaacctggacataaggtgcttgatgttggatgtggaattgggggaggtgacttttatatggccgaaaaatatgatgctcatgttgttggtattgatctttccataaacatggtatcatttgcacttgagcgtgccattgggcgcagttgctcagtggagtttgaagttgctgattgcactacgaagacatacccagacaacacatttgatgtcatatacagccgtgatactatccttcacatacatgacaaaccctctttgttcaaaagttttttcaagtggctgaagcctgggggcaaggtccttatcagtgactactgcaggagtcctgggaaaccatcagaggaatttgcagcgtacattaagcagagaggttatgacctacatgctgtggaggcttatggacagatgttgaagagtgctggttttcgtgatgtcattgctgaggatcgaactgatcagttccttggtgttttagataaggagttagctgaatttgaaaagaacaaggacgatttcctgtctgacttcacccaggaggactacgatgatatcgtgaacggttggaaggcaaaactgcagaggagttctgctggtgaacagaggtgggggctgttcatcgccaccaaatgatgatgcagatgtgagatgtgcgtggacgtgaaaataaagcatccttttactataattgatgtcgcattagttattctgaacccaggtagcctgggtcagtacctactaccctgtttatcataggacgtggagagaactcgtccagttttacattcccgtcactgctttgccggagtgctgtggcaatccataaaatctaataaagtaacaataagctgtctgcaactgcaaaaaaaaaaaaaaaaaaaaaaaaaaaaaacaaagagaaaaaaaataaactaatataaantatttaatattttttttttatttgtaaatttttattttattatcgtataaatgtttttttttaatgtttatttaaatatattttttaa

SEQ ID NO: 8003 - DNA, 5847 bp, Zea mays
ctgtttttgctattgatgggtgcaccggatagtccggtagtgcaccggacatggcactgttcagtgtccggtgcgtgccacatcagctaccccgttggggtttagagcggttgaccgttgaagtcctttgtcttcttgctgcactggacagcctgatgcgttctgacttcgctgctctgacttttgacttctgcattgtgaccgttgagcgcaggtgaccgttgctccattggctcatcggacagtccgatgaattatagtggagcgcctccctgagaaacccaagagtggccagttcgcgaggtgcttggcctgggcaccggacactgttcggtgcgccactgacagcatcaatgctagtctttgctccaatctttgttgaatcccaacttattttctttcttggtttatgttgaactttaagcacctgagataaatgacatctaagcaaactagttaatccacgtggtttgtgatgaacatcaaacaccaaaatcgattatagaaaatgatttacgtccatttccctttcaagaaggatagtgtattatataagacttaacaagaaaatttaatgataaaatgcaagaatggccttttatagattatcatagtttagatattcagatcaataagtataaaataaacataagcacaactgtctatttaatctatttttccataatacggtcaagataattttgtatattttcaggaaaaagttgaattgatatgagtttccattatatgtcaacaagtcaaacaataagtttctacgtagagtcgcaccagaaagaatgacgatgcccatgcccaagaaaggtgtgaattgggcttttctaaatttcttggaaaagattaaaccctaaacaagagctcaacttcacccaactacttagctgcataacaaaagttaggaattgctaaacaaaccctaagtcatcatggcaaatactaggaatgaaaatactcaaagtaaattgttcaaagtaagtgtggattgcaaagtaagggcaagaaaactcatctgaattttccttgaggtatcgaagagtctacattctccgctagtcatcgttggagcacctgcacgaaggtatagctctcccttagttctcacaaggaccaagtgatcactatgagatgatcctttgcctctccgatgcggtggatccctcaggaccgcgaacaaacttgagccgggtcaccaacaaatcctccagggtgatcaccacgctccaaatcccaccgagtcatctagatgatgccgatcatcaagagtaataagtcatagacttctttgcaactaagctgatgtaaacgatgaatttcgaatttcttattgtgtccacttcttatcccattagggcacatttaaatagaggtaatttgcatccaaatttatagggtttagttacgtttgatggaagtgcccaatttactagtacagtcctcttacaacttattcccttgtattggtccgataatcttttcttgttcgctactatatctttaaacaatgattgcttagttattgatatgtgtaacatcgttttgattgttttcggcagctgcagttgcacagcaaaagcatttaggttgcatgagaactgagaaccgcatttcaaacagacatcagccgtaaggaacttccccaaacgcattaacaaagtaagcattcttgaatcttgatgcattgtcttgaagtttaacaaaagacggatctttgttggatgtgttggtgacggtacctcagctaatgtttggagtgactaatgggaaccaacttgtacctggctgcaaacacattactgatcacaggatgtataaattataattatggaatgcaaagtcgagcgtactttgtggctgacagagcttctgggttgcagttgcaagtagtgactgggtgagggataggttttttttttttttgacatagcttctgatgtgttggcaaatgacaagaaaggatagagcacagagcggcgtccaagaggctgctgtatgatgaacagaaatacttaaagcaaagcacaagggagtttctcgccctctctcgattatgcccaaactgcatttgctcttttgtcctacagcctgaactggaaatcagttgacaagcacaagggagtctgagctattgtgaaatcggacatgtgattgtggccgaagttagggatacaagaagttaactcagggcagaaatctctccgatacaggcaaagaagagcttctctactgaagtctggacattgttttgtctcttttagtatgcgactctgcacttcgatggtccatggggtccaaaaggaaatacaagcttttgctcataggaggttcacagatcgagtcaacatttcaagtgaacccacatcttagccaacagcaggtagactctttaagaatctggagtagcttttgctggtgagccgaagtgatagactcaaagatgtttagatcagattgtcaagtgctccgaaattagtcagttctattctatcatctcaggccagagatgtttttccctttgctgctaaggctcttctgttgaagcagtatggtttccttcggcctttccctcgccagctgcaagcacagtggtcaaccctttgtacttgctgtgcgtccgacgatgccaatggctgccgccaagcaagaaggcagaaaagaaggatgctgccatggaggagggagaaaaggggactgaatcactgaactgagtttcaatctggtaatgtcgactaggtacccgcgatgaggatgatagcaggaagcagcccccatcttttacagcttggaacttcatgagcagctatcggatggctctgagcagttggcgtcttggcgagatgggttccgtaccagtggggttaaaaaaaacaaaaatgaagcaagtatgatgtagcacggcagtgacggcacggcacggatgaaaagcgaacgtgggagagcagtagcaccaacaggataacttggacagcaaactgccacatcacaggtgttgttcacacctcagccttcgccatcatcgtcatggatcacaatacaaagatacccgtaccatcacaaatcttgaaggacaaaagcgttacctgttcatgttctaaaccacgtgtattttcattagtaatcagcaatccacctagcaggtggtataaatagctgtgtaaaatactgttttataatgtggattacaatgtttgtagagttaagtttaaaacataacttagatgtttgtagagtgaagtttaaaacataacttaggagaggtggtgggatagcaagtctgctggatatagtgtaagactaacgggttgtttggtttgctacctaagacgccacaacgtgtctaacttttctatctaaccttagttcttcaattcgagcgactagggttagacagattatgacgccttaggtaggaaaccaaacaggctttaagactaggatgtggatttggcaagttgcacccaaatcaaagttaaccaagatgccatgtgaaaggatgaactccagcaattctcaaaaaaaaaaaaacggtgttgcatccaacagaatatatatatatatatatatatacttgtgaaaaagatggtgcaaataaaaaggggggcaccgggatactctgatgcactactagagaactagaagtccctgaaatatgggccccgtacgacgacatggcctgcgtgccagcgacttcgaattccaataatgcttgtccaaacaaccaaatcagggacgaagaaatgtttgtctttttttttaaagaaatagagtagcgtttgctcaaatcgacatgccgggtataatcttaatccttccctctcgcacaaacacaaacaagctaaaaaaggagaatgaatggtcacggaccaccgacatcaacaagaggacgaacagcacagcaccaaatgaaaaggggaagcctgaaattgttgttctaacaaaactcggtggcctaagcgccaccagcaacaacgaatcgccgaatcatggcggcggggagattaccaccggagcataggcagccaggcggatcgcgggtccgtcgcttcagcggtgcgccgtgacgagcgtctcgatgaagcgcaggccatcgaatcgcggcgcgaaccgctgcccgcggcgaccgccgctatggctgttgtccctcgacgccgacgaggatccctgtggtgaaaaacaggcgcgaacggtaccaattagccaaccctgcttctatttccccccgatctttacttggaatgtaaatcgaggcggaatcgttatccctcctatattatatatcgcgccatacaagacaggggaggccgggagggggacccaggaatcctcgatccgcgggagacgcacctcagggacctcgtcgtcgtggtgctgccgggagagcaccagcccgtcgcacctgccgacggtcgcggcaggggccggcgacggagcggaggcgtcgcagtcgcaggcgaggagctcggcgcccgacgccgccgccacggtcgccgcggaagccacggcggctgccagcccccacttcatctctcctcccccttgcggcggtcggcggcggcgcttgtggtcggcggctggcagactccaaggcgtgtggtcggcggctggtccacgccggccttacgtcgcaggtcgaggtgtgaacacgcggggagcgcttgcttgctggcgacgagtacgggatgtgaaggccagggtttccggccgccccggcgtggggtcgcgtatataggggagggagctagcgtgggcccggatttggcgcgcgggttttaacccgattggaatttctagtcggcgctgtggagcccactggtgggttcgctcgattccagtggcgacccgccagcgagtggaggcaggggatggatggatggatcgcgcgcgattggacggcatcgatcgggtcgtgtcctcgtgtgagtcagtcgctggtggtccgtcaacgcctccacgccgtgtacaatggtctcgtagacgtggcactgccatgaaacggggcaaccggacgccactgtgctgcgcgtgacctatagattggtacctcagcagtagggacagacggggcgaatccagcgccaattttgccgtggtgcaccttaatggctttggaagcgataaaaccagagatggttgtagggctaaatttctatttttatttaaaattaaatataaagcgaaaatttaattctctaatctattctggttttatggctcccaaactagttcttaatattagtttcggagccacaagatgagaggagattagaagggttaaaatcttcttcttatttaaaaatattttgctattgagaaaggtgaacgtggcgtcgcccctggggctagatatcgagctatctcggttcggctcatccaagttcgagctgctcgttaagctaacgagccacatagttggctcggctcgtttaagagttcgagctggctcgtttagttggcaagctagagcagaaaaaaggaatatgtatataataatcaatttctaattaattttaaaataaattaataatagaaaatagtaattatactaagttttatagaccataacaatgtaacaacaaattaacacaactcatcaattcataattcagacacatgttcaccagtttaacacatagctatattcgcatacatcaacttaacacatagacatagtccatcaattattagtttaactcataggccatacacacgacacatacatataatatgtcatcaattgttacataaatgatatatatatagtttcgttttactaaaatgtgatagctcgtttagctcacgagctggcttattaacgaaccgagcttgctcgtt

SEQ ID NO: 8004 - DNA, 853 bp, Zea mays
ggccgcccgctttttttttttttttttgggacgaagaaatgtgtgacattataaataaagaaatagagtagcgtttgctcaaatcgacatgccgggtataatcttaatccttccctctcgcacaaacacaaacaagctaaaaaaggagaatgaatggtcacggaccaccgacatcaacaagaggacgaacagcacagcaccaaatgaaaaggggaagcctgaaattgttgttctaacaaaactcggtggcctaagcgccaccagcaacaacgaatcgccgaatcatggcggcggggagattaccaccggagcataggcagccaggcggatcgcgggtccgtcgcttcagcggtgcgccgtgacgagcgtctcgatgaagcgcaggccatcgaatcgcggcgcgaaccgctgcccgcggcgaccgccgctatggctgttgtccctcgacgccgacgaggatccctcagggacctcgtcgtcgtggtgctgccgggagagcaccagcccgtcgcacctgccgacggtcgcggcaggggccggcgacggagcggaggcgtcgcagtcgcaggcgaggagctcggcgcccgacgccgccgccacggtcgccgcggaagccacggcggctgccagcccccacttcatctctcctcccccttgcggcggtcggcggcggcgcttgtggtcggcggctggcagactccaaggcgtgtggtcggcggctggtccacgccggcctcacgtcgcaggtcgaggtgtgaacacgcggggagcgcttgcttgctggcgacgagtacgggatgtgaaggccagggttcccggccggcctcgaggtacccaatcgcccataggagtg

SEQ ID NO: 8005 - DNA, 2150 bp, Zea mays
aaatacctgttcctgatgccgtgcgtgtgcctttttcactaacatcgtctttgcctttagccgccctgccatagtcagacgttgtccgcttatggccttcgcagtgacgatgctgacgagcgcgtgtgtcatggaccttggcggggtcctgtgtacgtggacactggacagggctgctgcccttgcgcgctgcggacctgcagtggcagtgtgtcagaagtgctggcctcattcttctgtcagggcacggtcaaatgtggggtccaggtcaggggcgcttccgcgcttatataaacaccaccaaccaacccaagtcaccatcctccgcacccgattcacctcctgggaaagtggaagggagggagaagcaaggcaaagcggagccgagggtcaaaggccctcgtcctgcttggccaagcaagcgtcgcgcacgtacgtagaggccgaccggccggccaggttgaagaaggcatggggaggccgccgtgctgtgagaaggccgggttgaagaaggggccctggtcgccggaggaggacctcttgctcgtctcctacgtgcaggagcacggtcctgggaattggcgcgccgtgccatgcagcaccggtacaaccctctgctcagagtttgtcttgtttctttctagactagatggatggtgccatggtggttgttttatgtcggcgattccttcactcgttcccgctgctgctcttgttcatggacgattgcattgcctaggtctgatgcgctgcagcaagagctgccggctccggtggaccaactacctccgcccgggcatcaagcgcggcagcttcagcgaccaggaggagaagctcatcatccacctccaggagctgctcgggaacaagtaattccactccgttccactccaagaacagctagtccttcattcgcagaaactcctatatgtgattcctcctcagtagagagccctaaccaccaactgcttttttttactcgatcaggtggtccgcgattgcgtcgtacctgccggagcggacggacaatgacatcaagaactactggaacacgcacctcaagaagaagctcgccaagacgggcgccagggaaagcggtgccagcgccaagacgacgaagaagagcgatagggccgcggcgcccaaggggcagtgggagcgacggctgcagacgaacatccacaccgcacgccaggcgctccgggaggcgctgtccatggacgacactgcgccgccggcaatcaagccggagccgctgccgctgccgctgccgctggggcagctgccggcgccagccagccaggcgatgtacgcttccagcatcgataacatagcgcgtctgctggagggctggatgcgtcccagcgtcagtgggaatgcgtcagctgagtccatgtcctccttctcggcgttctccggtggtggcgacggcgcgtcggcaagccacatcggcacggcgcacacgccggaggggttcaccggcacgagaaaggaagagggcgcggggccggggccgtcgtcattaccaatgttcgagaactggctgctcgatgacggcatggggagcggtgatgcgtccctcatctgcgtcccgctggcggacccgtgcgagttcttttagactgaactggagggggataaggaaaaacagaataaaagtgctaggctggaagaagaagaagaaagaagccaggaactcgattccctgataatatagatcgacacagtgcaatgctggtcttgatatatatagtatagttgttcaatccagttccttgcttcttatttctatgaatttggattttttttttctattctcttttttgtttacaaaatttgggtttgggcttggtcttgttatgtatgtccatagttatcagtcctacacaggatgatggattatgattcatcatgatgtgtgcattagaagcaaaaaaaaagaaatctacttcttatataagattaccaattcctatagaatgtaagcaatcttttgtttagtttaggtaggttattaagttgcatgtagcaactaattcaacctaaaaaaattaaactgataagaagaggtgaacaagttacttatattatattctaacgtagatttctataaatggtataaatgaattggaagttaaattatatggacg

SEQ ID NO: 8006 - DNA, 1173 bp, Zea mays
ttcgggtaactctcaaattggctattgctgatgacaaaaattgtgaaggtagaataatcataactactcgtaaatgggaacttgccaaagatgctagctgccagcactttttcctgatagctcaaggaaattattctatacaagaatatatggtgataaaaacttcagtcttggagaaatttgaagtgtccaacggtccaaggcgagtgacaggcagggcgactcgggcggccttccatccgccggaccgccgccggcggcttccaacctcgccgtcaccggagtggccgcagatggaagcttggcagcaacttcaagcttgcttgaagggcggatagtggatagccgccaggcgctcaccgccgccggctcccgcctccccgagccgcacgccgccagatcccaccctcaggtgccgcccagcgccggatcccgcttcaccgagctcccggtcgccggatcccatcgtcccgagtaggcgccgccggatcctgccgtcccagagcaggcgctgccggatccgtcttccccgaccagcccgctgcaggctccctcctctgccgaccaggacctcgccagtgtgcttctgggacaggccttcgcctcagagagcatcggagaggcggaggcagcccggatctgctacgtcctgctgccgtcgcgggagatccagcggaggctggcccgggacggccgccgtcgctccgtacctcggtcccgccgccgccgccggggtgctgctgctcccgcgcagtccgcgcgtggatctcgtcgccgccgccagggagcctgctgctttcgtggagtccgccagtggatcccgccgccgccaccgccggggagcctgctgtcctcaggagcccgctcggggatcccgtcgctgccgcccgggatcgggatctcgccactgccgccgccgttgggagcctgttgctgttcccgcccgggacgactgcgcaggaaaggttggctatgaccacatcgccgcggcatccgccggaggtccttcctggcctcaagcccacctttcgagctcgtcggctgctcgttctcgagtgcttgtccttgccctgcttcatgtagggccgctttcttccctagattggctgctgccgtcaatggcggcggccggtcttagcgctagcagaggccccgtctccaacagccgtccgc

SEQ ID NO: 8007 - DNA, 5121 bp, Zea mays
  misc_feature (599)..(599): n is a, c, g, or t
ctgatgccctgaacattgttccctctgtagggtactcactgttctttatttttgtgcatgttattttgttgtttactgctgctgtgagtagttatgcacacatgcatatatctgtcatcacgtttattgtgctatattttttattaaattgaatttgaaaatgcctaaattcctaacattcactaccgcgctcatctgagtaggtcactgttttgggcaatttcggttgtccattttgtgatctgtttgttttcttgggctcgtgtatactctagaagcttttccaaacattccaatcgctagctgttttttgcgtttttggtttgatcatcttcttgatttccattgaagtaaagagccaagtttagcattttggagaggtttatcccttgaacttattttgatcattttgtgtgcttcgtggtgtttactagtcatcaccgagaacatctagcctcataagaactatcattatgactagcaacaccaacataagaattcatagcacttgcaaaataattattagaattataagatatatttacaagttgtacttgtacctcgggctaattatagtagtattatggtgcaacaccttngtactccatgaacatgatcgtcttgctaaaattttgagtgataggagaaacgcgttacaaaaccacaaacaagatcataagttgtcaaaaccagatgcgatcaaacttttgggctagatgtgatggtaatggcaaccacatgaagataaatcaaagagattcagctataaagtagagctaaaacggtcttcccaaacaaagtagccaaaaagtgtgttcacgcaaagatcgatcatacactaactctgactaaattgcccgagctaccatagatcaaagaacacatgaggtaaccaacataattttacggcgaagagcggcgaggttcacaagcaaatcagcaaaagatagttatcacatttatgtggccaagaacaactagttctcgagcaaactagcagaggaaccgtcgaagctctcatacgaaagggaccttgtcaaggcaaggacatcgatggatagctataggtccatcaacaagactagggcgtcgaatcaaacgataaacaacatgaggttgaaatagattagagcaaaatgaggaatatatgtaaaaagagcgattggatgctagcttactcaatcggatatgatcatccaatatatatacatacatagagatagaaagagggagtaatcttatctattagaaaacctttccaagacgtatttttcaagtttttccatgagtttaaaacagttcatatcggaatccaaaaggtcagatccaaacatggtctttttttatatttgtcgaaagttcggacgtccatcgcaacttttgaactccgttaggacttcgggcatgggaatgatcctagacattgaaataggtttttgaaaaaaaatggatatgggtcagaattttttatgttggagtatcttttcgagagcgtaactcatttatttagactctaaatcgtatatatatttcgaccatctcaacaagcgactctgaatggtgagactcagttcatattttaataataacctcacaaaatgtttttttttacaaaatgaccaattttgtcaccgtatattgctgtctgggcaaatgcacgatgcttatctgtttccttgtgggggtagaggcagatgacaaggcgatgagcatttatccggtccggcatcacagaatggaccacggagattgcaagatgcaataactgaaagtggaccatgaatctgcgtctcattgacggatactccgatagcgaccgattctgattattggaaagtaaattcagaacggtaggtcctgatgactcgatgtggatgggcttgttgtatcattattgaactccagaagaagttttacttccccgtgaagcaaagctgatcgatgtaaattactccggcagcagtagtagtcctcttgtctttggctgcccgtctgtcttggttgactctcagtttcacgatttcatcctagacgtgcacaataaataaacttgcataaacaattcaaagtgccctgtgaatgactcggttaattttccttgggcagttgagcacttgagcatgagctgaagggcacaagaacgttgacaagctcgaatctcgaagctgtagattcaagaaaaccgaacccaaccaaccgccagccttgacccacgcgacgcgatccccgagctcacgccgtggcagcgcatgcatgcacgagggtccaagtcatcgccggcgccctggcccacccatcgcccatccaacggccgcccgcgtcgcgacggacactgtcagcttccgatccgcgtggcacgagaccattacctagaacatcctaatcgaaaaagggctctacttggacggggtgaggagaggcgaggagagcagagcaggcagccgacgacttccccacgcggaggcgttgcttcccggtcgtccaacgcctggcatcccttccttctcctcacccagcagcagccggtcggcctcggctagatctcgccggccgcctccaattggttgtccactgtggccgggccgaggggtacttatctataggcccgcagatctgcgcctgcgcccgtgggaatctccgcacctcgctatccgtctcttggatagatcgatcttccgtcgctggttccccttcgccccacacgagtacttccaaggaactggaacttccagccggcacggggattcgagcttctgctctatcagcaactccactgggcgctgagggtctgtagcagagcggtgcgatcggggcagaagggagccatgatgagggggcaggcgtggctggcgctgctggtcgtggtggcgctggccttggcggacgcggcggcggggaggttcgtggtggagaagaacagcctcgaggtgacctcccccgacgagctcaagggcaagtacgagtgcgccatcggcaacttcggggtgccgcagtacgggggcaccctgcacggatgggtcgagtaccccaagtccaaccggaaggcgtgccagagcttcgaccagttcgacatctcgttcaagcccaagcaggctgggggacgacccatcttcgtcctcgtcgaccgcggagaatgtttcttcacaaccaaggcatggaatgcacaaaatgctggagctgctgcagttcttgttgtggatgacaagtcggaacctctaatcacaatggacaacccagaagaaggcaaagagcacctagaaaacatcactattccctcagtgcttataacaaagaaattgggggaaaaccttaagaaatccgcggaaaatggcgatatgctcagcgttcttctggactggagagaatcccttccccatcccgatgagcgtgtagagtatgagttctggacaaacagtaatgatgaatgtggtcctaaatgtgatatgcaaatggacttcgtgaggagctttagaggaactgcacaaattcttgagaaaaagggttacactcagtttactcctcattatatcacatggtattgtccagaagcttttgttgatagcaagcaatgcaaatcacagtgcatcaatcatgggagatattgtgcaccagacccagatcaggattttagccaagggtatgatggaagaaatgttgtggttcaaaacctacatcagatttgtgtattcaagattgctaatgagactggaaagccatggctgtggtgggattatgtgcatgatttcgcacttaggtgtccaatgaaggataagaaatacaataatgactgtgcccatgatgttatcaaatcacttggattggacatcgagaatataaacaagtgtgttggagaccctgaagccgatgtggaaaatgaaattctaaaggcagaacaagatgcccaaattggtcatggtaaaaggggagatgtcacaatactaccaacccttgtcatcaacaacaagcaatatagaggtaagctggacaaagttgctgtcctgaaagcgatctgttcaggatttgaggagacaactgaacctgctatttgtttgagcgaagagattcaaacaaatgagtgtttggagaacaatgggggttgctggctggacaaagctaataatgttactgcatgcaaggataccttccgcgggcgtgtttgtgagtgccctattgtgagaggtgtaaaatttgttggtgatggatatacccattgtgaagcttccggtgttggtaggtgtgagatcagtaatggagggtgctggcaggaaactaaagatgggaaaacaatctctgcctgctcaaacgaaatatctgaaggttgtaaatgtccaatgggtttcaagggtgatggagaaaaaagttgtgaagacattgatgaatgccaagagaaactttattgtcagtgcaagggttgcagctgcaagaatacgtggggaagctatgaatgcagctgtggtgatgacaatatgctatacatgagagagcatgacacttgcatcagcaaagagggaactgccactactgttggctggagcttcctctgggttattttctttggacttgtttttgccggggttggagcatacgctgtgtacaaatacaggctgcggagttacatggattcagagatccgtgccatcatggctcagtacatgcctctggataaccaagaaggagcaaaccagcatcaggtcgtgcacgccaatgatatctgaagctgcactccttttctgaagcagaaatagagggggcgtgcaacatttcacttgtgctgctgcatcattgggtcatgggttttacaggtataggtcaactaggctcaaagatacacaggttatgcgagatcaagatctactgtaccatgaattaagatttaagagagagacgttgtgcgcctcttgttacgacacttgatgaacagcatagggaatgataccatcatagttttagtagtccttcgttgccttcagtttgtcttcaaagagttcttgttgcctcttcacatacatgtaaacactgtaaataccgttacctgaataaagcttcagcctgctaggctacaagcagggttcactgtacgtgtccgaacatgtgatttattacaaaaatctttcaaaaaaa

SEQ ID NO: 8008 - DNA, 2762 bp, Zea mays
caccccccgcgcgcggaggcgttgcttccaggtcgtccaaagactgcatccctcccccctctccagtcgccccccagaacacaagcaggcagcagccgatcggactcggctagtttcgccggccgcctccaactggtcctccgctgggcgcgagggctctttctctaggcccgtagatctgcgctgctgcgccctcgttgtcgtgaaaatcactatccgtctcttggatcgagcgatcctcccattcgcggcttcgccccacacgagtcgttccaaggagccgaaatttccagcccgcccggcaggggcaggcggtacggggattcgggctctgccctgcttttatcagcaactccactggccgctgaggttctgtaggagggcggtgcaccggtggggccaggggagcatgatgagggggcacacgtggctggcgcttctggtcgtggtggtgctcgcgttggcggacgcggcggcggggaggttcgtggtggagaagaacagcatccaggtgacgtcccccgacgagctcaagggcaagtacgagtgcgccatcggcaacttcggggtgccgcagtacgggggcaccctgcacggattggtcgagtacccaaagtccaaccggaaggcgtgccagagcttcgacatctcgttcaagcccaagcaggccgggggacgacccaccttcgtcctcgtcgaccgcggagaatgcttcttcacaaccaaggcatggaatgcacaaaacgctggagctgctgccgttcttgttgtggatgacaagtcggaacctctaatcacaatggacaacccagaagaaggcaaagagcacctagaaaacatcactattccctcagtgcttataacaaagaaattgggggaaagccttaagaaatccgcggaaaatggcgatatgcttagcgttcttctagactggagagaatcccttccccatcccgatgagcgtgtagagtatgagttctggacaaacagtaatgatgaatgtggtcctaaatgtgatatgcaaatggacttcgcgaagagctttagaggaactgcacaaatccttgagaaaaagggttacactcagtttactcctcattatatcacatggtattgtccagaagcttttgtcgatagcaagcaatgcaaatcacagtgcatcaatcatgggagatattgtgcaccagacccagagcaggattttagtcaagggtatgatggaagaaatgttgtggttcaaaatctacatcaaatttgtgtattcaagattgctaatgaaactggaaagccatggctgtggtgggattatgtgcatgatttcgcacttaggtgcccaatgaaggataagaaatacaatcatgactgtgccagcgatgttatcaagtcacttggattggacatcgagaaaataaacaagtgtgttggcgaccctgaagccaatgaggaaaacgtaattttaaaggcagaacaagatgcccaaattggtcatggtaaaaggggagatgtcacaatactaccaacccttgtcatcaacaacaggcaatacagaggtaagctggacaaagttgctgtcctgaaagcgatttgttcaggattcgaggagacaactgagcctgctgtttgtttgagcgaagaggttcaaacaaatgagtgtttggagaacaatgggggttgctggctggacaaagctaataatgttactgcatgcaaggatactttccgtgggcgtgtttgtgagtgccctattgtgagaggtgtaaaatttgttggtgatggatatatccattgtgaagcttccggtattggtagatgtgagatcaacaatggagggtgctggcaggaaagtaaagatgggaagacaatctctgcctgctcaaatgaagtatctgaaggttgtaaatgtccagtgggtttcaaaggtgatggagaaaaaagttgtgaagacattgatgaatgcaaagagaaactttactgtcagtgcaagggttgcagctgcaagaatacatggggaagctacgagtgcagctgtggtgatgacaatatgctatacatgagggagcatgacacttgcatcagcaaagagggaactgccactactgttggctggagcttcctctgggttattttctttggacttgtttttgctggggttggagcatacgccgtgtacaaatacaggctgaggagctacatggattcggagatccgtgccatcatggctcagtacatgcctctggataaccaagaaggagcaaaccagcatcaggtcgtgcacgccaatgatatctgaagcggcacgccttctctggagcagcatggaggcatttcacttgtgctgctgcatcattgggcatggggttttgcaaataggtcaaactaggctcaaagatacacgggttggtgcgaggagatcaagatcatcaactgtaccatgtgttaagagagatacgttgtgcacttcttgttacgcacggcacttggatagcatagggggatgaagatgataccaccattagtagaccttcgtttccttcagcttctcttagaacttacgggttcttgctgcctcttcgcatacatgtgaatactgtaaataccgttgcctgaataaaagcttcagcctgcaaggctacaagcaatataccaatgttctgactctgaagcactggttttacatgtctctacgtgtatatgtgtatgtgatacatgacagattactttcgctgcttctgtccgacgctatcaatcagaattatttgtgt

SEQ ID NO: 8009 - DNA, 1090 bp, Zea mays
cccaagattgagaaaagaagatctaagagggacctatggagaatgtggtcagaaatccataatagagtccgaccacaacgaccgaattaattatcctcatcgagaaacttagactactttagactacttaagtagaaaagatttgaaaatcatggcatgggtctcctttttttctttctttagagttttctatatgcacaatttctcgatgtttcgatgagaatttcttgactttccatatatagaaagagatagactataaatgacatctcttatgtcaataagaccaaaggaatggatattaaatgataggaagtgctaagaagtgaaatagaatgaaatagagccactttgggcttccctatgaaatgaggcatggaacggagccactacgaagaaattccgggagttacgaaagaagcttcggactcatattgttcacgggttgagagcgggagttgaactctaggaggtcgaatctccccttgttcctcagtagctcagtggtagagcggtcggctgttaactgactggtcgtaggttcgaatcctacttggggagatttgattcattctttaatgtaagaataaagaattgaattaaaaggcttgctttgacccttaggagtaggtaacccgttcgctatccttgtttctattgcattctgtctcatcgtatcacattctgttctacgattccacttcgacaaaaggaaagagcatacccaagttcaatagctttacgtccgctattccgatcatgattttcctaccctcagggagaaagtaaaggtccttccccctttggaaggctgtgggcgaggagggattcgaacccccgacaccgtggttcgtagccacgtgctctaatcctctgagctacaggcccaccccgtctccactggatctcttcccggggataccccccaaaaggaaccttcttctccttcagccatttcatttcgggttaggaagatgggaaagcgcctttctctctataagaacagtgcgttctgaggtgtgaagtgggagagaggggatgattgaggttttgaataagacgacctttgcgttttggatttggatctttt

SEQ ID NO: 8010 - DNA, 1402 bp, Zea mays
acacgccatacccttctcgcaagcagtcaagctcctcccccaatccttccccgatgctgcggcgcaacagcgtgtgcgaaaccgagtccgaatcccgacgcgctccggctcccttggagcttagattttaggtgtgagctgctccccctgtatggatccagatgttctcgtggagccgtaagcagtcctcctccggctcgtcctccggccgccgccgcggcggggcggacgcctccatggactccagcagccgcggcggcggcgggagcgggagccgcggacggagcccgcggttggatcgccgcaacgcagtgaagcgcatcgagtacgaggcgagcgcgggggcgtccgcgtcgtggtcgtcctcgtcctccgcggagcagcagcgctcgccggggctccggccctcgcgctccctggaccttgcccccggcgcggacctccgaatcagcgggagcgtggagggggaggtcgacgagctctgccgcagcctggggctctcggggcccgaggatttcgccgtccccgtcgcggcctgggaggcgcgcaagtcgcggtctaactccgacctcctcccgcgctcccgcctcgacccgtccacacccgccgacgaaacctcgccgattgcgcgggcggtctcggcgcccggtgctcagccgactcgctccttccctgcccccattcccgaggagtcactccactcttcgcctgcttccaccgccaccgagtcggcggaggagcctaccgttgcggcgcccgaggagtcacccaacgctgcccctgcctctgctgtcgtggctcccgtcgggggtttgcccctgccttcgccaaggaggggaggcggggaggtagggatacggggtgcacggccgcctttactctccccgcctccgccaattggtgcactagctcctccgccagttaggaggtccttcgttgacaatgacatgactgggtccgcttgggacattgtgcagtcgtttgctcccagggatcagggaagtgaactgggactgggaggaagtgtcgacagtcgttgcaattcggacaaagaggaagagaatgatgttgaggatggggacgcagcggtggagggcgagctgaaggaattgaggataggagagactttcgaggggttcactggaacttcttcattgtcgacgacgaatgatgatgacgcgtccagtacaaccacggaggccatgttcatcatttcaccgaatggcaagttcaagcggaacattaaatcatggatgcgtggtgctcttctgggaagcggctcatttgggatggtgtacgaggggatcagtgagtaagtccccgtgcttatgaatattactgtgatatcatgttgtttgcataattactttgttactcatcagtcacctcaaaatataagcct

SEQ ID NO: 8011 - DNA, 4224 bp, Zea mays
  misc_feature (1413)..(1413): n is a, c, g, or t
  misc_feature (2314)..(2314): n is a, c, g, or t
cgccggagtcactgctgtaaacagcaatacaatctggatctctcctcgcatacacacaaaggccagctaagatcgagtataaacatactatgctagttgaggtaaacgacgtaccgtcgctcagtcacaggagtgtttagagctggctctgacaggaacgtcacatgagtaaacaactccagagagccaatggacttgccacgtgcggtcacctcggtgctagctgccacccgcgtcacaccagaattcactccgagcaactcagacagacagtgagccgggtgcccggatgcatgggaggcgtgcgctgtcgcgaacatgatgctcgcgcatcgcgccagcatcgccgtggcgcctccgcaggtgggccgggaacacatgcgcgtcgctgtcgagcgcgtaaacaaacgcatgtgtacgtagtgtacgggccacgccggagaaggcagaacgtcaggcggtctctcgcgcacgaaacacagccagcgacaggtccgttctccaatcaatattacatgcgaaagtttcccaatcaatattacctatgacatataggaccccattaattaagacgtatgacagatctctataaaattaagtaaaaaaattaagaaatggactatctacaaagagtttgtctatttatgactttctataattattattttttaactgtatttatgatctaatggttcagagaccagagttgtaccatacattctcttaggacatgtacaacccaattgaatgaggtgttttgagaggtctctagcagactaactaataactattgcactagttaaatcaaagtagctaatatctaccaacagtacttatgatctattagcttgccaactgttagcagctagtgaatccaaacaaatcctaattgtcaaactcataaaacctattgattggtttatcaaactaagccctataaactattagtagctggaggatcaaaacatggctgcaataatagcttatctaatagcgccacaaataaattgatattagctgatttcctccttaatagcaaatagtaacaattagcagactttcgaccttaagattgtctccagcagatcgtacagatgatcatatgaaacaatgcttatattataaactcagagtttagttcgaaacacaagataagatgagaaatatgatggataaacgtctaaggccacctgttcaaccaaaatccccacgtgctgctttccgatccaaaggctttgttggattcggagtagcgtctgctgtgctatcgcagattcgcagtaccggaggccggagccaggcagccagctccttccaagtgttcttgcctgcctcaccggcaaccgtgcgccgtgcgcgccatagccgttgacactcgaccgcgcggaggatcaggcaggcagcacactgacntcacatccacgccaacggcagccatttactgtgtgttcttccactgacgcccgggccctaagtgggtccggctcgacccccttctttaatgctccacctcttggtcgtcgtagtcaacccgcgtctggacagtcgtccgccacttccttaaacccacccaaggatcagccagccgcttgcctccatgtcccttccactcgcccgtgcgtacctgcaggcaacctcatgtgtatattgtagcaaagggaattttcacttcccaccactacgccacggcagtacggcgcacgccatagcccttcccgcaagcagccgagcaggctcctccccaaatccttccccgatgctgcggcgcaacagcgagtgcgaaatcgagtccgagctctgacgcgctcgcatggagctctggttctaggtgtgggctgcgctcctcgtatggatccagatgttctcgtggaaccgtaagcagtcctcctcctccggctcgccctcgccctcctcctcctccggccgccgccgcggcggggcggacgcctccatggactccagcagccgcggcggcggcgggagcgggagcgggagccgcggacggagcccgcggttggatcgccgcaacgcggtgaagcgcgtcgactacgaggcgggcgcgggggcgtccgtgtcggtggccgcgtcgtggtcgttctcgtcctccgcggaccagcagcgttcgccgggcccggggctccagccttcgcgctccctagaccttgcccctggagcggacctccggatcagcgggagcgtagagggggaggtcgacgaactctgtcgcagcctggggctctcggggcccgaggatttcgccatccccgtcgcggcctgggaggcgcgcaagtcgcgctctaactccgaccttctnccgcgctcccaccccgacccgtccacacccgccgacgaaccctcgccaattgcgcgtgtggtctcggcgcccgatgttcagccgactcgcttcgtccctgcccccattcctgctaccgttgcggcgcccgaggagtcacccaaggctgtccctgccgttgctgttgcggctcccgtcgggggtttgcccctgccttcgccaaggaggggaggcggggaggtagggatacgtggtgcacgaccgcctttactctccccgcctccgccaattggtgcactcgctcctccgccggtgaggaggtccttcgttgacgatgacatgactaggtccgcttgggacattgtgcagtcgtttgctcccagggaacagggaagtgaaccgggagagcgtttggacactcgttgcaattcggacacagaggaagagagtgaggctgaggatggggtggcagctgtggagggcgagctgaaagagttgaggataggagagaccttcgaggggctcactggaacttcttcattgtcaacgacaaatgatgatgatgcgtccagtacaaccacggaggccatgttcatcatctcaccgaatggcaagttcaagcgtaagattaagtcatggatgcgtggtgctcttctgggaagcggctcatttgggatggtgtacgaggggatcagtgatgagggtgcttttttcgctgtgaaggaagtatctttgcttgaccaaggaagcaacgcacaacaatctattgttgcacttgagcaggaaattgcactcctcagtcagtttgaacatgaaaatatagtccagtattatggaactgacaaggaagaatccaaactctatatttttattgagcttgtcacgcaaggatctctttcatccctctaccaaaagtataaactacgagaatcacaagtctctgcatacacaaggcagattcttaacggattggtttacctgcatgagagaaatgtggtccacagagatatcaagtgtgccaatatattggtgcatgcaaatggatctgtaaagcttgcagattttggattggcaaaggaggttaccctttgtctttctgttcattatttccatgttcgcagtgtcaaattgtcttatggttgtagtttttttgttcaactttcagatgtcaaaaatcaatatgctaaggtcatgcaaaggaagtgtttactggatggcacctgaggttattaatcctaaaaagatgtatgggccttcagctgatatatggagccttggctgcaccgtgttggaaatgctaacccggcaaataccatttcctaatattgagtggacaaatgctttcttcatgattggaagaggggaacagcctactattccctgctacctgtcgaaggaggcacaagatttcattggccagtgtgtaagagttgatcctgagagccggccttctgcatcacaacttttggagcacccattcgttaacagaccactgcgggcttcatttgaatcttcatctcccccagccatctgattgtactattgatatagtggggtgtttctcgttgtgaggccaatgcgcaggtcacgtgttgatcgtcatgatttacgctactggttccagaatagaattatgtgggcgtgttagtttagtatttgtagtccatagggtttggtaggcagcattgctgtgtttttgtattctttgggtgttcttcatcaggcatagggttttcttcctggttactacgtagatttgtgtacacttgtaggtaaaagggttgcaaacttgcaattgcctctggtgtagggttaggcagttagccgatgtttgtgaatattagacatcaccattctttacttaatggtttgttgaagcgtcaaaaaaaaaaaaaaaaaaaaaaaaaaaaaaaggcccctaaaaaaaaaaa

SEQ ID NO: 8012 - DNA, 1559 bp, Zea mays
acgcaaatcggcaatccaccaaagattctccccgacccggtctgttgtgtttgccccctgcccggttggcccctggctctccttctgccgcccggccgccccccgccccacccaatcctaccccgcggggggaattctctctcagttctctcggcgacgactgggagaccgccgccgccgccatcctactccaggtgccctgagaactcgatcggagtcttcgctggcgacgaacacccaccagctatcaggtgtacaaccatgtacttcaccgtgtccgcccctgcaatgtctctatgatcctccagctacggtagacgccccgttcgctagctgaggacctcctggttcctgtgagcaggcggcgtggttagctgctgccttcaagcatgcagagacccaatgcgccgtcggcttgcgctaccatcaccttcgcggaggctctaaggagggagatggagtaccgcaagtgggtggagaggacccacccacatctgctcgtcggaatctgcggagcccctgaaatgcagagagatttcagtgcaggatcagtacctgatgcgatcaagagaaaactagctgccgagaccagtgtgcctccacaacaatcaagtttcagctgtgtaactggacagaagcagccccaaaactggtaccccacaaagaaaaaggtgaaagttccacatcttccgtcgcagattctgcagtgtcccagaccaaacgtggtgccatccttctggtgcaaaatctgcaaggtcgactgtgtcaccgagttcaatttcagcgctcacgttggaggcaaaaagcacaaggccaaaaagctagagattctaggtaagaggaacgctggggggcctgctagccgatgcgcaggcaacaggagcgctggacagagtggacttgcagtttctgggagcagaagcagcgaacagaatgtggctggcagcgttgctgctggaccgaactgtgacatgtcgtctgagagcagaactaatggaacagaaggaaatgggtgcactgtccagctatgagcagcttgggtttcactcccgtctggtattccaataaaagttcgccttgcacattttcttctcaagggcacagtcaaatggctaggccgctagggagatttcatctgatggattggactgaacaacactagtcagataataagttgaaacgtatgcaatgtcctatgtgagagcagtacattgtttggacatgtatctgacagcagatgcatcctgtttcctttcgcttccttctcgaaaatgtacagtagcaagccttgttccggtaggaggtggaagttcaggacgctgttctgattatgtactactagatagttataatgtatgacatcatggcttgtttgttgtttccatttcttccttgtgattgaagatgatgagggggactgtagcgtgtgccaaactggccggcactgtaggccttcgttacgtactagaggacatatctggtgtacatgaaagcttagtgcatatggtgcacatattaaattatcactatcaatctcagatccaaaaaaaaaaaaaaaa

SEQ ID NO: 8013 - DNA, 1379 bp, Zea mays
ttgggtacctcgaggccggccgggcaccaaagattctccccgcctccccggtctgtgtttggctgtttgtcccctgcccgagttggccgcgccgggcaaaaaattccgcccaccccaaaatcctaccccgcgggggggattctcagttctctcggcgacgactgggagactgccgccgccgccatcccaggtgccctgagaactcgatcgggctcttcgctggcgacgaacacccaccagctatcaggtgtacaaccatgtacttcaccgtgtccgcccctgcaatgtctctatgatcctccagctacggtagacgccccgttcgctagctgaggacctcctggttcctgtgagcaggcggcgtggttagctgctgccttcaagcatgcagagacccaatgcgccgtcggcttgcgctaccatcaccttcgcggaggctctaaggagggagatggagtaccgcaagtgggtggagaggacccacccacatctgctcgtcggaatctgcggagcccctgaaatgcagagagatttcagtgcaggatcagtacctgatgcgatcaagagaaaactagctgccgagaccagtgtgcctccacaacaatcaagtttcagctgtgtaactggacagaagcagccccaaaactggtaccccacaaagaaaaaggtgaaagttccacatcttccatcgcagattctgcagtgtcccagaccaaacgtggtgccatccttctggtgcaaaatctgcaaggtcgactgtgtcaccgagttcaatttcagcgctcacgttggaggcaaaaagcacaaggccaaaaagctagagattctaggtaagaggaacgctggggggcctgctagccgatgcgcaggcaacaggagcgctggacagagtggacttgcagtttctaggagcagaagcagcgaacagaatgtggctggcagcgttgctgctggaccgaactgtgacatgttgtctgagagcagaactaatggaacagaaggaaatgggtgcactgtccagctatgagcagcttgggtttcactcccgtctggtattccaataaaagttcgccttgcacattttcttctcaagggcacagtcaaatggctaggccgctagggagatttcatctgatggattggactgaacaacactagtcagataataagttgaaacgtatgcaatgtcctatgtgagagcagtacattgtttggacatgtatctgacagcagatgcatcctgtttcctttcgcttccttctcgaaaatgtacagtagcaagccttgttccggtaggaggtggaagttcaggacgctgttctgattatgtactactagatagttataatgtatgacatcatggcttgtttgttgtttcc

SEQ ID NO: 8014 - DNA, 3706 bp, Zea mays
ttttaaattttaaaaatagaaaatagaaactagttaatttttttttttttttttcctcgtcgtgaaaccaatttaattgaatttgaaaaccggcaaaagccgatttccggtccgaaaattcggaaaaccatcaagaatcaacgattttctcgaccgaaaacttaaattccaaaaaccatcaagaatcagcgaagaaaatcagtcgaaaacgccaaaaccagctgagaaacctgaaaattgtttttagatttaaaaatagaaaaccggttactgataatcacaggtttttaactctaaaacggcttagtttcgatgatctcaagcaaagcaagggtctgatgttgaggtacggatttagtttgggacggtcaagtgttgaggtgcgtggaagtcacttttctgttcaatatagatttatctgattactggtctgtggacatatacaagataaaaatcatcttaaccggtaatacaacaagattccgcaatcaaaataaactgaaaacaaactactgtaagccgtttaagcagagaacacgaaatttgatttgaactggttgggatgcgcctggctcgggcagaagtgcaacgcccgagcgacacacgaggaccaagtagcaagctactatacggaccctcccccacaaaaaataaatttaatatcgaagtaaacacatagttcacatatcagatattaaactgataagaacagatactacacttgatcttagccaaaaggccgagaaaggtatgtttcgctctagccaccagggtcttcttttatagcgttcctctggctccgctcgtccattgcctccggggtgggactaaacctagacgcgctccacgcacacggaaccacggcgcgcgctatttcgtagcgggccgctgtgaaaatgtgctcgccaaggcccatcaatagcaagccttcagagtttgaagtggcgatgcctgattgatgcggcctcccccggtcgccctgcagatgctcctctctcgcctccagcctcacgcgttcctcgggcagtcaggccacctctccgcctccccgttatggctctccaaccgcttcctcctcgccctcgcgtccatcccggtgtcgccacgctcgcggacgccgtcttcgcgcgccccccggatcccgccgcccgcgaccgattcccctggaacacgtccgtccgcctccacgcccccgcatcgcgctgctctactttgcgtggatgcgctattgcgacgtgcggccgggcgcctacaacgttcctcactgtcctcaaggcctgtggccgcgccggactcctggttcacgccgaggccgtgaggagagagggctgggcgcggacctcttcacggtgaacacgctcatcaacttctaatgcaggatcctggattgccactaggggaggattgtgttcgacaaggcgggcaacgtctcatggaactccatggtcgctgggttcttcgggaaggggagatgaggctcgcgcaggagctgttcgacgaaatgccgcagaaagacacgttctcttgggggtccttgatcgacgtttacacggaatgtgatcttagaaacatttttgttgatgggcattcaggtgtgaggaagccaaggaggctttggagtattttcagagtatgccggggtgtggcgtaaggcctgataaggtcgttgccgtgggggctgtcagtgctagggcccccctggccgctttggagcaagtaagatggcttcactcttgcttggagaagtgctatctgatgatgtggtctggatgtcgttggacttgcaactcatggttatggtctggatgctgtcatgctgtttcatcgagtggaggcagaaaaggttgcagtggacgatcttagtgtacttgtcattctgattgcttgcacacatgctggcttgatctcagagggtttagaaatatttcacagaatgaaaaatgattttgggatagatcccgaggtagaattggttgatctacttggccgtgctggacatttgcgttgagctggctgagttataaatggaacgtcttgcaaatcttggagctgattctggagtctgtttttctatcaaatatatatgctgatgaagcaatgtggggtgatgttttgaggattaggaaaatgatatgtgatgaggggatgagaaaggatattggacggagtgtgattgaagtggatggagaaatacatgagtttgtgaagggaggttgctcatatcattataaggaggaaatgtacttggtgctttggaatttatctaacatggcagcatctatttgattgcttctttctgtaccaactttgtgaaatcattcatcacgagtctgttgattcaacattctagtcatgcaccaaattgcatctgatggttcatagcccagatggtaactgcctatttttcaagcctgaattttcctgctcaagcacaagcaggtgccaacatgaacagtaccgactcaatgaggctcttgagtatccatgtgctgtccatttattattatttttcttgacttgcttccacagtggtgactcaacatgtgatttaacgaagaagatttatgcttttggctgcagttgttactccttttagtcagttttaaattgcatcatgcattagagtagccacttgtggattatgggatttaaaagtggttttggcctttaaaggacaagtttagtcctaattgagaagtgtctgcacctctgtaccattgttctttacttcatcagagtgaagatacatgaagttcagatttcagaatgaagacttcaagattgtatactgcctcttacttccgtctactttatgtgtttcattttatatctgtgttgttgtttgctgattacaaaaatgaaaagtggctgattttgggaacaacatttgatgatttgggactctgtaatatgccttgttttggttatttggctttagaactgaaaagtgattgctttctaaattaccagtatggtttatgcatatagtcatgactacctgaccatcagcacgagtagtttgacttggcactctattttgtttagtcgatctagcatgattgagacacctaaatggttggtcctctttgctaattgtaagaagcatgctcaagcttagaatttaagattatatcctaacagagttaacaatgatgaacactatcaagctacataagtgctgctggaccgtggggttcggtggtgtatttacgtcaaccttggggcatgagactcgagtatggtttggtgtaggcgtcttatgcatgtaaaatagaacagaaaccaatttgtttgttcctcttttttttcctgtttattaatacctactttaccttaaacactaaaactttgtttggtgtaggcgtcttatgcagtatgaacttttggtgtgagctgtctgagggtgggcgcagtcacgcacgcaggaagctgattgacgagcctggacggatcactctcgctccactccagtcaccagtagccgagtgccacgtccatcttttacgtgacgcgaagccgcgaagcggtcggttcttatcacttatcatcagggggccagtcggggcaaccagctacaggacacgtccagatgaacttgcccaggtatgcatgccccggcccgaccacactgactgaacctggacggcttcccggtctcgtgcgctgcccgggcagtctggtggggcacttggataacacgctgcag

SEQ ID NO: 8015 - DNA, 4751 bp, Zea mays
gtaacggtacaaagctgccagttttggcaccgtgtttactactaccatttttgccatgctcttaaaaccacaggcaaatgcacgcattcgatacagccaggaatgacagaaaatccaacgcaaagccaccacaagattcaagacatttttggcaatggtaatgtcatgcggggccaccgcggcggtggtccttctacagtcgggcgcggaccacgccacgccacctgaggcgcctccgccgctccaccaaccctctcctcgtcttccatacagtgggtgcctcggccccggccgggaagcatccgactaaaaagggccagggccagggccttcgcttgcttactactcctgcttaccacactctaccttgtctcttcacgtgcacacgacgcctcccccaatggctgcggtggcggaggaggaggtgatcgtcgtcggcgcggggcagtcggggctagcggtggcggcgtgcctgtccctgcgcggcgtgcgggcgctggtcctggagcgcgacgactgcgtggggtcgctgtggcggaagcgcgcctacgaccgcctccacctccacctcaccaagaagtactgcgcgctgccgcacgcgccgcacccggccgaggcccccgcgtacctgcaccgcgacgacttcgcgcggtacctggacgggtacgccgcgcggttcgccgtccgcccgcgcctccgccgcgaggtccggtcggcgcggtacgaccccgcgagcgcgcggtgggaggtggaggccgtggacctcggcacgggccaggccgagcggtacgcggcgaggttcctggtggtcgcgtccggggagaacgccgagaagttcctgccggaggtgcctgggctggaggcgttccccggccaggtgatgcacgcagtggagtaccggtcggccgaggggatgcgcgggaaggccgtgctcgtcgtggggtcgggcaactccggcatggagatcgcctacgacctcgccgccgccggcgccgtcacctccatcgtcgtccgaggcgagctccgtaacctggtgaccaacgagactccctgctgctcgatctggtacgccggccagtctcttgctgcgtcgttaccatatgcctggctcgacagatggtcatcgatgggatgtctactgctagctagtagatgccaggcagcacaacaagacctgacctggtgcgaccgtggcgtcatgcatgatgcatgacagtggcactgcttgacagatggtgcatgcatgcacccgaatcctatgttccgctgcttgcattgcatatataatcctatgctgtcgtagtgtgagtgtcgtgtatatatacgagtattatgaaatcgtatttttgcgtctcgatcgatgtcgtctttatgtccatactcccgtgtggtgaataaaatccaagcacgatcacgatagtataggggaataccatgtttccaaaataatctttttatttttactggatatttttttaagaaaaaagatcattctatctctattattatattggtttagtttacacagcactgctagtttgatttgcaaatcatattttacttagataaaagtcagtatatattttaggatcgctctttgccgcttcatcgagccattgactattcctcttccaactacatgcgtgcataattttaggtaaccttgacatatcttgcctggaacgctacagaacgtgtgactgttcccccacgcggtagcagtcaacatacgtcaccaacgtgcaacgctacatagagacatgtttgactaggctgccattagacaatggggaatggcgatggtaacaggaattttcctgtcgggaaaaaatttccgccgcgttcccgtagagaagaaacttttccattcccattctatggctagtttggggaatttcgattttatcaagaaaaaataaactaatttttcttagaaaaataaaaatctcgttggaaaatagggttccctttttttttcttttttggagaaattctccaccagaaattgaggatggaggcacattgccatctttaatggggaacaatgcagtttgaagttatatagtataggattccatcaggaatggaatggatgccaagttttccatcaattaatcatgatgcgcagccgctactgctaacgatcgatgcaatccgatcagcagtaactaataatcacgcatatatgcagctccacctggtgaccaaggagatctggaacgtggcgatgacgctgtacccgtacctgcccgtgtgggtcatagacaagctggtgctgctcatgtgcgccgtggtgttcggcgacacgtcccggcacggcctccgccgccccgccatcgggcccttcaccatgaagctcaccaccccgggctaccccgtcgtggacgtcggcacctacgccaagatcaggagcggcgagatccgggtgctccccgccgccgtcaagagcgtccgcgggaacgtcgtcgagttcggggacggcagccgccaccctttcgacgccatcgtcttcgccaccggctaccggagcactgtcaggcggtggctcaaggtacgccgccgcgcgccgcacgctttaactaactaccgcatcatcttcacgcgatggtctatctctatctgcactgccaaaaaagctagctagcatgtattgcataaacattttttgcattgcatgtggccttgcctggtgatgcgtcagactttgccgcgaagcaaagcacggtcagcccggcgccgggtgtcatctttgcggttgttgcacgcgcatgcggcgccatcgtctaatacaacgagcatgcatgtgcgttcttctctttttccgcagagcgaggacgggctggtcggtgacgacgggatggcggcgcggagctacccggagcactggaagggggaccacgggctgtactgcgcggggatggtgcggaggggcatctacggcagctgcgaggacgcggagctcatcgccgccgacatcagcaagctgctgcaccccaagcaggagcagggcaacggcgtctagctgcagctagcatttcgctttgttggttgcgatggaaacaagctctattgttgttgggttggttgataataatggttgcgtgaataattaaacgtgcttaattgagatggcctggccagcctattcgttcattaccctgtctgtgccagtgtactgatgtgcaccgacgaggctacgacctaccgccgctagaaaccggaatttccccgcatgccgctttctattgttgacaacagttcaagaaatgcacctgtcaaaatcatctatcaatcgacgtctacgtctcctatcttctcagaattaagaattctcgctatctattatggaaattgtgcactttacttttactttactgttacggattaggaggtgggaaagccaaactagcttttcaagatcacccttgctcaccgtccactccgtttatatgtgcttagcttaaaattaatccaaatagagactgcgtaaaagttaaatcttatcatttgctgaatgagtaaagtgcactagacggctgtcctcgaaacttggcatgtgtcacttagagtatctctaatagttatgtaaatttagcgccctaaattatatatctaggaagttgctaaaatactgtaagtagtaaaaaatgtttgtactccaacaattctttatttatttattgctactttttaaagttgtcaaggtcaacaaaaaattaaggaggtctgctttctattttaaattaagctggcgacataaatcagtatcaacaaccttttctgacgccttgggagatcggagctgtccatggaagaccaaacgaccgctatgacaggcacacaccgtgcaaggaggtcctcgtggcgacgacgtgaaggtagcacaacagatgctctgacggtgtctcggcacaagaggttgtctggcggtggtgacgtcaagacgtctatatgatggagatggatttgtggtcaactgggcggtggggcggcacggaaacgtggatagagtatgcttttcgtgatgtacttagcaccaatgttactttagggagtcccggcgaggttgttaaatgtatagataaaattgagttttgtagggagattgtaaatttagagattgactttacataacagctggagaaaagtttttctccaaaacttcataaatttatatttagggagttatttacataactatgggagatcttttaggcttccaactcagaaaactgagaaaacatgtccagaaactttatcggcccatgcaaaactatctaaagctaggtttgcaaaacaggatgccaacgtggcattgccacgttgaagccacttgagatcctgaacttggcatgctgtgtcacgggtccccgaactttgatattatgtcacttgggtacccaaactttcattagtgtgctctaacgtggtatgacacgtcattattatgttttaaatgagtagtatacatgttataaagttacatatttatcttgtataccttagcatcatttagtagtaacaatcttcccacaaatttcatacttgtgcatgtgtaagcttgaatcgaaatcattaaagcacacatgtagggaaaattatcactactaaatcaagttttatagtgcttattcaaataataatgataaagtttcaaagttggataagcgacataaaaaacaaaccaagtagcaatttataatagtgtgaagtgctaccttgaattatgcttagtttctcttatgttgcac

SEQ ID NO: 8016 - DNA, 1609 bp, Zea mays
tccatatagtcagaggctcagagcctgaagcatccgactaaaaagggccagggccagggccttcgcttgcttactactcctgcttaccacactctaccttgtctcttcacgtgcacacgacgcctcccccaatggctgcggtggcggaggaggaggtgatcgtcgtcggcgcggggcagtcggggctagcggtggcggcgtgcctgtccctgcgcggcgtgcgggcgctggtcctggagcgcgacgactgcgtggggtcgctgtggcggaagcgcgcctacgaccgcctccacctccacctcaccaagaagtactgcgcgctgccgcacgcgccgcacccggccgaggcccccgcgtacctgcaccgcgacgacttcgcgcggtacctggacgggtacgccgcgcggttcgccgtccgcccgcgcctccgccgcgaggtccggtcggcgcggtacgaccccgcgagcgcgcggtgggaggtggaggccgtggacctcggcacgggccaggccgagcggtacgcggcgaggttcctggtggtcgcgtccggggagaacgccgagaagttcctgccggaggtgcctgggctggaggcgttccccggccaggtgatgcacgcagtggagtaccggtcggccgaggggatgcgcgggaaggccgtgctcgtcgtggggtcgggcaactccggcatggagatcgcctacgacctcgccgccgccggcgccgtcacctccatcgtcgtccgaggcgagctccacctggtgaccaaggagatctggaacgtggcgatgacgctgtacccgtacctgcccgtgtgggtcatagacaagctggtgctgctcatgtgcgccgtggtgttcggcgacacgtcccggcacggcctccgccgccccgccatcgggcccttcaccatgaagctcaccaccccgggctaccccgtcgtggacgtcggcacctacgccaagatcaggagcggcgagatccgggtgctccccgccgccgtcaagagcgtccgcgggaacgtcgtcgagttcggggacggcagccgccaccctttcgacgccatcgtcttcgccaccggctaccggagcactgtcaggcggtggctcaagagcgaggacgggctggtcggtgacgacgggatggcggcgcggagctacccggagcactggaagggggaccacgggctgtactgcgcggggatggtgcggaggggcatctacggcagctgcgaggacgcggagctcatcgccgccgacatcagcaagctgctgcaccccaagcaggagcagggcaacggcgtctagctgcagctagcatttcgctttgttggttgcgatggaaacaagctctattgttgttgggttggttgataataatggttgcgtgaataattaaacgtgcttaattgagatggcctggccagcctattcgttcaaaaaaaaaaaaaaaacagtgtactgatgtgcaccgacgaggctacgacctaccgccgctagaaaccggaatttccccgcatgccgctttctattgttgacaacagttcaagaaatgcacctgtcaaaatcatctatcaatcgacgtctacgtctcctatcttctcagaatt

SEQ ID NO: 8017 - DNA, 3385 bp, Zea mays
aagatattagttgacaaagttatgttgatcatcaatcaccaaaattctttaatcaaatgagttggagtctattttccttactgaccactgattactcaaattgtttgtaagtttagagcataaaacttatttataataacagttttgtgtttaaagtggctctaagatgatattgattgtttggctattgacgacacactataaaaaatataggtcaaaatattttttgtatgatttattttgtagtcaaatacgtctatcgtttttttggatagaaggagttgactttagatattggtagcttccatttgcttcatgtttttttttgaacattcttatttgtggtgtcttgcttgctatttgttagtttctctcgatagattggcctagatctgcatgccttgtccacaggctaagaataaaaaacacatgtgcaatcgccctatataaacaaccccaagatccatggtggtggtcgtccgcccatagccgtaggcccgtaggtacattagctagaagctttagtagcggcgatgggcagcctaccgctcgacgcgtcactgcggccactggaccccgaggccttcgccggcgattcacgcgccatcgtggacttcctcgccgagtactaccgtgacgtcgataagtaccctgtgagggcggccgacctcgagcctggcaggctacggaagctgctccccgaggctgcgccagagcacggtgagccgatggaggacatactggaggacgtgcggcgggacatcctgccgggtctgacccactggcagagccccagcttcttcgcctacttccccatgaacggcagcgccgctgggttcgcgggggagatgttgtcggccggcctgaacgtggcgccgttcgtgtgggtggcgtcgcccgccgcagcggagctcgagagcgtggtggtggactggatgggtacgctgctcgggctgccgcagcggttactcttctcgggcggcggcggcggcgtgctacaggggagcacgtgcgaggccgtggtgtgcacgctcgccgcggcgcgggaccgcgcgctggctaggctggggcacgagagcatcgtgaagctggtggtctacgcctcggaccagacgcacgccaccttccagaagggcgcgcggctggtgggcatcccgccgtccaacttccgcgtcatccggacgacgtcggcctccgggtacggcctgacggccgacgacgtccgcgccgcggtcgatcgcgacgtcgcacgcggcctggtgccgctgtacctctgcgccacggtgggcaccgcggggctcggcgcggtcgaccccgtgcgcgagctcggagaggaggcgcggcgacacggcatgtggctgcacgtggacgcggcgtacgccggcagcgcggccatctgccctgagttccagggcactctcgatggcgccgagctcgccgactcggtgagcatgaacccgcacaagtggttcctcaccaacgcggactgctgctgtctgtgggtggcaagcccaggtgccctgacctccgcgctgtccaccgacccggagtacctcaagaacgtcggcacggacggcacggggaagccggccgccatagactacaaggactggcagatctccctgtcacgccggttccgcgccatcaagctctgggtggtgctgcggcgctacggtgccgtcggcctgcgcgcgcacatccgccgacacgtcaccacagcaaagtggttcgagcggacagtggcggcggacgaacgcttcgaggttgtggtgccgaggaagttctcgcttgtatgtttccgcctccgggagaggttcgcaggggacgacgcggcggacgagttgaaccgggagctcctcacggcggtgaacgcgagcgggcgggcgttcgtgacgcacttcgtggtggacggcaagttcgtgatccgcctcgcggtcggcggtgctatgacggagatgcggcatgtcatggacgtgtgggaactgctgcaggccagcgccgaccacgttttacgccgctactcctactagtgtattctgctgcacgtatacgtacacttttacgcgcacatgtaccaaaaaaaataaagtatacacctactctccttgtgcttggtttagcttcaccactctgcacgccatgtactttcgcacgctgaggaccggaaatagcaagtgatttcatatcccattgaagattctcttcaccttctttgttaccaagccagccaaatgttttatattgttatgtgtacgcgtgtatctattgtcgggctaagacgcagttgagcatcgattttttctttcacatgcagagagtcaatcatcagcggccacacgacgctgggagcttggaacgcagacacggcgtagggtgttggcttgatgtggcagggctagggatgaaaacagaccaaaaaacctctcttctgttttttgttttcgtaagaagcaccacagcaagatccagactaggatacataacctcatccaataggataaagagaatatgttagctcttgaacaagaaatttcataactacatgcctagcaggacccagctcacccctcgcacagcaaagcaagaccaaataacttcgacaaagccagacagactccacaaaatgatgccttccaagctttcaacttcactgacaacggatgcccactctcagccatgttgcaagcaacaccttggccaagcaattatagagcaggaaattggccaaaatacaatggaaaggccaacccttcgcaattcatcatgagttatcaggtcacgatggcttcgtcggggggcaacgacaatgcaatggcgaagtcactcgtaatagccatcaaaggccccgctctgacatggtacactaggctgccatcgctctcaatcgactcatgggcggccctttgggagaagtttctcctcaatttccaaggtacatgtcgtagactgacgccctcgtagagctatcactgtgcaggcagctagaaaccgagagcctccatgacttacaacaagttcttgtcgctcaaatctcagctaacatcatttgaagatagaattgccatccattactctatataagcggcctttgtgccggttagttctacatccattgcactcgagatcccccaacaacccttcaagaactgtaccaactattcgagaagtatgcatggtctgaggatctccattactgcaaggtcaaggcacaacgcaaaccgagggagccctcacacctaggaaactccaaaacatggtcaagaggatagtagcccttggcgcctaactagcaagtcaacaacgtcatccactaccagcaatttgaggacccctcataactatgaccacagccagcaactaggaagaagtggtagggcacccaggg

SEQ ID NO: 8018 - DNA, 1263 bp, Zea mays
ttttttttttttttttgggacaaatcatttcgaactgcaattgcaatatttaatgacattgaactgggattgtcagctttgaatgaaccggccagctcgtactccattattacaaagttactagtagaattttctacacgtgaacttaaattttccaagtatgctactactgattgtactcaagtgtccctgtgcacactcgcatgagctagcatctgccgatgctcttttccttctcttccagttggtagtcttttcggtctgaaatctagattgtcagatattctcgttatttggcaatccatcaaactgcaacttcttaactactgaagcagcaccttgatcaactccaagtaaaagacttgtgtatcctccttgtacaccctgagcatccatttctgaagacggcggccaccagtcacgcgtggcggcggcggcggcggcttcaatatgattagcaggacatgttttttggaagccaagatacgtatctgtttgttcgtcgatccacgagcgcactcaacttatttaaggcaaccagacgtgttgcaggcacctctgatcgctgatggacatgtcggccacggcgactgtggccgtgcagtttatctccagcaccacgcgccggtgcaccaatccgcccagcacggcgacgcgcccgcgcacacgcgtggcagtggccacgacgacggcgcctgccgccacgacgtcctccaggaacgccgggtcccccaggagtgcgcccacggcgacgtccaccgtcacgttcagccgcacggtccgccgcgccggggccgtgccaggagggcccagggcctccccgacctgacgcgcgcggtagtagaccgacgtctccgtcgcaccgtaccgcagcgatgcggcgttcgggttcttcaccgacacgtccgccaccaccgtcagcgacaggagtggcgtcgaggaggccgaagatgacgcgacggtggcgccggggtccttgacacagatggcgttcatcttcatcacgggctcgcggacgcggtagacggtcagcgtcacagctagcgaggcagcgccgatgaggatgctgataatgccgcatgagatgagcacgcagcggaggcgcagaaatgggaagttgacaacggcgttgctgcccatggcatcagtggatcggatcatgggaggccaagtgctggttgcattggttggaagagaggtaggagaacggtgaagtagcgaagatctgtggtaggtagtgggtgggtgatctcgaaggttagt

SEQ ID NO: 8019 - DNA, 2228 bp, Zea mays
atcccccgggctgcaggcaacgtttctctcctctcagcgcaaaaagatagatcctctgctctaccggcctaccacgttcgtctcccgcgccggccacccaccgctgccaccgagggtaaaaccgtcaacccgccttgccccggcgcctataccatgcgttggctacctcgagccggccgggagttccagagccctccagagcaaaaaaaatatattatcgaatactaaagcattttcctcatcgatagaatatagaattttaaaaagggagcgaaataggtttttcctttttgcagctccgtcgtccaccaacctcctccgatccggccgccgcagcgtagccgaattgtcccctcgctagcttctccggccggctagaggctgtttcaggcggcctcgatctcctccgcgcggctgaggaaggagatcacgcggttgctcaggggctggggcgtgcatgatgggattttggttgattccgatggagactccggcgaggcttctgtggagcacgagcttcttccgccacaagatcgccgccatgctcgcctcctcctcctgcttcttatagatcccaccccctcgccgtcgtcgtcggcacggcagctagctcgctagcttctgtacataggtcgacgcgccatatagatactagtctcggattaagcgataattaaggcaaagaatctccaagtttgcttcgctcttgcattgaaccatggagtctggacggctcatcttcaacgcgccgggctctggcgccgggcagatgctcttcctcgactgcggcgcaggcggcggtcccggcggcggcttgttccatcgaggcgggagaccgatgcttggccttgaagaagggcgcggcgtaaaacggcccttcttcacctcgcccgacgagctcctcgaggaagagtactacgacgagcagctgccggagaagaagcgccgcctcaccccagagcaggtgcttctgctggagaggagcttcgaggaggagaacaagctggagccggagcgcaagacggagctggcgcgcaagctgggcctgcagcctcgccaggtggccgtctggttccagaaccgccgcgcccggtggaagaccaagcagctcgagcgcgacttcgaccgcctcaaggcctccttcgacgctctccgagcggaccacgacgccctcctccaggacaacaaccgcctccgctcacaggttgtgtcgttgaccgagaagctgcaagagaaggaggatgcgacggagggcggcgccaccgctgacaccgccgcgccggcggtggacgtcgaggcttccctggccgacgacgtcgaggagccagcagagcctgcggcgacgttcgaggtgctgcaggaggtgaagtccgaggacaggctgagcaccggcagcggcgggagcgcggtggtggacgcggacgcgctgctgtacggcaggttcgccgcggcagttgatagcagcgtggagtcgtacttccccggcggcgaggaccactaccacgactgcgggacgatgggccccgtgaatcatggcgccggaggaggcatccagtcggacgacgacggcgccggcagcgacgaggggtgcagctactacgccgacgaagccgccgccgccgccgccgcgttcttcgccggacacgccacccaccaccacgcggacgaggacgaggacgccggccagatcagctggtggatgtggaactagacgttcgatcttcccacgccgatcgatcgaccgtcttcgaatcctgtgtcaacaagaagaaaaaagaatcgtgccgtgatttttctttgcgcaacgctgctgtaagcctgtaatggtgaatttctagctatggttatgccgttatgaaggaagaaagtgtatgcatgcatggtagggtaaagagtgggtaattaatatcgttgatcatcccagtcactcgtggtgttccagaagatcaatggagttgggggagaaataagtgcgcatagaggcaagtactactctttttatggcacagtgcctatgtcaaatcagggtgttattaccagttggttttttttaaaaaaaaatactgtactattacgcattttcgcatgatttagctgtgagttctgcacagtgaaactgaaacagctagtgtagtgtattaatgaatggaacagtgccccccaccgaagcacagacttgaagaaagcttattggaaaaaaaaaaaaaaaaaaaaaaaaaaaaaaaaaa

SEQ ID NO: 8020 - DNA, 3017 bp, Zea mays
ccggctgggacgagcgagcctcctctccctccttgtcgcgtcccacataactgggcctcctcgccgctgcgccccacctctgctcaggcccacactgccctgatcccgccggagtgcccgcacgcgcgcccttgcctgggccggccgccggcgaggggtctgggcggtcggtcgacgtgaccccccccgcaggcgcgctgtctcttcgtcgccctgctcttttcgaccggcctcgcctcgctgtccgcgagtggcgccgtgtcggcggcacacgccggcggcggtgcgggaacaaggcgagggcggcgcgccttgtcgccgtgcggactgagcatgacttgagccttgagatttaggatgtgtacagaggggctgtattcttgtgtataggttctctttctatcggtcaactgttgctgattcggacggaatgttggaggatcaatcttgcctgatatcaaggtcgctgccgggttcctgtgagcaggaatccagactagcttacatgacttaccacctacttgagatcacgaggagtaagcgcccgcctgggaccctgtcgattgagcacgacgtcgtggcagcattgactaaaaggacaaagtcctctgagcaccaaaacagcgaggcgctggattgtcaaggaagtaatggtcagggcgactcagattcaagcaccctgataagttccattggccgggacaactcgatcaactgtcttgctcgttgttctcgttctgactatggttctatcgcatcactgaaccggagcttccgatcgcttgtgcgcagtggcgaactgtacaaggagcgtcggcagcaggggatttcagaacactgggtctacttctcttgcaacgtgcaggagtgggaggcgtatgacccctaccgttcacggtggatgacgctcccaaggatgccccgcaacgaatgtttcatgcactctgacaaggagtcgcttgccgtgggcaccgagcttctggtgtttggaaaggagatcctctcgcatattatcctgagctatagcatcctgacacattcatggtcgcggggcgttgaaatgaacgcccctagatgtttgtttggatcagctagttttggagagaaagcaattatagccggaggcatggatgctgatggaagggtgcttcgctccgtcgagctgtataactcggaaaccaagaggtggacaacacttccaagcatgaataaggctaggcggaagtgctctggtgtcttcatggatggcaagttctatgtgatcggtggaatggccagtaacacagaagtgcttacttgtggagaagagtacgacctagatagaggtacctggcgggtgatagagaacatgtccgaggggctcaatggtgcaagcggcgctcctccactcgtcgccgttgtcgaaaacgagctatatgcagcgcagtacgccggaaagctagtgaggaagtacaataaaagggacaactcgtggacgacgctgggggagttaccggagcggccagaagccgtggatggctggggcattgcgttccggggctgcggagagcggctgttggtcatcggtggaccgagagtgctgggcggcgggatgatcgagctccattcctggattccaagcgaggggccactgcagtggaacatgatcggaagcaagccctcgggtaactttgtctataactgtgctgtcatggggtgctgatacgtgcgcccctcaaaacataccgtcgacgacacacgaaagattgtgatattgggtttttttttattatcaaatggcataaagcactgattaattccgcctgacgggtaatctctgcattcttttttttgacatttcagattttactcaaggttcgtccaatagagctagtcggttccgtgtactcgttaatagctagctacccattggttcctgtgctcagcacattctatttgcagtccatctgtacctttggtccatatgatatactctgttgaaatgagtttttttctgagatggacgcgtacaggtgataaattgtaattggggggtgggtaaccgtgcatctatatgatttgtttgtatcatgttctgaaccgtgtctcaacgctgtaattctattgtgcaaatgtctcttttccaagaactgcatgaaaaaaaaaagaaaagaaagtgcccatctgtacatcccccagcataaatttgagcaccgacttggaaaccgttggtgctgaagcccttccacttcctttccagtagagcctgccctatgagatattattatcagcgagtgttaggcaggcgaggtgaccactttattataatccagcaggagggcgacaagtgcggagctaatcagtatatcattgtctggcaggttgagtggttgggtgctctgtgtcgtggagattgagaggccatgttttgtttgtcgagttgtgcctataatagcctggcgtgggtttgttcggacccgtcagtttgcagcgtaggatcattggctagaatttctaacgcatcatcatagacagattagtgaaaaagatgcgggtatttcaaacctaagacgcgcgctgtatccacgcacgatccgagtggatctgctgctgctgctgctactactaaaaagaataggaccgcatttggcctgttgtgatcattgtggtgtccctggtcaatcatgcattcacgcatcatttctgttcgtcgagcagttttctgctttagcagtagcgctccggactctcgtccacgcgcgcattcgatttcttggtgctgctgctgctgctgtggcatcatttgtgatcattgggcgacagctcctggtttcgttgacgagagcctaaaaccatcatccccgggctgcagcccgctcgctgcgcagcttccgtttccacggctccacgcagaatttcacggaaatggaaggcagtgaaggagattggattgatggcatgagtcacggagctgccggatggaagcggtatgtttcccctccccctcactttttacagtccttgccgagtcgtgcagt

SEQ ID NO: 8021 - DNA, 1047 bp, Zea mays
  misc_feature (869)..(869): n is a, c, g, or t
  misc_feature (872)..(872): n is a, c, g, or t
  misc_feature (923)..(923): n is a, c, g, or t
  misc_feature (976)..(976): n is a, c, g, or t
  misc_feature (988)..(988): n is a, c, g, or t
  misc_feature (1002)..(1002): n is a, c, g, or t
  misc_feature (1005)..(1005): n is a, c, g, or t
  misc_feature (1015)..(1015): n is a, c, g, or t
  misc_feature (1047)..(1047): n is a, c, g, or t
cattgggaccctcgaggccggccgggtcccctccagatttgccacaataccccccggttctcctctcctccgcgggctccgtctcccccccccccgccgacgccgggcgcacgcagccaggccaggtatccccccggccccaaccaaaccatcgcatgggagccgcgactggcccgacgaagcggagccgcgtccccagcaagaggcaggaggaggaggaggaggccatggcgcgcgctgcgggcgtggaggcgcaggcgcggcggcggccacggctggtggggtacgaggagctgccggagtacctcaaggacaacgagtacatccgcgggcactaccgcgccgagtggcccgtccgcgacgcgctcctcagcgccttcgcctggcacaacgagactctcaacgtgtggacgcatctcggcgggttcctgtttttcctggcgctcgcggtcgccggagggtggacggaggccgccgacgaagccgctccggggatcatgaggttcgtggtgacaccaccagctaacgcttcgtggggaagcgcccgcattcgggtctgccaagccacgacggcagggcgtcgcagtccggcgtgccgcggtggccgcggacggtgttcctggtgggcgccatgtcgtgcctggccatcagcgcgacggcccacctgctggcgtgccactcgcggcgcgccagcgtggtgttctggcagctcgactacgcgggcatctccgtgatgatcgtcgcctccttcgtgccgccggtgtactacgccttcctctgccacccgccggcgcgggcggccatacctgtccgccatcgcggcgctgggcgcgctccgtggtggccgcgctgctctccccgtactgctngtncccgcgctaccgccgccttcgcgcggagctgttcctggccatgggcctgtngggcgtcagtacccggcgctgcacgcgctgtggctcaactggggccacgccgnctgctacctggnagctcggactcgangtngccatgggtntcgcctacgccacgggcgcatggttctacgtn

SEQ ID NO: 8022 - DNA, 1526 bp, Zea mays
aaaaagcgtgtgcgacagaggaagtccatgtgcccggctcggccctgccacggccacgcacagcagaggagcccgcaagcccgcgcgctccccgccaagatttgccaccaataccccggtcctccactcctcctctcctccgcgagctccgtctccccccctcgcgcgaacgccgggcgcacgcagccaggccaggtatccccccggccccaaccaaaccatcgcatgggagccgcgactggcccgacgaagcggagccgcgtccccagcaagaggcagcaggaggaggaggccatggcgcgcgctgcgggcgtggaggcgcaggcgcaggcgcggcggcggccacggctggtggggtacgaggagctgccggagtacctcaaggacaacgagtacatccgcgggcactaccgcgccgagtggcccgtccgcgacgcgctcctcagcgccttcgcctggcacaacgagactctcaacgtgtggacgcatctcggcgggttcctgtttttcctggcgctcgcggtcgccggagggtggacggaggccgccgacgaagccgctccggggatcatgaggttcgtggtgacaccaccagctaacgcttcgtgggacgtgctgcattcgggtctgccaagccacgacggcagggcgtcgcagtccggcgtgccgcggtggccgcggacggtgttcctggtgggcgccatgtcgtgcctggccatcagcgcgacggcccacctgctggcgtgccactcgcggcgcgccagcgtggtgttctggcagctcgactacgcgggcatctccgtgatgatcgtcgcctccttcgtgccgccggtgtactacgccttcctctgccacccgccggcgcgggcggccatacctgtccgccatcgcggcgctgggcgcgctcgtggtggccgcgctgctctccccgtcctgctcgtccccgcgctaccgccgcctccgcgcggcgctgttcctggccatgggcctgtcgggcgtcgtcccggcgctgcacgcgctgtggctcaactggggccacgccgcctgctacctggcgctcggcctcgaggtcgccatgggtctcgcctacgccacgggcgcatggttctacgtcagccgcgtgccggagaagtggaggcccggggtgttcgacgtcgtgggccacagccaccagatcttccacgtgctcgtgctcgtcggcgccgtcacgcactacgtcgccgtcgccgtgctcatccactggcgggagaaggtggctgccgcctgtggcgcggcgtcgtaggcgggcttgctgctcctggcttctgcagcaagccagctgaggtgtttgatcatccagagcttcaatgtgccagtgcgatggattcaacaagcgttcgaatcggcgaacgaagtagttgcagttgcagttgcagcatagatcggctctagagttcgacgatttgtaatttaattgatgggatgattgagtatggtggtccaataatttatgatgagatttatctcccgacaaaaaaaaaaaaaaa

SEQ ID NO: 8023 - DNA, 923 bp, Zea mays
cgccgattcactccctctctcgcgctggggcggaaacttctcccttgcgtcttcccatcgcgaaggtcttgtccatgccgacagctagttcccgacggactttctcggaggcggtcagcaccgacgacgaggaggctgcgcggggaggagatggacgcaacacctgataatcatttctgggatcatttctcaggtcgcgcagcaaagtagcaaactcctgcgaccctacccaccgcacctaccattctggagaggagaggaacagagccaagaaacaagcccggaagatggcaggcggcggagtggtgaagcacatcctgctggcaagcttcaaggaggaggtgacgcaggagcgcctggacgagctcatccgaggatacgccgcgctcgtcggcgtggtcccctccatgaaggcgttccactggggaactgatgtgagcatagaaaacatgcatcaagggttcacgcacgtcttcgagtccacgtttgaaagcacggaaggaatcaaggagtacattgagcaccctgcacacgtcgaattcgcaagtgtgttcttgcctgtgctggagaaggtcctcataatcgactacaaaccgacgtcggccaattagcggtagaacatgctctgtacttgttcctcggaggatccagtttgattctactctttattttgctaaataaactcggtctgctttgtcccttgttaagaatgagctttgagttttctgtagtgcaattgttgtagcttcgcatgttttcatatgggaattacgttcctaaagaccgtatttgccacttggaagcagcaaactgcttgaacttcttggagattggacgatggtttgtttcttggttcggaaaaaaaaaggcggccaagcgcgtgagactgctctaaaaaaaaaaaaaaaaaaaaaaaactcact

SEQ ID NO: 8024 - DNA, 1496 bp, Zea mays
  misc_feature (1467)..(1470): n is a, c, g, or t
  misc_feature (1472)..(1472): n is a, c, g, or t
  misc_feature (1476)..(1480): n is a, c, g, or t
attactcataaaaaacggaacgcaagagcacgagaccattcccgaacgctcctggatcgctgggcgccgctgttcgcaacccaagcagtagccgagccaacgaaggcgtgcgagcggaggcaatcatacatggacggcagccgcaagagggtggacgcggaagacgtcaaaggggattccaccggcgggaagcgattgcgagcatcggagtcatttcaaagtggcgtaggaagcaaagtgaagctatgcaccaattttttcagtacttatggttgtccctttggtgagggctgccattttgtccattacttccctggtgactaccgggccgtttcagaaatgaccaacctgggtggcgcaacaatcgcacctcctggaggaatgatgatggatgggccacctacacccatcgtgaagactcgcttgtgcaacaagtacaacactgcagagggatgcaaatggggggacagatgccactttgcacatggtgaaagtgagcttggcaagtctatgatggacaactatatgccaccccccatcggaccaccaccaaccggttattttgcacctccacctatggcacctccacctatggcgcctccacccatggcacctccacctatggcacctctacctatggcgcctccacccatggcacctccacctatggcgcctccacccatggcacctccacctatggcgcctctacctatggcgcctccacctatggcacctccacctatggcacctccacccatggcgcctccacccatggcacctctacctatggcgcctccacccatggcacctccacctatggccaaccctggtttggccactccagctagcttcggcgcttatgccacggccaagatcagtgtcgatgcgtcccttgcaggtggcatcattgggaagggtggagctaacataaagcaaatatcttccgtcacaggggccaaggtggtcattcaggaggaccgccatgaatcagacaccagcttgaaaaacattgagtttgagggcacctttgatcagatcaggaacgctagtgctatggtcatcgagctgattgttagcatcagtggcataggaagcaacttcaagaccaagatgtgtgagaacttcgcaaaagggtcatgctcttatggcggcaaatgccactttgcccatggtgagagtgagctgcgcaagcctgccgctgcttgagatccatgccctgtttcttacctcatagtcattagtcaatgtaactcaaaacttggcctctgatgatggatttgttggcttctttaggtctacgctaatgaattgctggcttcaggcctactactaaatttgctgacttctttagtccttcgctgttggccaactaaatctgttttctgcgtttgttcttgaatgttctcctatgatctaatcctctatttaggttcaaccagagaagtgttgatgctgatgatttgcagnnnnanaacnnnnnaaaaaaaaaaaaaaaa

SEQ ID NO: 8025 - DNA, 895 bp, Zea mays
  misc_feature (77)..(77): n is a, c, g, or t
atgcaaaacacatgtcatatacgatccgggtggtcaaagcctcagaaagaacgaacctgaccagtataggttaatgncctggatgtccagggcgctagccattgtgagcgccatgctcctcaaattacttgtggacaactttcgctggtagttgactagttaagaatttgtttctgatgctgaatctttcttttccatacacgccgcggtgttttcttttgtccgctggtaacagctcacatcctccatgagaagctgcgttactgaagttggccgcttttttttttttttttttgcaagaggcaaaattcatcttttcttaaggcatactatactgttacacatcttctaaaacatgattgatattttctgacgttctgtaaattttcttactgtgcttttgcaaaattagcatcatgtcataacaagatgtgcacaggctgaaaaaccggtaacatcgtaggcccagtttaacattatttatcagcacatgcttgcatatatcatctatataaatctaaggcctcggtttcatctttcctggtattttttggaccagaacatctctacctcttctgctgtccttcctgggattcttcctgctataatctcccacctgttccccacaagcctgtgcattctggaaacaagatcttcctctgcttccgtgaagtcaacaagatgctgtgcggtgctattagcttcttttgcttcagggcgatcattgtctctgaatttcttgtcctggctaccactgctgctatccattagaggggttaggctgtagcctggaatgttaaggctagatgtttcttccacccttgtaatcgcctactggcctattgagtccctggaccccggccggcctcgaggcacccaaccccgtggtcccaat

SEQ ID NO: 8026 - DNA, 5745 bp, Zea mays
aattttacccatatgatacctccactttatttttcaatgatatactttttataggttcatgtgtgaatagatacatagtcatccaagtttcaagcatatttatgaagttctatgaactttggttcagacacaaacacattagcataataattgtctaaaaaacaagtaaaaaccataaatttcatataagtttcatgtgaaatcccacactccaaaatccaataaatcgaagatgccaaaatttgcctcattcacctttcaattacccatgaaaacgaacatcgatgtggcaacccctttaatcaaccaaatgccaataagaagaaatttaaatctaaatacatttctactttgttgtggggcaaaacgggggaacaagtcataacactggtcccacaaattcttagttctcgtttccctccctaatatctattcccctatgacatataatgtggtgcccatgcacattataattgtgatcccaatgacataatgcttaccaatgcctcgactggatgcacaacatggagcgcatgactacctcaaatgacgctgataccatgcacaaaagtcaactatgcattactaaaggtatcattgcgtgattttgctgatacggctagtgaataccaatgcatgacatagatatgccaaagggaaagtataggatgcaggagtatttatgaagagatatgacaatgcggcgtgaggatgcgtattttgactaaagaaaatagtgcgggacaggttggtgagcggaggaagcacgcgaggtctaggattcaaggagtaagagagaagatttgatgactacaaaccaatagatataataaaaagaaagataatataaccatagttacttaggagttgtgaagtatatatttttccaattctacccttatttgagagattatgatattttccattataaagaatgggcttcgcaaaattgtcatcagtctcacgtttcgtatactcagatgagcctacaattcatagatagacttagtggtactaataaccaaagagataatgtttgtaatgacaaataacaaattgccccccttattctaaatctagttcctattttattttcaaccaaatatttctataagtttccatttgaacataaagtcactcaactttcataaatctactgaaagaacatataaaaaataattgaaaactaaatcacatacatttccagtgacatctcccaccgaactccaacacacaaaaaattaccaacaaaatgccttcttcatctttttctgatgacagagattcctagaacagagcacagatgtgtccaaccccacaagcacctgaatagcaatagcaatattaagaaaaaaaaggaaatcgccaccaaaaaaacattcctacttttgagaggggcaaagtgggaagaacaagtcaaaacagcgccccacagattcctcgtccccctcgttgcgtttccctcctcccttatatctctcccctgctttcgctctcctcacaccacaccagttcgtcgcaaaacccaaacccgttccaaccgcaaggagactccgctctgcgaagaacgggacggatctagctcgaccctctagaccggcagacaaaggagacgccttcgtgcggcacgctcttgggggtaatggcgccggcgtgggagcgcgccaggcgcgcgctcgccaccaggttctgcatgcgctttgcggcgaggcgcgtggtcgtcgaggatgcgccacgtgggatggacgacatagaggcagaggaggaggaggagcaggagcagcagcagcaccaagaggagccggccgaggatgagagggagatgtcgctggccgcggagtccgaggacctggcgtcgtcgtggtctgggagccggagttcagaggtgagatctctttcgccccttgcagcagtgcccgcgtcccctgctcacggtgcatctatcagatgcgccactagtttcatgattttgcattcgatagattgccttgttcttgcctgccttaccgtcgatatgtgctgcttggcatgcatggggaccatagttccctgggaaactttctgtgacgtgattgttttcccaagcttacacgaaaaaaatacagatattgctctttttttttcagtttccatttcggtgtcctgcgtatagaaatgggaccccatacacgtataaaacttttgctgctcttgtttcagtataggaccaaactcgtgccaacggtttgaaattcgctagaaagaaacccaagttcggaactgtttggtttattattgtcgctcatccttgaacgaaaatgttggctttttagttattattttttttgtcgctttgggaaaactagcggctgcttgcgttccatcaatgtcaggtttcgcaagctcctgtattcgtattttggactttcttggtcatcgatcgaactgatattgaatttgtatgtatattgttcatgtttgatttccagttttcttttatctatgaatgtttctatgcattctacttcattacacaatagttctgtgtcattctatttgtagctaggatgcagcggggtcctctaaaaagaaaaagaaaaatcgtctcctagtttagcaatttaccgagtactgatcactcattttttttgcgtgtcttacgaagcatacttttatcatttccaagccatgtttatctttgaactgtttgggtggtggtgttgccatgtacatgtactcgtatagataaggctcaaatgacttgctgtgataaacaacattcagttgcaataatattttccgttgacagcatgctccttgaaaacttagagggacagtgactaatatcttctgaaacatgcatggttacgacttgctagggatggccgcgctgatagatagctctgggctctggctgatgtgtgtctgcacctgtcctgatttttttttatggatgcatctaatttggatctgtgttgcctttggacaatgccagggaacctatgttgaagcatttttttgtttatttttgatgtatagaaataaaacagaagaaacatagatgcttttataagttgacttcattgattgcatggcctacttccagagctctatgagtttgttttgagttcttacctggtaaattgtatctgatacatgctaatatgaagatggtaagtattacgtgtgctgcgcattgatgtttcttccgccggtcactactagacttcatttgtgtgcttaatttgttgctgattctgagcatttctaataacttggcctcttctcttgatttctgaagacatgtgcaatttgcctcagcggcatgaggtccggccgcggccaagcgctattcactgctgaatgctcccacaagttccatttcaactgcatctcctcaaacgtgcagcacggcaacaagatctgcccaatctgccgtgctgtgtggaaggagctgcctttccaggggcatgtggctacatctgctgctgctcatgcggtttggccccagatgagcatgcagtcagtgagtccgctggatgagctcccggtctttggctatcaggatacagcagttatgaacgacgatgagcagatacagcctcctgaaacagcctgcttggtcatgcaggcgcctcctcctcctcctcctctgcttgagatcacgacgtacactgaattcccagccgtccaggagtccgtggcacacgaggaattcgccatcgtcatccatctcaaggctccgtcgtgggtgagcacccgagcgccactggatctggtgactgtgctcgacgtgagcgggagcatgtcgggccccaagcttgcactcgtcaagcgcgccatgaggttcgtgatcgagaaccttgaccccagcgaccggctctccgtcgtcgccttctcctcggcggcttggaggctgttcccgctccggaggatgaccgcctccggacagcagcagtcgctgcaggctgtcaactgcctcgtcgccgacggcggcaccaacatcgccgacgggctgcggaaggctaccagggtggtgcaggacaggcatgccaggaacccggtctgtagcatcatgctcctctctgacggcgtcgactcccacgtcctcccgccgcggcgcggctcggcgccggactacggccggctcgtcccgcgctccgccctccttcccgggagcgagcaccacgtgccgatccatgcctttggcttcggcatcgaccacgactccagggcgttgcacgccgtggcccagatgtccggcggcaccttctccttcatcgacgtggtggggtcgatccaggacgccttcgcgcagtgcatcggcgggctcctcagcgtcgtggcgcaggagacgacgctcagcgtcgagtgcgccgaccagggcgtgctcctcacgtccatcaagtctggcagctacgccagcggagcggacggcgacggccgcggcgggttcgtcgacgtcggccgcctctacgccgacgaggagagggacttcctcgtcaccgtgcgcgtcccgccgtcacgcgggaccatcgcgctcgtccggccgagctgcacctaccgcgacgcggccaccacggagatggtgcgggtggggggcgacccggtgacgctgctccgcgcggcgagcccggtgagcgcggcgatgtccctgcaggtggagcgcgagtggcaccgcgtccacgccaccgaggacatggccgcggcgcaggccgccgcagaggagcacgactacgcccgcgcggcttcgatcctcgaggcccgccgccggctgctggagtcgtgcgcgtcgctgtcctcggaccagcagacgcaggcgctggtggccgagctgcgggagatgcaggagcgcgtgctgaacccgcggctgtaccaggggtttggccgcgcctacatcctgtccgggctcagctcccactcgtggcagcgtgccacggcgcgcggtgactccacggagctcacgggcctcgtccacacctaccagacgccgtccatggtcaacatgctcaaccggtcgcaggcgctccagccagaggtagcggaggcgctgacccggtccccgacgatcgcgccgttgcgcagcccagcccccgcctccggctcgcgggggacgcgacgcgggccccggtcgttcaggccggcaaagtccttcactgggcggtcatcgtgagcgcaggttcgctgacaatgcatgcgaaccggcagtatctaggaggaagaagaaaacccattaccatttgattcgtttcttcgatactcttttgtcgtagagtcttttgctttttatactgttatttggtcgtgggctaatcgtgagatatgtatgttttggttcatctactaaactagtgggaactaatcatcgatttggtgtttttgttctaagtgttgtcttgtttttttttcctggacgggatacgggagctagctgttttgcgtctgctagctggttggagcgcacaccgttgcacatcaaggcgattgctattagcacaacaggaacatataaacgtccgacggctattttgtttttgatgaaggtctatatgtaattataacgtatgacgacttcctcgagccgtcggatccaggcttatatccaacggctatgagacagaccgtcagattttaagggccattgtttcacttctccaactctctttctcgctcgtactctttctctctcttgtcgcgcgctgtcgcctcgcgcgctataggcagtgcagagccaaccaattaacatagaggcaaaatatgctagcg

SEQ ID NO: 8027 - DNA, 905 bp, Zea mays
tgccatctgccgccatgtcaaagcgaggtaagcagcctcttttaccaactggattcggccatttctcgtcgctcgatctggctataaatctcgcctgctcgtgcatgtgacatagttcggctgcttcaaggtgctcggaaaggggatgctgttgtccaaccccatcattgttagggccaagctcatctccaagatcatcgagaagaggatcaatgttactggaggcactgtctactaatctgagatgcagatgctgtcgacggatatgcatagaagagaacatatatgcataaaagggagtaaaactaagatttggatattttcatccggacacagagtaaagaattctccactctcttgacttgacgaggctatataaccagaggccatcagaggagaactgaagactgagagcattctctgcttataatctttattcctctatattctaaattatttttttcaatccccttccacctggattcgattcgaatcccacaccaccacgtggtgttcttcctatatcgaataaacgttgtttcgcttgtctaatgatcgatagggcactgaaagagtcattcctagagactctacggaaggacacaacggagatggagcagcctgcttgagaagaggcggcggaggagaaggaagcgctcaacctagactcgtggtcgtcgaccagcatgcgccttgacgtcctcttttttgattcatttatttgattttttgaacaaaattgcccttgtctttgtccttcctcccttttttcattttcttaatgccctcatgtaaaatataaggcatgtgttgttcaaatctttcttttaaaactacatgtatttcgtgtgttctatgatgatatatacagaaactggtcttcttgaaaaaaaaaaaaaaaaaaa

SEQ ID NO: 8028 - DNA, 3228 bp, Zea mays
  misc_feature (574)..(574): n is a, c, g, or t
atccttgagtttgtcttgggattgacaggccacccaagacgactctaaatgacgtagagctggagaggggtgaagattagaggaagaaatctatattacggcctacttctagggtaaaatgttaaagaactaaaggtatattggttgtttgatcgattgtgggttcttcaattggacgtaccccttcaaatatataagggggggtctagacccgttcctaggtgacctccaacaactcccgcgggattagaggactaaatatgcgaggagataggagttttaactgtcattcaatttattcggggaccgtccgcgcctatgactttatgagctatatgtatatatatcacgttgtagttgttctcacttagaagtgttgaaagtaaacttgagatattgatagttgtatccaaagccaagagtaaatgacatatagaattttctttaacaatcaaatatgtattaaaaaactatgtgtttgttgttacatcaacctacattatgatgatgtgagatatcatacagtgtcaaatatcttctgaaacatgcatggttacaacttgctagcttggtnctctgagaaatccagagtgtatatgatgcaccacacctcctcccatgtgctaggtgtcattcagaaaaggaaagagctgaataatggagggatgggccggtagatagatagctctagctgatgtgtctgcacttggataattccagcctgataatatacctgacctagtgacccatgcttgaagcatttttgggccgctcgttttgttttttttctggagaaaatagatgcctttataagttcacttgattgattgcacaggacattctcctcttatgcagatgtcgttcatatacaggaagaaatggcacttacagtgttgccactagtacttaatgcagttatttgttttggtactagcatgaagatgattctcaatgttcttgtttgcaaccacaaaccacttgattgaggtgtggcttgtctacattcctgacttggtcagttctcttgatttcagaagatatgtgcaatttgcctcagcgccatgaggtccggccgcggccaagcactgttcactgctgaatgctcccacaagttccacttcaactgcatctcctcaaacgtgcagcacggcaacaaaatctgcccaatctgccgtgcagtatggaagcagctgccttttcaggggcctctggctgcatctgctgcccatgggtcagcgagagtaaacccagcgatttggccccagatgagcatgctgtcggtgaatccgctggacgagctcccagtctttggcaatccggagccagctgttttcaatgacgatgagcagatacttcttcagcctgaaacagcagttggcggcgaggagggtgacgaggttccccctttgcttgagatcacgacatacaatgaattcccagccacccaggagtccgtggcgcaggaggaattcgccatcttgatccatctcaaggctccgcatgtgccgtcgtgggtaagcacccgagcgccgctggatctggtgactgtgctcgacgtgagcgggagcatgtcgggccacaagcttgcgctcctgaagcgcgccatgaggttcgtgatcgaaaaccttgaccccagcgaccggctctccgtcgtcgccttctcctcgtcggcctggaggctgttcccgctccagaggatgaccgcctccggacagcagcagtcgctgcaggctgtcaactccctcgccgccgatggcggcaccaacatcgccgaggggctgcggaaggctgccagggtggtggaggacaggcaggccaggaacccggtgtgcagcatcatgctcctctccgacggcgtggactcccacaacctcccgccgcgggacggctcggcgccggactacgggccgctcgtcccgcgctccatccttcccgggagcgagcaccacgtgccgatccatgcctttggcttcggcatggaccacgactccagggcgatgcacgccgtcgcccagatgtccagcggcaccttctccttcatcgacatggcggggtcgatccaggacgccttcgcgcagtgcatcggcggcctcctcagcgtggtggcgcaggagacgcggctcggcgtcgagtgcgccgacgatggcgtgctgctcacgtccatcaagtcgggcggctacgccagcggggtggacggcgacgggcgcggcgggttcgtcgacgtcggccgactctacgccgacgaggggagggacttcctcgtcaccgtgcgcgtcccgcagtcacgcggggacattgcgctcatccgcccgagctgcacctaccgcgacgcggtcaccatggagatggtgcgggtgggaggcgacccggtgacgctgctccgcgcggcgaaccctgcgaacgcggggatgtccctgcgtgtggagcgcgagtggcaccgcgtccacgccaccgaggacatagccgcggcgcagaccgccgcggaggagtacgactacgcgcgcgcggcttcgatcctggaggcccgccgcctgctgctggagtcgtgcgcgtcgctgtcctcggaccagcaaacgcaggcgctggtggccgagctgcgggagatgcaggagcgcgtgctgaacgcggagctgtacgaggggtctggccgcgcctacctcctgtccgggctgagctcccactcgtggcagcgtgccacggctcgtggcgactcgactgagctcacgggcctcgtccacagctaccagacgccgttcatggtcgacatgctcaacaggtcgcaggcgctccagccggaggtagcggaggcgctgagccggtccccgacgatcgcgtcgtcgcgcagctcggccccaactcccgcccctgcctcctccggctcgccgtggacgcgacgcgggcttcggtcgttcaggccggcaaagtctttcaccgggctgtcattgtgagtgcaggactgcaggttcgctgattccattcacaatgcatgcaaactggcatcttgcagtagcagtagctaggaggagcgcggaagaaaactatcaccattgatccgtttcttcgatactctattgtcgtagagaggatttggtattactggtttgtactgctgtttgtccgtggattaatcctgagacatgttgtttgaccatcgattcgggtgtttttgttctataaacgtttgtgctgtttgtcgattgttttttccatatagtagctgtttggccc

SEQ ID NO: 8029 - DNA, 1616 bp, Zea mays
aatccgctccgggcgtcatcgttgtatccaaagcgccgtgctagattccacacctagacaggacgccgcacacggcagccacccccttgtgtgcgtgactgcgtctcgcgcgggcaagagtgcacgggcagagccatggacgtagaagcgcgcaaggccgacgcgccgctcgcgcaaggcaaggcgatgcaccgctttctcgtagcgctcaactgcgggatgctggcggtgggagccatcggcgggccgctcctgagccggctctacttcagcaagggtgggcaccggcagtggctgtccgcgtggctggagaccggcgggtggccgctgctggtgattcccgtggcggcgtcgttcgtggcccgccgcgcgcgcgacaggggcgccccggtcctgctcgcgccgccgcggatcctgctggccgccgcgggcctcggcgtggccacgggcgcggacgacttcatctacgcctacgggctcgcgtacctcccggtgtccacgtccgcgatcctgatctcgacgcagctggcgttcacggtgttcttcgcgttcctcgtggtgcggcagcgcctgacggccgcgtccgtgaacgccgtggcgctgctgacggtgggcgccgtggtgctgggcctgcacgtctcgtcggaccggcccccgggcgtcaccaggggccagtactggctgggcttcgtgctgacgctcggcgccgcggcgctctacggcctcgtcctgccgctcgtggagctcgcctacaggcgcgccgcgggcgccggcggccgcgccgtgacgtacgcgctggtggtggagatgcagctggtgatgggcttcttcgccaccgcgttctgcaccgtcggcatggtcgtcaacaaggatttccaggcgatcccgagggaggcgaggcggtacgcgctgggggaggcgcggtactacgcggtgctggcgtggtcggcggtgatgtggcagtgcttcttcctgggcgcggtgggcgtcatcttctgcgtgcacacgctgctggcgggcatcctcatcgcggtgttcatcccggtgacggaggtggcggccgtcatcttcctgcgcgagaggttcagcagcgagaaaggcgtggcgctggtgctctcgctctggggcctcgcgtcctactcctacggcgagtggagcgaggccagggccaagaagaggaagaggacgaggacggaggagggcgccgccgccgcggaggccctgcagcaggcgaacccgtgatgctgctgcggactttggcctggcctcttcgatcttccccgttgtgtgtatatcagtatatgttgtgattgtgatcgctgctgtgtgctacgtggatagcgtcctgaatcgtcgtcacctgcagctgtcgcttctggtgtgggtgctcttctgttcggcggtggacgttggccaatactgtgctgcatggtgtgtagatgtaccttggcagtaccacgttcggttcggacagtaagtctggaccggcgcactttgtgggccgatcccagtacaggactgatctaatctgaacgaatataaaaaaaaaaagaagaaatgtctgtttctatgtgttaaaaaaaaaaaaataagggcggctgctcgcgatctagatc

SEQ ID NO: 8030 - DNA, 1014 bp, Zea mays
  misc_feature (951)..(951): n is a, c, g, or t
gttggtaggtggcgggcaggtaaaagagaaaacgaacccaagcgacagacgggcagcgcggggaggccgccgccgttgcggtatataatcggtccctcgccgccggccgggaaccgaagcagcgacagagttcctccctcccacacgctcggcgctctctccgccagaaatctcgtcgctgcaggtagaagagactcgtgccatttgtcatgtcaggaggatcttcaccatcatcaaggcgaaacagctttaattctttgtctaaggacctagaccttccatcagagcaaggttgtctctccattgttgtacttggggcatctggtgaccttgctaagaagaaaactttcccagccctctaccacctctttgagcagggattcatacaatctggagaagtccatatatttggttatgctagatcaaacctttctgatgatgggttaagagaacgcattcgtgggtatctcaaaggagccccagaagatctttcagattttttgcaactaataaaatatgtcagtggttcctatgatactggagaaggatttgagaaactgaacagggcaatatcagagtatgaggtgtcaaagagttcaggaagctatcgcaggctcttttatttggcattgcctccatctgtctacccttcagtgtgcaaaatgatcagaacatattgcatgaatccatcttctcaccttggatggaccagagtcattgttgagaagccctttggaaaggacttggattccgctgaagaattaagtgcccaacttggggagctattcgaggaacaccaactatacagaatagaccattacctgggaaaagagttagtccaaaacttgcttgttcttcgttttgccaaccgattgttcttgcctctttggaacgcgacatattgataatatacagattgtattcaggggagactttggtactgaagggcgntggaggatattttgacaatatggatcattcgagatatcatcagatcatttactgcaggtttct

SEQ ID NO: 8031 - DNA, 1913 bp, Zea mays
gcacgagaaaagaggaaacgaacccaagcgacagacgggcagcgcggggaggccgccgccccggcggtatataaacggacgctcgccgccaggccggaaaccgaagcagcgacagagctcttccctcccacacgctcggcgctctgtccgccagaaatctcgtcgctggtagaagagaatcgtgccatttgtcatgtcaggaggatcttcaccatcatcaaggcgaaacagctttaattctttgtctaaggacctagaccttccttcagagcaaggttgtctctccattgttgtacttggggcttctggtgaccttgctaagaagaaaacattcccagccctctaccacctctttgagcagggattcatacaatctggagaagtccatatatttggttatgctagatcaaatctttctgatgatgggttaagagaacgcattcgtgggtatctcaaaggagccccagaagatctttcagaatttttgcaactaataaaatatgtcagtggttcctatgatactggagaaggatttgagaaactgaacagggcaatatcagagtatgaggtgtcaaagagttcaggaagctatcgcaggctcttttatttggcattgcctccatctgtctacccttcagtgtgcaaaatgatcagaacatattgcatgaatccatcttctcaccctggatggaccagagtcattgttgagaagccctttggaaaggacttggattccgctgaagaattaagtgcccaacttggggagctattcgaggaacaccaactatacaggatagaccattacctgggaaaagagttggtccaaaacttgcttgttcttcgttttgccaaccgattattcttgcctctttggaaccgcgacaatattgataatatacagattgtattcagggaagactttggtactgaagggcgtggaggatattttgaccaatatggaatcattcgtgatatcattcagaatcatttactgcaggttttctgtttggttgcaatggaaaagcctgtctcccttaagcctgagcacatcagagatgagaaagtcaaggttctgcaatctgtgaaccctattaagcctgaagaggtagtccttgggcaatacgatggctacaaggatgaccctacagtgccagatgactcgaataccccaacttttgcatctgttgttcttcgggtacacaatgaaagatgggaaggtgttcctttcattcttaaagctggtaaagcattgagttcaaagaaagcagaagttcgggtgcaattcaaggatgtccctggtgacatttttagaagcaagaagcaaggaagaaatgagtttgttatacgcctccaaccatcagaagccatgtacatgaaactaactgttaagaagcctgggttagaaatggctactgaacaaagtgaacttgatctgtcatatgggatgcggtaccaaaatgtcaaaattcctgaggcatatgaacgccttatcttggatacaataagaggtgatcagcagcactttgttcgcagagatgagctacaggctgcttggaagatcttcactcctttgctgcatgacattgacgacggcaagctgaaggccctcccgtatgaacctggcagccggggacccaaggaagccgacgaattgagcgcgagagttggatacgtgcagacccacggttacatatgggtaccgccgacccttgcatagaagagaatacgaattgtttgtacctaggaagatccgagtgtcctacaataaagctgtgcgtatatgctcattttcgctatatcgcctgccgttgtaataatgttgtgctggatatgaaataaaattgcgtgttccattcagtaaaaaaaaaaaaaaaaaaaaaaaaaaaaaaaaaaaaaaaaaaaaaaaaaaaaaa

SEQ ID NO: 8032 - DNA, 3748 bp, Zea mays
tgtgtgatgtggtggtagatagagcagctgtgaatgcgtctgacgatcatcgcgaggccggtgagcctgagccccccaccgacagagcagcagaaccaacagactgcaacatctggtgctgcgctgccatgcaacgtgcaccctgccagtgtcagctcaaaagactgcaacatctgttgctcccaccggcccaccaccagacccatcacgatacatacaactgacacccacgcctccgcccacgcggccggtcttctcccgaacggcaacttcgaggatggcccgcccaagtcggcgctggtgaacggcacggtggtgtcgggcgcccacgccatcccgcggtgggagacgtccggcttcgtggagtacatcgagtcggggcacaagcagggggacatgctgctggtggtgccgcagggcgcgcacgcggtgcggctgggcaacgaggcgtcgatccggcagcgcctggccgtggcgcgcggcgcctactacgccatcacgttcagcgcggcgcggacgtgcgcgcaggcggagcggctgaacgtgtcggtgagccccgagtggggcgtgctgccgatgcagaccatctacggcagcaacggctgggactcgtacgcctgggcattcaaggcgaagatggacgcggtgacgctggtcatccacaacccgggcgtggaggaggacccggcctgcggcccgctcatcgacggcgtcgccatccgtgcgctgtacccgcccgcgctcgccaggcgggcggggggaaacaacctgctcaagaacggcgggttcgaggagggcccctacttcctgcccggcgcgtcctggggcgtgctcgtcccgcccaacatcgaggacgaccactcgccgctccccgcctggatgatcgtctcgtccaaggccgtcaagtacgtggacgccgcgcacttcgccgtgccccagggcgcgcgcgccgtcgagctggtgggcggccgggagagcgcgctcgtgcaggaggtccgcaccgtgcctgggtggacctaccgcctcgccttcgccgtgggagactcgggcgacggctgcgcgggctccatggccgccgaggcctacgcggcgcgcgccacggtcaaggtgccctaccagtccaggggcaccggaggatacaagcgcgccgtgctggacttcacggccatcgccaaccgcacccgcgtcgtcttccagagcaccttctaccacatgaagcccgacggcacgctctgcggcccgctcgtcgacgacgcctcgctcgtcggcctgcgcaagaagaagcccgcgcgccgcctcatgcagctcctgtaagcgctgcttccacgtgcactacgcccggacggaccgcgcaagcgatggtgtaatacggctggtatgtgttttttggtttggtgtgtgcgtgcgtggtatacgcgtgccgtgcgcgccctgtggctgtggctgcagtggcgtcgcgttgggtgttttcttgttgtgacgaagaaaaaagggtatgggttggggtggtccgctggccggcgcaccggggttttaatcaacttatattaacctgatgaaggtgaaggtgaaggtgacacgggattaatggcaaaaatgctcctagtactatttttgtaataaaaaaaaaaaaaaaaaaaccgcgaccagctcgccaccgccacgtcgcgcgtccagaccttgttgttctcgatcgtagtccagttccaggttgttgatgccgttccggtggaggaagttcttccaccaccgacgaagaagccaaccgctcatatatactcgaactggactctattgtaatccggacaggacgatcaagcatctcctagcgtcttacggctccttgtaggggcaggtttggtttggcgctctgagtccaggatcagttcagatttgatgtcttccatactcagaagccgccagcacttttttttttgcaatatgacactgaattagcctttcaagtttgtggatccgtttctttcttcctcatgcaattcgagaagctacatgcatggtgattcttctgacccagataaaagatctagaggatggggttctatggtgaaaaatatgaatggagaggtattggtggctggggctggggacacaactcgacatgcttcatcggccctacatgcatggcgatgtgccattgtggcctacaagagcattcattcttcatgcaattcagttaggtttatcgcaaatcatattagaaaaaaaaatggatgccatggtgtttcatattcgagacatgatgcaatcagagttttctttttttaatgcctcgttatgtaatagagactgtaataaggtatctgattaattgtttagctatccatggagcttatattttttttttaaaaaaaaagattttgaaaaatgtaaactggctaacacgctatggctgaagcgcatgtgttgttttaaattgttcgccgtacgtgctccatttcacttctcaacagcactcttctcttatttgtcccatgagccttgcctacgggatctgaatcctccgtcgtgcggccgtctcctcctttctccatcgtaacactgcttcgtggtcgtggcattatcctgacaccggcaaccgccatgcggccctctcccttctccagcaggacgccatcttctagtcgcatgtatagaaataggagagacaacataattcaggcaaaatggttgaataacttcaaaaaagtataaatgaaaatttagagttactacttcgcgaaatatggactatttggaatgatgaaacacatcattagattttgttagaagctagaatatcaacgctacaaaaaccgttactcatcatagaccagggttaaccatcctatttttactaatttctcactaataaccgggaaagagaaaccggatggttttcgttggttttcaaattttctggctgattttcattttcaaacaaaaaatggtttcgaatttcctgacctagaaatgatatttgctggctggtttttgttaatttttcattgaaaaatgttgttcctcggattttttcgaacgaaattcgttgtttgcaatgtgcatagactttcaaattaaaaaacaaaatttgtatttctcgaccaagatttcatgatttttagcgaaaattgttgtttttaaacgaaaaatgatgactgaatttaaaaaaaataaatatgggacataccaggaaaaatcgttgtttttaatagaaaatctttgtttttaaaccgaaaatgatggacatttagaatggcctcctctataacatcaattttgatagacgtgcaacaaggacgaacattctaaaacaaccatgtctcctaatagattatttatagaggcaaacatatttgaaaacggcgacgctacaatagcttatgagaagaaggtgaaaatcatccctaatatttttgttaattctcacaattcaaaacatggtcttattaggtattcatgcggttgttgatggagatcaacagtcaaattttaaaggaatggatgaagaggtaaatgatcagctaattcaaacggtcggtagagtcattggacacttataaaagcgataggaccttttattttccttttgccatgctataatgggccatggaatgggtaacttcaccaaggtgagtatagttaggtgtgatgtgcatagttgtaaaaattactgttaggtaaaccaaagatagctcacaaaaagtttgaaagaaaccccactcgaaaaacaattaaaacgagtgagtgg

SEQ ID NO: 8033 - DNA, 2048 bp, Zea mays
cattgggtacctcgaggccggccgggagggcgttctaccgcgacgggggtcgctctataaagaccttggttgggcaccccgaggccggccgggatcgtcctccgctccagcagctgccacagagacatcagagagcggtcctccttgtgagtctgagctgaagaggaggaggaggaggaggagaagcagcagcgcagccggaggagggagagcgaagatgcgccgcgtcgcgctgttgctcgtcgccgccgtgtgcgcgctggcggcgccggctgccgcggtcgtcactgacggtcttctcccgaacggcaacttcgaggatggcccgcccaagtcggcgctggtgaacggcacggtggtgtcgggcgcccacgccatcccgcggtgggagacgtccggcttcgtggagtacatcgagtcggggcacaagcagggggacatgctgctggtggtgccgcagggcgcgcacgcggtgcggctgggcaacgaggcgtcgatccggcagcgcctggccgtggcgcgcggcgcctactacgccatcacgttcagcgcggcgcggacgtgcgcgcaggcggagcggctgaacgtgtcggtgagccccgagtggggcgtgctcccgatgcagaccatctacggcagcaacggctgggactcgtacgcctgggcattcaaggcgaagatggacgcggtgacgctggtcatccacaacccgggcgtggaggaggacccggcctgcggcccgctcatcgacggcgtcgccatccgtgcgctgtacccgcccgcgctcgccaggcgggcggggggaaacctgctcaagaacggcgggttcgaggagggcccctacttcctgcccggcgcgtcctggggcgtgctcgtcccgcccaacatcgaggacgaccactcgccgctccccgcctggatgatcgtctcgtccaaggccgtcaagtacgtggacgccgcgcacttcgccgtgccccagggcgcgcgcgccgtcgagctggtgggcggccgggagagcgcgctcgtgcaggaggtccgcaccgtgcctgggtggacctaccgcctcgccttcgccgtgggggactcgggcgacggctgcgcgggctccatggccgccgaggcctacgcggcgcgcgccaccggtcaaggtgccctaccagtccaggggcaccggaggctacaagcgcgccgtgctggacttcacggccatcgccaaccgcacccgcgtcgtcttccagagcaccttctaccacatgaagcccgacggcacgctctgcggcccgctcgtcgacgacgcctcgctcgtcggcctgcgcaagaagaagcccgcgcgccgcctcatgcagctcctgtaagcgctgcttccacgtgcactacgcccggacggaccgcgcaagcgatggtgtaatacggctggtatgtgttttttggtttggtgtgtgcgtgcgtggtatacgcgtgccgtgcgcgccctgtggctgtggctgcagtggcgtcgcgttgggtgttttcttgttgtgacgaagaaaaaagggtatgggttggggtggtccgctggccggcgcaccggggttttaatcaacttatattaacctgatgaaggtgaaggtgaaggtgacacgggattaatggcaaaaatgctcctagtactatttttgtaatatctcgtcccccggcggctcctcgctcagatctccacctccacgtcgggcgtccagaccttgttgttttcgatcgtagtccagttccaggttgttgatgccgttccggtggaggaagtttttccccccccgacgaagaagccaaccgctcatatatactcgaactggactctattgtaatccggacaggacgatcaagcatctcctagcgttttacggctccttgtaggggcaggtttggtttggcgctttgagtccaggatcagttcagatttgatgttttccatactcagaagccgccagcacttttttttttgcaatatgaccctgaattagcctttcaagtttgggaaaaaaaaaaaaaaaaaaaaaaaaaaaaaaaaaaaa

SEQ ID NO: 8034 - DNA, 761 bp, Zea mays
atcgtccttcgctccagcagctgccacagagacatcagagagcggtcctccttgtgagtctgagctgaggaggaggagaagcagcagcggcgcagcgggaggaggaggccgggagagcgaagatgcgccgcgtcgcgctgttgctcgtcgccgccgtgtgcgcgctggcgccggctgccgcggtcgtcactgacggtcttctcccgaacggcaacttcgaggatggcccgcccaagtcggcgctggtgaacggcacggtggtgtcgggcgcgaacgccatcccgcgttgggagacgtcgggcttcgtggagtacatcgagtcggggcacaagcagggggacatgctgctggtggtgccgcagggcgcgcacgcggtgcgtctgggcaacgaggcgtcgatccggcagcgcctggccgtggcgcgcggcgcctactacgccgtcacgttcagcgcggcgcggacgtgcgcgcaggcggagcggctgaacgtgtcggtgagccccgagtggggcgtgctgccgatgcagaccatctacggcagcaacggctgggactcgtacgcctgggccttcaaggcgaagatggacgcggtgacgctggtcatccacaacccgggcgtggaggaggaccccgcctgcggcccgctcatcgacggcgtcgccatccgtgcgctgtacccgcccgcgcttcgccaggcgggcgggggggaaacctcctcctcaagaacggcgggttcgaggaaggccccctacttcctgccc

SEQ ID NO: 8035 - DNA, 2560 bp, Zea mays
cgacctgcagtcttctcttctacactacaactaaaatactttgtcttcaatcatgtgttagattagactgatgtaaaatatactatagtggtattataaactacggttttgagaaatagagttcccaaacaggtcctaagagtaaaaatgaggacaccagcaaaaataaggttatcacctttaaaatggctgatatgagcaccaaaactccttgagcacgggatatgtcaagttttttgctattataggtctccttttaacaggcttttgctttatggtactcttaaaataaccttccataatagtatttataagtggtgttactctttaaaataatattctagccctttttatattcctttttttttcttttttccctgtcttctaaactgctcatattgcccctgtccccaatctgcatctgttcagcgccgctgcaaatgaacaaatccatctcaagcctctgctatctttctccagcgttgggctcaagtttagtaaggatgcaaagcattatcacaagtcagcgttgattctttccatagtaaaatcaaaagaaaatgtaaacattgcggttagatgatcatactgtgcaggtcatgctctatcgatatttagacctgatgattatcctctgtatgtttagtttctgaacacatcagttcacacctatataatccagcaatcatgccttgaataaaaatggtgttacagtttctgaacacaacaggtttcaaaacggtgtttacagtttctaaacacatcagttcacaacaatacgagcagtttagaagatgaggaaaaacaaagggaaaaagaaatataaaaaggatatactattattttaaaaagtaacactacttataaatactattatagaaaagattatattgatatcataaggtagaaaagcttgttaaaagaaaacctataataccaaaaaaaactcaattgctgttttttttttttttttggacgataaaatctgatatttgttatcagcaagaaacagatttgtaaaattgtcatcagacccatattttatagaaccaactggactcacagtttatatacataacaagaagacattgtgagtgacaaaagttcaattatcttaaaacaggattggcaacaacagtactccgtacaacactgtgaccaaggaatcgggctttagggatccctatgtccagtaccaccacctcgcctccgccgccggccgccggggaccatccccgtgttctgctccgaggtttcctctcccgtgagacatgcaaggtactctccttccttcccgaaaccactgttccactgaagcttggcgcttagaaccctaaaccttagctgctcggttcggtctggaatcgcttcacgggcgcggcgcgtgcgtgcggcaggagctggagttcgtgcaccggagctgcggcgcagcggggtaccgcccctcggtgatatcgacatctctgccgcacctggcggccaccggctgcggccacctcctgctcccgttcgtgcccgtccgcgagcgcctccgcgacgctgtggagtccttcttcgattgccacttcgatctcttcatcgagttcaccgggcttatcaggtgcacagtcgtcgtgttgcgtggacttcgcttcctatgtgttttgctgcgccggggttgctccagcttttgggctcgtgccaagtttaacgccagcatcaaattagtgctcttagtgtttctctgcagactgccgagtgcggtgtgacgtgtgagtatgggtgctttcttcagctaccttaagggtctgtttggatatacatggctagttaccggtttggataaaaattagctatgattgtccagctagttggcaaagaactagttgaagtaactaaaaaaatactccatatatctaccttcctgtttggatgcattagagctattttgagctaaaattagctagctaacagttacctcatggtatccaatcatacccttattgtgttgatcaaattcacaatgtttctcacgggattaacagctgctgtagagtgtttccatgtggtgcccgtaccaatgatcgaccgggcttggcagatttatataagtatactagtggctgaacagtatgcagtgttgggctagtagcgtgaatgatttggtaccatgttgataaatttggccattattgcgatagttttctttactatgtgatgattaatttgcataatgagattacataccttgcatgtgtactgcataagctatatgcagttttatcattttatcaacactacatgcacattccttaaaagtggaacatcacatctgaacgttcttatagtccttgacacaacgtgctcccacttaaaccatgttcgctatgcagttggtgcaagggagcttctattggatggcacagtgatgacaaccagccttatcttaggcaaagggcattcacagtaaggatctatctttatttttccttgcagtttcgtcagtttagctaaggcctattcctgtttatatgttgcatctattgcgcctatgctttgttttgggtttggtggcgcatca

SEQ ID NO: 8036 - DNA, 2650 bp, Zea mays
cttcctcttcctcttcctcttcctttccatcctttcgacccatccacaccgccaccaccgcctacctccaccaccagtccatctcctccgcagcgtctaaagccctatccggatatccccactcgccgaagcccggacacatggccagcttcggcgtcgacacccgcccggccgccgcggcctccggcggcggcgtgggcgtggcggggacgagggagggcgcgctctcgtttctctcccgcgggctgcgggaggaccttcgtctcatccgcgcgcgggccggggagctcgagaccttcctcagcgcgccggtgccggaacccgagctgttcgcgcgcctccgtcgcgcctactcctcctcggcgtcctcttcgcggacgcggctcgacctgtccgccatcgggaaggcgttcgaggccgacgcgtggaggggcgccaggactgccaggtggaggtgggaggcggagacggaggcggaggagtgggagccagtcaggatggtcaaggcgcacctcagcgagctcgagcggaggaggctggcccagtcgcccagcgacatgctgcacaagctcaagctcagcttgaaatcactgacctttgcgcctgaagcgtctgaggatgttctgccactggatttaggggaacttcttgcttattttgtaaagcaatctgtaccactattcgaccaacttggtataaaaagagatgtatgtgacaagttggtggagtctctgtgcagcaagcgcaaggaccaccctgcatatagttttttgtcagcaactgaatcatcttcattgaaaaatgacaatgttgggaatgaactcgacctaagaatagctagcgccctacagagtacaggacaccattatgaaggtggattttggagtgatggccataagtctgacatatctggcaagagacatgttgccatagtcaccactgccagtcttccctggatgactggaacggctgtgaatcctttgtttcgagctgcatacttggctaaatcttgcaagcaagatgtaactttggtagtgccctggctttgtaagtcgctcggccgggttgtgtaccccaacagcatgacttttagttcaccagaagagcaagaaacatatatgaggaattggctggaagaaagagttggtttcaagacagacttcaaaatatcattttatcctggaaagtttcaaaaggaaaggagaagcataattcctgctggggacacttcacagttcataccatcaaaggaagctgatattgcaatcttggaagagcccgagcacctcaactggtatcatcacgggaaacgatggacagataaattcaatcatgtgatcggtgtagtgcatacaaattatttggagtacatcaagagggagaagaatggtgctattcaggcctttttcgttaagcacattaataacctggtcgccagagcttattgccataagatcttgcggctgtcaggtgccactcaagatcttcccaagtcgacgatctgcaatgtgcatggtgtgaaccccaagtttctggaggttggagagaggatagcagcagagcgggagtctggccagcaatccttctctaaaggagcttattttctggggaagatggtgtgggccaagggttacagagagttaatagatttgttcgcgaagcacaacagtgatttggaaggcttcaagctggacatctatggaaacggtgaggattcacacgaggtgcaatcggctgccaggaagctgaatctgaacctcaactttcataagggccgggaccatgcggatgattctcttcatgggtacaaggttttcataaacccaagcatcagcgacgtcctctgcaccgcgaccgcggaggcgctagcgatgggcaagttcgtggtgtgcgccgaccacccgtccaacgacttcttccggtcgttccccaactgcctgacatacaagacctccgaggacttcgtcgccagagtgaaggaagccatggcgcgcgacccgcagcccctgaccccggagcagcggtacaacctgtcgtgggatgccgccacccagcggttcatggagcactccgagctcgacaaggtcctgaatggcgacagcaacagcgaatgcggtggctctgttggcaccgaaaccggcaagagcgcgggcacaatgatgaggagatccgcctcggcgccgaacatgtcagacgtcgtggacggcggcctggcgttcgtgcactattgcttcaccggcagtgagctcttgaggctgtccacgggtgccgtccctggaacccgggactacaacaagcaacatagcctggacctccgtctcccgccgccccaggtacagaacccggtctacggctggtaattactagatatataggtatagctctgcagtctgtagcactagctttttcatctccgcgtgtgtttgtttgccaaaggcgagccttgttcattattacctacaaacaacaactacgactgtaaggatgacaacgctgcgtcgtgattttgtaagactagtgctagatagagaggcgagcatttcttcaatcaaaaaatttaaaaaaaaaggaaaggaaagaaagactgaggcggggcaggccctctgtttccaaaaaaaaaaaaaaaaaagcggccaaaaaaaaaaaaaaa

SEQ ID NO: 8037 - DNA, 645 bp, Zea mays
agcaggagaagagagacgacacagcagctttttgggtttccccttccctttccccgcgcggtgatcgcagggttctccgcgagcgaggcagagcactgcgcgtcctccgtgacttcctggtgatcgctgggggttctggacgttggtgtttcatttggttggttggtgggtggcagcagccgtggcgagatggacctgatgatgccggtgacggtgaaggaggagtggccgccggaggaggaggaggaggaggacgtggacgcggacgcggacgctccgcggccgatggaggggctgcacgaggtcgggccaccgccgttcctgaccaagacgttcgacctggtggccgacccggccaccgacgaggtcatctcctggggccgcgccggcaacagtttcgtggtctgggaatccccacgtgttcgccgccgtgctgctccccaggttctttaagcacaacaacttctccagctttgtgcgccagctgaacacctatctagatggaccaggacaagggatgaacgaagctactacagcctacaagaaagaaacaaactgcttgtttgtcctagagataaagaagactcactcctttgatcaccactcaccaccaagcaatatactgctagtggcttcagaaagagc

SEQ ID NO: 8038 - DNA, 1371 bp, Zea mays
ggcgaaaaatccaccaccacccctatccccatcaacaacgcaaaaacctaaaccgctcgctctggtccatccagatccacagtcgccatcgcccccacctctcgtcgtcgtctccgtgcaccactcggcccccactgtcggccgcgcctcccagccacctcgtgccgctctgccaccccgcccgtcctccactgcccctatggctgccatgggcgagcgctgcccgagtagccgaccgccctttccccgccgtcttcagctgccgcgcgctgccccgcctccccgccaggcctccactgcccacttctccggcggctacagcggaaggcaaggagaaggacagcgggcagcggtagctggatctagcaagcacagggcgtcttctccatccgccacctctcggcgcatcatcagctgagagtttcaggcatttgctcaggtgttttcatttcataatatagctactactattttaatgatgggtaagagattaggtggttgtactgtacaaaatattcatgtgttttactggccatcaagtttcccttaaattaatgcctaattgcatttgttggggttacgtactaatgccttgaaaggactgtgtaatattccagaatattgtgttcattttcataagtaaaatttgtttgggtgaagttgatttttcacatatatttgagatctgtttagacaagccttgatgaacttggttgtttagcatagttcggctttcacaaatcacaatgtttagaatctttttatacgcatggggcttatatgatgaagcttcactgctccactactatttgacatacaatatgtttagaatgttttttataattgagctttcacaatgtttagaatcttttattcttataatgtatgtttttatgccacgtactcatagtttttacaatcagttgcttatgatccttcagttcattaacgaacttttaggtggttgtgcttgatcggtggtgttctcatgccttctgttttgtggctgtaggatatcaagaggagggaagaggcgctgaagaatggtgcagatacacatttgtttttgcataattgctgccatagctccaccaattgtatttcatgggaaatcattaacatatttcgttccctccgttgagaagagccagcaactccttgtgctatgtagccccctttgaagataaaaaaacttctgataggtttggagctactgctctcagctgcaggtgtccatctcttgaacataacctttgtggtttgctcagtctggagctattttgtttcagctgtgttgtgtgattaaaattgggtctccgaggtattttgcagaactaccactatgttttaatcttgtatgtttggtctgtc

SEQ ID NO: 8039 - DNA, 1146 bp, Zea mays
cattgggacctcgagccggccccgcgtggccggccggcagcacgacctgcccggtcagaatcattgattgatgtgtttgttggattagtcaagatctctcactgattcgcagcatccccctctgtttctccatgatctgttccttctcctggctgttctccagttgacttgctccatcgcctctccacgactagaggagggaggaggggagctctgatcgattcacccaagatgtctgaggtggtggcgatggcggggcaggcctacatgaagcagctgcaggcccacccgctgcgcaccaaggctatcacctccggcgtcctggccggctgcagcgacgccgtcgctcagaagatctccggtgtttccaagctccaactcaggaggctcctcctcatcgcgctatatggatttgcatacgcgggaccgtttggacatttcctccacaagctcatggataggtttttcaagggaaagaaaggaaaagaaactacagccaagaaggtcttagtagagcagctgaccgcatctccatggaacaacatgatgtttatgatgtattttggtctggtggttgaagggagaccatttggacaagtaaagaacaaggtgaagaaggattatgcatctgtccaactcacagcttggaggttctggccaattgtaagttggatcaactatgagtacatgccactccagctccgagttcttttccacagctttgtcgcctcctgctgggcggtgtttttgaacctcaaggcagcaagatcgatcgcaaatactaagaaggcatagaggcagctatctataccaggagcggaagtcatgatttgagttgaaaaccagtatatattctagacttccgttgtaacacctgaattcttttccagcaggagaggaaccgagtcgtattgtttgccatgaaaagtttgctccttttcatttccatagctgctgttctctcttcatttcgaaaaaaaatgttgtttgctcgcctcgtcgaagtgatcacgtgtacttctagttctagtggaacttagtttgtgcagaaagaatatgtactcgctaacttgtatctaaagcatatatgtttttcacatcgaataactggattgcattcagacagattcaaaaaaaaaaaaaaaa

SEQ ID NO: 8040 - DNA, 4703 bp, Zea mays
cttgatgattacgggcaagataaagtcttggaaaactcagagacagctattgtctagaaaaaggaaaaatcaaattactacacttgtcgaggtacttccttttttctaaacagaagtcaattaatataattattgttaaacatttttctgatactctttatgtactatgcaggaagcccttaaaaattcaagcttcgagatctatggctccaggacacgtgattctctagtgaattggaatcctgattgcataggtttcaacctcatagaggctgttctgtgccacatatgtcgcaaagagcgacctggtgctgttttagttttcatgactggatgggacgatattagttgcttgaaggatcaactgaaagcacatccattgttaggtgatccgaatagggtttttctgcttgcatgccatggttctatggctacttctgagcaggtaattgctctaatctggcatatcatagtgatgctgatgtaactatatcttggaccacatgtactattgtactgtgcctaaattgataccatatacaacaggtttatcttgtttattagctgtttgatgtattttatcccaaacatcccttctgtgtttcacatctacatttttatcttgttcacagaggctaatttttgagaagccacctcctaatgttcggaaggtagtccttgccacaaatatggcagaagcaagtattacaataaatgatatcgtttttgttgttgattgtggtaaagcaaaggaaaccacatatgatgctctaaacaatactccatgcttactcccctcatggatttcgaaagcttctgcccgtcaggtgaattcgtagcttctgtttgcttgtttcatctttcaccggtagatcttttgtttgactcaattatgagacttctgttcaattataatcccaattcctgactaaaagaactttgttccattggcaaaaccaaaggtcaaaagacctatttattcagctgacatctggggttatttatgtttgtttaattgcattagtccttaactctattaacccttctgtgttcttctttctctctctctctctctcaaacctttcataaggtatctttttggtctgttttagtattcactggttacaattagaaaagaccaacaataacaattgaaagaaatcccaacgagccaaatttgaacataacctcttggcacatatattatcacacttggccactttgtttacagtaccatctatccatctttgtgattcgcggcaattctcatagtatccattgtcttaatgcagaggaggggtagagctggccgtgtgcaacctggagaatgctaccatctgtaccctagatgtgtgtatgatgcatttgcagactatcagcttccagagcttcttagaactcctttgaattcattatgtctgcagataaaaagtttgcaagttggaagcattggggagttcctatcagctgctctacagcctccagaaccacgagctgtatgtgtttaaatcatactttggcatttccatattccctttttctcattgcctttgtgtctttgttggatatagtgtcatattaaccgattttttttctagcatgtgcacatcatatacattttttaagtaggtagcaaaagatccttcttttgattttgaattatttccacttacacttgataaacacgtaggtcgagaatgcagtggaattcttgaagatgattggagcattagatggaaatgagaaccttactgatcttggtatgcagtgtatgttggttccctgcatgctccggagaaacatttagaactgaatcttagatttccttattcaattttgcaggacgatacctttccatgcttccagttgatccaaaattgggaaagatgctcataatgggtgcagtttttcgatgcatagatcctatacttactgtagttgctgggcttagtgttcgggatcctttcctgttaccacaggaaaagaaggatgtaagccttttaatttctgctattagtgtatatatatattagtgtctgagtattggttgcgaatcaaaatttccttttgaaaaaagttatatttatgaaacagtaagggatactttagtactgaaaaaaatgcatgtggtgctttttatttagcaagaagcttattttgcatgaaggtaagaaggcttggttttcatattatactttatatattagttggcaggaacagcaaaagctagattctcagcaattatttagcaagaagcttattttgcatgaaggtaagaaggcttgtttttcatatgattactttatatattagttggcaggaacagccaaagctagattctcagcaaaggattatagtgatcatatggcccttgttcgggcttatgaaggatggaaggatgcacagagagaagggtctgcttatgaatactgctggagaaatttcctttcttctcaaacactacaagccattcactctctccggaagcaattcagctatattttaaaggattccggtttgatagactctgatgggaatacaaacaacagtttgagccataatcaatcattggtccgcggtattatatgttctgggctttttcctgggatagcatctgttgtggtaaacagctcttgacaactactatccattttgttaggctggaattaacagttcaactggcccttttcctttgcagcatcgagaaagctccatgtcctttaagaccatggatgacgggcaagttcttctttatgctgtaagtgcatagcagaatgtcctgaaatgttcgtatgcaatgccttgtttagtatctagctatctaatcacccctgctatcatatgctatgatacctttcaagttggcaagcgattccatgcttaaacacctactgataccaaagtagcactgatttctaagtttgaattcctgacattattcttaaattcagaattcagtgaatgcaaaatatcagaccatcccatatccatggctggtctttggtgagaaggtgaaggtgaatgctgtcttcatccgtgattcaaccggagtatcagactccatattgattttgtttggcggtgctgtagcaaaaggaggcatggtacatcgcgttctactaacagatagtttttctcatggatttctgtgtttacgttgctgtgctttatggcttctagctgttatgtttcaggccgggcacttgaagatgctcgatggctacattgatttcttcatggaccccagcctgtctgaatgctacctgcaacttaaagaagaactcgataaacttatacagcagaaggtgagtcatgcagtcaaatcggttcacttttcaaaggagttctctagattgtcaatatgcatttccattttctagtgaacgataataacaaacattttctagtgaacgataataacaaacatcagtagaaacccttctggtatgcaataaaattgacagtctttgagcagtgatatgtgctttgtttcagtcaacagtctgactgtgatactttttgcgtgatccgacaatttatttgttcgagtccagcttgaagacccaaacttcgacatccacaaggaaggcaagtacatcctattcgccgtacaagagctcgccgccggcgacctgtgcgaagggaggttcgtgttcggccgcgagacgagccgggcccggctccggagccccgaggacgacggcaagagcaacctcataaaggacgggatgaaccccaagagcctgctgcagacgctgctgatgcgggccggccacaccccgcccaggtacaagacgaagcacctcaagacgaacgagttcagggccgtggtggagttcaaggggatgcagttcgtggggaagccgaagcggaacaagcagctcgcggagcgggacgccgccatcgaggcgctggggtggctgacacagacctccggcgtgaaggctcaggacgagaaagacgacgactcgccgctggacctgactgacagcatgctcaagctcctcaccaggccgaggcggcactcgaagaatagctctaggaaacggtgattttttgggcgaggatttgctgtagattgatcgcgcacacgcacaaaaggcagagagagagagagagagataggaaacgtcagctttggttacacgaatgcctcatggtctcgatgtgttgctttgtacattttttatttttatttttccacgctatgtcatcagaatcagaagttcctccatcctgctgattgctgtcaccccccccccccctttaaaaaattaaaataactgcctatagcgctgttatttctatagaaataaccttccgaagaatctaaatctacgatattacacttttaaccgctatttcagctagaactgctttagcctaatttagctttgctaaatgtcgtagctttaatgctaaacaacaaatgttatttctatttttatggtaggccaaaaaaattaatgaatgtaatgacaaaggataaggaagctcattgatattaatgaatataataaggatcaaacctgagtttgcttcatacagaagaagacatacatgctatttacatggatcaacagtcctcaagtgctcatttttatgattaagataattttatgcttaatgaatagattgcactaatagtcatttactcgcattaataagtattttttgttacataccaaaattatggtgttgta

SEQ ID NO: 8041 - DNA, 1351 bp, Zea mays
gttgctgggcttagtgttcgggatcctttcctgttaccacaggaaaagaaggatttggcaggaacagcaaaagctagattctcagcaaaggattatagtgatcatatggcccttgttcgggcttatgaaggatggaaggatgcagagagagaagggtctgcttatgaatactgctggagaaatttcctttcttctcaaacactacaagccattcactctctccggaagcaattcagctatattttgaaggattccggtttgatagactctgatgggaatacaaacaacagtttgagccataatcaatcattggtccgcggtattatatgttctgggctttttcctgggatagcatctgttgtgcatcgagaaagctccatgtcctttaagaccatggatgacgggcaagttcttctttatgctaattcagtgaatgcaaaatatcagaccatcccatatccatggctggtctttggtgagaaggtgaaggtgaatgctgtcttcatccgtgattcaaccggagtatcagactccatattgattttgtttggcggtgctgtagcaaaaggaggcatggccgggcacttgaagatgctcgatggctacattgatttcttcatggaccccagcctgtctgaatgctacctgcaacttaaagaagaactcgataaacttatacagcagaagcttgaagacccaaacttcgacatccacaaggaaggcaagtacatcctattcgccgtacaagagctcgccgccggcgacctgtgcgaagggaggttcgtgttcggccgcgagacgagccgggccaggctccggagccccgaggacgacggcaagagcaacctcataaaggacgggatgaaccccaagagcctgctgcagacgctgctgatgcgggccggccacaccccgcccaggtacaagacgaagcacctcaagacaaacgagttcagggccgtggtggagttcaaggggatgcagttcgtggggaagccgaagcggaacaagcagctcgcggagcgggacgccgccatcgaggcgctggggtggctgacgcagacctccggcgtgaaggctcaggacgagaaagacgacgactcgccgctggacctgactgacagcatgctcaagctcctcaccaggccgaggcggcactcgaagaatagctctagaaaacggtgattttttgggcgaggatttgctgtagattgatcgcgcacacgcacaaaaggcagagagagagagagagagagagctttggttacacgaatgcctcatggtctcgatgtgttggtttgtacatttttttatttttatttttccacgctatgtcatcagaagttcctcc

SEQ ID NO: 8042 - DNA, 1797 bp, Zea mays
tcctgggatacgatacatcaaagatgggccatgaaaaagctatggggcaacgatttggtaaactattatcagaggaagcattcaactgcataaatgttgtaggaactctatcctttcaaagatgcgcaatatcaaataataagatcagataatgagcaacaaaccaacaggacgatatcaacacatctactactattaattcatccaggcacagggaatggcatgcttagttgcagaagtaccaatcgcggtgcaccagaagaatatgcaaactattgacaccagatctcgcctaacatggtccaaaatgccacacacacaacacatcccagcacattaagtcattaatcgccaaggaccaggacaatgagtctcaaacaaaactcgaagcagggagcagcaggaagaaataaaaaaataaaacaagccgacggcgagcaatccacaaggaaggcaagtacatcctattcgccgtacaagagctcgccgccggcgacctgtgcgaagggaggttcgtgttcagccgcgagacgagccgggccaggctccggagccccgaggacgatgacaagagcaacctcataaaggacgggatgaaccccaagagcctgctgcagacgctgctgatgcgggccggccacaccccgcccaggtacaagacgaagcacctcaagacgaacgagttcagggccgtggtggagttcaaggggatgcagttcgtggggaagccgaagcggaacaagcagctcgcggagcgggacgccgccatcgaggcgctggggtggctgacgcagacctccggcgtgaatgctgtcttcatccgtcgggagcaggagctccctcctagactcaatctgcagcggcatgtgatttgactgaaaattgagcaacgcggctatacaatacctgttggggtgctgctcccggacgaagcggatgccaccgttgcagaggttgcaggcgcctgcaagcacagagcacttcacccccacaggctgctgggcgcggacgagtgtcgggttacgtcctgattctcagcagcgagataccccgtagcgcccccaagttgctcttcttcctaggctgcgggtcgcggacgccgtacctggttcggtgctcgccgatatgctgcgcgcggttctttagatcgacgatctgggtggcgatgttgcggcaggggtaccacgtccggatctcgtagagaatcttgcggacgaccgtcacctagccgctgcccctggggtctggacggaggctgtaggcgaagtcgtcgatgcagtcttcgatgtcgtaggcgacatcccagatctgcttcatccagtcctccgtctagttgttgtggccctcctcgcacttgctcaggctgctgaggaaggtctgcatgctggctagctcgtcggtgataaattggatgtcgccccggacgccacggatcagggcatactcctctgcgaggagggcgtagctgggcgagggatttcgtggagcgctcagctaggctagggcacgcgcggatcgcggagagggggaggcgggggcatcctatgcactggatctgggcgtggatgttggcgtggatctggtgcgcggaggtagtagctgggcgagggatttcgcagaggtagcagctgggcatgcggcgggcggctcgtggcggttgaaacggtcacggcgccattcgcgtagggatttgcgtgcttgaggatcgcggaggcgggaggatcgcggaggcggggtttccggagagggagacgaccgaggggatcgggggcgacggggtttgcggcgtgcgggcgt

SEQ ID NO: 8043 - DNA, 1571 bp, Zea mays
ctccttttttatttgttcatgcttgtcacgaccgccaccattatcttgcttttgatttgggaacggcagcctaattcggcttaatatagttgcaatgactggattcttcttccccaaggagacggcgccagagctatcttcgcctcgcctctccgcgttgttggacagtggtttgacctggttcagtatatttctgacgaccgcctcaggatctgagttctgggacacagtgaccattgctcgacgctggaattcaggcccgtattttgtgtagagatccattgcgatggtggttttacccacaccaccaaacccgacaatgctcagcacgccggttttctccctcttgccatcttcatggatccacttcttaagatccggcatatccttcacccccacaggctgctggacgcggacgagttgccgggttacgtcctgattctcagcagcgagataccccgtagcgccccccaagttgctcttcttcttcccaggctgcgggtcgcggacgccgtacctggcccggcccgcccccgtatgctgcgcgcggttcttcagatcgacgatctgggtggcgatgttgcggcgggggtaccacgtccggatctcgtagagaatcttgcggacggccgtcacctagccgctgcccctggggtctggacggaggctgtaggtgaagtcgtcgatgcagtcttcgatgtcgtaggcgacatcccagatctgcttcatccagtcctccgtctagttgttgtggccctcctcgcacttgctcaggctgctgaggaaggtctgcatgctggctagctcgtcggtgatgaattggatgtcgccccggacgccacggatcagggcatactcctctgcgaggagggcgtggatttcgtggagcgctcagctaggctagggcacgcgcggatcgcggagagggggaggcgggggcatcctatgcactggatctgggcgtggatgttggcgtggatctggtgcgcggaggtagtagctgggcgagggatttcgcagaggtagcagctgggcatgcggcgggcggctcgcggcggttgaaacggccacgacgccattcgcgtagggatttgcgtgcttgaggatcgcggaggcgggaggatcgcggaggcggggtttcccgcggccgggcgggcggaggcgggggtagtctacagtaagcgcttaatagttagtagagctaaacaggttacacatattgtcttgtgcatgtggtcaacttatagattttcctaaaaattgtttaaggacattagtctgcacttaccaacctatttttgaaattcattctgtatatcggacaagtgccaacaggtatggtcaattaagtatcaacactgcaaccctgctccccctctccaacatttactgtttgcccatttattcatctctattcacacctttttttgttttcttgctacatttactcaaatgtgtgcacttaccaaccattggttcatctcttatttatggtattacctggttacacatacatactttacaagcatgttctacttactatatcttcatatatataaataggttcaata

SEQ ID NO: 8044 - DNA, 1406 bp, Zea mays
gcacgagaccattacctagaacatcctaatcgaaaaagccgcgctgccatcccgcggaggactggaggagcacgcatatccgagccttccctgccgcgtcgcatggactcatgctgtcgcgggccgcctcccgcatcgcctccaaccgggtgcctgcctaactggccgattttcttcctcgcgtagccccattccgcagcacaaatagcgcgtcactttcccgggttctatcgcgtgccccccttccgatcctgccatttcgtgcatcctgtagcgtctggcagtgcgggggtcatcggggatggagtgggtggacaggaccaaggcctccgccgccgccgccgcagcggcggcggacgagagggctgggggagcggaagggctcgcgggatacgtcaaggtcatgaccgacgaacagatggaggtgctccgcaagcagatctccatctacgccaccatctgcgagcagcttgtcgagatgcaccgcgccctcaccgagcaccaggacaccattgcaggaattaggtttagtaatctgtactgtgatcctcaaattatccctggaggccacaagatcacagcaaggcaacgatggcaaccaacaccaatgcagctgcagatcttggagaacatctttgaccaaggcaatggaacaccaagcaagcagaggataaaggagataacggcagagctctcgcaccatggccaaatctcggagacaaatgtgtacaactggttccagaacagacgggcacggtcaaagcggaagcaggccgcttctttaccgaacaatgctgaatctgaagctgaggtggacgaggagtctctcaccgataagaagccgaagtcagatcggtcgctccaggacaacaaggctatgggcgctcacaacgctgacaggatatctgggatgcatcacttggacactgatcatgaccaaatcggtggcatgatgtatggatgcaatgacaacggcttgagatcgtctggcagttctggccagatgtccttctacgggaacatcatgccgaatccaagaatcgatcatttcccggggaaggtggagagctcccggagcttctcccatctccaacacggggaaggctttgacatgtttggatgacatgatgcggcgctgagttaccgtgtaaaatgtgatggttgacacatcgtgcgttcaatttgctgacatgaaagttgatgttggatgtccgtgttgcttatcacgttctggttaaccacctccgcggatggtagctagcttgaatgaacctactctttgggatagctgtaagaggttgatattatagtttgcccgtagtctatatacgctgaactatcagcatgtaattctccacgtttgcaaatttagcacgggtatgcagcagcctgtggttaaaccttac

SEQ ID NO: 8045 - DNA, 1133 bp, Zea mays
ctgtgtggcagtcgctgggggctcgctcaccacaccaccctgggcggcgctggcgctgccatcccgcggaggagcacgcgtgtcgacgaaatactcaccgctcgccgagctcggcttggctcgactcgcataattttatatttttcacgagctcaaacgagcttagatctatgaggcctgtgctgtgaccataaatttaggaggcccagtaagcaagcccacgacagacaatgaacgggagaaaagtttgagttcaacgtatacaatgctagatatttgtattattcttaagtataccataagtatcagtagggaaatcacaactgatgtcttctacctttaaccttgatatatagtaacaattaggttatattgttaaaggctgagaaatcagatagtgcatatttatgaaatatggctgctaatacgattgtataatagacgtcgcctactaatccatatagcatagacatcataaactgtttttttagcagatcacaaattaaataagctagcttaagctcacgaacaatccaaactgaactggctctttaggtagtactccattaacgagctgagttgaacgggcttgttagccagagccgagccgatgtgaggtgagcctgtccgaggcttctcatccgcgtcgcatggactcggggtctcgtgctgtcgcgctcgcgcccgccagccgcctcccgcatcgcctccaaggctctccaaccggggcgcctgcctaaccggccgatttccttccttgcgtagctccattccactgcacaaacagcgcgccactttcccaattcccgtcgcgtggcctccttccgatcctggccactttgtgcgtcctgtagcgagggggtgatcggtgatggactgggggaacaggaccaaggccgccgccgccgctgcggcgccggacgagagggccgggggaggggaagggctcggaggatacgtcaaggtcatgaccgacgaacagatggaggtgctccgcaagcagatctccatctacgccaccatctgcgagcagcttgtcgagatgcatcgcgtcctcaccgagcaccaggacaccattgcaggtcggtcagcgcagctgcacgcaaaaccaattgctactctctcagctctct

SEQ ID NO: 8046 - DNA, 2668 bp, Zea mays
cggatggggatggggcggcggcggctcacgcggggtggggaggggaggcgggggaacgaacgcgggtgtgggcgggcgaacggtgtggattcacagaagcgaacggatggtacagattcaccgaaggcagaacacaaaaaggcaggctactattgcttacttaataagtagtagagatttgcgcccatcttcaatgttaaggaaaagcataacgtttgtgctgccgcgataattgctgtctgcgtttgggtcccaccgccagggggccggtcgacgtctccgtccacgggtcaggtctcctcccgctgcccgacgcaaggagccattgaccacccaagggcccctgcctaggacggccccacctgtctgtcgtgccgctgatcgcccgtcgctgatggggcccggccagcccacccacccctccgcacgtcacggcgtaacgcgcggcgcgacccatccgtcccctccgtgttctgtccgcatgcgcgcgccgcccgtaattcttttccgccgcgagtcgcggcgcccgctcgtggccggtgcgcgcgtccacaaccgccgccaccgccttcccacttccaaatacgcctgctgccactttccccattcctgtctgaccatccccacgcccccctgctgtggcctctgctctctcctgccagttcacctgctgcctccggtgcccgctgctgtgcctcgctcgctcaccaccaccaatcgccaccccgtgcggcagccgcgctgccatcccgcggaggactggaggagcacgcatatccgagccttccctgccgcgtcgcatggactcatgctgtcgcgggccgcctcccgcatcgcctccaaccgggtgcctgcctaactggccgattttcttcctcgcgtagccccattccgcagcacaaatagcgcgtcactttcccaatttctatcgcgtgccccccttccgatcctgccatttcgtgcatcctgtagcgtctggcagtgcgggggtcatcggggatggagtgggtggacaggaccaaggcctccgccgccgccgccgcagcggcggcggacgagagggctgggggagcggaagggctcgcgggatacgtcaaggtcatgaccgacgaacagatggaggtgctccgcaagcagatctccatctacgccaccatctgcgagcagcttgtcgagatgcaccgcgccctcaccgagcaccaggacaccattgcaggagagctgcgtatcattgcattaagaagaaaagccgaatacaaatggcctgcgaggctgcaaccccgggcaaaggagtccgaagaggaaacccaaagaaaatataaagaaactactaaaaaagagaaggccaggtcacaaccactaactacaacttcctaagaatttcctgatccaagagcacgcaaaccagctgctccaacaaaacaccaaagattgcgctcatccataagggaccggagatttgcataaactttttttagctttcattaggtcattttttaaatattccgtattccaatgattcaccctaattacttacattgatggccgcacaacatcccacctgtccctttttagaataatctttaaaacagacttcactgaatttgcccttcctcctgtacaagtgttttaatgctcctttgtaatgtatgcattgtcgatggaatatagtcccttcttttttttcccgatcaactgggtttttgtttcttcttcaggaattaggtttagtaatctgtactgtgatcctcaaattatccctggaggccacaagatcacagcaaggcaacgatggcaaccaacaccaatgcagctgcagatcttggagaacatctttgaccaaggcaatggaacaccaagcaagcagaggataaaggagataacggcagagctctcgcaccatggccaaatctcggagacaaatgtgtacaactggttccagaacagacgggcacggtcaaagcggaagcaggccgcttctttaccgaacaatgctgaatctgaagctgaggtggacgaggagtctctcaccgataagaagccgaagtcagatcggtcgctccaggacaacaaggctatgggcgctcacaacgctgacaggatatctgggatgcatcacttggacactgatcatgaccaaatcggtggcatgatgtatggatgcaatgacaacggcttgagatcgtctggcagttctggccagatgtccttctacgggaacatcatgccgaatccaagaatcgatcatttcccggggaaggtggagagctcccggagcttctcccatctccaacacggggaaggctttgacatgtttggatgacatgatgcggcgctgagttgccgtgtaaaatgtgatggttgacacatcgtgcgttcaatttgctgacatgaaagttgatgttggatgtccgtgttgcttatcacgttctggttaaccacctccgcggatggtagctagcttgaatgaacctactctttgggatagctgtaagaggttgatattatagtttgcccgtagtctatatacgctgaactatcagcatgtaattctccacgtttgcaaatttagcacgggtatgcagcagcctgtggttaaaccttcgtgtgtgtgaaaccatttcttgcttgcttttaagaaaaaaaaaaaaaaaaaaaaaaagcggcc

SEQ ID NO: 8047 - DNA, 1357 bp, Zea mays
atcaccagagctccactagcggtccccgatccggcgtttgcgtcggcacgcttggcggtggcgcgcaaaagcagtgcagttgggccacgcccacgccacgctcactggcaggggcgaggggacacgtaccgtaccgtacgtactgctggatcgggaggaagcaacgctatggccgccgggagggagagggaccgggagatgctcctcccggtggtgggcggggagcatgtcgccggcgatgaggacgactcggatccgaccacccccgtcatcgctgggccgctgccgccaacgacgtccgcgcgcgtgctccacctccaccaccatcccaccggcatcgaggcattctcacgagtgataaggagctgggcgtggaagaagttcatgtctggatgcgtcatcctgctcccgatcgccatcaccttctacacgacatggtggttcatccgcttcgtcgacggcttcttctcgcccatctacgtccatctcgggatacacctcttcggcctcgggtttgtcacctccatcaccttcatcttcctcgtcggcgtgttcatgtcgtcgtggctgggcgcctcgctcctcggcctcggcgagttcttcatcaagaggatgccgctcgtgcgccacatctactcggcttccaagcagatcagcgccgcgatatcgccagaccagagctcaagagccttcaaagaggtggtgatcatccggcaccccaggatcggcgagtacgcgctgggcttcatcacgtcgacggtggcgctgcgaggcgccggcgtccgcggcgaccaggacctcgcctgcgtctacgtgcccaccaacaacctctacctcggcgacatcttcctcatgagccgcgccgacgtcatcgtcccggacctctccgtccgggaggccatcgaaatcatcctctcaggcggcatgtcggtgccaaagatcatatcgacggtggagggggccgtcggcctcggcgatcatggccgggcagtgaaggactcctagctcacgcttcttccaactcctgacggttgacgcttccttctctatcacaatcttgggttgcttttcgaggttctgaatgttctagactgcaggttttaggcaacgtgctccagttttcatccgtcatagaaaaatatattttggtatctagcaaacttctgctgtataaattctttcatgcgagttttggtttggactgacaaagtattgtttcgataggtaaacatcctaaatttacatttatactcatgacaataggtgatgtttggttcacgaattgtaacgttatcgttatcggtaatgattcattgacagcggtaataaatttgaatagtcaaaaaaaaaaaaaaaa

SEQ ID NO: 8048 - DNA, 1682 bp, Zea mays
aaaaccattccccgttcctgattccaattccaaccagcccatcccccttcgagcacacgcgcagagcgggggcgaaggcaagagcaaacagagtagccgccgccgccgtcgccgtcgtcgtcgtgtgtgtgtgtggagaggaaagaccgggttttgttttttacggcttagcgttgagcagctgagatgttgcgagcgctggcggcgaggtgctgcggccactggccgccgggcgccgcggcggcggacgggatgctgtggcaggcggagctgcggccgcacgcggcgggggagttctcgatggccgcggcgcaggccaacctggccatggaggaccaggcgcaggtgctggcgtccccggccgccacgctcgtcggcgtctacgacggccacggcggggccgacgcatcccggttcctccgctcccggctcttcccgcatgtccaacgcgtcgtgcaggagcaggggggcatgagcgccgaggcgattcggagcgcgttcggcgcggccgaggaggagttccataggcaggtgaggcaggagtggaggagccggccgcggctcgctgccgtgggctcctgctgcctgctcggggccatctccggggacacgctgtacgtggccaacgccggcgattcccgcgccgtgctcggccgccgagtgcccggcggcggggcggccgtcgccgagcggctctccgccgagcacaacgcggcgtgcgaggaggtgcggcgcgagctcgccgcgctcaaccccgacgacgcgcagatcgttgtgcacgccaggggagcctggagggtcaaggggataattcaggtgtcgagatccattggcgatttttatctcaagaaaccggagtatagcctggaccccttgttccggcaagttggggcccctattgcgctgaagaggccagctctcagcgctgaaccatcggttcaagtacgcaagctgaaaccaaacgacctgttcctgatatttgcttcagatggcctttgggagcacctcagcgacgatgctgcggtgcagattgtcttcaagaatccgagaactgggatagccagcagactggtgaaggctgccttgaaggaagcgaccaggaagagggaggtcaggtaccgtgatctgaggacgatcgagagaggggtgaggcggcatttccacgacgacatcagcgtcgtcgtggtctacctcgatggccaccgcgagcgtcgccacaccagggtcgttgactcgagcagcaactgcaccagtgcgcccgtcgacatccactcctccaactcccgctagtttccggagccccttgcaacgcgagctgaactctgggtgggaggtgaggtgggtgcagccgtagccatcggaatcggaacaagtcgatatgtacataggtaggagtgggtgcgtggcatcttgatgccggagaagatcatttggtctcgaaactacttagcacaagtggttaatgactgcatttttcttgtttctttttgtctgaaaccagcagcaagcccgtccattggatcggacttatttttaaggtaagaaatagttgatgacgaactggaggttggttaatggagaccaaagaatatatgctctgctcagtgctcaggatcatagaatttaggttccggcctgagaatatatactcgttgcaacggaaaaaaaaaaaattttttttt

SEQ ID NO: 8049 - DNA, 1054 bp, Zea mays
ctctagcctctagcctcgaactcacagacacggttcagcgagaggaatccgcccgcaggggatccctcatcttatctccttgctaaattgctctgacacggaacctatccgcaataaataatctggccggacggccggcccgcgctgccggtcgagtcggacgccggaaagacggtgaagcaaaacattcggaatatgcccagctcaccgcgtctataaactcacccgacccgtagggcacgcacaaacatgtgtcactcaccagcgctttccgtcccgtactcccgtgtaccctgtcccgtcctcctagctcgcattccgatttccgagttccagccagcgagcgagccaaccaactgaaccaaccaaccaccgctccttcttccttccttccttccttccccagttcccctcgtctcaccagtcaccaaggttccgagagcagagcgagataaaaaaaaggtaatccgacggaaacgacaagggcgcggcgagggcggggacagggtcggggaggccctgggcgcgggggcgccaagcgcatggcatcgtcgagggtgatgccgtcctcctcgccgtcgcacacggcctctgatctcgcgcgcctagcgcaggccgccagcaggcccggcggcgggggcagcgggctgggctccatgaacgtggaggagctcctccgcggcatctacagcgacatgcccaccccggcgccgcccgcgtcggagcccgaacgcccgaggtcgccggccccggcgccggaggtcgccacgcggaggacggcggaggaggtgtggaaggagatcaccggcggaggtggcagtggggaacccgtgccccccgtggcggctcaggctgccgtccccgctggtggtggtggcgccggcggcccggagatgacgctggaggacttcctggccagggaggagggcgcggtgaaggaggatggggttagggtttcgggcccctctgcgccggccatggggttcctgggcggagcggagggcgtgggtgtgcctggcggcggaggcgggaggggaaggaagcggcagctcat

SEQ ID NO: 8050 - DNA, 3792 bp, Zea mays
agacgccgtctccatggccccgacgccgtaacagctgtttttctttgccgagtgccccctggcactcgtcaaacctttttgccgagtgcccgagaaaaagtactcggtaaagaaggctttgccgatgcactgtgtgccgagccctctttgccgagtgtaacactcggcaaagcctttaccgagtgtttttaagactttgccgagtgcttcaggcactcgacaaagccgacgattccggtagtggctatggatttcttataccgggtgcataggtggcggtctagtcttagaatccatagccactagattgtgtttggattcttcttcttgttgttttggttgtatgtttcctttatgaaacagaggtcgaaaggtactcgttcaagaatgtgcttaaactcgatatatttttctcgaaaggtttaatatattttccttttcaaaaaaaaagctacctagcatggagtggcagcaagaacgccgcagccggtgtgttggcgctgctgcttctccagctgatggtaccggggacgacggcgatggcccgcctcctgcaggcggatacccgcgcgagggagtttggccatcagtgggaggcatcccctgtggtgaatcctgtatatcttcataccatgcagttataaggcactcttgggttgccaatgcatagacaaagtatgcatgaaataataactcgtgacgccgcttcttcatttgggcttcaatgatgttatcccacgtacgaggccacgttgatctgttgcttcggtatcttaatttccgtcgtcatttcacagggccgctgtgatctctggactagctatttgtaatttgtgttgggagaaacacaagcaggacggtggtgttcaacaatattgtgtgtatatatatggtgatttaataataaacaggatatgttggatgtgtgtacgtacccatcgcctgctcctcgcgtaaggcgtatctccattctctaatatttgtcgccgctagttcatttgattgtaatcacggaaccgtaacttgtgcaacgcctaccaagaaagaaaggaggaaccaattctgttttaatctcaatccatgtggatcgaacgagattgagaagcatgtcacttctgccatgattagatagtgtagtgattggccaaagggaccaatatcaggtttgagctacactccttattaccattataaaagactttgccatcactgtcgcattgccaccataggatgatattgtagcttcgtatctcatcagaaactgcttcagattcgacaaaccatcaaactttggaaattgaggtagcctggtcatggtgtagcttataatttatctgcagcaagggagaaccactatatatcatacaaaaaatcaacaaagccttgctcttcatggtgaaggttgttttgacggcatatggttcctctagatgctcaacttgttgcattatattacgcaattgctccgacgcttcatcaattaatcctccttagtgatattaaataacggaataatattagagaaataaacaataatctaagacattagcgcataaagatgtgacaaaatgattgagtctggtcatattaccctccttcatcctttattgcataaaagattgtagtttacaccttcggctttacaaaggagagctcgaaggtaatattacagcttcgaaggcggagtgatttgattctcccttgttcaaaaagcgagatctcttcatatcattgtgcctctatttatagtaaccaagtacaatttcatatgaaattacaaacatgctcatggacatgataattccagtgcacatccaaccctgcttgatacaaaacatgctcataatcatgatgattcaagtgcacatccaccctgctcgatacaacagttggcgacctggtgtgagagtcagaccagacgggctttcacaatcgccatgcatgtcattctctcgtggtccacgtgtttattaatattgccattaattggagggaaataaaatcaacaagaatagcttattgatgagtcatatattatgaatacatcttatcatcttaccaaacaaaaacatatgaccgtcgatgacctgaaactagactattcgggatctgcaatgatctgcttgtaaatattaatttgcacatcacgccattgcatgcacatcggcgtgggcattattaatttggattggacgaaaaatcaaccagagggcgtcacccttttgctagttggccttgtaatacttataataattatccgtatagtctagtacgtacgggacatcacgccattgcctgttgtgtataaaaagcgagcatgcccgccggggcggggagagcaaagcgtagtcatcacctgtgtctaggttgggagcaaagcaaagagagagaggaaagctagctagctagcatggagagtggcagcaagaaggtcgcagccggtgtgttggtgctgctgcttctccagctgatggtagctccgacgacggcgacagcccgcctcctgcaggcggatacctcccccgtgtttggcctggacttcatcgcgagggagtttggccatccagatggagccatctcctgtggtgaatcatgtgtcatcataccatgcgtttcgacactcttgggatgccgatgtgaaaacaaactctgcgtgaaataaactcgtgacgccgctgctacagtcgggacgaggccatatatctctgatccctttacgtgtgaagaaccagctccatctttgtaacaaatttgtgttgggagaaacaaaaagacggtggtgtttaacttattgtgaaaggtgatttaataataatatataataaacggtacgttggatgtgtgtaaaaaaaaaaaaaaaaaaaaaaacaaaatgaaaaaaaaaaaagcagactgcatacatcttattgtaatcacggaacggtaacttgtgcaaaaacatatggactcactaccggaatctttctgtttttttgcattcatagttttccatatttcgagtgaattgcagttcaaatatgaattatacgaataaattcaattaaaagaataaaatctaatagttatagcaaacaattttataattatgccaaaatagtacatataggtctacatattgtagcaacataccacaaaaaggaggagtactcctaccatgaatggaaaaaggaggaacctaattatattccaaacttagcaacaaggccgtctatgagattttgtagccctgatctacattgaagccttaccggtttacattgaatctctatgatttcatgtgtaggacatttagatttctacacataatgcgtcacaactttcttgaaacattatgaaatttttatcataccctatacatatgatatcatgacatgtgaacaagtttcataatgttctgactttctttgtgttttatacaatttttaaataactggatgacaagttcacgaccatgtttcgtgagcatggtgctcgaaaattccggtctgcttcttaaatcggccgtaacttgtgctaaataacatgaatatcatgtttgcattcacagttttctatttttcgagtgacttatagttcaaatctgaattatccgagaaaattcaaataaacgaacaaaatctaatagttatagcaaacacttttataattgtgccaaaatgtaatatgtaagtctacgtagtgtaggaacaaaccacaaaaagtttggttgcaaaaaaatatatactttgtcaagtgtccaaggtagtaaattggtaaagaatagttatacgtgtgaagaaccagctcagatct

SEQ ID NO: 8051 - DNA, 889 bp, Zea mays
tacttcactctcggcaacggatatctcggctctcgcatcgatgaagaacgtagcaaaatgcgatacctggtgtgaattgcagaatcccgcgaaccatcgagtttttgaacgcaagttgcgcccgaagccttctggggggccccccggggggcggcgggccgggagagcaaagcgtagtcggtcatcacctgtgtctaggttgggagcaaagcaaagagagagagaggaaagctagctagctagcatggagagtgccagcaagaaggtcgcagccggtgtgttggcgctgctgcttctccagctgatggtagctccgacgacagcccgcctcctgcagcaggcggatacctcccccgtgttaggcctggacatcatggcgagggagtttggccatccagatggagccatcccctgtggtgaatcctgtgtcttcataccatgcgctacgtcagtctttggttgccgatgcgaaaacaaagtctgcgtgcacgactgaagaagccttcttcagtcgggacgagacgaggccatatctctgatctctgtctcgtcatttgcgtgctaagaaccagctcacaaatttgtgttgggagaaacagaaagacggtggtgttcaacttattgtgtacggtgatttaataataatatataataaacgggatacgttggatgtgtgtaaaaaaaaaaaaaaaaaaaaaccccccggcgggcccaaaaaaaaaaaaaaaaaaaaaaaaaaccccaattaaaaaaaaacccggccccttgggccgagcatagtcgatcatgaagggtggcaagaaggaagtggccggtgcgggggtggccatactgctggttctgcagctcatggaagctccaccgacggccatggccgcccgctcgccgc

SEQ ID NO: 8052 - DNA, 614 bp, Zea mays
ggccgcttcgaggcgccgccccgtcgcggggccggccgggcccgggagagcaaagcgtagtcatcacctatctatagagagagagaagagagaagagagagagaggaaatctagcatggagagtggcagcaagaaggtcgcagcctgtgtgttggcgctgctgcttctccagctgatggtagctccgacgacggcgacggcccgcttgctgcagcaggcggatacctcccccgtgtttggcctggacatcatcgcgagggagtttggccatccagatggagccgtcccctgttttgaatcctgtgtcttcgtaccatgcatttcgtcagtcgtgggatgccgatgcgaaaacaatgtctgcgtgaaataaactcgtgacgccgctgctacagtcgggacgaggccatatatctctgatcccgttacgtgtgaagaaccagctccatctttgtaacaaatttgtgttgggagaaacagaaagacggtggtgtttaacttattgtgaaaggtgatttaataataatatataataaacgggatacgttggatgtggtgtacccaaaaaaaaaaaaaacgcccccatttggcaaaaaaaaaaaaaaaaaaggccccta

SEQ ID NO: 8053 - DNA, 584 bp, Zea mays
gatcgcctgttgtgtataaaaagcgagcatgggctaggttgggagtgagagcaaagcgtagtcatcacctatctatagagagagagaggaaagctagctagctagcatggagagtggcagcaagaaggccgcagccggtgtgttggcgctgctgcttctccagctgatggtagcaccgacgacggcgacgtcccgcttgctgcagcaggcggatacctcccccttgtttggcctggacatcatcgcgagggagtttggccatccagatggaaccatcgtctgtagtgaatcctgtgtcttcctaccatgcgtttcgtcagtctttggttgccgatgcgaaaacaaagtctgcgtgcacgactgaagaaaccttcttcagtctctgatctttctctctcgtcatttgcgtgtgaagaaccagctccatctttgtaacgaatttgtgttgggagaaacagaaagacggtggtgttcaacttattgtgtatggtgatttaataataatatataataaacgggatacgttggatgtgtgtgcacctccttatatgggcttggcccatttattgaataaactctatgtt

SEQ ID NO: 8054 - DNA, 1044 bp, Zea mays
attggctccgcggcgcgccaggccgccgcctctcccggccagttcacgcggacggatatctcgtctcggtcagttcgcttcgtgagttatctttatctcctctcgatcgatcgcttcctccatcgaggcggtaaagcgccgcccagatcgccggaagcaagcggcgacctcaccagctccgagcagcagcagggaggctcgtggaaccattagtcgttttctggcagcggcatggaggggctgagctggagaacggtgtgttgtttatcggtgctctgtgccgtgctgttcttgcgcccggccgagggcatccgcttcgtgatcgatagggaagagtgcttctcgcataacgtggaatacgagggggatactgtccatgtatccttcgtcgtcatcaaggctgacaccccgtggcattacagcgaggagggcgtcgatcttgtggttaaggatcctaatggcgctcaagtccgtgattcccgagataagactagtgacaagtttgagttcatagttcagaagagaggcgtccatcgcttctgcttcacgaacaaatccccatatcacgaaacgatagacttcgatgttcatgttggccatttttcatatttcgagcagcatgccaaagatgagcattttgcaccactttttgagcaaataggcaagttggatgaggcactttacaatattcagttcgaacagcactggctagaggcccagactgaccgtcaagcaatattgaacgagaacatgagcaggagggcagtccataaggcgctcttcgagtcagcagcgctgatcgccgccagcgtcatccaagtctacctcctgcgccggctcttcgagcgcaagctggggacgtcctcgggtttaaggcaacagtagccaacttgcccttcgcagccaccatgatcacaccgacataaccgttacgaattcgaatggttgctagatcagctaaataccacatgtttgtggacttcagttacatgtaatattttttttgtgattccacaaaaaaaaaaaaaaaaaaaaaaaaaaaaa

SEQ ID NO: 8055 - DNA, 826 bp, Zea mays
cgaacgatgtgaaagaactcctttcttctacgcggacggattcctctcgtctcgatcagctcgcttcgtgacttctctctcctctcgatcgattgcttcctccaccgaggcgggggaaagcgccgcccagatcgccgtaggcaagcggcgatcactccagctctgagcataaggttaaggatcctaatggcgctcaagtccgtgattctcgagataagactagtgataagtttgagttcatagttcagaagagaggcgtccatcgcttctgcttcacgaataaatccccgtatcacgaaactatagacttcgacgtgcatgttggccatttttcatacttcgagcagcatgccaaagatgagcattttgcaccacttttcgagcaaatagccaagttagatgaggcactttacaatatccagtttgaacagcactggctagaggcccaaactgaccgtcaagcaatattgaacgagaacatgagcaggagggcagtccccaaggcacttttcgagtcggcggcactgatcgcggccagcgtcatccaggtctatctcctgcgccggctcttcgagcgcaagctggggacgtctagggtataaggctccactggtatccaactctcccttgtagtagccaccatgatcgtaccgacataaccgttaatgatcgctagatcagctaatactgcttgcttgtgggctttagttacatgtaatcttttgtggtgccacagatgagaactcttcggatttaaaccgtcaatctttcagccttcattttggctctcgtaacatttttttcacccgagaaggcgagaacaacg

SEQ ID NO: 8056 - DNA, 1153 bp, Zea mays
cggatagtgccaggactgccagcccgatctcgcgtcgaacgatgtgaaagaactcctttcttctacgcggacggattcctctcgtctcgatcagctcgcttcgtgacttctctctcctctcgatcgattgcttcctccaccgaggcgggggaaagcgccgcccagatcgccgtaggcaagcggcgatcactccagctttgagcataagggaggctcgtgaagtcagtagtcgtatctggcagtggcagcacagcgcaccatggaatggctgagctggagaacggtgtgttgtttatcagtgctgtgcaccgtgctgttcttgcgcccggtcgagggcattcgctttgtgatcgatagagaagagtgcttctcgcataacgtggagtatgagggggatactgtccatgtatccttcgtcgtcatcaaggctgacaccccgtggcattacagcgaagaaggcgttgatcttgtggttaaggatcctaatggcgctcaagtccgtgattctcgagataagactagtgataagtttgagttcatagttcagaagagaggtgtccatcgcttctgcttcacgaataaatccccgtaccacgaaactatagacttcgacgtgcatgttggccatttttcatacttcgagcagcatgccaaagatgagcattttgcaccacttttcgagcaaatagccaagttagatgaggcactttacaatatccagtttgaacagcactggctagaggcccaaactgaccgtcaagcaatattgaacgagaacatgagcaggagggcagtccacaaggcactcttcgagtcggcggcactgatcgcggccagcgtcatccaggtctatctcctgcgccggctcttcgagcgcaagctggggacgtctagggtttaaggctccactagtatccaactctcccttgtagtagccaccatgatcgtaccgacataaccgttaatggtcgctagatcagctaatactgcttgcttgtgggctttagttacatgtaatcttttgtggtgccacagatgagaactcttcggatttaaaccgtcaatctttcagccttccttttgtctctcgtaacattcttttcacccgagaacaacaaggctctctgtacagaataggagattttcttaaaaa

SEQ ID NO: 8057 - DNA, 604 bp, Zea mays
aagcggctcgagcggctcgaggtcaagcaatattgaacgagaacatgagcaggagggcagtccataaggcgctcttcgagtcagcggcgctgatcgccgccagcgtcatccaagtctacctcctgcgccggctcttcgagcgcaagctggggacgtctcgggtttaaggcaccagtagccaacttgcagagataaccgttacgtcgaatcaaattcgaatggttgctagatcagctaataccacatgtttgtggacttgagttacatgtaatattttttgtgattccacagatgagaactcttcaaagtttaaaccgtcgatttagccttcattttgcctcagcattttatccccttgtttctgtagtagcaaccagtaacaacaaggctgcctgtagtctgtacaagatagtagagattttttttttctgtgctggttgtacgacacaaccgtgaatgacttgccgtagacggataaaaaaaaaaaaaaaaaaaaaaaaaaaaaaaaaaaaaaaaaaaaaaaaaaaaaaaaaaaaaaaaaaaaaaaaccaaaaaaaaaaaaaaaaaaaaaaaaaaaaaggggctttgggttgttcccattgtt

SEQ ID NO: 8058 - DNA, 1201 bp, Zea mays
ctcccgcccggccggcccgggccccgcccccgataggcccgtccggatagtgccaggactgccagcccgatctcgcgtcgaacgatgtgaaagaactcctttcttctacgcggacggattcctctcgtctcgatcagctcgcttcgtgacttctctctcctctcgatcgattgcttcctccaccgaggcgggggaaagcgccgcccagatcgccgtaggcaagcggcgatcactccagctctgagcataagtttctgcagggaggctcgtgaagtcagtagtcgtatctggcagtggcagcacagcgcaccatggaatggctgagctggagaacggtgtgttgtttatcagtgctgtgcaccgtgctgttcttgcgcccggtcgagggcattcgcttcgtgatcgatagagaagagtgcttctcgcataacgtggagtatgagggggatactgtccatgtatccttcgtcgtcatcaaggctgacaccccgtggcattacagcgaagaaggcgttgatcttgtggttaaggatcctaatggcgctcaagtccgtgattctcgagataagactagtgataagtttgagttcatagttcagaagagaggcgtccatcgcttctgcttcacgaataaatccccgtaccacgaaactatagacttcgacgtgcatgttggccatttttcatacttcgagcagcatgccaaagatgagcattttgcaccacttttcgagcaaatagccaagttagatgaggcactttacaatatccagtttgaacagcactggctagaggcccaaactgaccgtcaagcaatattgaacgagaacatgagcaggagggcagtccacaaggcactcttcgagtcggcggcactgatcgcggccagcgtcatccaggtctatctcctgcgccggctcttcgagcgcaagctggggacgtctagggtataaggctccactggtatccaactctcccttgtagtagccaccatgatcgtatcgacataaccgttaatggtcgctagatcagctaatactgcttccttgtgggctttagttacatgtaatcttttgtggtgccacagatgagaactcttcggatttaaaccgtcaatctttcagccttcattttgtcaaaaaaaaaaaaaaaaaaaaaaaaaagcaacaaggctccctgtacagaataggagattttcttc

SEQ ID NO: 8059 - DNA, 1283 bp, Zea mays
actcctatgggcgattgggttcctcgaggccggccggggaactccttccttccagttcacgcggaccccgcccgggtctcggtcagttcgcttcgtgagttatctcctctcgatcgatcgcttcctccatcgaggcgggaaagcgccgcccagatcgccggaagcaagcggcgacctcaccagctccgagcagcagcagggaggctcgtggaaccattagtcgttttctgtcagcggcaacagagcacaccatggaggggctgagctggagaacggtgtgttgtttatcggtgctctgtgccgtgctgttcttgcgcccggccgagggcatccgcttcgtgatcgacagggaagagtgcttctcgcataacgtggaatacgagggggatactgtccatgtatccttcgtcgtcatcaaggctgacaccccgtggcattacagcgaggagggcgtcgatcttgtggttaaggatcctaatggcgctcaagtccgtgattcccgagataagactagtgacaagtttgagttcatagttcagaagagaggcgtccatcgcttctgcttcacgaacaaatccccatatcacgaaacgatagacttcgatgttcatgttggccatttttcatatttcgagcagcatgccaaagatgagcattttgcaccactttttgagcaaataggcaagttggatgaggcactttacaatattcagttcgaacagcactggctagaggcccagactgaccgtcaagcaatattgaacgagaacatgagcaggagggcagtccataaggcgctcttcgagtcagcggcgctgatcgccgccagcgtcatccaagtctacctcctgcgccggctcttcgagcgcaagctggggacgtctcgggtttaaggcaacagtagccaacttgcccttcgcagccaccatgatcacaccgacataaccgttacgaattcgaatggttgctagatcagctaaataccacatgtttgtggacttcagttacatgtaatattttttttgtgattccacagatgagaactcttcaaagtttaaaccgtcgatttagccttcattctgcctcagcattttatcgccttgtttctgtagtagcaaccagtaacaacaaggttgcctgtagtctgtacaagatagtagaggttttttttttctgtgctggttgtacgacacaactgtgaatgacttgccgtagacggatactatactgtaaaaaaaaaaaaaaaaaaaaaaaaaaaaaaaaaaggaaaaaaaaaaaaaaaa

SEQ ID NO: 8060 - DNA, 772 bp, Zea mays
aaataatgagtaatttaatggagtggagtgttccgatcggcgagttcctcgagcggatccatctgctcgtccggtcagaggcggccgccgggcacgcgatccgcgtcgacggcacgtgtctcgtgctcgctggggtgtacctgacgcgtttcatcggcagccaccggcgcgggtcgcggggatcgtggtggagccgtccaccgcgcaccgattggtggccgtcgcgctgttcctgggcggtcactcccccaagaactgggctgccgcgttcgaggcggtctcagaccgcgcgatccgcacaggcacagggccaataggagaagacggtgcatggtcgtggctatcttcgactcagtcagcattcaattcaatcaaattcttctagttttggttgcttctcctacttctacttcgtctgtcttgattttgctgtaggcacgaggccagagaagacgtagacggtagatgctctcttgctcgtggccacgctcctcggaagaggacgatgctctcgtcattgatcaagctcgctggaccagaacggggtggagctggagcatccccacagttgctgcctagcttcaagttttattagtgattggtcttgttgtttccagctctggtagagagctcggcgtcgctgctcactagcagagcagcttgctgtgttttatgtgtactggatcagcaagtaccaataaaacctgtcgttgcatcaaaaaaaaaagaaaaaaaaaaaaaaaaaatcccaacacaatggaattcgatatca

SEQ ID NO: 8061 - DNA, 2162 bp, Zea mays
tgcagaaggtaaatgaggacatgagttttatgtacacaaaaataatctggacgaacaatcttctgctagcgtgttttttttaaaaaaaaacttccacactctcctccctgcgctcaactatattttttgcagaaaacctcttgtgtgttgagctaaatactaccaaaattcggctttttgccgagtgacaaacaaaaaaaaaaaaccttggtaaaaaaatactcgacaaaaaactttttgtcaagtgttttattttttactaaattaattttatagcttctttatactatctccgttcacaagtatatggcatttaatatttttagtctcaaatttgaccattcctcttatccaaaagaaattaaaattccagagtgatttatacctagacttaaggtttattatatactaaaccaaaccatagtgcaaattagtaaaatttctaatttttttacaaggcgagctgtcaaaactgaaactaaaaaaaaagtcaaaagtcatatatttacgaacgaagcgaatagataatcttatgcgatcgagtaattctgacggttcatgtagcgatctggtaaaattatgtgtgcatgaatataatgcgtggcgtcatcctgtatgtatatatatgctaccgtgcccgaggcccggccggcactgtaggctgccggtagccaatgcaagaaacttggaagcaccggtagccactgagcgcagcatacaaagttgagagatggatgtggtctcgtggtttagccaggtctcggtggtggtaagcgttctggccgtgtgctggaccgtgttatggcagaacctgcagcacatccacctgcatcagttcttcgcgcgcagcttcaaccgccgcccagtgacaccgtgccgtggagccgtgcctcacgcgccgagcgccggttcttccggctcgagttccacgagggccaccgcgacctggtgctcaacgagtacctcccgtacgtgcgcaggcagggccgcgccgtcatggccaagaaccgccagcgaagactctacacgaacatcctcagggaaggctttgacgacggtttctaccgagacgtttggacgcatgtcccgttcgagcaccccaagacgttcgacaagctggccatggacccggcgaagaagaaggacgtcatcgacgacctcgacatgttcaagcagagcaaggactactacaaccgcgtggggaagccgtggaagcgggggtatctcctgtacgggccgccgggcaccggcaagtccaccatggtcgccgcgatggccaaccacctcgggtacgacgtctacgacttcgagctcacgtcggtgaagaccaacaccgacctccggaagctgctcatagagaccaagagcaagtccatcatggtgttcgaggacatcgactgctcgctccaagtgaccggcaagcgcaaaagcaaggaggaggaggagggttcgaaagacgggaacggggacgacccttctgcggcgaaacagaaggaggaggaggaggacgccaagagcagcagcaaggtcactctgtccggcctgctcaacttcatcgacggcatctggtcggcgtgcggcgaggagcggctcgtcgtgttcaccaccaaccacgtcgacaagctggacccggcgctgatccggacggggcggatggacaagaagatcgagatgtcctactgcgacttcgagtccttcaagttcctggcccggatgcacctccgcgacgacgtcgtcgaggcacacggggagcaatgcgaccgtgttagggctttgctccaggaagtgaacatggtgcccgtcgacgtcggcgagcacctcacgcccaggagccccgacgaattcgaagacgctggaccatgcctcgcgaggctggtcaccgcgttggagaaggccaagaaggaggctgatatactaccgaggccacaggcccaaccggatgtcagcggcatcgttgtggacgctggtagtaaatagtaataactacggtccgctagggctactccgatgaccccaccaggccaccatgttggttccagcggtttacctttctacagtgcatatacacttgtaatctactactactttataagactgtaaagagggcgtccaccaccacatatgtggtgtaccatggctccgctcccgcgattctcgccaag

SEQ ID NO: 8062 - DNA, 2544 bp, Zea mays
tttttttacaaggcgagctgtctaagctgaaactaaaaaagagccaaaagtcatatatttacgaacggagcgagtagataatcttatgcaatcgagtaattctgacggttcatgtagcgatctggtaaaattatgtgtgtgcatgaatataatgcgtggcgtcatatatcctgtatgtatatatatatatgctaccgtggctggagactgtactgtaggctgccggtagccaatgcaagaaacttggaagcacgcactgagcgcagcatacaaagttgagagatggatgtggtctcgtggtttagccaggtctcggtggtggtaggcgttctggccgtgtgctggaccgtggtatggcagaacctgcagcacatccacctgcagcagttcttcgcgcgcagcttcaaccgtcgcgcgcggcggctcgccgcggtggtcgacccttacctgtcggtgaccttcgaggagtacgagggcgggcgcatcaagagcagcgacgccttcgacgagatcaagtcctacctcaccacggcgagcacgcgcgacgtgcgccacctcagggccgagtctggcggcggcggccgccgggacgccgccgccaccgacagggacaagctcgtgttcagcatggccaagggcgaggaggtcgccgacacattccggggcgccatggtctggtggtcggccgccggcgtgccgccgcccagtgacaccgtgccgtggagccgtgcctcacgcgccgagcgccggttcttccggctcgagttccacgagggccaccgcgacctggtgctcaacgagtacctcccgtacgtgcgcaggcagggccgcgccgtcatggccaagaaccgccagcgaagactctacacgaacatcctcagggaaggctttgacgacgggtaccctttcctgaacctgtcgacatgcatgtagaatctgcttctattctaggtaggggtaggtaactcccttggattcccctgcagtttctaccgagacgtttggacgcatgtcccgttcgagcaccccaagacgttcgacaagctggccatggccccggcgaagaagaaggacgtcatcgacgacctcgacatgttcaagcagagcaaggactactacaaccgcgtggggaagccgtggaagcgggggtatctcctgtacgggccgccgggcaccggcaagtccaccatggtcgccgcgatggccaaccacctcgggtacgacgtctacgacttcgagctcacgtcggtgaagaccaacaccgacctccggaagctgctcatagagaccaagagcaagtccatcatggtgttcgaggacatcgactgctcgctccaagtgaccggcaagcgcaaaagcaaggaggaggaggagggttcgaaagacgggaacggggacgacccttatgcggcgaaacagaaggaggaggaggaggacgccaagagcagcagcaaggtcactctgtcgggcctgctcaacttcatcgacggcatctggtcggcgtgcggcgaggagcggctcgtcgtgttcaccaccaaccacgtcgacaagctggacccggcgctgatccggacggggcggatggacaaaaagatcgagatgtcctactgcgacttcgagtccttcaagttcctggcccggatgcacctccgcgacgacgtcgtcgaggcacacggggcgcagtgcgaccgtgttagggctttgctccaggaagtgaacatggtgcccgtcgacgtcggcgagcacctcacgcccaggagccccgacgaattcgaagacgctggaccgtgcctcgcgaggctggtcaccgcgttggagaaggccaagaaggaggctgctatactaccgaagccacaggcccaaccggatgtcagcggcatcgttgtggacgatgatagtaataactagggtccgctagggctactccgatgaccccaccatgttggttcgagctgtttacctttctacagtgcatatacacttgtaataatgttattatatataaataaagtatatttgctgtacccgcatccaggggtgaatggactgaatgcacatagaggcatgcatggaggcgtattttctttcttaggctatattaatagctctcatatatcttatcttctattttaaaatgcacatagaggcatgcataaagatgtaccagttggttagccgtgcgttgcgatgtcttacaacaatacccacgtaaattatccatcaaaaaattcaagattttttattgattgtctccgttctctgtataatatttttttgatttgactaacttgtgttattgtttactccatgcaatatgtcttggtacaatacgaccaatgaagtgagcgattagaagagagttcacaatgactgactgaacgaacagagattataaatagacataatcccaccatacagagatcaaataagagaaagtttctgagctcaagtttctaaaataagtcacatgaagtcaaaccaataaaaaagatagattaaaatatggagtggttgctaaagtcaggcatcaacaaaaactggatg

SEQ ID NO: 8063 - DNA, 814 bp, Zea mays
ggtaccctcgaggccggccgggactgtaggctgccggtagccaatgcaagaaacttggaagcaccggtagccactggagcgcagcatacaaagttgagagatggatgtggtctcgtggtttagccaggtctcggtggtggtaagcgttctggccgtgtgctggaccgtgttatggcagaacctgcagcacatccacctgcagcagttcttcgcgcgcagcttcaaccgtcgcgcgcggcggctcgccgcggtggtcgacccttacctgtcggtgaccttcgaggagtacgagggcgggcgcatcaagagcagcgacgccttcgacgagatcaagtcctacctcaccacggcgagcacgcgcgacgtgcgccacctcagggccgccaccggcagggacaagttcgtgttcagcatggccaagggcgaggaggtcaccgacacattccggggcgccatggtctggtggtcggccgccggcgtgccgccgcccagtgacaccgtgccgtggagccgtgcctcacgcgccgagcgccggttcttccggctcgagttccacgagggccaccgcgacctggtgctcaacgagtacctcccgtacgtgcgcaggcagggccgcgccgtcatggccaagaaccgccagcgaagactctacacgaacatcctcagggaaggctttgacgacggtttctaccgagacgtttggacgcatgtcccgttcgagcaccccaagacgttcgacaagctggccatggacccggcgaagaagaaagacgtcatcgacgacctcgacatgttcaagcagagcaaggactac

SEQ ID NO: 8064 - DNA, 3084 bp, Zea mays
cgtcgcggtcgcggacgcggacgcggcgggaggggaagaggcgggcgctcgcgcgctccgcgtccgagccgctgctctggttcggcgacgcgcgggtccacgacgtgccgccgcacgggcccgggctcgggctcgggctcgattgcccgccgtcccctccgccgccgccgctcgagcgtccgcacacttgcttcgacgtctttgccccggagttcggccgctccccctcctacgcctccctcaccagtccctgcccccgggaggtacggtacggcccggccccgccggcgagctaaccgaagcccggagttaggcaatttgcgaggtttattcacgggtgggagtggtttggctggcgcggtgtgcaggaggcgaaggtggtggtgagcgtgacggttgagggcagcgtcggcccggtgaaggccatggtcaggctgggcgccagcgtcggggaggccattgctgccgtggtcgagaggtacgccagggaggggagaagcccgcgcctggacccggccgcagccgagagcttccaacttcaccactcccacttcagccttgagagtaagccaccaccattacgcttgattttagtaagaagtgtcatacgaacgtttcggtgcttgtgcttgtattttggatgttagcgtgcgataggaaccattctggcttgatcaaattggcgaaccattccggatttctcgaaatcgaactgcagagtaaggcaaccttagcttactgttttcctgtgatccacgtttagttattcttcatgtcgttttgactcagaaaccattcccgaaaggccgaaatggaattgctatttgtccagtgggttgatttgtattttaactactgtctggctgattatttgtgagacaactgcagttttaactactgtcatagctaaaatgagctctgttgtcaatgacacatcacatcaatgagaccatagacatctaacatttttttttgctactatacatatagagacataggttggaaaattttctggctgtcgttctcctgattcggtcctccaattatatagagctaggcggctaggcccgatgctttggtcggcaggatataacataaaatatataataatgtacttatcgcgtcagaaaattgtgtggatgccaacgtcagtgcatctttatggtgccatataattacatagattttaaaaaccctgcccaccgacgtacacagtttaaaatatttggattcactgcttgattatgaaatcaataataataataatcatcatctatttctgcgcccagggtcagccatagcctattgggaaccttgagtcaagtgtgactgtcaggatgaggctactagaaaacatatggtggatagcttttgtgttgactaacttcttgtttgtcataagtgccacggcaagatggtacattaaagcataaacaacacacacttctcttcgtgttagttgggcctctgagagctgtttattacagttataactgttatatactctggtcagaaacaagtcatttaattgtttctgatctgagggattacctatgtaactctggtcagaaacaagtcatttaattgtttcccccgaggcccgccgggctgccttctatcagcttaaaattcgagagcgcaatacgaatttggacccattctcgttttttttgtataacacattacatactggattatgtgttcattacctgctgaagctctttgagcatgagagtgacagattttatggaaattgagtcatcctaccctaagacaaagacaagagtaaccatcctgaccattttcccccctcacaggtctgaacaagaaggacagaatcggagacgtgggaggtaggaacttctacctgcacaagaacgattcaagcaacgacgggctctacctccagggccaggaggagcccggtgcagatccaagtggtggtgacatcagccggcactcctcctcaggagtaggacaagcatctggtggcgctacaagtcagcaccaggtcctcaccatcgtcatcagcaagctggataagattgggcggcggacgaggcggatctggaggttcatcacctgcaacaactgcgcatgacgcagcacaatgcacaaagcatctgctgcacaacagtgcaggcaagaggtagttagctaattaaccagtgaaaggcttggcatggattctggttaaccagtgtgtggtgtggtgtggtgtgtaatcctaattcctagcagcagttaaccagtgtacatgccattgtggttgtggttaaaccacaagaagagccagtggggaaggggatagccccactaagcagagtcatgggcacctatcgccgatttattaagatatgtgtccatgcgcatgtataaaattcaaaagttgtagctcgaaagaaaaattacagctctctctctctctctctctctctctataccgtggtcggtgctgcagtgtgtcgttgtctgtcgtctctgcccagctgggactggttttacatgaaaaccttgaaaacttgtaaggcttcgattttcaactgttcctgtgtaccaattgacctgggacgtctatgctccacctcctatggccatgatgaatgatgtgtagtagccctagatacaaaaattaattggaatcaaatgcaaatataggaatgtgaactcttgttgggatgcccatctaaactttggcgacaatgaaggtcaacgcaacaagaattcagggaattcctgtcagccaaaaaccgacaagaattaagttgttaccgacgagaattagttattcctgttgatatacagttaattacagtcggtacttcgtcgacgcggggttaactactagagattaattaattctcgccggcttactgtagccaatgggaattaaccacgacacgtattaactcctgtcggcccacccctggtcgacaacaataagtaatccccgtcgaccactccctagctgacaacaattaatgccattatccctatcgtctgacatgaccgactgaagttatctcgggcacagtaactcctgttggctatggtcatgctgacgaggattaacctcggccatcc

SEQ ID NO: 8065 - DNA, 888 bp, Zea mays
  misc_feature (827)..(827): n is a, c, g, or t
tcgggcgcggtgtgcatgaggcgaaggtggtggttagcgtgacggttgagggcagcgtcggcccggtgaaggccatggtcaggctgggcgccagcgtcggggaggccattgctgccgtggtcgagaggtacgccagggaggggagaagcccgcgcctggacccggccgcagccgagagcttccaacttcaccactcccacttcagccttgagagtctgaacaagaaggacagaatcggagacgtgggaggtaggaacttctacctgcacaagaacgattcaagcaacgacgggctctacctccagggccaggaggagcccggtgcagatccaagtggtggtgacatcagccggcactcctcctcaggagtaggacaagcatctggtggcgctacaagtcagcaccaggtcctcaccatcgtcatcagcaagctggataagattgggcggcggacgaggcggatctggaggttcatcacctgcaacaactgcgcatgacgcagcacaatgcacaaagcatctgctgcacaacagtgcaggcaagaggtagttagctaattaaccagtgaaaggcttggcatggattctggttaaccagtgtgtggtgtggtgtgtggtgtgtaatcctaattcctagcagctgttaaccagtgtacatgccattggtggttgtggttaaaccacaagaagagccagtggggaaggggatagccccactaagcagagtcatgggcacctatcgccgatttattaagatatgtgtccatgcgcatgtataaaattcaaaagttgtagctcgaaagaaaaattacagctctctctctctanctataccgtggtcgcctggtcggcgctgcagtgtgtctaaaaaaaaaaaaaaaaagcggcc

SEQ ID NO: 8066 - DNA, 1410 bp, Zea mays
gggtacactccgggctcggccggcgccccacccgttcccagaccagcctcacgcgctcaccgtgctgcctccaccaccgatggctctccctcccggcgcaggggcggtggcgccggcgacgcccttcgccgcgaatccgtgccgtctccggcgggcgtctggtcctcctgccgccgcccttcggctcgggccgctcttctggccatgggaaaaggtgaaaatcggtcccctttctgtttcccccatgggttttggaacatgggcatggggaaaccagctactttggggctatcaagaaagcatggacaacgaacttcaggattgcttcaatctggctctaaggaatggcataaacctttttgacactgctgactcttacggaactggaaggctgaacggacagagcgaacggctactcggtaaattcatccttgagtttgaagggaggattaaatctccagatgatgtggtcatagcaactaagtttgctgcatatccttggcgacttacatcggggcagtttgtcagcgcctgcaagtcttctttggaaagattacaacttgataggctcgggatagggcagctgcattggtctactgctaactatgcacccttgcaggagcgtgccctctgggatggactagttgaaatgtatgaaaagggccttgtaagtgctgtcggtgtcagcaattacgggccgaagcagcttctgaagatccacagctatctagcttctagaggagttcccttgagctcagctcaggttcagttctcgttactgagcatgggtgacgatcagatggagctgaaaagtgtgtgtgattcattgggcattcgcatcatcgcatatagcccgcttggattaggaatgctcactgggaagtatggtgcttctaacctcccaaaaggaccaaggtcagtgctgttccgacaaatccttcctgggctggagcctctgctgtcttgcctgagaaggattgccgaaaagaaggggaagaccatgcctcaggtggccatcaactggtgcatgtgcaagggcacagttcctatcccaggcgtcaaaacggtgaggcatgtccaggagaacctgggcgcgctcggctggaggctgagttctgccgagatctcggagctcgagtccgcagcgatggcggctccgaggaagatgatccagaatgtcttccagactgcctgaccgtgctgaatacatgtgtgtgtatgcatgtttctgcaatcgtctttactgaaaaatctgaaaccgggcagccgtgaaccttttcttctcgtaagattcataatatagatagtcactgccatgttctattagttgtcgtttttgacaaagtttaaataaaacttataaaattttgactatcaatacatgttttattatttaaaaaaaaagcggcc

SEQ ID NO: 8067 - DNA, 1943 bp, Zea mays
cgttcctcctcgcgcgtccacctctctcccgacgtccacgtcgccactcaccagttcgccacggcagcaccaccaaccaaacaagcagctctccctcccacttctcattcaaacaacaaagctccctgcgacccaccggcgccggccgcggcatttcttggccccaaagcacgcgcgcgcagcgctaatgccttcgtcgccaacgtcgcctactcgcttcgcgttgtcgtcccctttacttgttgggcagcacctttaggtggcgcgtctcttcgtcgtcggtgtcgtcgtccttgcttcccaagagaccgtcgccttacacctatcgctcgctgccttattgcctgcacctccgtgctgtgctgtactgcacctccgtgcatgcgctccgaggctgctgctgctgcagagcaagtgcttctttcctcacaaattaaagcgtatagtcctgtgcgacgcgtgccgacggccggagcaaggaataggtctcgggtcctggtcacgggaaggtatcttggaagagctggatacacggaaagttgtgagggccgccgccgccggccttgaattagttcgtcctttcaactggagctatactagtaggagggcatttaagatgttcaacatagtttcgtcgtggaacaagaggcggagaagcaggtcactcgaccagctaaatccctgggtgtacaagccggctgagctatggcaggcgaaggagcaggagcaccaccacccgccgcccaagaagcgcagctgcaccatggtgttcacgctcaaggagatggaggaggcgaccaacctgttcagcgaccgcaacctcatcggcaagggcggcttcggccgggtttacagaggcgtgctcaaggatggccagatcgtcgccgtcaagaagatggagctgccgacttgcaagcaggccgacggcgagcgcgagttccgggtggagatcgacatcctgagcaggctagaccaccccaacctggtcacgctcatcggctactgcgccgacggcaagcaccggttcgtggtgtacgagtacatgcccaggggcaacctccaggacatcctcaacggcattggggaggtgaggatggactggccgctgcgcctgcggatcgcgctgggagcggcgcgggcgctggcctacctgcactccagcacggccgtcggcgtccccgtcgtccacagggacttcaagtccagcaacatcctcctcaccgaccactacgaggcaaagatctcggacttcgggctcgccaagctgctgcagcaggaccaggacctgcacaccaccaccagggtgctgggcacgttcggctacttcgaccccgaatacgcgctgacagggaagctgacgctgcagagcgacgtgtacgcgttcggcgtggtgctgctggagctgctgacggggcggcgggccatcgacctgagccaggggccgcaggagcagaacctcatcgtcggcatccaccaggtggtgggcgaccgcaagaagctgcgcaaggtggtggaccgggacatgcccaggggctcctacacgctggagtcggtgtccatgttcgccgcgctcgccgcgcgctgcgtctgcttcgacagcgccgcccgcccgcccatgcaggactgcgtcaaggagctccagttcatcatgtacgctaacatgaagatatgatcactctcgcgggtgcaaaccgcgcgtgggttttctttacttttgagacgggggcggggcatgcggacgatgctgctggattgcaagcaattgcaggtccgcagcttttgtttggttgatgaaacgaattgtctaaaaaggctttatacagttacttgctagtggtgctcgtttggtagagcttgtagctctagtcaaaccagttctactggtgatttctccaaaaaaaaaaaaaaaagtgaccgccccccctccgcgagcggccgtttag

SEQ ID NO: 8068 - DNA, 1087 bp, Zea mays
ccacgcgtccggagtagcctgatccgcttgctcttcaccctcgccgcggccatcggcgcggcctcgctcctcgtcgcctcactccgccgccgcgcgccgcctcccgggcttcccgccaagctcgtcccctcctcccacatggcaggacgcaaccggagtttcgtgctgtggctgcacggcctcggcgactcaggccctgccaacgagcccatccgcaacctcttctccgccccggagttccggctcgccaagtggtcgttcccctccgctccccgcgcccccgtatcatgcaacaatggttttgtcatgccgtcgtggttcgatatccacgagcttcccatgagcgctggctctccgcaagatgagactggggttctcaaggctgtcgaaaaggtgcacgccatgatagacagggaagtagccgatggcatccaccctgagaacatatttgtttgtggattcagtcaaggaggtgctctgacattagctagcgttttgctttatccgaagaagttaggtggaggagcagtgttcagtgggtgggtgcctttcagttcatcagtcactgagaggatttcacctgaagcgaggaagaccccgtttctttggtcacatggaatggctgacaaagtagtattgtttgaagctggccaggctggtccaccgtttttgcaaagcgctggtgttaactgtgagttcaaggcatatccagatctgggtcattcgctttcccaagaagagctactttatcttgagtcgtggatcaagagtcgtctaaatgcctctcaagagaaggacggttaactgattccatcatgcttaagtggcatttatttagtatttttattatacgatacacagatcaactacttgtcctggaatttgttatttggaatttccgattggttatcgttgtcgggtgaataagggcacatagaaccgggatcttctgctggccatggatgttctaaatgcacttgtaacggccctggtatctgacactctcctacaatacaagggctgcagctctagcttgaattgcctggtcaaaaaaaaaaaaaaaaaactcgagactagttcctcgtgc

SEQ ID NO: 8069 - DNA, 1226 bp, Zea mays
gcacgagaccattacctagaacatcctaattgaaaaactagctttttttgaacaaaaaaaaacactattttccaaacaacttcaagttctcggcaatgcattttgggccggctcggcccttgacccatgagtagcctgatccgcttgctcttcaccctcgccgcggccatcggcgcggcctcgctcctcgtcgcctcactccgccgccgcgcgccgcctcccgggcttcccgccaagctcgtcccctcctcccacatggcaggacgcaaccggagtttcgtgctgtggctgcacggcctcggcgactcaggcccggccaacgagcccatccgcaacctcttctccgccccggagttccggctcgccaagtggtcgttcccctccgctccccgcgcccccgtatcatgcaacaatggttttgtcatgccgtcgtggttcgatatccacgagcttcccatgagcgctggctctccgcaagatgagactggggttctcaaggctgtggaaaaggtgcacgccatgatagacagggaagtagccgatggcatccaccctgagaacatatttgtttgtggattcagtcaaggaggtgctctgacattagctagcgttttgctttatccgaagaagttaggtggaggagcagtgttcagtgggtgggtgcctttcagttcatcagtcactgagaggatttcacctgaagcgaggaagaccccgtttctttggtcacatggaatggctgacaaagtagtattgtttgaagctggccaggctggtccaccgtttttgcaaagcgcgggtgttaactgtgaattcaaggcatatccagatctgggccattcgctttcccaagaagagctactttatcttgagtcgtggatcaagagtcgtctaaatgcctctcaagagaaggacggttaactgattccatcatgcttaagtggcatttatttagtatttttattatacgatacacagatcaactactggtcctggaatttgttattggaatttccgataggttatcgttgtcgggtgaataagggcacatagaaccgggatcttctgctggccatggatgttctgaatgcacttgtaacggccctggtatctgacactctcctacaatacaattcaatacaagggctgcagctctagcttgaatcgcctggtcaaccaaaaaaaaaaaaaaaaaaaaaaaaaaaacacaaataaaaataactaaa

SEQ ID NO: 8070 - DNA, 1184 bp, Zea mays
tccaaggctccaaacgccgacacgcgctcttcaaccgagcccaacagatacaggtcaggtctcataaaacttccccaagttggatttcacagccgtgtcagaccacccgactgcccccgcctagtttagggcccacagatcagagacaggaggagacagctccggactcttctagaacgttcaccgcactagcctcccctaatcatatatacccgccaccattcaatccgccagaaaaacacacccagattctttcgattctttcacggttccacctctcccctccctctcgtgctcgatccatcgccgctgcctaatccccatggcctcagcgaacaacgacaaccgcgaggcggcgggcatcctgcggctgctgatggggatggcggcggcggcgccgcctcggcattgcctcgggggggcggcggcggcggcggcggcggcctgatggtggtgcagcacgtcatcctcgacgtcgacggggaattgttctcgggcggggtcggcggcggcggcgtgccgccggcgtcgaaggccgcgatcgccgcgctgaaggaggtgaaggccggggagggcgagggcgagggcgaggacgcgctgggcgagtgcgccatctgcctggacgcggtggagggcaccggcaaggagatgccgtgcgggcaccgcttccacgggcgctgcctggagcggtggctcggcgtgcacggcaactgccccgtctgccgccgcgagctgccagcgccggccaaggaggaggaggaggacagcgcggcgtcggcggagggcggcgaggaggagaggcggaggcccagggccgcggtcgtcgtcagctacctcgtgttcggaggcgggcgggcggaggcgcagcaggagccggagagggaggagccgtggaacattagaatagaggatgtggattagcattggtcgccttcccattggttttcagattggtttgatggcggaggaggttatgtacatactagtaatgtcatgaacgctggaaatgggcgaagggggaatttgtgaatatttcgggagttcaatctgttgatcaatgcttatattgccattaagcactattcttttgaaaatgagcagcggtttgcttctctgctgttttgatgctattctagaaagtctcgaagatgggcaggagtttgttcttctgccgttttgattgt

SEQ ID NO: 8071 - DNA, 732 bp, Zea mays
  misc_feature (590)..(590): n is a, c, g, or t
  misc_feature (630)..(630): n is a, c, g, or t
  misc_feature (691)..(691): n is a, c, g, or t
acacccagattctttcgattctttcacggttccacccctcccctgaattcccctcccgtcctcatcccgccgctgcctactccccatggcctcagcgaacaacgacgaccgcgaggcggcgggcatcctgcggctgctgatggggatggcggcggcggcggcgcccgcctcggcattgcctcggggcggcggcggcggcctgatgatggtgcagcacgtcatcctcgacgtcaacggggaactgttctcgggcggggtcggcggcggcggcgtgccgccggcgtcgaaggccgcgatcgccgcgctgaaggaggtgaaggccggggagggcgaggacgcgcttggcgagtgcgccatctgcctggacgcggtggagggcaccggcaaggagatgccgtgcgggcactgcttccacgggcgctgcctggagcggtggctcggcgtgcacggcaactgccccgtctgccgccgcgagctgccagcgccggccaaggaggaggaggaggaggacagcgcggcgtcggcggagggcggcgaggaggagaggcggaggcccagggccgcggtcgtcgtcagctacctcgtgttcngaggcgggcgggccggaggtgcagcaggagcccggagagngaggagccgtggaacattagaatagaggatgtggattagcattgatcactttgccattggntttcagaatggtttgatggcggaggagggtatgtacatact

SEQ ID NO: 8072 - DNA, 2046 bp, Zea mays
ttcgtcagtatgttgtctagtatatctctgaaataaatagttgttattaaaaaaaaatcctaagccaaaactgcaatttttctgtccaacaggtgcaatacatgcagtattatgctcctccggcaaatgaactgcctcaagcagcaccagaaaatattgctgatgcaatcccttctgaaaatggcaatgctggaagggctctgaatgatggaaacgaggacatgacccgggaagaaaatggtggtgcaactgacacagtgatcagtaataggatagaggaagacagcgttgaggcaaaggatgacatgacacaggaaggggacaagggtgaagtgagtggcaagggtcacatggctacagaggataggaaaggggaagcacaaggtggcgcagatggcaagctggaggaagcaaatgtgatgtcggcggacaagatgatggaggaagcaaatgcgacgtcggcagacaagatggaggaagcaaatgccacgtcggcggataagatggaagaagcagatgccacgtcgtcggacaagatggaagaagcagatgccacattgccggacaagatggaagaagcagatgccacattgccggacaagatggaagaaacaaatgtcacgttgccggacaagatggaggaagcaaatgccatgtcgccggacaagatggaggagaaaaattctgatccgaaggacaagatggatgaggagtgacgtggtggtgtaaccagttttgaaatagcggtagacttgttctgtcagccgcatatcttgatttggaacatcatgtattcacctgtgttaccgcagatgaagactgatacgtgctccccaagaggtgtagccttgtgggcagaatcaagatcgacatatgatgaccatgttcctgcggttaatggtggtgaaggttgttttcgctaccatcttggccaggctatgctggaaaatgttccttctcttccagccaagggtatccatgtttccgcatgtgtttaatcgtgtaaactgtagaggattttttgggtagttttttctgaaacacccgttccatctatcgttgtctccgtaacataacacagctggaacgttgcttttgtatacttgactgactactataattttggcacaagcattagatttttgcagatttgataggccttatcggccattcaaaattttgatttgacagaccaactcacccagcctataaaagagaagcaaatgggagtaagaaataaatgtatgacactggcaagaggtttttcattcttctgagcgcgcagcgaaggcggatgggaaacagaaaactgctatcatatggcagctaatgtagatctatcaggccaaatgtgaccaagagaaaggttggcgtaagtttgagctaactggatagcaaattttctcctgacaattcgaggttttactttatttatacgaaagtaatttataggtcgtgtcgtggatctatctgtggccctggttgggcgcacatggagagatagaaggaggcaactataatttttatagtgtatgaaagtcacgcgagagaagatgaacaccagagtagtttttgatgacgccataataaaaaaaatcaaggggatagcatgtctcatcttattttaaccttaaaccaaacacattctaaactgtgctgcacgtacacagtacacgtattttgaaaaagaggtgatagtatagactatagagtctggcaacttgagatacttcttcatatttgttgtagtttgtatatgaatataaaaatgtctaaataagaacatggtactaatgttcaggatgaaaatgggacgaatattttttcttataggggcttttttagcaacctcatttttccaaggatttttcattttttcaaaaaaaattattttttcttgaaaaaatgaaaatcttagataggataaaataggatggatatttatccatatcgatcggtccatatagatagtccgtatctaaatacgaaatgcgattgtatctgaattcaaatacttaaaatctaagtctgttcgcttgattttag

SEQ ID NO: 8073 - DNA, 1537 bp, Zea mays
atatacaaaaaacagttcttcctctattctattcttacatggtatcagccgcctagatcctgccttcctctcttttgcgtccgacatgagtgatacgcagagttcattttccagcactactgctgccgtttcttccaccaccgctcttcctctctctcaagctatacacagcgtgaacatcaaatcgcttgtgtcgtacattcttgatactcaagttcacaactacggcaaatggagccaactcttcaccattattctcggtcgcttcgatcttctccaccatatcactacctctgatgttttctcggatgatcctgcctgggtccgtgagaacctcacagttctctcatggatcttcgccactatctatgaagacctcgtcgacatggtgattcgtccgcccggtcgacgcgcacacgccatctggcgtcatctgtgcgacatcttctccggcaacaaggccagtcgtgccgttcatcttgaggctgcatttcactctctcacccagggagatctttcggcgcacgactattgtcatcgtcttcaacagctggccaacaacctcgccgattgcgacgctcccatcgacgactgcaccctcgtccatcagcttgtcgccggcatgaacacaaaataccacactttgcgtaccctgctccctgctcttcctgtcttccccagtttcatgcaagctcgcgacatgctccttcttgaggagcgttctcagtctgtgtcggaccggcgcgcggcggacactgctctcgtcgccacagcgacccgaccatcctctgcgccggcttctccactcgtcgctcccaccaacaatgctggcggtgtcactgacaatcgcccgcgcggtggctacggtcgtggtcgcggccgtggccgtggccgcggtttccgctacaacggtggtggccgtagcaccggcttcctcccgccatgggttagcccatggcctgctgcctggcgcgcgccctggactggagcttctggtcccggcgttcttggagcacgcccccaggctcaggcgttcccgatgcttcagcaacctcacactacttttgcgccgcttcagcaaccgtcatgggacatctcaggccttgtccaggcgctccaggctgcttctgtacagcagcaagcaagcgtcggcgattggtttatggacaccgtgagccagctctcacatgaccaacaattctggatctggccaccaagaaaataatcatgaggtccaatagtttcggcgacctctatcccttctttggaaccagctctgcttccccgacggctcttctggcacacaccacatccgttgatgtttggcatcgtcgtctcggtcatcctaataaatattccttagctcggcttcttgatcaatttccctttttatgtaataagtctttagctgcttctcctacgtgtgaagcctgccaaaagggcaaacatgttcggctaccctttccacattctatgtcattcacatatttcccttttcaaatcatacattgcgatttatgcaaaaaaaaaaaaaaaa

SEQ ID NO: 8074 - DNA, 2081 bp, Zea mays
  misc_feature (1929)..(1929): n is a, c, g, or t
  misc_feature (1987)..(1992): n is a, c, g, or t
  misc_feature (1994)..(1995): n is a, c, g, or t
  misc_feature (2007)..(2080): n is a, c, g, or t
cccagcgtccgccaggatctctttacaggtttgttagacttggtgtcccttatattgagctcaatgcccagggtcgtgcaagacctagtaccccgcgtccccacagcgtccgcgcaagggagctgggagatctgccttatgtccgtgagcaagcaatcttccataaagctaacgccgggttctcttttgagtatcagttagttgatgttcctgattataagggaaaaggtgagtcagcgccttctccttggttttaccagaatgaaggggaggctgagtatattgttagtgtgtatatctatatgcgcctgattggctaccctgccaataagatttcaatattgaccacctacaatggtcagaagcttcttattcgtgatgttatcaacaaaagatgcaaaccatggaatattgagccccctaacaaggttaccactgtggacaagttccagggccagcaaaatgatttcattttactttctcttgtccgtacccgttttgtgggtcatcttcgtgatgtcagaagacttattgtagctatgtcccgtgctcgtctgggcttgtacgtgttctgccgtcgttcactgtttgaacaatgttacgaattgcaaccaacattccagctgctcctccaaagatctgataagcttgccttgaatcttgaggagtgcactccttttaccgagcgacctttggaggaaactggaaacatccattacattactggtattgaagacattaatcatctagtaaagttcaggctggaacatcttcgtcaagtgcaatacatgcagtattatgctcctccggcaaatgaactgcctcaagcagcaccagaaaatattgctgatgcaatcccttctgaaaatggcaatgctggaagggctctgaatgatggaaacgaggacatgacccgggaagaaaatggtggtgcaactgacacagtgatcagtaataggatagaggaagacagcgttgaggcaaaggatgacatgacacaggaagggaacaagggtgaagtgagtggcaagggtcacatggctacagaggataggaagggggaagcacaaggtggcgcagatggcaagctggaggaagcaaatgtgatgtcggcggacaagatgatggaggaagcaaatgcgacgtcggcagacaagatggaggaagcaaatgccacgtcggcggataagatggaagaagcagatgccacgtcgtcggacaagatggaagaagcagatgccacattgccggacaagatggaagaagcagatgccacattgccggacaagatggaagaagcagatgccacattgccggacaagatggaggaagcaaatgccatgtcgccggacaggatggaggagaaaaattctgatccgaagacaagatggatgaggagtgacgtggtggtgtaaccagttttgaaatagcggtagacttgttctgtcagccgcatatcttgatttggaacatcatgtattcacctgtgttaccgcagatgaagactgatacgtgctccccaagaggtgtccccgtgccggctgtatcgtgttcgacctatgatgaccatcttcctgcggttaatggtggtgaaggctgttttccctaccatcttggccaggctatgctggaaaatgttccttctcttccagccaagggtatccatgtttccccatgtgtttaatcgtgcaaactgtagaggattttttgggtagtttttttctgaaacacccgttccatctatcgttgtctccgtaacataacacagctggaacgttgcttttgtatacttgactgactactataattttggcaaatgcattagatttttgcggctcgggctcgccctatcggccattcaaaaaaaaaaaaaaaaaaaaaaaaaaaaaaaaaaaaaaaaaaaaaaaaaaaccaaaaaaaaaaaaaaantttttttttccccccccccccccggggggggcccccccccccccccccctaggggggnnnnnntnnccccgggggggnnnnnnnnnnnnnnnnnnnnnnnnnnnnnnnnnnnnnnnnnnnnnnnnnnnnnnnnnnnnnnnnnnnnnnnnnng

SEQ ID NO: 8075 - DNA, 827 bp, Zea mays
gccggccgttccgggtatcccggtgtgccacagaatacagaggcggatgaacactacacagatcagcttaacaagaaggagctatcctcaccatcgaaaatgtaagtattcgagtattataaaaaaagtaggataaacaacagatacattttaattttaccactaaaacttatgtccaggatgaagcacacccaagttgacaaagtcctagattctataattccagaaaaatgaagcttgttacatcctcatgacatgcatggaggtataatactatctatactcctttgtgatacaaaacatattacccccccccacattatctttcactcgccttagtacccattaaacagcaacaaataattaggcaaacactgttagcacaactaatcctatcttcctctttatgtaaaggaatttgcttttgcgtatctgtggagggcttcgtcacttttgaatgaaaaaaacatctatgtacatataaatcacttggtgaagcctttctcaggccatgtgtgttgatgcaacctctgggaaacacaatgctatcagctgctgacatatgctacttcaatactgcttgatatgtattgcactctcagttccgtctactgttggtccaaactgcatctgtgtatatacagaccagttgtattaaactttctaaatctgtgtatactaatgcaacctcttgaaaacagttgttagcccttgacacgtatgctattttaatgctacttaatatgtattgcaatttggttgtcctgtacagaactgctgccccccacgttccaatattaatcggaagctactgcaggcatgcaaaa

SEQ ID NO: 8076 - DNA, 5446 bp, Zea mays
  misc_feature (4527)..(4527): n is a, c, g, or t
gcgcggaggtgcggaatggagagcagcagcggggaggagctggaggaggagttcccgggccacgagtggatcaccccgcagtcctccatcaacgccgcctaccagtctcagaccgagaaggttcgatttctgcttccttgccttgctccgcgcttcagctgttttcctacattccggccagcatacagcggggaatttcacctgctaccattcctggctagttcctgcttcttttgtcgctgtgcgtcagggcctgcttgggcttgaaattacgcaattttggatctagactcgttacaatggtgttatgatgggtaatttcgcgttgggagaggaatgtatctatctgttattcttgaatcccatgtttttcccctccgtaacacagcatgttctcaccgagcctcgacgcatcaaaactagaagcataaccaaacaaaagcatatcaccttcttctaccaaaaactgcaagtaaaatctggctaacttgtcattcttttttattgagatgaagcaaagggtttagtgctgcttgcatctttgtctgccgggattggtacagagaagggctctggtggtttccagtgcgaaatgtttctcattggtgtggtgatggcactcatcgatcgtggttgttgtgcttgcagggtatcaggaaaatttgctccgatttgttggagttgaaggatgctattgaaaacctgtctgcaaataggcagtcaaagttcctggcttttctcaggtaatcacgaaattaatggctattttttcctgctctaaaaataaacgaaacaaattaaaattcagaatttaatatgtttcctttgctcatacttgaaaactcccttctctgtactcattttctctctttttgaaactacttctctcttatgtttttctccttttcactatttgcacagaatttctgaggaggttgttgaagcagaacaagagttaattgagctacaaaagcatgtgtcttcccaaggaattcttgtgcaggatctaatgtcccctctccgttcccaactttattgtgtttaaacatctagcaaggaagaagatgcaacaaaaaaagactctgaaactgaacttgatgaaattttgtctgatgatacccaggatcccagaactatttttctagataagttagacgttttgcttgcagagcacaaaatggaggaggctgttcttgctttggaagctgaagagaagaaatatttagttgcagatgaatctggtaaagaatcaaatgcagataatactgcctttaagacagcactggttaaaaggaaaacaattcttgaggatcagcttgttaggtattgtggacagccatctttatctatgaacgaactaaggaagtgtttgtctggtttaattaagataggcaaaagttctttagcccatcaagtacttctaaaagcttatggttcacgcctgcagaaaagtgtcgaggcatttcttcctaactgttcaatctacacggagacatactctgcaactttgtcacagcttgttttctcagctattgcaaaagcagcaaaagaaactaatacgctacttggagatagccccatgaatacaaaccggattatccaatgggctgaatatgaaatcgaaacctttgcgcgtttggttaaagaaaattctcctttgcctgagagtgtttctgcccttcgctctgcctgtatatgcatcgaaactagtctctttcattgctcttgtctagaatcccaaggtctgaaattctcaaaattacttatggtactattgcgcccttatattgaagaagttcttgatttgaattttagaagggtgaggagaaagattgtggatggggcaaggaatgatgatattctgcttctcacccctcaagaagcatcaccgctctctggtgcagtttcaccaaatgttatgcttacaagcagtggaaaaaagttcatgtccattgtcaatgtgagttcttcgttggttcttatcttctgatatctcttttaagtgaacttgccttaatgcaaccttttgttttaacttgtctggaaattcagcttgctgtcatgttggactgtggattttgacttgtaatttgtcctaccatatctctatatctagatatctctatatctctatgtctatacctatatatctagagcatgcaattacgacacctatctattcatgcaagttatcgatatcaacaggccatgtcatccactaacatgcatttattcttccacgtcagcttaccacactatccactaaaagtcatttgtgatccttgcagcaatgggtgtgtgaggtacccttataattttttagatgtactacacccattgaattcttacagagttgaacaacttgcaatcaatgagcatttgagtatttctagaatccactcagtctttaaattataacagacacaagcagtctgcacactctctattctctacatatgtgtacttggcacaagcaaccatacacaatagcagtagctctctgcatgaaaatatctaggataattagatgtaatgcattttcttgactcgtgagtgatggcctgatgggtttgtgtagaaaccatgctactgcagtcagtttactggttatgcacttatgtgccagcattcaaaaatatgaatagaataatctttcactggaacatggattactatgctttgtggtttatttgattgttttgcaaagttctctacttcacctgctatctgatacactgaagcagctgatatatatgcatatcctccttataggatgttttggatcagatcctcccaatgaccatagttcactttggtggagcaattctgaataaatttatccagctttttgatccctcgcgtccgcccccgcgcccgccctcgcctccgccttctgaagatgataatctactggagtcaaaagagcctattgaacttaaagctgaaagtgatgcgcaacaacttacactaattggaacagcatacactgtagcagatgagttattgccagctgctgtatccaagttctttgacatacaagctgagaagaaaggagctggtggatcaagcgaaggccttggccctgggtccatatatgccatggaatacaaagagtggaaacgtaatttgcagcattcattggacaaactgagggatcacttctgccgacagtatgtcttatcttttatttacttggaagggaagtcacgtttggatgctaaaatgtacttgggacggaaagacgatgatcttttatttgatcctgatcccttgccttcattgcccttccaggttattgcattttttcgcaaccatgcctaaggcctaagcacattttcattaagagggtaattgcatatttgaattttaatgatttgatatcaaatgtttacatgtggtactgatggaaggtgtaactattttccttatctatttgaaaaactgttttgtatgtttgcgacattttttccccgaaaatagcgcaggagaactgcgcacccatatattaaagtagaggggatagggggggccagaaaggacccagatacaacacactccttatggaggccagaagcaggcatacacaaaactatccataaggatcaaaactaaaaaatcacagccctaggagctaggaagcttggccggccaagaaggaaagacctttggcaccagccatttgccatttctccctttcctcaccagcagcctgaaggaggaaggagatacaaggggtcctgtcatcaaacaccaccttgttcctatgattccagatcatccaggcccctaaggccataagagaatccaatcctttctttcccagactgaggacctgagccgaagatctctcccaccagtcaaagaaggaagcccccgcttgctgaggggataagctatgcagcccaacctttctcaagaggttgtaccaaaacactcttgagaacacacaggagatcagcaaatgatcgatgttttcaggtgtgcttggaagatttgccaaacactgttgtgcctagccaagcaagaaattagacttagctagctgtttggatcctgcacttcttctgtctcactatccacgctggcaagattttccttgctgctccgggagagccaaattggctcacctgagctggcaagcatctcatggcttgagccatctaggcaacgctagtttaaccaaacctgctaaaggttccaagtgttagactgccatatattgtgtgtgtatatatggtatggatacatgctaggtatagtcgtcctgatccttgtatacggttagaaagatacagggagatcttgtttggttctgtttccataagccacgagatctctcccctataaatatgtacataggtctctccaatcaatcaatcaatccattattctgcactatctctattgcattcatggtatcattcgcctaggtttagcctttcacttcttgccactgctgctccctgcatgcatgtcatccgtcgcaccggctgctatggctggcgaccctcttgcaccgcctcctantgtcactgcttcaagcgcagccatcggtgcccaacacgatcaccattgatctggccaccaccaccgtcgctctccaatagtctaatgaggcttgccttgctaaggaggaacgcgagcgcacaacctaggtcactcgcgacaccatagatgatcacatttgtgccgctctagaccacgtcactcgtgtgtgtgttgcgatcgagttgtctccgggtgacgtcaaccttgatgagaatgaccctgaggacaatgcctttgcccccgacgcgccacacatctgtgatgcccttcatgaggccaccacactcaatcttcatgcacaggttgttgtcgtgcagaacattcatgtgctcgtgcctcttgtcctcgacattttacacccctggcacgaggctttcctcctcgccatcggccgatactccctcgagagccatgtcctctctgttgtttctgcctcgactcccctgaccaggtctgtatggattgcgttgtacggacatggatcatcaacatcgtctctgacgagctcacctaagccatcgttgagcgtggcgcccccaccaacaccacctagcttgacctcgagccacagttcctcggcaaccgtgaaactcgtgccctcttccttgatgtcgcctttcacaccttcaccaaaagggacgtcaccatcaccaactactaccacatatctcgagcatgagaaaaagctttgtcctttgtctccatgaaaagcacacgagtagcgagagaaaatcataatgatcaaaacatatcacttccccccccaagagagcaaacccgaagctagaccaactgtgtccatgtgtagcaactcactgggttgcttgtgtgaagcaacaaacatcttttcatgacgaccatagtggaaaacaagatctttctcatattttagtttagg

SEQ ID NO: 8077 - DNA, 1906 bp, Zea mays
gggtaccgcgaccccggcgcccaacttctcgtcgtgccgttcccatctttcctttcctcttcccttccccgtcgatctcgtcggcgacgccactacctctcgccgtccggtgccaccatccgcctccgactcctgcgacccagccacggttcccgaggatacgggccgagtccggcgatgggggtggtggtagagcgggaggagtgggcactcagccccttcgcctacccgctcctctccgccgccgccctcgccgcggtgctcctcctcccttacctttccccgaggactgcgccgcacgccaccggaccctcgtctcccttcgacgtgggcgccgcacccttcctccggttccgccgcgccttcctcgtcctcttctccctcgcgtccgtggttgaaggtatccattccgtgtttggggaggatgagttcgtgcggtgtgggcttggcagagagcagacgaccgcgcgccttgcctctaccactgcagctgcgctgttccccggtgccatttctggcgtcatctccgacaaaataggaccacgaagggcttgcatattgtactgggtacttcagcttgcagtaggtgttgtgaagagtttcagtgcgcttcactgttcatggatcaacaatttcattctggcttttgcctcttcagtgttctctttctgttttgagacgtggcttgtgctggagcatgagaagcaagaccagaagcaagatctgctgtttgataccttctggctgatgacattctttgaatcggtgtcccttgtcggaagtcaagaaatcacaaatgtattggttagtgatgatgacagtagattcttgcttccctatgcatttgcagccacactatcggtagtgggcattctgtatatcagaaatgcatcaagtacatgtcagcatgcatctgccattgggagctaccaaaaatcatttcttgctcatgtcctcagagacaaaagagtactgatcctggtcttagctcaagcaagcatccattttgctgtctcagccttttggtttctctgggcaccaaccatagtggctgacggaaggtatgctcaactgtcagtaatctacccctgtttcttggcatcaaggatgcttggaagtgctggttttccatggttttacggagccatagcccccttccggaacgaggacagcttgacaatagcttacgttggtgctggactcgctttgtcgattgcggcttatgattaccaggagattgcaccactggtgatagtgttctgcatcttccatgcttgtgtgggcttcattttgccgtcactggccagattgcgaacaatgtacctgccaaatgagctgcgagggggcatgatgagcttttcaatgtcactggcaaatgccgccaccttcgttttcttgatacagggcagcgcccaccatcgacgcgttgcaaactcaaccatcctgagccttgcgtcctatggcctgttaggagctgggggctgcgtccatatgttgaggaggtggaggaagcacactcggctgaatgcccgtagtctgtaggagctggaggcacccaatgaatgctatacacactgcagggtgaacttgagagcggtttctgtagcatgctagtatctcacgttttgtttatctgactttttctggaaatatcaggaggtaggtgtaggatactacttttgttgttgttcaaagaaattgttgaaattgaaggttgacaaaaaatctgtgtacatgcgtcggggccatcaaactaacgtctgactttgatttttagcaattaaactcgaaagccaggaatctgtgtatgtatgtttggtttgtagtttttttttccaagtgttcgtttcatacattgtcttgatagtataaaaatcgctcgtaccatacaaaaaaaaaaaaaaaa

SEQ ID NO: 8078 - DNA, 1402 bp, Zea mays
tgtgagcctgctgccgtcttcttccgccgccgccgccgtcgtcttcgtccgtaggtagcctcctctctcctgtcctcgcttgatcttatctactagtagtactcctgatgagacgctaagaaatctcgcttatattatgttaaccctgaaaccgaaagtgagtcttgtgcaactgtaaaaactgggacgtcactgaacgaacgatagcctgggttcgttcggtcgtagtggaggatacagcaacatcctcttaagttgaatttacgaacgcagttaatttgtttccctgtgccgttcgctgcgttacgcacaaggatctttactcctggatttcaatttatttattttccccccgcatttaagtattgcggcttgccttgccttgccttctggatgtcgcgttgcgccgctggctgatgatggcctatcccctgcagggtccagcagatcagagagcggggaggaagaaaaagcgatcgatggcgtccaactacgtggacacgacgggcgaggagggacggttccacggccctcacagccacagcaccagcacgaccccgacgggcggcgcggcggcggcggcggcatcgccgcgcaacttccggcgcagcttctcctccgcgtcctccgcgggccacagccacggcggcggcggcggcggggccaagtgcgtgtgcgcgcccgcgacccacgccgggtcgttcaagtgccggctccaccgcaccaactcccagggccacggccacggccacccgcacccgtccccgccggcctcccccgccgcgccggcgcagggcgtctcgtcttccgcttcctcccgcaccgtcgaggccctgtgagtgtccgaggccaaagacgggcgaggcgtggggaaagtgagaagatgatgggatatacttgtcgtgtcagtctgtcagaaggaaaggagtgaagctattattccctcttgttgtgatccgcgctgttttgcctcttcccccctacccgtttcctcccttcgtgctggttgtggttctaaattcctgattgccggccgtcccgccttcttccttgccaagacgagactctcctcctcctgccactgctaccgctgctcctctcaactggtgaactggatcctgatttggggagaaggttaaactggatgcctttccatgtaattaattgcctctctttaccattctacgtgctactagtattgaagtatcatcacccttgttgtgtccttctgtctgtggtgtgatggtcatggactcatggtctgtgtttcttcggtgaagagttcgtacccgtacataaaagatcttcaatcagtggccggtttggtacctgtttggttcagatttaaaaaaacaagctaaaaaaaaaatctggctgtggtgagaatcatacagaaaacaac

SEQ ID NO: 8079 - DNA, 546 bp, Zea mays
gccggccaggccgggagtttgccgctctgtgagcctgctgccgtcttcttccgccgccgccgccgtcgtcttcgtccgtagcagatcagagagcggggaggaagaaaaagcgatcgatggcgtccaactacgtggacacgacgggcgaggagggacggttccacggccctcacagccacagcaccagcacgaccccgacgggcggcgcggcggcggcggcggcatcgccgcgcaacttccggcgcagcttctcctccgcgtcctccgcgggccacagccacggcggcggcggcggcgggggcaggtggctgtgcgcgccgccgcgacccacgccgggtcgttcaagtgccggctccaccgcaccaactcccagggccacggccacggccacccgcacccgtccccgccgggctcccccgccgtgccggcggcaggcggctcgtcttccgtttcctcccgcaccgtcctggccctgtgagtgttccgaggcctatgacgggcgatgcgtggggaaagtgagaagattatgggattttctttgtcgtg

SEQ ID NO: 8080 - DNA, 922 bp, Zea mays
agtttgccactctgtgagcctgctgcccgtcttcttccgccgccgccgccgtcgtcttcgtccgtagagcagcagatcagagagcggggaggaagaaaaaccgatcgatggcgtccaactacgtggacacgacgggcgaggagggacggttccacggccctcacagccacagcaccagcacgaccccgacgggcggcgcggcggcggcggcggcatcgccgcgcaacttccggcgcagcttctcctccgcgtcctccgcgggccacagccacggcggcggcggcggggccaagtgcgtgtgcgcgcccgcgacccacgccgggtcgttcaagtgccggctccaccgcaccaactcccagggccacggccacccgcacccgtccccgccggcctcccccgccgcgccggcgcagggcgtctcgtcttccgcttcctcccgcaccgtcgaggccctgtgagtgtccgaggccaaagacgggcgagacgcggggaaagtgagaagatgatgggatatacttgtcgtgtcagtctgtcagaaggaaaggagggaagctattattccctccctcttgttgtgatccgcgctgttttgcctcttccccctacccgtttcctcccttcgtgctggttgtggttctaaattcctgattgccggccgtcccgccttcttccttgccaagacgagactctcctcctcctgccactgctaccgctgctcctctcaactggtgaactggatcctgatttggggagaaggttaaactggatgcctatgtaattaattgcatctctttaccattctacgtactactagtattgaagtatcatcacccttgttgtgaattccttctgtctgtggtgtgatggtaatggtctgtgtgtccattgggcactttgagcaagctactccctacttcgtgtt

SEQ ID NO: 8081 - DNA, 811 bp, Zea mays
ccattgggtacctcgaggccggccgggagagattagtgagctgttgcaaaaagcaaaaaatatcgtctagcatcagtagcatccccctgcagtgctggccacataatggcgaataagtccgctgccgctgctattctgctcgccgccgccgtgctcggctgtcttgtctcggcgtcgctcgccgaccagggcaccgccacctactacaccgtctacactccgtcggcgtgctacgggaaccaggacgagggcacgctgatcgcggcggcgagcgacgcgctctggaacggcggcgccgcgtgcggcaccatgtacacggtcacctgcgtcgggggcaccaacgagaccccgaacccctgcaaccccggcgcctccgtcaccgtcaagatcgtcgaccgctgcccgtcgcccggctgccaggccacgctcgacctctcccagcaggccttcgccaccatcggcaacctcggcgccggcaagatcgtcatcgactacagccaggcgtaagatacatgcatgttgtgggaagaagcacgaactatacgtacatacatgcaaaagattcattcaagcttatatatattattcggggatgagttagtaaatactaagcaataacaaatcatgtcgtattagtctcaagctacgactatacaatcctagtgcaaacaagtgatttgtttgctgaaataatgatctgcaccatacgagtgtgcgtgtataatcgtacctttggagaaataaataaccgggcagtcgggcttatctaaaacaaaaaaaaaaaaaacagccggccctcgagctcccgcct

SEQ ID NO: 8082 - DNA, 815 bp, Zea mays
cccattgggtccctcgaggccggccgggagagcattagtgagctgttgcaaaaagcaaaaaatatcgtctagcatcagtagcatccccctgcagtgctggccacataatggcgaataagtccgctgccgctgccattctgctcgccgccgccgtgctcggctgtcttgtctcggcgtcgctcgccgaccagggcaccgccacctactacaccgtctacactccgtcggcgtgctacgggaaccaggacgagggcacgctgatcgcggcggcgagcgacgcgctctggaacggcggcgccgcgtgcggcaccatgtacacggtcacctgcgtcgggggcaccaacgagaccccgaacccctgcaaccccggcgcctccgtcaccgtcaagatcgtcgaccgctgcccgtcgcccggctgccaggccacgctcgacctctcccagcaggccttcgccaccatcggcaacctcggcgccggcaagatcgtcatcgactacagccaggcgtaagatatatacatgcatgttgtgggaagcaagcacgaactacgtacatacatgcaaaagcttcattcaagcttatattattcggggatgagttagtaaatactaagcaataacaaatcatgtcgtattagtctcaagctacgactatacaatcctagtgcaaacaagtgatttgtttgctgaaataatgatctgcaccatacgagtgtgcgtgtataatcgtacctttggagaaataaataaccgggcagtcgggcttatctaaaaaaaaaaaaaaaaaaccgccccccccccccaccgccgctccct

SEQ ID NO: 8083 - DNA, 823 bp, Zea mays
ctctcattgggtccctcgaggccggccgggagagattagtgagctgttgcaaaaagcaaaaaatatcgtctagcatcagtagcatccccctgcagtgctggccacataatggcgaataagtccgctgccgctgccattctgctcgccgccgccgtgctcggctgtcttgtctcggcgtcgctcgccgaccagggcaccgccacctactacaccgtctacactccgtcggcgtgctacgggaaccaggacgagggcacgctgatcgcggcggcgagcgacgcgctctggaacggcggcgccgcgtgcggcaccatgtacacggtcacctgcgtcgggggcaccaacgagaccccgaacccctgcaaccccggcgcctccgtcaccgtcaagatcgtcgaccgctgcccgtcgcccggctgccaggccacgctcgacctctcccagcaggccttcgccaccatcggcaacctcggcgccggcaagatcgtcatcgactacagccaggcgtaagatatatacatgcatgttgtgggaagcaagcacgaactacgtacatacatgcaaaagcttcattcaagcttatattattcggggatgagttagtaaatactaagcaataacaaatcatgtcgtattagtctcaagctacgactatacaatcctagtgcaaacaagtgatttgtttgctgaaataatgatctgcaccatacgagtgtgcgtgtataatcgtacctttggagaaataaataaccgggcagtcgggcttatctaaagaaaaaaaaaaaccataaaacaaacaaaaaaaaaaaagcggccagcggcc

SEQ ID NO: 8084 - DNA, 1742 bp, Zea mays
ggcacacagagtctcagacacaggcacagctggcacctcggccccccccggcacaaacccaactcgttttcagctcgcgaaacgggcggcctcgtagcggagtcctagtcctctcgctttctccctgcgattcgcctcagcttccatccgatccgattcgggagtcgggactcgggagatagaggcagacggagagagaagaaaggcaaggcaatcgccgcgcgcgtgcttcctgccttctcggtcggctccagctcgccgttcattcccgcaatcccgctccgctcgcggtatcgggccgtggtagtgatgccgctggctgagccgccccagtggcgccgcaaagccacggatttcttctccacatctagtgtcaagctgaagcaggcagggcaatcggccggggataatatagctgatgttgctgggaaggttgggtccgcggtgaagagtcggtgggtcgtcttccaggaggctaggcagcagcagcagcaacggccaccgcatgagacagtgcaagagcgtatcatcaccgctgctgccaccactggtttgcttttcaggaaaggcatttcagagacaaaggagaaggttgcagtgggaaaggttaaagttgaagaggttgctaaaaaaactgcagataaaagcaagaatatcttgaacaatattgaacgctggcagaagggagtcgcaagcactgatgtgtttggtgttcctattgaagccactgtacaacgagagcaatctggtaaagctgtgcccttggtgctagtgagatgtgcagactacctggttatatcaggtttgaataatgagtacttattcaaatctgaaggtgacaaaaaagttcttcagcagttagtttctctttacaatgaagactctggcgcatctttacctgaaggtgtgaatcctattgatgtaggtgcactggtgaagtgctaccttgccagtatccctgagccgcttactacattttcgctttatgatgagcttcgagctgcgagggttagcattcctgatcttagggatatattgaagaagcttccaaatgtgaactacatgacaatagagtttgttacagcattgcttcttcgagtcagccataaatcatcacttaacaagatggactcccgcagccttgctgtggaatttgcgcctttgatcatgtggcggcaaggtgatgctggcacagatttgcgtaaccacctcaagttaaccctgaaaccgcctccaaaaattgtggatacaacatcaaatactgccacgtgggacctgtttgatgaggatggcgaggatgcttcatcccagatccccttggacgatgcttcacccccagactacaactccattgaggtcatccagtgtctgatcgagcatcataatgccatcttcactgatgcaaatgaaaccgtgtggagatgatcaaggtctcctctagatctctctggtgttagctcgtgctacgtattagttccaggtaggaaggtggattaccgtccgttattgttagggataagcattttggccggaacatttttggagtaggtttgtatatatgcgctagtgttaattctccccgggactaggatctggtcatgttatagcaatataagtcttgggtggatgtaaaccagatggacacgattgtgctgcatttgctgaattcggcttatacactgctgttaatctaaaaaaaaaaaaacctgtacgttcacggttagctggtagcgtttgtcgtc

SEQ ID NO: 8085 - DNA, 1667 bp, Zea mays
cgggagaatggcagaatccacaagcggcagagcgccccaaacaaaacccaactcatttttttttcccagctcgcggaacgggcggcctcgttgcaacttgcagagacccagtcctctcgctttctcaccgcgattcgcctcgcttccatccgattcgattcgggagctagaggagagagaggagaggagaggcagtgatgccgctggctgagtcgcccccgtggcgccgcaaggccacagatttcttctccacgtccagtgtcaagctgaagcaggcaggccaatcggccggggataatatagttgatgttgctgggaaggttgggtccgtggtgaagagtcggtgggctgtcttccaagaggctaggcagcagcagcagcagcagcaacgtccgccgcatgagacagtgcaagagcgtatcatcactgctgctgcctccactggtttgcttttcaggaaaggcatttcagagacaaaggagaaggttgcagtgggaaaggtcaaagttgaagaggctgctaaaaaaactgcagataaaagcaagagtatcttgaacaatattgaacgctggcagaagggagtcgcaagcactgatgtgtttggtgttcctattgaagctactgtacaacgagagcaatctgatagagcggtgcccctggtgcttgtgagatgtgcggactacctggttatatcaggtttgaataatgagtacttattcaaatctgaaggtgacaaaaaagttcttcagcagttagtttctctttacaatgaagactcgggtgcatctttacttgaaggtgtaaatcctattgatgtaggtgcactggtgaagtgctaccttgccagtatcccggagccacttactacattttcgctttatgatgagcttcgagctgcgagggttagcattcctgatcttaggaacatattgaagaagcttccaaatgtgaactacatgacgctagagtttgttacagcgttgctgctgcgagtcagccgtaaatcatcacttaacaagatggactcccgcagccttgctgtggaatttgcgcctttgatcatgtggcggcaaggtgacactggcacagatttgcgtaaccacctcaagtttaccctgaaaccgcctccaaaaattgtggatacaacatcaaatgctgccacatgggacctgttagatgaggatgacgaggatgcttcatcccagatccccttagacgatgcttcaccaccagactacagctccattgaggttatccagtgtctgatcgagcatcacaatgccatcttcaccgacgcaaatgaaaccgtgtggagatgatcggcatctcctctagatctctctggtgttagatcgtgctattgtacaagttccaggtaggaaggtgggaaggtggattagcgctcgctattgttagggataagcattttggccggaatatttttgaagtaggtttgtatatacactagtgttaactgttaattctccacgggactagaaccgggtcatgccatatcaataaaaatatatttggatggatgtaaacgaaatgtgttgtttccatcattgattgtattcagatcatataataataacaaagcctttgtccccagttgggctagactaaagttgaaatccaataaaagccacaaattatggtttagtcat

SEQ ID NO: 8086 - DNA, 1225 bp, Zea mays
ccgggaaggcaatcgccgcgcgcgtgcttcctgccttctcggtcggctccagctcgccgttcattcccgcaatcccgctccgctcgcggtatcgggccgtggtagtgatgccgctggctgagccgccccagtggcgccgcaaagccacggatttcttctccacatctagtgtcaagctgaagcaggcagggcaatcggccggggataatatagctgatgttgctgggaaggttgggtccgcggtgaagagtcggtgggtcatcttccaggaggctaggcagcagcagcagcaacggccaccgcatgagacagtgcaagagcgtatcatcaccgctgctgccaccactggtttgcttttcaggaaaggcatttcagagacaaaggagaaggttgcagtgggaaaggttaaagttccattgggtccctcgaggccggccgggagagcattagtgagctgttgcaaaaagcaaaaaatatcgtctagcatcagtagcatccccctgcagtgctggccacataatggcgaataagtccgctgccgctgctattctgctcgccgccgccgtgctcggctgtcttgtctcggcgtcgctcgccgaccagggcaccgccacctactacaccgtctacactccgtcggcgtgctacgggaaccaggacgagggcacgctgatcgcggcggcgagcgacgcgctctggaacggcggcgccgcgtgcggcaccatgtacacggtcacctgcgtcgggggcaccaacgagaccccgaacccctgcaaccccggcgcctccgtcaccgtcaagatcgtcgaccgctgcccgtcgcccggctgccaggccacgctcgacctctcccagcaggccttcgccaccatcggcaacctcggcgccggcaagatcgtcatcgactacagccaggcgtaagatacatgcatgttgtgggaagaagcacgaactatacgtacatacatgcaaaagattcattcaagcttatatatattattcggggatgagttagtaaatactaagcaataacaaatcatgtcgtattagtctcaagctacgactatacaatcctagtgcaaacaagtgatttgtttgctgaaataatgatctgcaccatacgagtgtgcgtgtataatcgtacctttggagaaataaataaccgggcagtcgggcttatctaaagcaaaaaaaaaaaaaaaaagcggcccccgagacgcggcct

SEQ ID NO: 8087 - DNA, 5296 bp, Zea mays
  misc_feature (3684)..(3684): n is a, c, g, or t
cttccttctatcgtaggctcgccctcgccgctcgctggagcggaggtctctccctgcagcccatactccttgattcattctattgcctcgccgccggctctatggataagcaggagccagtagccaatggtgaacaaacgataggtcttgctgagaagccgaaggagctgcctgttgccagtaaggatgagaaagcaactgtgcccccgattttagttgattcaaatgctttcaatctaccaagtgaaggccaaacccaagctggcacatctaacatggatgggggccataatggtgcacacaacttttatgcttctcaggcacaaccattctattaccaaggctccggttctgaaaaccctacacaagcatgggatacatatcctccctacatgagtgttgaaggattggaagtgggtccaccagttgtatacaatgaggacccctcattgatgttccatggtggctatggttacgacccatattattctcctattgcaacacctgtaccaaatgctgttagtggagggtgatacaataatgccgattgacccaacacaaggagcttttatcgctgataccctgagtccaaacagcttcctgtttggcccaagacctgaatggttcagatcttcagaaggaactgggtcatttccatcacctgcagcttcacctcaaccttctaggggtgttccagggtcctatgaccaaaacaactttccaatggcttcaagaatgtcatcacctcaccagaagcccttctatggtttgagatccacaactgactcctatggaaggggtttttctcatggtggaatgttcccacaggccagtaattatgggggatccgtcaccagctttggccttaatggtagaagtttgatctcaaccgagaaagggcgcaggaggggaaggggcaatgcacttatttgcagctgcaatggtcctcttgactttcttaatgagcaaagtcggggtccacgtgcaactaagcctaagaagcaaccagaggttgacagtaaggatgaggtgcctactacaggagttggtcgtgagttatacaacaagcctgactttgttatggagtacacgaatgcgaggtttttcatcataaaatcgtacagcgaagataatgtgcacaagagtgtcaaatatggtgtttgggctagcaccacaaatggaaacaagaaactggactcagcctatcgcgaagctaaggagaaaggagagcactgtcccattttcctgttattttcggtgaatgccagtgcacaattctgtggtgttgctgagatgattggaccagtggactttgagaaaagtgtggattactggcagcaagataagtggactggtcaattccctgtgaagtggcacatagtgaaggatgttcccaataatcttttccgacatataattcttgaaaacaacgacaataaacctgtaacaaacagcagagatacacaggaggtgaaactagagcaaggaatggagatgctgaagatctttaagaaccatgatgatgatgcatcaatccttgacgactttgagttttacgaggagcgtgagaaagcgctgcaggaaaataaggcacgcctgcatcagcaacatctacccagttctattgttattgagcccaagaaacccttgactgcacccagtgacctcgtgggccatatcaccaagagttttgctgaggctgtgcggcttggtgaggccaagactgtaagccatttgactgagaaggtttctgggggtgatccgtctattcctgtgaagcatgttgaagttaagcagagtggtttatcttaggaactcttgatcgatgtgaatgaactgtaccaaaaattcacccatacgcttcctgatcaaaatgtcgggaatgcatatgcagatggatgatgatgaaacccaagacatcggcaaaagcatgcatgcacactagggtaggtctttgccaaccttggaagcatagtttcttgaatagtttctctctttttttcttctttcttcctagtattttctccccttctcttcgcatcatatgatgattccttagtgtctagcctcaaggagagttgctgtttttgtgtaagcctctgtaagtttcctgttccatcacatatgagtaaggcctttttgtttctttttatttaagtaaaagatccatcttttatgtactgtcgtggcagttttattatactatgtctgaacaaggcctattcactatgtaagcaaaacataaacgctatccaggtgacctggttgtgatgactacagtaataagtaactgaataattttttatgtttgctgggaagggcatagtgtcgtgtggccccgtgatatatggctgcaacgtcatgtttgtcagctcccatgcatggattgatatttgcgcaagctatattttcagtgcataaaaatctttgttctaggcaaatattttaggaaacttcacagtcgtaaatttcctaatagctatgctttgacagttcatttttgcgatctcggtctggatatggaaatgaagtagtcaagtcatggaattgcgtgattttggtacccagaacacttcaaccaggtagcatgtagaactagtccgttgataaatattcgataaaatattaacacacaactacacgaaaatgagcaactcgtggctcacacctatatctcgtctaacaaccaaataagctttacctctttcatgtgtaactaacaatgccactatgagtgcttcctcctcgccgttgtcgtcccatatgcgttccggttagttttgtattggttgttggcaatagtttgtaagacattaagatcgatgatcatatatgtattgcatgtttttatgtaatcgttatatgctaatatttcatcgaatatttatgtaccggcgcaactcacgagcatttttactagttgaccttaatatcacacaaattattgtgcaccgtcagtcgcgatgcctcctctccttcgtctattcttgccctcctctccctcatatgttcttgctacgctgcctgcatacgcatatggagtcacgacaacggtttgagatgcttgccaacgagggaagatcgatgtcctctatgatggtgtgaagaatctgggtgtgggaggtgcatgtctgtgcattgtgacgacatgtaaatatttgataaaatattaacgcaaaacgattaaataaaaacgtgcaatacatatattatcatcgacattaataactcacaaattatttgctaacaactaaaacaaaattaaactcgggatccagagcgcctcatcggcggcagttgtgcctcctcctttccctcgcttgttcttgtatcgctgcatgcagaggtgcatggtagcgaagagttgcgaaggcttgccgttttgcctatagaggcgcacgacacagagagtcacgatagtggttcaaggcgcttgctgacgggagaaggtcgatgtcttctacggtgatgcagaagaatctgaatgagggaggtggggacgggaaaagatatgagaagttggaggacgacaacaatgacgatgatgagaggtaactcttatcttatctagttgttaggcgacataggggaagacagatctagcgcgaggattggttacacatgtaagagataagacatatcttatgtggatgttaggcgacacttgtgaaaaaaaacaaattnacatgtttcatgcgtgtggcacgacacacgaaaagttgtgatttaaatgagtagaaattggaacctatgcagattttaggttgttatgcttttcttttcattctgcttgtgtttgtgtttggattcatttaatctaaacaagaattcattaagttacgttatcatcctataagcataagcatttcgaatatgatttttactaatacgtatagttttttgttgttggttttttgagaatggatcggaggtgcatatgtctgcagcgtccttttcctccaatcggttgggtcgttgatattttccagctttactcggattagtttatctcagtcattgtacacagtcggaaaactgacagaaaccagcgagactgtagccgttttaaatgttagctatttgtaaaaagactaaaatttcacgatggtgcaaaaaagaatagaccggattactctatccgtcttaatttacaattcatttttattaaatttgttcggctcattttattcattttttcaaaaatttaaagtcatacataaagacatgacaataaaatctaataataattatgattttttaaataagataaactgatcaaacttgacgttaaaaagtcaaatgaattataaattacaaccgagggagtacaatttacattccaatttcctcttgtcaaaatagaacatactatgatgcaaaaggaaaatagttgggtcatactaatattccggaagagctttgatgacaaaatttgcgtgcatgtattcatcgagtgtaggtctactttcgtggacatttacatttactagtaccttacgtgcgtcttcctacacgctctagcgaaggttatcgtcacccgcgccaccgctctgtgttttgccattgtttcacttttatagaggtgctaaagatcacatttgtagcttcagctgcacaattttaactataagtgttgaatgtcgcactaccagaaacagtttctttgccgagtatctcaagcactcggcaaaatctgaaaaacactaaacgaaggttttgtcgagtgtgacactcggcaaagaaagctcgacgaactgtacatcagcaacggcttctttgccgaatattttttatcgggcactcgacaaagtttttaccgagtgtcactcggtacttggcaaagaaaagtcgccgttacggcgccaggtaacggcgacggagcctgtgtgacactcggcaaaggctcactctttgcagagcgtcaactgtacagacactcagcaaagaagctccatgtgggcccctttaccaggtcctttgccaagcgtattacgtggcactcggcaaaggctccctctttgccgagtgcccgctggactagcactcggcaaagggatcaccagcggacccctttgtcagttcctttaccgagtgcatttgtaggtactcggcaaagcttgcttgtttgccgagtgccaaggccacaacactcgacaaaaaggctttaccggtgcctaggtgtgcattctttgtcgagtgctatgaccttgacactcaacaaagaatctctttgtcgagtgttacacatgaaatcatagagcttcaatgtagaccgtctaggtttatacacatagtg

SEQ ID NO: 8088 - DNA, 3806 bp, Zea mays
tgcaggctgttatgccgttacactcttaacctgttcgatgaaatgcccttaggaaaagacgtgataactaccgggcacgccaatccccgaagtaatcagtcttttcaccttactttgtttggtgatgttcttgtctcagtaagattctgcttcctcatgcgcaggaggttgatctcaggagctctgatgtttcgagtgattcccgtgcaaaggtaagctgaatgatatcgagatcatagagttacgctcagttgttgttatcagtgacagatgtggcttactccttgttattaggtgactgatacttcataccgagcaatcataccagagatcgttgacgttctcagaactgtttgtgagacgcacaaactgccactggcccagacgtggataccctgcatctgccaggcaaagaggggaagccgccacaccgatgaaaaactcaagtattgtgtgtctaccctggacgaagcgtgttacgtccgcgacctgaatgtaaatggctttcacgaagcttgctctgagcatcatttgttcagaggtgagggtgttgttggcagggcctttgcaacgaacgagccatgtttctctgaagacattaccgcctccagcaagatccaataccctctctctcatcatgccaaacttttcagcttaagggctgcagtggccatccggttacggagtatcagcactggaagccttgactatgtcttggaattcttcctgccagtggactgcatagagattgaagagcaacgagccatgctgaattctttgtccattacaatacagcaaacatgctacacacttcgagttgtcagcttgaaagagctggtggatgaaggatcaattgaaacaagtgctctaactccaccagaatatgacaaatctatgcatgaaaacatagatgaggtttgtagtggcattggtgttcctgcaaggacagcatcactggaaacttccgaggaggtgtcctcatggatagcaagccttgtgtgcgctcaaaataagggagtgaaagaaatggatggtgacctgccatttggattcagcaagcaagaggatgaagggtttagtgttacagctggctggcatacctctccagtaatagagcctgaaggtagcatcttttcaggcttcaagcagcatgaagaatacaaggtcaaggaggtaacttgtctcagagatccaagctcatccaacttggaaaaaactgtagaaaagagacggactaagatggagaaaactgttagcctggaagaacttcggaagcattttgctgagcagcctgaaagaagctgcaaagaatttaggaggtagcttctgaccctcagatctttacagttcttttccattcctcttgttgtactacctctttgtattgatgaatagtcagtagcctgtggacagcctgctgaaatatggcaccatcttccagtaaccatagttacaagttcataactcaaatagaactggaatttttttagttgaacattgtttgcaatcctgttagtcaaatgtcaggagtgacacaagtaaatttactcctcaaattacatttcattacttcttgcaacaattccagacggaaggcagattggtcaatgcttgttcactatttgcatagaaacatcaacgttttcatccatgtttaactattttaatcatttgtttcagtgtgccccactacactgaagagaatatgcaggcagcatggaattaatcgttggccatcacggaagattaagaaagttgggcactccctgaagaaattgcaaatggtgatcgattcagtacatggtagcgaaggaacggttcagctcagctcgctctatgaaaactttaccaagaccacatggtcagaaagagagttacaaggggatgccacttatccattgtcagaggaaaaaggtcccttggaaccttctgttcctgatcggtattgcgagggcagattcacctcgcatacttctggttctaattccctctcaccctcttgtagccaaagctcaaattccagccatggttgttccagtggttcgaaatcacaacaacatgtcagtgctcctcaacttgcagtaaagaaagaagttttcatggaggagaatcagagctccacactactcaaagctgcaagccatgctgaactgcaggcgcgccctgaagaaagacttgtcaccctgcctaggtctcatagccaagtgcttttaagtgaacaaaagcgcagtggaaaatataacaggtatgcaaatgtctaagcctgattctctcaagataaaagccatgtacggcgaagaaagatgtatattccgactgcagcctagttggggatttgaaaagctaaaagaagaaattctaaagcggtttggcattgctcgggaggtgtatgtggacctcaagtatttggatgatgaatctgagtgggttcttctaacatgcaacgcagacctgcttgagtgtattgatgtgtacaagtcatcaagtactcaaacagtaaggatcttggtacattctagtgaccagtaagtgcctgttcctttggtcaaactggtttgtcctgacaatggcgcaaagctcatcaggatgctgaagaaagcatacaatctctctttgaagtaaagtgcttgttgacatcgcgctcagtttcaagtcataatcatatatgcaaaagcagcatctgtaaatacctacactcgtgttgtcatcccgtggtcaagtgcctagtaagttctgtatgttgctgtttggtggctgtgtggcagaattggagagaaagtgattgttggtgttccctgtcagctcttgggattggtttgtatgcagtaagctgcatacagtctttgatataacagaagatgggacttctgtacctctagttcagtttgttaacagtacaggtagttcgttgaatgtaacaaactagtgtacaatattgtaggccggagggtggaatcagtaggaatttgtcgatatgaagctttggattaggttaagtaatcacgaccaagttgcatcgcgcttgtaagttcttttggattaggttttgaaattcaaaaactcgccaaaaaaaccacaagctgtggaaagtggaatcaacagaagcatgcccatgccgtcatgtgtcgttttagtgggcacaatgaaatgtcttctcaccagtggcaaaaggtgtcgagcagagagcaactggctggagcaacactacgagctcatcacctggtcaaaaatgagatttggttggttcaaggtcaatgctactttttcatgttcttgcttcaaccatgcagaaggggtggtggttttaggtatcctgaataattccacagttagaaagcaggagatgtcttagtctcctagacgacaatgcagcatagatattttcttttgtttcgctcttattaatttttgtccagcagtgtatttctcttgtgttttttgaggtagccttgtgtgtaatctgtcctcggattcgcagcatgtgtgtctgtttcataactcatagtctgcatgtatgttgctacgactgtggccatcctgtccgattccaagaacattgctgaacctatatactgctgtaataatgagggatcaatcgagtaaaaatgtgtactctgtggcgattagttgaatgaagctgaagaatcaatgccagtactgttctgagtcagcagctatagccttgctcaagccaagcaacgaccatgccgcatcagcaaggcctggaaaaatcatggtgcggcgacgaccggcgcgccccgggccgcggcggcaggtcccgctgccccaccgcccccctgctgcag

SEQ ID NO: 8089 - DNA, 1391 bp, Zea mays
  misc_feature (350)..(351): n is a, c, g, or t
gatcacttggtctgtttaacaaatacaatgaggtaccatcaatcatggctattaagattgcttgctgcttcttgtctgtaattttgatatgggaaatccctggggtatttgaatcattgtgggccccctttacgtttctgctaggctataaagatccatcgccatccaaggcacacttacccctgctacatgagtggcatttccgatctggcctcgatcgatacatatggattattggaatgatttatgcttacttccatcctaatgttgaaagatggatggagaagctggaagaatctgagactaaggttagattatcaatcaaggggaaccattgtcactctttcatnntgacggttggccttttctgtggtatgaatatatatacaagctagacaaagttacatacaacaagtaccatccctacacatcatggatccctataacgtacgtataagaaatttaacatgtattcataatcgatgtggcacatgccatgccagcaatatgcttacagctttgttccagtccctgacacatcaactgtgttccctatcactgtttatatctgcctgcgcaattgcacccagcagttgaggaatgcctctttagctcttttcgcatggcttggcaagattacactcgagacttatatttctcagatccatatttggcttaggtctagcatgccaaatggacaaccaaagtggcttctttgtttcataccagattatcctatgcttaacttcatgcttactacagcgatctatcttcttctatcataccgtgtgtttgagatcacaaacgtcttgaagtcggcttttatccccagtagggataatagccgcctataccaaaatttgattgctgggatcgccatctcagtgtgcttgtatctctgctcgcttattcttctgaagattcctggtgtatagggatgaagatcttgatagaaggtttcttgtaaaatgtttgcttgataggatgtttcagctcgggcctcgatccccttttgctgttgtggagatagttgggatgcgcggagaagcggctaaagttggacatacggggaattgaattgccagaggctgcagatacagaagtccgaatcttgatctttttgttcattcaaaacacggatggatacaacaagtaggcaatccttccattcttttggaagttgtagcaactgttcgctagactatgttgatgcaacctcgttgtatgagttatcctgtagaactgcaccgtgttgtgccataggtattctgaagctgtaaaaaaaacgacgggcatttcttcttccttgaaaagaagaaatataaaggcagaggcgcagagccctttcttctcctaaaaaagacgacccgctgcccggcgctagctcgtgc

SEQ ID NO: 8090 - DNA, 3130 bp, Zea mays
  misc_feature (61)..(61): n is a, c, g, or t
aaatttgcttgtaagctgtaagttttcgtggcaagtcaaactgtaacacagacaatatttntacgatggttctctgttattgttctcgcggaaggtgtttcaaatttgcatgagaatctgccgatctgattttgttcgggggtgatcgtgaacatggcaggtctatatatagcactaaaaatagctgatggacgtcgaaaggcaaaggcgtgtgatcttagagcatctcagtgagatggttttggaatttggatcggagcttcatagattttaagggcgtgttggcatgactttaaagcaaaactcttagtacaagttagtcagagtctgtcaaacagcataactctagagttcaaactttatagagttatagagatgaagtacaagtatctcttttaccgctccgaaatttaaaaaattaatccagatatggagtttgaagttatttagccgtctctgctactctcgttataaaaaaacgatctaaactatgcagtggggctgattttaaagtagagttgctctagggtagaataaaatcatactaaacacgtcctaagttcagtatgttaacgtttagatttgatttttcctttttttggtttttggattcgaggactccaaaacttattcttggttttcttgttgaacctttttttctgctaaaagatttcaattacaaaccagtttccccaaacatgtctaatagttcactcatataatcacctaaaatataggtacgagaatgagtaagctcctgaaaggagctcaaccaaacaagactcttcacataaagagagaaaaaagaaacgtgaacagcagctgccctatgcgaggtcgcgcacactgcacacacacgctgcaaagaggccgaggggccggcgatggataaagggtttcgcgccaataatgatgtgccaacccctgccacgtacatgccaaattagcgcatctgagcgagtgagatctcgacgttatttatattggcgccgagacatgtaacatccgcgttaatgatgatgacgccgccgagataaaggtctattttttgaatttaaactacaaaaatgtttcgaaaaaagattaaaaagcaaaaaagacggctagtgcagctaggctccgggcaggccctggcgaagtaccaccagccggccacgctgctcctgcaggcgtacaccattaagtatgagaaggagctgatcagcaggtggcccggcccgccggcaaagtgaaatggtgttgccgcgattttttgttccggtagggaccaggatgcatcatttcttgtaaaactttacatcttgatgcgccttcgcatgaatacatatacgtggttgcgagaactgggaaatttccaggaattcgaggaaagaagtcacattgggcaaaaatgctttgtgatgctgttgttgagaaatagcgagattaatctcgagaaagcaagcaccaagcagacgtgtggatttgctatgcgcaggcgacgacttgaccatcaagcgcaacgccggtcaaagcgacggcagacagaccaatcgactctcatcgcgctcgcgttcgggtcgcgtacgacagcggcacaacaacgcctgtatggctggagctggaccacagaaagagaacaatgaagatgccaaatcgctggagctgtcgagcccccacggacaacgaatccctcgagtacgcagcagcagcttcgcagctccatccagttccacggagggcactcgagagatcatgtgaaatttcacccaagtggcgtttgtcgccttcacgcgcggctcaccttttccatggaatgtcggtcccacagcagctgtactcacatcaactcgaaaccaaattatagagacaagtcggtctttaatacaagggccgcactagcacccagggcaaaaatagcacatgccgggggggttcttatttcactttgagcttggcctcaaaatgttcagtgtctccacccacccttcatcatccacatgtactagcagctcggcttgtaaacggagcaggacccagggttactatagagagagggagggagcagtatgctttagacgctgcagcaccatgtcctgagaaaataatgcagcaaaaacaaagcaatatatggaatgggagacgctggcaaaaaggtgttgggttcgtctgagaccgagatctgtggcagatgcatcagccagtccagtccacccgaaggccaacgacgtcgtcttcattagccggtcaagctgtgagtgcagtaggtcagtacctcctcctctttggtctgtcatttgtgtcactgtctcgccacccttgatgaccgccacggcggtgcctgtacccgtcctcttgttcccctcgtgccctgtcgtgccccatcctgttcctgaagccgccgttgtgctctcgtggaccagcacctccttcagcaaactccatgtcatcctccgtgcggtaggggagcatctcgtcttcgtcactcacccgtgaatgaagatatggtctccgctccctatacttccttctgcccacaagttcctctactgtatggaactcagctaggtgggagggatgtagcggtggctcgaagcctgaggcatcaccttccatggcgcacctcctgtcatttctttgcatggcacccctctcgtcatggcttccgttgtgatggcggtgaggcatgtatgttctgtcagttcgcattaccggcggtggtgatctgcgcatcgcttcaggtgatcgtccacgatggaaatgcacatggccaacccttctctgtgcagcaggcgaatgactcctgtctctgtctctgtggatgaacccatgatcaccttgaccacggtgtctatgggaatacggcataaaaaacctgtcgtccatcatgctatctgggagatcttctatttgtccacgggccggcagcctatactctggaatctctcttccgtagaattcgtcaatgtccgtatctctcatgaggcagccatgtggtggtgaatgccgcctcctatgtggacctcgggtgtgcccaggttcatcttcaaatgagtgcctgttgccaccaatagattcatcagcaaactcattgcgcattcttggacctcggaagttcctcagatggccacgggatccagcaccccgccaa

SEQ ID NO: 8091 - DNA, 1991 bp, Zea mays
tgccgcttgagtaccacagatctccagaagtcatcagctttgccaaaatctgcttctcctaaaatgcaacctactaagcaacctcctaagactttagatagccgtcttgggaagactagaagcccagatataaagtcagagatgtctcaaaatggtatgcaagctgggagctgtagtgagaaccatgcaaaacttgctgctttgaagacagagcatcagaatgaaagtgaagaggtcggtagacactctgatttgcacccaagagactctgtcctgggtgaagactcagaacttgatggtgcttcaagcagtcaacagcatagtgaatatagcaagaagacagcttctgaaaagtcagaacgtgacaaatccaaacctgactcttgtaacacatctgttcagaatgaaaaagatggacaacttggggcaaatttgagagaactggggtatgcttatgtgaacaggtatgtttcgtgccatctgtttcctttgtgggatactacagtaatcatgactcaaggtccctttgtgtatggtgcctaggtgtgcatggttttatgtttggcttgaactacaactgggggccctcctgtgctccctgtggcattttttacaggaatgaaagatgggagaggttcatggagtctgagagagaaaagagcaatggagaatgccatggtggcagacatgcatctgacgttatgaacaaacgaatgacaaaccaccgtggtggttggcggggtgctggatcccgtggccatctgaggaacttccgaggtccaagaatgcgcaatgagtttgctgatgaatctattggtggcaacaggcactcatttgaagatgaacctgggcacacccgaggtccacataggaggcggcattcaccaccacatggctgcctcatgagagatacggacattgacgaattctacggaagagagattccagagtataggctgccggcccgtggacaaatagaagatctcccagatagcatgatggacgacaggttttttatgccgtattcccatagacaccgtggccaaggtgatcatgggttcatccacagagacagagacaggagtcattcgcctgctgcacagagaagggttggccatgtgcatttccatcgtggacgatcacctgaagcgatgcgcagatcaccaccgccggtaatgcgaactgacagaacatacatgcctcaccgccatcacaacggaagccatgacgagaggggtgccatgcaaagaaatgacaggaggtgcgccatggaaggtgatgcctcaggcttcgagccaccgctacatccctcccacctagctgagttccatacagtagaggaacttgtgggcagaaggaagtatagggagcggagaccatatcttcattcaacggtgagtgacgaagacgagatgctcccctaccgcacggaggatgacatggagtttgctgaaggaggtgctggtccacgagagcacaacggcggcttcaggaacaggatggggcacaacagggcacgaggggaacaagaggacgggtacaggcaccgccgtggcggtcatcaagggtggcgagacagtgacacaaatgacagaccaaagaggaggaggtactgacctactgcactcacagcttgaccggctaatgaagacgacgtcgttggcctttgggtggactggactggctgatgcatctgccacagatctcggtctcagacgaacccaacacctttttgccagcgtctcccattccaatatattgctttgtttttgctgcattattttctcaggacatggtgctgcagcgtctaaagcatactgctccctccctctctctatagtaaccctgggtcctgctccgtttacaagccgagctgctagtacatgtggatgatgaatggtgaggtggagacactgaacattttgaggccaagctcatagtgaaataagaacccccccggcatgtgctatttttgcgctgggtgctagtgc

SEQ ID NO: 8092 - DNA, 2268 bp, Zea mays
gccgtccggactctcctctcccctccccacccgctcgccattgcgcgcgcatataaatcccacacccccttcgcggccgccccggcccacccgcccgcccacccgagcgccgcgccgcacgcacgtccctccggcctccggtcggtgcggcggccctggatctgggctgatcggtcgcgggggaggatcgcgatctcggctcgggggtgcccgccggaatggaggtcttcggccccgtcacgcccggacaggtgtcgtttttgctaggcctattccctgtcctcatcgcgtggatctactctgaagtccttgaatacaggagatctttgtctcatggcaaaatccattcagacgccaacggaaccatcaaggaggatgacaagtcggtattacttgaaggagggcagttgaaatcaccatctacaaagttcaggaatctgtctaccaaagcaaatttgttacggtttataactatggacgagtcttttctgcttgaaaaccgtgctgtactgagagccatggctgaatttggcgttgttctggtttatttttacatttgtgaccggacaaacatatttccagaaagcaagaagagctacaaccgtgatctgttcctgtttctgtacattcttctcatcatagcatcagcgcttacttcacttaagaagcatcatgaaaaatcagcattttcagggaagtccatactctatcttaatcgccaccagactgaggaatggaaagggtggatgcaggtattatttctgatgtaccactattttgctgcttcggagatatacaatgcaatccgtgtgttcattgcttgctatgtctggatgactggatttgggaatttctcgtattactatatcaagaaagattttagtattgcaagatttgctcagatgatgtggggactaaatttctttgtggttttctgttgcgttgtccttgacaatgatatcatgctctattatatctgcccaatgcacacactatttactgttatggtatatggatcacttggtctgtttaacaaatacaatgagataccatcagtcatggctattaagattgcctgctgcttcttgtctgtaattttgatatgggaaattccgggggtattcgaactattgtgggccccctttacgtttctactaggttataaagatccatcaccatccaaggcacacttacccctgctacatgagtggcatttccgatctggcctcgatcgatacatatggattattggaatgatttatgcttacttccatcctaatgttgaaagatggatggagaagctggaagaatctgagactaaggttagattatcaatcaagggaaccattgttactctttcattgatgactggctttctgtggtatgaatacatatacaagctagacaaagttacatacaacaagtaccatccctacacgtcatggatccctataactgtttatatctgcctgcgcaattgctcccagcagttgaggagtgcctctttggtccttttcgcatggcttggcaagattacactagagacttatatctctcagatccatatttggcttaggtctagcatgccaaatggacagccaaaatggcttctttgtttcataccagaatatcctatgcttaacttcatgcttactacggcgatctatcttcttctatcataccgtgtgtttgagatcacgaatgtcttgaagtcggcttttatccccagtagggataatagccgtctgtaccaaaatttcgttgctgggatcgccatctctgtgtgcctgtatctctgctcacttattcttctgaagattcctgttgtatagcttattgcatctgcagggatgaacatacaccaagcaatctcgatagtagaaggtttcttgtaaagtgtttgcttgataggatgtttccagctctggcctggattcccttttgcttggtaggatttgaacatatacggggaactgagagattcaattgccagaggctgcatatacagaaatccgattttttgatctctttgttggttcaaaacactctgctgtatgtatacaacaagtaggcaatcagcgcattcttttggaagctgtagcaactactactcgccagccgatgttgatgcaacctcgtgtaagagttatcctgtagaaccgcaccgtgtcgtgttgtaccataggtagtttggtgctgtacaaaaaacgacgggcttttcctcttccttgaaaagaagaatatataaaggcagaggtgcagggccct

SEQ ID NO: 8093 - DNA, 1287 bp, Zea mays
cctcgaggccggccgggacacactatttactcttatggtatatggatcacttggtctgtttaacaaatacaatgaggtaccatcaatcatggctattaagattgcttgctgcttcttgtctgtaattttgatatgggaaatccctggggtatttgaatcattgtgggccccctttacgtttctgctaggctataaagatccatcgccatccaaggcacacttacccctgctacatgagtggcatttccgatctggcctcgatcgatacatatggattattggaatgatttatgcttacttccatcctaatgttgaaagatggatggagaagctggaagaatctgagactaaggttagattatcaatcaagggaaccattgtcactctttcattgacggttggctttctgtggtatgaatatatgggccacctcgagcccgcccggtacaacagtaccatccctacacctcatggatccctataactgtttatatctgcctgcgcaattgctcccagcagttgaggagtgcctctttggtccttttcgcatggcttggcaagattacactagagacttatatctctcagatccatatttggcttaggtctagcatgccaaatggacagccaaaatggcttctttgtttcataccagattatcctatgcttaacttcatgcttactacggcgatctatcttcttctatcataccgtgtgtttgagatcacgaatgtcttgaagtcggcttttatccccagtagggataatagccgtctgtaccaaaatttcgttgctgggatcgccatctcagtgtgcctgtatctctgctcacttattcttctgaagattcctgttgtatagggatgaacatacaccaagcaatcttgatagtagaaggtttcttgtaaagtgtttgcttgataggatgtttccagctctggcctggattcccttttgcttggtaggattcgaacatatacggggaactgagagattcaattgccagaggctgcatatacagaaatccgatttttgatctctttgttggttcaaaacactctgctgtatgtatacaacaagtaggcaatcagcgcattccttttggaagctgtagcaactactactcgccagccgatgttgatgccacctcgtgtaagagttatcctgtagaaccgcaccgtgtcgtggtgtaccataagtagtttggtgctgtacaaaaacgacgggctttttctcttccttgaaaaaagaatatataagggagaggtgcagggccctttcttctcc

SEQ ID NO: 8094 - DNA, 1496 bp, Zea mays
  misc_feature (155)..(155): n is a, c, g, or t
tgtttttctcgtctaccagataatcaagaaagattttagtattgcaagatttgctcagatgatgcggaggttaaatttctttgtggcattctgttgcattgggcatatataatagagcatgagatctattgactcttatggtatatggggatcancttggtctgtttaacacatacaatgaggtaccatcagtcatggctattaagattgcctgctgcttcttgtctgtaattttgatatgggaaatcccgggggtattcgaactattgtgggccccctttacgtttctgctaggttataaagatccatcaccatccaaggcacacttacccctgctacatgaatggcatttccgatctggcctcgatcgatacatatggattattggaatgatttatgcttacttccatcctaatgttgaaagatggatggagaagctggaagaatctgagactaaggttagattatcaatcaagggaaccattgttactctttcattgatgactggctttctgtggtatgaatacatatacaagctagacaaagttacatacaacaagtaccatccctacacctcatggatccctataagggggtgtagctcatactgtttacatctgcctgcgcaattgctcccagcagttgaggagtgcctctttggtccttttcgcatggcttggcaagattacactagagacttatatctctcagatccatatttggcttaggtctagcatgccaaatggacagccaaaatggcttctttgtttcataccagattatcctatgcttaacttcatgcttactacggcgatctatcttcttctatcataccgtgtgtttgagatcacgaatgtcttgaagtcggcttttatccccagtagggataatagccgtctgtaccaaaatttcgttgctgggatcgccatctcagtgtgcctgtatctctgctcacttattcttctgaagattcctgttgtatagggatgaacatacaccaagcaatcttgatagtagaaggtttcttgtaaagtgtttgcttgataggatgtttccagctctggcctggattcccttttgcttggtaggattcgaacatatacggggaactgagagattcaattgccagaggctgcatatacagaaatccgatttttgatctctttgttggttcaaaacactctgctgtatgtatacaacaagtaggcaatcagcgcattcttttggaagctgtaccaactactactcgccagcctctcgtgtaagagttatcctgtagaaccgcaccgtgtcgtgttgtaccataggtagtttggtgctgtacaaaaaacgacgggcttttcctcttccttgaaaagaagaatatataaaggcagaggtgcagggccctttcttctcccattataaattatttatatcttacttctccggccggcccaaaggaaaaaaaaaaaaaaaaaaaaaaaaaaaaaggaccttggggtggtaccactgct

SEQ ID NO: 8095 - DNA, 3063 bp, Zea mays
ccggtgctctcctacgctggtgttagctgcccatttggtgaactttggctgagcgacgcttaaccacctcgcgcgccaaaacttgcgcgcacgcaggcaggcacgctgagggcgaagggagctccacccaccgcacccaccgccttgacccctctctcctaaacccaagctaaccccctcgtatcctccttggttccccacatccatggccgcggcaacttaaccgattccaactaacaacaagaaaaaaaacccagagcggggccgcgggcagccaatctcccctcaccaacctcgagccgcttttgactgctccagtatggagctataagaatcattaccgccggcagggtcatcagagtccaagccaacgccgatcgagagcccgcatatctatatctcgctcgccgcggcaggcagagaggtggggtgccggccggcggcgaggagaaggtggaggagcacgtacgtgagttgggcgcggcgatgtcgcggttcgtcgacaagctgccattctttgaccggaggtcgtcgctgatggaggaggccggggacattccgcggagcggcctcctgcacatgcaccaccaccagccgcaccacagcggcctgctcatgcagccgcagccgtcgccgccggcgaagcagtcgtcgttcacgctcgcgcagctgctgaagcgcgtcaacgaggcgcgcagcgacgcctcgtcgcccacgtcctcgcccacgcactcgcactacaccatcgagctgggcggctccgtgccggggtccaccggcagcgacctgagcgagcgcataggcggcggcggcggcgacgggccgctcctgccgttcgtgctcaagttcacggacctcacgtacagcgtcaagcagcggaagaggggaccgtgcctgccggtgctgccgttccgccgcggggccggggagccggccgagcccgaggtgtcccggatgaaaacgctgctggacaacatctccggcgaggcaagggagggcgagatcatggcggtgctcggcgccagcggctccggcaagagcacgctcatcgacgcgctcgccaaccgcatcgtcaaggagagcctccgcggctccgtcacgctcaacggcgagtcgctcgacagcaacctgctcaaggtcatctccgcgtacgtcatgcaggacgacctcctgtacccgatgctcaccgtggaggagacgctcatgttcgccgccgagttccgcttgccccgctctctgccaaccaaggagaagaagaagcgcgtgcaggcgctcatcgaccagctgggcctgcgcaacgcggccaacaccatcatcggcgacgagggccaccgtggcgtgtccggcggggagcgccgccgggtgtccatcggcgtggacatcatccacgacccaatcgtcctgttccttgacgagcccacctccgggctcgactccaccagcgcgttcatggtggtcaaggtgctgcagcgcatcgcgcagagcggcagcgtggtggtcatgtccatccaccagccgagctaccgcatcctcggcctcctcgaccgcctcctgttcctctcccgcggccagacggtgtactacggcccgccaggcgcgctgccgtccttcttcaacgacttcggcaagcccatccctggcaacgagaacccgacggagttcgcgctcgacctcatcagggagctggagaccatgccggacggggccacggacctcgtggagcacaacaagaaatggcagatgcgcacggcccccaaggcgaagcaccacgacgggcacggcgagaagccgtcgctgtccctgaaggaggccatcagcgccagcatctcccgcgggaagctcgtgtccggcgcgaccgacggatccgtgtcggtgcactcggccggggagtcggcgcccgcagccgcggtgtccaagttcgcgaacccgttctgggtggagatgggcgtgctcacccggcgcgcgttcctcaacacgaagcgcacgccggagatcttcatcatccgcctagcggccgtgatggtgacggggttcatcctggcgaccatcttctggcgcctggacgactcccccaagggagtccaggagcgcctgggcttcttcgccatcgccatgtccaccatgttctacacctgctccgactcgctgcccgtgttcctcaacgagcgctacatcttcctcagggagacggcctacaacgcgtaccggaggtcctcgtacgtgctctcccacaccatcgtcggcttcccgtcgctgatcgtgctctccttcgcgttcgcgctcacgacgttcttcgccgtgggcctggccggcggcgccgacgggttcttcttcttcgtggccatcgtgctggcctccttctgggcggggtccgggttcgcgacgttcctctccggcgtggtgacgaacgtgatgctgggcttccccgtggtggtgtcgacgctggcctacttcctcctgttcagcggcttcttcatcaaccgggaccgcatcccgcgctactggctctggttccactacctgtcgctggtgaagtatccgtacgaggcagtgatgcagaacgagttcagcgacccgacgcggtgcttcgtgcggggcgtgcagatgttcgacaacacgccgctggcggtgctgccggcggtgctcaaggtgcgggtgctgcgcgccatgagccagtcgctgggcgtggacatcggcacggccacgtgcatcacgacggggccggacttcctggcgcagcaggccgtgacggacctcaccaagtgggactgcctctggatcaccgtcgcctgggggttcctcttccgcatcctcttctacatttcgctgctgctcgggagcagaaacaagaggaggtgagcggttcctcgtcctgctggtgcgatcggtatgcacggggctggttgtatgttgctccctctgcctttattttcttcctcgatcgagctttttatcgcgtgtaaatttgcttgtaagctgtaagttttcgtggcaagtcaaactgtaacacagacaatatttgtacgatggttctctgttattgttccaaaaaaaaaaaaaaaa

SEQ ID NO: 8096 - DNA, 926 bp, Zea mays
  misc_feature (39)..(39): n is a, c, g, or t
  misc_feature (855)..(912): n is a, c, g, or t
gtgtacggcgtcgactggccgctatccgggcagacaagnatcacgctgacgccggcgctggagtcccccgtcgggccgctgatcaacgcggcggagctcatgatggtcgtcccgctcggtgggaggacgcatcccagagacgtaatcggcatgcaggagctggccagaggattcacgaacccgccgtcggactggagaggtgatccatgcttgccccaggggaactcgtggactggtgtcacctgcaaccaagatccactggcaagagtaactgggctcaacctcacaaatttcagagttggaggatcgatatctaacaacattgccaatctgactgcaatttccagcatttggcttgtcgggaacaatttgaccggcccgattccagatctgaaccacctcctgcatgtagtctctttgcacctggaggacaacggactgacaggcccgctccctgaatcgctcggaaaccttacaagacttgaggaactgtccgtgcagaacaacagcctacaaggaacaattccaagcagcatcaggaacagagcggcggtggacccaaggtttaggttccagtacacacctgggaacaaccttagctaacaagtgcattacaggaaggcaaaaatatctgactgctgttccttacccaatttcgggtgcttcggaccattttccttcccttttttgaatcacgattttttgttgtacttcggaatgtatacttatctcttcccctgtaaagatgcatttttgtcatagaaaaaaaacgaggactatattttattgaacgagaaaacgagaaggcttattgctttagacgaattttcataagagcaatgcgtgtacaacccnnnnnnnnnnnnnnnnnnnnnnnnnnnnnnnnnnnnnnnnnnnnnnnnnnnnnnnnnnaaaaaaaaaaaaaa

SEQ ID NO: 8097 - DNA, 1984 bp, Zea mays
gtgcctgctgactgcctccctttggccgccttgcctgccacgcccacgcgcaatcagaagcaggccaccaccccaccctcccaaacggctataattacgcgggggccctcgaggccggccggggcatcgcatagcagcaattccctcccccccgctccggcccctcgcaccgtttccctctccccgccgctcctccgaagccaccaccgcgccccgccccgcgagggcacgaaagaggaggaacgcggccaccggcggcgagggttcgggctcttgctcccgacggtttgcaacccgggagggagccgaccgtgcgcgcgcattgggcccgcgcgggggaagcggcaggcgcgtgccgtttttatttagcccgctccgctccgcgcccggcggctgcggggtgtggtgctcctgctgattttcttctcggcgccatggaggccggctactgcaaccgcaagaagaccgacggcatctgcgacggcgtctgcgacagcgagcttggttcaaagtcagtcctgagcatgtcgaggctgaagtgcgcgctgcggacattcgatctgagggttctcttgattctgctgatcggtgtgccaatcctgctcttcgccatctacgtgcacggccagaaggtgacctacttcctccggccgatctgggagaagcccccaaagcccttcaaagtactcccccactactaccacgagaacgtctcgatggccaacctctgcaagctgcacggatggagagtcagggagaccccgcgccgcgtcttcgacgccgtgctcttcagcaacgagctcgacatccttgacatccgctggcacgagctgagcccctacgtgtcggagttcgtgctgctggagtccaactcgaccttcaccggcataaggaaggacctccacttcagggagaaccggcagcggttcggcttcgccgagtcgcggctgacctacggcaccataggcgggaggttcgtgaagggagagaacccgttcgtggaggagtcgtaccagagggtcgccctcgaccagctgatcaagatcgcgggcatcgcggacgacgacctgctgatcatgtcggacgtggacgagatcccgagcgggcacaccgtcaacctcctgagatggtgcgacgacgtccccgaggtactccacctccagctccggaactacctctactcgttccagttcctgctcgacgacaggagctggcgggcctcggtgcacaggtacagggccgggaggacgaggtacgcgcacttccggcagacggacgacctcctggccgattccgggtggcactgcagcttctgcttccgccgcatagacgacttcgtcttcaagatgaaggcctacagccacgtggaccggatcaggttcgggtacttcctgaacccgaggaggatccagcacgtgatctgcgagggggccgatctcttcgacatgctccccgaggagtacacgttccaggagatcatcgccaagctggggcctatcccgagcacgttctccgctgtccatctccccgcctatctgctggagcacaacgagcggtacaggtaccttctcccgggcaactgcgttagagagagtggctagtagctaaggctgtaaggcagctagctgtgttgctgtctgcatcgccatggcctgaggcgcaccgacgtcgctcgcggatgcatgcatgcgtggaggagcgccctgccgttgccggggttgttgtatctggatatacgactggctgggctgacttatatatttagatgatgaatgaatggtcgcttgaccgctgctggttcagttcgtaaaaaaaaaaaaaaaattttgtaccatggaaggccttcacagcagcatagcatgcttggtcgctgcttccttgttgttttgcaggcaggcctgggtttttattcattgcttccatgattgatgtatgtatgaatgaactcaaactatttgtaggtgtcataccgagcgacattcat

SEQ ID NO: 8098 - DNA, 1882 bp, Zea mays
atcgcataccagcaattccctccccccgctccggcccctcgcaccgtttccctttccccgccgctcctccgaagccaccaccgtgccccgccccgcgagggcacgaaagaggaggaacgcggccaccggcggcgagggttcgggctccgctcccgacgtttgcaacccgggagggagccaaccgtgcgcgcgcattgggcccgcgcgggggaagcggcaggcgcgtgccgtttttatttagcccgctcagctccgctccgcgccgcgcccggcggctgcgggtgtggtgctcctgctgattttcttctcggcgccatggaggccggctactgcaaccgcaagaagaccgacggcatctgcgacggcgtctgcgacagcgagcttggttcaaagtcagtcctgagcatgtcgaggctcaagtgcgcgctgcggacattcgatctgagggttctcttgattctgctgatcggtgtgccaatcctgctcttcgccatctacgtgcacggccagaaggtgacctacttcctccggccgatctgggagaagcccccgaagcccttcaaagtactcccccactactaccacgagaacgtctcgatggccaacctctgcaagctgcacggatggagagtcagggagaccccgcgccgcgtcttcgacgccgtgctcttcagcaacgagctcgacatccttgacatccgctggcacgagctgagcccctacgtctcagagttcgtgctgctggagtccaactcgaccttcaccggcataaggaaggacctccacttcagggagaaccggcagcggttcggcttcgccgagtcgcggctgacctacggcaccataggcgggaggttcgtgaagggagagaacccgttcgtggaggagtcgtaccagagggtcgccctcgaccagctgatcaagatcgcgggcatcgcggacgacgacctgctgatcatgtcggacgtggacgagatcccgagcgggcacacggtcaacctcctgagatggtgcgacgacgtccccgaggtactccacctccagctccggaactacctctactcgttccagttcctgctcgacgacaggagctggcgggcctcggtgcacaggtacagggccgggaggacgaggtacgcgcacttccggcagacggacgacctcctggccgattccgggtggcactgcagcttctgcttccgccgcatagaggacttcgtcttcaagatgaaggcctacagccacgtggaccggatcaggttcaggtacttcctgaacccgaggaggatccagcacgtgatctgcgagggggccgatctcttcgacatgctccccgaggagtacacgttccaggagatcatcgccaagctggggcctatcccgagcacgttctccgctgtccatctccccgcctatctgctggagcacaacgagcggtacaggtaccttctcccgggcaactgcgttagagagagtggctagtagctaaggctgtaaggcagctagctgtgttgctgtctgcatcgccatggcctgaggcgcaccgacgtcgctcgcggatgcatgcatgcgtggaggagcgccctgccgttgccggggttgttgtatctggatatacgactggctgggctgacttatatatttagatgatgaatgaatggtcgcttgaccgctgctggttcagttcgtatgagattttgtaccatggaaggccttgacagcagcagagcatgcttggtcgctgcttccttgttgttttgcagaggagctcagcagtgtgtgtacctaccgcctgggtttttattcattgcttccatgattgatgtatgtatgaatgaactcgatcaaactatttgtaggtgtcataccgagcgccattcac

SEQ ID NO: 8099 - DNA, 2723 bp, Zea mays
  misc_feature (958)..(958): n is a, c, g, or t
tcgtacctctgtaataaagaagccggctgattaaagtgaagcaaccacctcccccaccaaagaagcgagtgggacgtgatgatgttgagatgaagaaaggagaggggctctgccctaagtaatgttgccacttgcctctgatttattgaatcttgttgacttgagaaatattgttcttactccctggggtctattttgcaggtgtgattttatgaattttgcaaaaaacactgtttgcttgcagtgtgatgctaagcgtcccaaaaggcaactcctccctggagagtgggaatgccctcggtaagcgtactcataggaattctgttttgatgtctatttttctgtcctattctgttgtaagtttatacatatggcatcatatactgcactgacaccttcacttttcatcatgtttctttacatccatatttgctacatgcatagttgtgaagaaagaaattgttatcttggatcagtatattttctggcacattctgtagtaactttattaaatgaacagtgcatgttagcattcatgtttgcactgtgtgcggtgtctgttatccaacacaattatgatttatgaacaacaatagcttggactaagatttctaagaaggttctccatgacatcttatgtctctgaagaggtgatcttgaagaatatggaaaacggaaatagcacattcattacagtgattcatgaatcaatttgttatgttctgttggttccttatagcgctgattcatgtacatgaaatttcaggtgcaatttcttgaactataggcggaatatgtcatgtttccattgtgaacatgaccgtccttcagatgagtatgccaacagacaaatggaagcaaagcaatctgcactgcggaatagattagaaagacctccacgcaaatctgatatttctagtgcatggaactttgattttgaagataacgagtcagatgntgcagatgttgcggcgtttgaatatgctgattcatctaaggtgaggagggagagctcatcagcaggcagcatgtcgtatagaggtgtttccaagggctctgatgatgaggaatatagaatggctgaaacaatgactacaggacgggggaataagttctcagaaagagatagcttgccatcttcaagagatggttttaatgattttgatgatgaagatgatgacattgacagttatgaacttgacttgtcaaaaggtagtcacacaggtggagtgtcaaggatgagttattcggatcttgagagtgcttctgattcagaaggttttagtgaaattgataatagtagagagtccagatatggtaatagtaaagagtccagatatgataatggtagagagtccagaaatgataataatagagagtccaaatatgcagccaaggttgaggatgaatttgaggatcatcattccctgagatcgactcatcttgctgattcctggcaaaaaaccagaggtcggagtggttcgaatgactacagaagggcatcttttggatcagagagtgatgatgagatcaattcttatccggacgaggacattgacaaaggtcctagaaataatggaagccgtagtcagggaagtaccaacagagcttctgttaggcacaatgcacttgcctacagtgatgatgaaccattttctgatgatgtggattctggtatggctgatcggttcgggcctaggcagactaagtcttccacgaacatcaaggataacttccgtgacacaaggcgtaacttgaatggaagacgttctagtggggaccgttatggtagaacagaacggaatgagcgggaccgttatggtagaacagaacaacggaatgagcgggaccgctatggtagaacagaacggaatgagcggttcaacaattttgacatgcaccgtggcggttcagtcttggataagggccgtggggctaggggtaaccagttagatagtggttcaagaggtttacaaagaaacgcaagaagaaattgggatagaagtggtggctttgacggcaggcacaagggtgtttaaataataatagcaagagtggtatcttaagtaccaaatggcaaccagtgatatccttcatgtgaccttatccaatgccgagggtatttcaatccagctgagcatggctcttatgattccaccatgtgtccatgaccactcttccataatgctacttcaccctgcgacagaggctatggcgattcctctccatctgcacttccatttcaagcattgcacctctctgtctgcttgtttgttacatgtcattgcatcagtcagagcggtcgaacctgaagagctctggaactgggttcgttatttggttcactcatgccgcacaggtacaattttagactactagttagtctccatattgttttgcagagatgcatcaacaggattgtacctcgaattatgagagcaataaaactatacacttcaaacttaatgtgataccaaatgtaacgatgttgaagcgttttggtcgggttatagattctcgttgcaatattgatctagattcttttaaaaaaatgtttcttagatgaaccagaattacttttagaactgtttgtagctcgcttgattctcaaacatctctctcttttgaccgggaagactggggaagcccatacatcggcacaaattttatagaatttaaatgaaagaaaggtaaggaagggtctttgcatcttcctcgacggg

SEQ ID NO: 8100 - DNA, 1607 bp, Zea mays
gatccactgtcccctcccctcccctccggtgctcgttcttgccaccttaacactcaaaaagcatcggcaagaatgggatggcatctcgttcccaacgatttcatgctccttttttttttaatctgatttagcggggctctggcgaacgatgtaaaatctatttgttttggtgctccaattcgatggttgcatagaaaattttatgccctagttaaacggtaatctgatgatcagatctcacgttatttggcagaggcaggcaggtaacaacatccttacctctaaaatcgaaaaaaagatcgagtcgatcgaccttgcaaaaaaggacaaatagcataaacatttaaatacaatatactttctaattgcatccacaataatatattttaaatcaaatatttaaaaatattcagttttgaattgtggggccccccaaaaagaaggatcccctccaaaaataagcgtatgctgctatgtgcagagcacacacggtattctttagtaaaaggcgaaagaatagttcgctctgtgcgcactgcgcagctgcgtgcttcaactaggtagccttcctgctccttttattcatctcactcgatgctcacctcgcgcatgcaagccgtatggtactaatccctccttgcgaccatctcacgctctacgcgctctgccgcgctagcaaacttgggccaggcccactaaccattgccaacccactactggaccaggccgggcctgatgcatcgaagcgctttacagcgcgagcgattgcgagcggaggttttcctggaccggccacatctgccacctagaaaaaaattctcgccatcacgagcagtcgagcaccaccctctgaccggtgaccgctgtgaagtcagtcagcttcagcaccacgagcacgatggccctcgcgctcgccacgaccccactcgcgcatctcgcccttgccccgccctcgatcttcggctcccagtcctcgctgctgctgctcccgcgccgcgcgtcgcccgcccccgtctccctctcccaccgccgcatcatcgcggccgtcgcgaccaaggaacccgagctcggcggcggcggatcgggggccggcgacggtgccggagggagcggcggcggcagcgacccgaggggaggagggcaggaaggagacggggaggaagagatgatggggcagggcctgcccatgtcgctgaaactcaccctcgcctacgccgcgctcggcggagctggtcctgtctacctcgaccccggagtgatccgttgcaagcgcgactatgattctctttacgaactgggatcagatattaatcactaccagcccccaaaaattgttcctgtgtactccgagctaccatgatgtgtgttgttgtcttatcccagcttcaatcagaatcatatccaactacctgaataccttaggcagtggtggttactcaccagtcaccagtgttgcttcatgaactcgaggtcttccgcgtactgcactgctgctacctcagttgacttacataattcatgtgcacaattaaatcttgttgccccttcataatcacatgaatcagtttaatggcatcgcccattggtttcaattcactaatagaaca

SEQ ID NO: 8101 - DNA, 1002 bp, Zea mays
  misc_feature (970)..(970): n is a, c, g, or t
  misc_feature (978)..(978): n is a, c, g, or t
aagaaaaaaattctcgccatcacgagcaccaccctctgaccggtgaccgctgtgaagtcagtcagcttcagcaccacgagcaggatggccctcgcgctcgccacgaccccactcgcgcatctcgcccttgccccgccctcgatcttcggctcccaatcctcgctgctgctgctcccgcgccgcgcgtcgcccgcccccgtctccctctctcaccgccgcatcatcgcggccgtcgcgaccaaggaacccgagctcggcggcggcggatcgggggccggcgacggtgccggagggagcggcggcggcagcgacccgaggggaggagggcaggaaggagacggggaggaagagaagatggggcagggcctgtccatgtcgcagaaactcaccctcgcctacgccgcgctcgtcggagctggtggtgtaatgggatatatgaagagtggaagccagaaatccttggctgcaggaggcatatcagccctggtcctgtacgtcgtccacactcaactcccagtgagacctgtcctcgcatcatcgatcggtttaggtatatcggccgcgctactgtcagtgatggggtcgcgcttcaagaagtccgggaaggtattccctgccggcgtcgtgtcccttgtatccctggttatggtcggaggctacttccacgggatcttgcgtagctcgcacgcgtgatgcagcctgtggtcttttctgttccgtaatgcaatttggctccccctttgaactgtttctctgtttcacttctcggtggatgttttgtatccgttctcaactttagttcatcttttgtgacagtgggcaataataaccaataagcatgtgagagctgatagaggtgaagtttaaaaaaaaaaaaaaaaaaaaaaaaaaaacaaaaaaaaaaaaaaaaaaaaaaaaaaaaactgagtacctcggtgcctgcgtaccacgtctagaagggcgagagttnctgcatgnatatcctatcatcactggcgtgcc

SEQ ID NO: 8102 - DNA, 4316 bp, Zea mays
gtatattccaactttaaacataccgagtaatatatagtatgcatatccaatatatgaatttatgtaaagattacttaggtctgtttgaaaacactcagtttctaaaaaactgatttatagaaattgagttggtttcaaatatatcagtttatgacttattttatagaaattagattactaatttcttaaaaataaaaaattggtctctcctaactaaaagataaaaactagttccttaaaaactgagttgcttccaaaatagttcttaattagtatttaaacactttcggacggattaataccgagaaaatacccatcccgtatttatcgcactctcggacactgctagctcatcagtaaaatacgtacgttatcccaattcactatcatttgcatgactaaccaaacccattctgcataaccacgtaattaagcagatgagtacgtccgtacacgtataaatacataagaacactataatctaccagctcgggtgggccctagctaacgagcacttgggtcgccaagctcaggcaggcaccaccaagagagcagaccggctcgctttcactttattttggcttttggtggtgtataaatacggggcaccagcagaggggccttcatctcgcctcctcgcgtccgatcgatccccatccccttccattgcgtgctggagccctcctccgcgcgctttctctggtgacgccgtccatgtctcctcctctcttcctgcacactgattgaggtcttcattcttctctctctctctctcctactgttagctacctagggtttgccatggccatcaccttttttgagccatcacactttactctctctctcttcacccatgacacatccatccagccacccccactagctctctagctagccatcctcctcatcaccctctccgcctctgtctcttgctgtcttgcggcactgttcttagctgcaggtagctccgtccagctcgacggttctctcttagcagctaaggaaggcgacataaattataaaaggcgccacttgagggcagggccaaggaaagttgtggtttccaactcctcacctcacacactctcttcttctctccttcgttctccctcgcaaagtcagggtcactgaaagtagcggaagagcccaagtagttcttcgccaccggtaccgcatcgatcatcatggtgttctcctcgctcccgatcttcctagaccctcccaattggggccaggtaattggtttatccaatcatatactcttcgttccttacttttagtttcgtcatgcacaagcatgacgaactggtttctctctccgtttcctaattattattttagagtgaatccggcctttttccaatacgaacttcaaatctctggttgattgatcgctgtgattcgcaagtttgtttactacctatgctcatgccctggttgagcatagacacaaaggaagggcatcattataggcatgttcttgaatataccgtgctttgaattccagcctttattaattgattcgttatacatacagatgcagatgcagatgcagcagcagtcaccgctccagtgtctcctcggcagcggcggtggcagcgaccaccaccacctcatgcctcctccgtccggcctggcgccgctgccggggggtcctgctgacacagcggcgagcggtccggcgggaggcggctcgtccacctcggcctcagtgcaagccgcggcgggagcgggggcaggggcgcagcctcgccccgtggtgtcgatggcggagcgcgcccggctcgcgcgcgtgccgctgccggagcccggcacgctccgatgcccgcgctgtgactcgaccaacaccaagttctgctacttcaataactactcgctgtcgcagccgcgccacttctgcaaggcgtgccgccgctactggacccgtggcggcgcgctccgcaacgtgcccgtcggcggcgggtgcaggcgcaacaccaagcgctccagcaagaagtcgtcccgcggcggcggcgcgggcgccacggcggcaacctcctcgtcctcgaccacctccacctccaccacggccactaccaccaccaccacgagcgcggccatggcggcggccgaggccatcgccggcatgcaggcgcagctgccccacctcggcctcccgcccgcagcggccgccgcggcgcttgaggcctcgctggagggctaccaccactacctcccgctccagatgcagccgcagttcctgcagcaggctggcctgcacggctaccatttcgccgacgacggcaccggcgtcctcgcagctgacgggttcccgaggggcgtcgtcgcctcggggctgctcgcgcagctcgcggcggtgaagatggaggagcacggcagcaacggcggaggtgccatcgcggcgcatcatgagcagcagtcctactggcccggcagcaccggcggtggcggtgggtggccggtggagttcttgtcggggttcagctcatcctcgtcggggaatgtgttgtgagttgcatgtggccgcgtccaggtccacctgggcatgcatgatggggggcatgcatgcatggatgctgatgaagctgaactagctcaccatcctcaattagttctagggtttatgtggtgtttggaacttaattggcgtcgtcttcttcaattaggctggtgatgatcttgtgttggggtaaggtttttacatgtttttttttcttatgagttttaagctggttaatgtcgtgcagttggtagttttgcatgtagtgggaagtgcatgtgttgactcatggaggttatatgtgtcaggttacttaactatactatgtttaattatatgagaacttggtgggcatagttgtactagtacaacccgtttctgaattgcagatgtgtgtttggatgttttattgttgatcgaaatgttggaaaagttatgaggtgtttggtttgatgaaccactctatccaaaatgaagtggtgcataatgggtccattcctcaaatttggtgggataactctattccacatattagtactaaacaactaactataagcaatgaggtggtgatagattaacttacttcattccacaaaccaaacaaaaaaaatgaggagtgagaagatgatggactatattattcctcaaaccaaacactccattaatgaatgagtataaatggctatgttcgcccatttaaaatttgatcgacatgatgatatcagctgagtggccatatttgatcaacatgaccatacctgactaaaatgttttgatctacatttcatatttatggaaatcaagtctcaatttgatggaatctgttcttccacctcttgaaactcatgaatccccttgagtccaatgacggaggtagcagtgaggtggacggggctcgagccccctaccgttatcgagcctatggtgtccactgaaactttccaaaatttcaaaacatacaaatataatgtaggtgtggctcatatattgtactccctccgtccataaatgtttgtcgctatggtattcgtgccagtcaaactttgttaagtttgactagctttgtagaatatattagcaacatttgaaatatgtatcttcgaataagttgagtacaaaaatagattcaaagatatatctaatgatattaattatgtactataaatattaatattttcttatataattgtggtcaaagttaaaattgattgaccattcgaaaagtgagaatgaccaacatttgtggacggagggagtagcgatttagttcagtccctcgtaatttttttatggctctgtccctgtttgagtccgataacttgtatgaggattaaagagtatttcctcgcattcaattttgaaaatttggctggtacagctacgactacatctaccatttttttatcaaacttaatcatgtcctaatttgattatatcctcatgttaaactagctcttggaacttattgggattcatggactatctctcctgagaaaatttaacatggcaactaagtaagactagattttctcactgaccagaagctagttgatgtattcattcacaattgattcagtgctatgtaggtttgcaacattgagccgaacacactcacttgtcagtgttgaggttggatactttttccttcatctaaagaaataatagctagctcatgaaacgttgagaagttaagaaagggaatttttaggtgacaaagaaattaaacttaatttcaattgtacttatgttcaacaaaaggttttattttttctatagggatattttacaaaagttcagggctggtttgctgaccagg

SEQ ID NO: 8103 - DNA, 1549 bp, Zea mays
cgggaccgacccaacccagatccattcctgtcccgtgtttaccttcacccagcggcgctgcccctgtcgtcgtcttcccgctcgcttccgagcgccgccctccccttctttccccatcgcctcccttccaccccctctcatctccgtctcccgcgccgacgacttaagtagggtttggccttagggttcaggcaagatgggtgagcgcaaagtgctgaacaagtattacccgccggacttcgacccgtcgaagatcccgcggcggcggcagcccaagaaccagcagatcaaggtgcgcatgatgctccccatgagcatccagtgcggtacctgcgggacatacatatacaagggcactaagttcaactccagaaaggaggacgtcgtcggagagacatacttgggaatacaaatatttaggttttacttcaagtgcactaaatgctctgctgagatcacattcaaaacggaccctcagaattctgactacacagtggaatcgggggctagtcgcaattttgaaccatggcgtgcacaggacgaggcagcagacaaagaaaagattaaacgagatgctgaggagatgggtgatgcaatgaaagcgttggaaaatagagcaatggattcaaagcaggatatggacatccttgcagctttggaagagatgcggtccatgaagtctagacatgctggtgtctctgttgaccagatgcttgaaattttgaagcgttcagctcacgagaaggaggaaaaagcaattgcagagcttgatgaagaagatgaggaacttataaaatcaatcactttccgaaactctggattctatgtaaagcggatagaagatgacgacgacgatgatgatgaggatttggctcctggccaatcaagtagaacaataaagatcaatgaatcttctgaatctgtgactaagccaacagatgttttaagcaaaaataacggatcagaggttgccaataaagaagggagcaagagctggatgcccaaatttattgtgaaaccgaagtctgcaagcgcagatcctcataagagacagaagatcgaatccacggctgtccaagacaccgggaaaggccaagatgatgaacaaaaaagtgaacctgcgaagcaaaccaatgttctccagtccctctgccagaactacgatagtgatgatagtgaatgaatgaggacaccgccctcttgaagccataacagtcctggttgccaatgctgtattataccagaggatgttaacacatgtagttccccaaaccactggcattgtaccatcatggcacatgatatttatcacaaatctctgattgtcaatgggccaactacaagtattggctcttacaaatatgggctatccagatagagctgcgttattggataaaatgatagttgcagaaagtcagatctgcggtttgtacatcaaacagccatacacaagcttgtttatgcagcatcactgaattaatcattgtttgtttgaagtgtgtgatatttacctgcctttgcttgtgccaattcaatgaaatgtcaaaat

SEQ ID NO: 8104 - DNA, 1154 bp, Zea mays
  misc_feature (935)..(935): n is a, c, g, or t
tagcaaaatagcactagcgtcgctcccactcccaggctcccagcagagaaaaaaaaattcccgggaaaaatacccgccaccaatcagttgaggaggtgaagcaagaaggggaggggaggacagggaaaagcgtcagcaacagcaagccggcaacaaatgatttggtgaggccgaaccatccgtgaggtgccctgtccggctgtcccttttccctcaccttctccacctgacctccctcctcgtcttcccttccggccttccctccccctcgcgcctatagatctctctcctccgttacacctcacagccaagctcacggagtcgcagtgccaccgaggcttccaagaaccacccccgcctgcctgcggagctcggccgtcccctgcgctgcggagcgggagcgggagcggcggcgacaatgtcctccaacggcaagcccaccccacagcccgcggcggccagcgccggcgccggtggcccgccgaagatgtaccagcgacccatctaccggccgcagcaggcgcccgcgaagcgccggcgcggggggcggtcgtgcccgttcagctgctgctgctgcttctgctggacgctcctcgtcgtcgtcctcctcgccgtcctggccgccgtggccgggggcgccttctacctgctgtaccggccgcaccggccggccttcacgctgaccgcggcgcgcgtgacgaggctgagcctgtcgccgtccgccaccgcgcccgcgctgagcgacgccatcgacgtgacgctgaccgccaggaaccccaacaagaagctggtgtacgtctacgacgacttcgccgtgacggccgccacggccgccaacgccgtgccgctgggcgcggccaccgttttttggttcgcgcacgaggccggcgggggaccgtcatctgggctaacgtttccgcgtccgcgctcgcggncgaccccgccgcggccggctccgacgtcaagaggtccggcgagttccccatcgtcctggacctggagaccagggccggcgtccgggttggcgcgctcaggaccaagaagatcggcatcctggtgcactgcgacggcgtcaaggtggccgcgcccgcgcccgcgccggccaagaagacgaagaagctggcgaaggccgcggtcgacaccccagcccccga

SEQ ID NO: 8105 - DNA, 3244 bp, Zea mays
  misc_feature (2664)..(2664): n is a, c, g, or t
ttgcatgcctgcagattgctccttgattagcaaaatagtactagcgtcgctcccactcccaggctcccagcagagaaaaaaaaaaatcccgggaaaaatacccgccaccaatcagttgaggaggtgaagcaagaaggggaggggaggacagggaaaagcgtcagcaacagcaagccggcaacaaatgatttggtgaggccgaaccatccgtgaggtgccctgtcccttttccctcaccttctccacctccctcctcgtcgcctatagatctctctcctccgttacacctcacatccaagctcacggagtcgcagtgccaccgaggcttccaagcaagaaccacccccgcctgcctgcggagctcggccgtcccctgcgctgcggagcgggagcgggagcggcggcgacaatgtcctccaacggcaagcccaccccacagcccgcggcggccagcgccggcgccggcgccggcgggccgccgaagatgtaccagcgacccatctaccggccgcagcaggcgccggcgaagcggcggcgcggggggcggtcgtgcccgttcagctgctgctgctgcttctgctggacgctcctcgtcgtcgtcctcctcgccgtcctggccgccgtggccgggggcgccttctacctgctgtaccggccgcaccggccggccttcacgctgaccgcggcgcgcgtgacgaggctgagcctgtcgtcgtccgccaccgcgcccgcgctgagcgacgccatcgacgtgacgctgaccgccaggaaccccaacaagaagctggtgtacgtctacgacgacttcgccgtgacggccgccacggccgccaacgccgtgccgctgggcgcggccaccgcgcccgggttcgcgcacgaggccggcaacgtcaccgtcatccgggccaccgtctccgcgtccgcgctcgcggtcgaccccgccgcggccggctccgacgtcaagaggtccggcgagttccccatcgtcctggacctggagaccagggccggcgtccgggttggcgcgctcaggaccaagaagatcggcatcctggtgcactgcgacggcgtcaaggtggccgcgcccgcgcccgcgccggccaagaagacgaagaagctggcgaaggccgcggccgacaccccagcccccgccgccgcggccgtcgacgacgcgccggcgccgcccgccgcgtcggccacggccaccgtcgctcgcgcgtgccaggtcagggtccgcgtcaagatctggaagtggaccttctagccacgtcgtcgtcgccagcctccgaggggccgcattgcaaaatttttcgggtgaaagggaaaaaggttgctttgctttgctttgctttgcaacaccgggtgaagtttctccagtcagtccagtaggagggaaagcaagggaaacagaattcgaatcaaatgccggccgctgtaaatttttttccgtgtttaattgaattttaccaaattcggcggggagggaaggagaaggagaggtcggaggagcggcaaggcaggaagtgacgtgccgtgtgcattctgttctgcagtgtgaggcttgaacgatttgttttctctctctctctctttctctttatcgctttgtgtagtgccatttttttaaattttttcacgcatcttcttgttggtagcgcaagtacgatttggtggtctcttacttttaaccatgtaatccaaaagtgtctggaatgtataattggtagtgacatgaagtgtagtactgtactctctccgttttttgtgctgtgtgctaattttattcaatttgcatctgcggatgaagtgacccaaagctctgttttggatttgtaattaaccgggaggggtgtcggtgagccctgatgtcgagggtgtctgacaaattctagtcgtgaaaaaggaaaaacgaagatgctaatatggcgctgcctttttcatgtgaaggacagtaggacactcgaggctgaggcgaaggtgctgccagttggatcggagtgacgccagcgtgacgtagtgagttctggaatgggggaaaaagggcaaaggaggaccagggccaagtagcagcatgttctcagggctcattgtgtgattactgctactccctctgttttattttaattgtcgttggatagtgcaaaattaaactattcagcgacaactaaaaacaaatagaagaagtactatactactcctactagtagcaattttgtagttaaagagtgtcaacaaggaggagcgtgggttggttaatcgggatcggcgagccattaacaaaaggtcaacctgcactgcactcattaaagcggcctgcgtcgtctttccccagcacgccccaaatgaccaaaagcaaaaggctgtgcagcgatctgcaaagactgtcggggacgcccctcactgcatcatcagatcagacaccagtgttgcattgcatggctgcaagcccagtgctaatcatgtgaggcctggagagacggaggagacgagcacagcggacagcggtggtagctggggatggatgcttggagtggtcgccatcactagctagcttgacagcagccgcacggcggcggcactgggaacggacgacgacggcctgttgcctgcatgttggccggacggtgagaagtccgcttcggagattagctggagtgctagctnttgtgtgacgactgacagtgccagccttttcttaattgattaacgaaagagaaggatcccttgtttcctcgtgttacgctgacgaggaaccgtagcttgcacatggaagaagaacccaatctggtatatcaatttgccggcatatagcataagagctaacaggaatagtcctccctccgtttcgttttagttgtcaccgctagtgcaaaacaaaacgaaacggagggagtacttggatggttggtcaataattaacaaatctattaatcaatttagagcaagtataatagagtgatgtagacggactacaggatatccgacaccagatctatggtgatatggaaaaaaaagaaatagagagatataaaataagttaactattagccaattaaaggtgggcagctaatactctaagacactttggagagaaaaagatggattaaatattaaatgtacaacttatatttttatattactaggattttagttggctatacattccttagatcgtttatagggtctagggggagtaaaatataagccttagggtgtctataagggtgtctctactctctaccag

SEQ ID NO: 8106 - DNA, 2691 bp, Zea mays
cattgggacctcgagccggccgggaaacccgcatctctcctggctcggcataacctcgcgcaaccatcacttcacagctgcacaggcaaccctgaggcccagacctgatctcgccggcggcgagcttgtgtccatggctgacggggccgagatggacgaagaggctatgcgggccttcttcccgctctccttcggaaaggcggctccgcggcccagctctgctacctcctccgcccactccaacacccttcgcaagcctcaaaaccctagtaaccccaagccttccgcctctaccgccgcggacgacgatggggccgctatgattggtcctcctcgcccgccgccggcgcccgcgggggaggaagacgatgaggacggcggcggtatcatgatcgggccgcctcggccaccgccgccctccgctcgcggcgagggggacgacggcgacggcatgattgggccgcctaggccgccgccagcggatgatgaagacgtcgatgatgatgaggacgacgacgaggaggagatggaggatgatggggagggtggattcaatcggatccctcttagcaacgaaattgttctgcgggggcacaataaggttgtctctgcccttgctgttgaccatacaggatccagagtgctctctggtagctatgattatacagtgcgtatgtacgacttccagggtatgaattcaaagcttcagtcattcagacaattggaaccatttgagggccatcaagttcgtagcctaagttggagtccaacgtctgatcgattcttatgtgttactggttcagctcaggccaagatttacgacagggatggacttacactaggcgagtttgttaagggtgatatgtatattcgtgatctgaagaatacaaaaggtcacatctctgggcttacaggtggtgagtggaatccaaagtcaaaagaaaccattttgacatcatctgaagatggctccatgcgtctctgggatgtgtctgattttacaagtcagaagcaggtcatcaaacctaagctggtacgaccaatgcggattcctgttacatcatgtgcatgggaccatgaagggaaacgaattgtgggtggcataggggatggttctatacaggtctggaccataaaagctggatggggtagcagaccagatatccacgttgagaaaacacacacagaggatattactggggttaagttctcaacagatggacagagtcttctgtcaagaagtatggatagtactcttaagatatgggatttgagaagaatgaaaactcctttgaaagtatttgaagatctgccaaatcactacgctgagacaaatgcagcatttagctcagatgagcagcttatttttacaggaacatctattgaaaaagatggtgacaatgggggattactttgtttctttgatagaaagaaacttgagcttgtatcaagggtgggaatttcagcacattacagtgtgataaggtgcctctggcatccaagaatcaaccaggtgtttgcaacagttggagacaagaaagaaggtgggactcatatcctgtacgatccttctattagtcaaaggggagctcttgtatgtgttggacgagcaccaaggaaaaagtctgttgatgattttgaggtgcaacctgtcatacacaatccacatgcattgccacttttcagagatcaaccaagtcgtaagcgtcaaagagagaagatactgaaagacccactcaaatcccacaaaccagaagcacctgttaatggtccaggttttggtggaagagttggtactacaaaaggcagtttgctgacacagtatctcttgaaggaaggtggtttaattaaggagacctggatggatgaagatccaagagaagccattttgaagtatgctgatgctgcggagaaagacccaaagtttattgcgccagcttattcccaaacccagccgaaacctgtttttgcggagtctgattcagacaatgaagagaaataaccatgcgcctggttacctaagctagcatgcacctgcattctgttttctgacagatgtctcttgatgagcttgttgcacatgccctgtaacctgcttttcaacagtggagaaacaaaagagcatcttcaagggtcttgatgataggagctctgccccttcattacagatggataggattagtatctacgacacttcagcactagagctctatgatttgttggatgttgtacccactgtatgtacttagtcctgaaacagtggccaatctatattatactctctctgttctttcttttttatttgtcgcggtctagtttaaaaatgaactagcgggcgacaaatattcaagaacggaggtagtatatgaggtagtatatgacttagacgtaactttagtgcaccgaatgtagtcaacctttgtttgctttggagaatgaggatttgttgttctagtatcagtctctttgatgttcctaatgggctagttggaagatattttgaggattttgaaaggcaaatgctgtttttgtgtggtttgggctgtacggtccaaacaagttgggaaacagtggcgtatcagccttgttattactatgatccaacaagccaatggtcctggatatagcaagatttggataacacaatcctgaaatatcattgctatctattttcttaaaaaaaaaaaaaaa

SEQ ID NO: 8107 - DNA, 1626 bp, Zea mays
tctgattttacaagtcagaagcaggtcatcaaacctaagctggtacgaccaatgcggattcctgttacatcatgtgcatgggaccatgaagggaaacgaattgtgggtggcataggggatggttctatacaggtctggaccataaaagctggatggggtagcagaccagatatccacgttgagaaaacacacacagaggatattactggggttaagttctcaacagatggacagagtcttctgtcaagaagtatggatagtactcttaagatatgggatttgagaagaatgaaaactcctttgaaagtatttgaagatctgccaaatcactacgctgagacaaatgcagcatttagctcagatgagcagcttatttttacaggaacatctattgaaaaagatggtgacaatgggggattactttgtttctttgatagaaagaaacttgagcttgtatcaagggtgggaatttcagcacattacagtgtgataaggtgcctctggcatccaagaatcaaccaggtgtttgcaacagttggagacaagaaagaaggtgggactcatatcctgtacgatccttctattagtcaaaggggagctcttgtatgtgttggacgagcaccaaggaaaaagtctgttgatgattttgaggtgcaacctgtcatacacaatccacatgcattgccacttttcagagatcaaccaagtcgtaagcgtcaaagagagaagatactgaaagacccactcaaatcccacaaaccagaagcacctgttaatggtccaggttttggtggaagagttggtactacaaaagggcagtttgctgacacagtatctcttgaaggaaggtggtttaattaaggagacctggatggatgaagatccaagagaagccattttgaagtatgctgatgctgcggagaaagacccaaagtttattgcgccagcttattcccaaacccagccgaaacctgtttttgcggagtctgattcagacaatgaagagaaataaccatgcgcctggttacctaagctagcatgcacctgcattctgttttctgacagatgtctcttgatgagcttgttgcacatgccctgtaacctgcttttcaacagtggagaaacaaaagagcatcttcaagggtcttgatgataggagctctgccccttcattacagatggataggattagtatctacgacacttcagcactagagctctatgatttgttggatgttgtacccactgtatgtacttagtcctgaaacagtggccaatctatattatactctctctgttctttcttttttatttgtcgcggtctagttcaaaaatgaactagcgggcgacaaatattcaagaacggaggtagtatatgacttagacgtaactttagtgcaccgaatgtagtcaacctttgtttgctttggagaatgaggatttgttgttctagtatcagtctctttgttgttcctaatgggctagttggaagatattttgaggattttgaaaggcaaaaaaaaaaaaaaaaaaaaaaaaaaaaaaaaaaaaaaaaaagttgtgaaacagtggcgtatcagccttgttattactatgatccaacaagccaatggtcctggatatagc

SEQ ID NO: 8108 - DNA, 3140 bp, Zea mays
ttgtaggaaaagagacggacaggagaacattaattatgaaataaatggtcatgattcaatatatacatcaaaggaccggatccccctgatatgcttcctaacataaacagagtctcgagaacttatttctttaaatttttacaataaactactacaacacgcataggttcaggaatggtatgaatatctctactccttgagcacgagtttccaccgttgtgcgtcgtgcatcatgcgtgtagatctattccttccccctctcctcaacctaatcaatagaaacagataatcatacttctagataagacttatctcgatctattccttcccctctccccacctaactaacataaacagatcatcacgcttctagtgttggcgcaggagagaccggtgccaaagagttgggtgagaacgacgttgggttcaaagccagggtggaggcacgaggagagattgttaaacgccctctcaaacgatgcctcgacgagcaacttccaggacgtgctcctggcttgagctagggttaggccacatgaggccacgaggtaggtctcgaaggaaaagaggaggcggggaggccatcgcagcgcacggacatcgtactattgtgattaaagcaccattgttaagacttctttgaatgtccatgtatggttataatttaccaatgtgttaaattactatggtgtaaaaatcaatttgtagttctaagttaaatcgcttcggcacctatgaattaagatgaaaacacgctatgcaaacaggacaaggcatcagtgatcatcgttcccatgatggacgattggacgggcactaggcgctagctgatgctggaaccgtcagcggtgcgtggcgtcctttgtttgtgagcacatggatggatgtcgatatgctaaaaagaaagtactatagaatgggaagagcagacacatataattatttataattgtgtgcacgttttttaaacatgtccctctcctcatgtactcgctccgtcctagtagtagttttagctctagatttttatagataattataaaattaaatatatatatatataacacatacattaattactgtatgaattcgataaaaaaggtaaaaccaattttaatttagaatagggagagtataatataatctccttcgcattcgcgagctcagcctcagtgctatcacaatggcgtcgcttgggtcggtggagccttggaagccctgcaggtgtggtcgctcccttgtctctatcagcaggaaccacgttgaaagtaaccggctcaggcgctcagcccacgccgatgtcgtgccggtctacagagaagcaagcagtactatgcagcgacaaagatagggatgtacaattttccatcttcgtctccacgaacactcacagatcgagatggaaaatcttctccgatacgaaatacagtatttaaagccaaatataaattgattatatcaaatcaatataaactgaagaagcaggatttaaaacaacaagcaacatctattttacagttttgtttgctaactgtatcaagttatgtgctaagtttttttgggtagatttttaacatgctaaagaactaatttagagctagagaagtttgtgggactggaacatggatgaagaacggtcctccatccaggtcttcacggactcgattaggactattttttgttcctatttgtgaaagctatattattgttatctctgtcctctaatacatacatttctcatgggaaatctcgaggatcaggtccctatcagacaaagaaggcttccaagtgcacaagccatgatagctgctgggtgatggagctctctcaccgcgaccatccagttttcagtcttctttacaactaggtgtgtgcccgttcattgctacggagtaaacatgctataataagatacattgagatgcagaaacattaattatcattcaatgttcttgttagcatctttttaaaggttaagaatgtttacataactataattttatcttcatcaatgaagataaaatccataaaaacatttcgtgatagtttgcttttcatgacagcacaacgctagagacactgacctagagtcctcacatcgtcatctcgatgttgaggctaggtatagccaaagacgtcggataggaggtccgagacttcgagagcctgtcgtggaggtctatgatcttgaagagtttctaggggggcgaccgatgctgatggcctcggcgaagctgaagaggtgcagcgcggcgccattgatggccttggcgaagggggtgtgaagaacaaaaataccaagcatcacaatactcgttgagctttgaaaccaatttacacgataagttgagcttcaaatagaatgtccctctcgaatgtaaagtaaacataagaacacacctgagaacgatgtccttctcgactttactaatatctttgtgcttctgaacatcgcaattcatacaatacaaggaaaatatattaattggagtttgacaaaagaaaaaccaaatatcccaacagcattcatcagacagtgaaaacatatccactattgcaaatggaacctaaattttttcttttaaacaagcaacagtaaatttagtactacacgaagcaaaaggagcagttgctacaatacaaatagtcaaatactgtgaggaattgttaatatcacaagatacatgactatttcagatcataactatttcagcaaagttttacctctagcagctcacacctcatagattatttgcaacacagaagttacaattcctatcttccaaatcataccagttcatagagtttaatacgcttcaaggcttgcattaacaaaaataataaactggtaatgctcaaaatccaaatctatgagatcgcaaacatatgtatgacaagcaatatatttagagagcaaaaaccacacagtggaactaaatgttactcccaactgaaggattccagggatggcatgctttcggcgcgatctcaaagtttgcttgcgctctgggatgatccatgtgagcccctgagaagagttgaagcaagcataagcaaagtggcaactcatagacctcatatcatatcgattagctaaagaagttgtgatacagaacaacaaacatatatatagacaagca

SEQ ID NO: 8109 - DNA, 1232 bp, Zea mays
gcacgagaccattacctagaacatcctaatcgtcgcattgaattgcttctcgcggtaccggtcaccggtggaaccaactccccaccacccgcccccgcgcccgcgggctccaggccgagccgaagctaggcgcgatgtcgctgtcaccggcggacggcgcagcgtactggctgcggtggcaggtcctcgtctgcggcgcgctcatcgcgctgcccacggtggccgcggcggcgctgctgccgcggctgcggagctcagcgccgcccctgcgcgcggccgacctctgggttccttgctgggcgcgcctccacccgggctggctccttgcctaccgcgccgtcgcgctcgccgccgctgtagcgcttctcgcgcgcctcgtcgtcgcgcgcggcatcaccgtcttctacttctacacccagtggacgtttctattagtcaccatatattttgcgtttgccacagctatatcagcccatggatgtttggtttactcaaggaaaagtttgaggaaagccgacgaatcccgtggacttcttaatgctgatgtcgaaaatcgtgatgtttccaattctgtttctggagagaggaaaacagatgagacaaatatgatgatgagctattatgaacaaatagtgaatgagagaagagctgggttctggggccggtgcatggaaatcatataccagactagcgcaggtgcaacaatgttgactgatgtcacatattggggccttcttgtgccatttttctaccgtgacaagtttgggttagctttgttcactgatggcatgcactccttaaatgctgtttttctacttattgacacacttctcaacaacatgccctttccctggtaccgaatgtctttctttgttttctggagctgcgcctatgtaacattccagtgggtccttcatgcttgtggaggcgtatcctggtggccgtacccatttctggacctttcatcatctggagctcctctatggtacctcggcatggccatcgctcatgtcccctgcttcttcctgtattggttgatcgtcaaggcgaagcacacttatttccaacggatgttcccacatgcttatgttagggcaacatagacccatttatctaatcacaggttaggataaactcataaacatgtataaataaatatctgtatcatactacttctgcacctgccgggcttaagtgtacacctgtatagtctctgaaaaaaaaaaaaaaaa

SEQ ID NO: 8110 - DNA, 1395 bp, Zea mays
aactgcttcttgcggtagcgactagcgatcgacccaacttcccacccgcccccgcgtccgcgagctcgccgaagctaaggccgaagggtacccgccctcggcgctatgtcgctgtcgccggcggacagcgcggcgtactggctgcggtggcaggtcctcgtctacggcgcgctcatcgctttccccgcggcggccgcggcggcgctactgccgcggctgcggagggcggcgccgcctctgcgcgcggccgacctctgggtctcctgctgggcgcgcctccacccgggttggctcctcgcctaccgcgccttcgcgttcgcagcggccgtcgcgctcctggcgcgcctcctcgtcgggcacggcctcaccgtcttctacttctacacccagtggacatttctattagtcaccatatattttgcgtttgccacagctatatcagcccatggctgctgggtttactcaaggaaaagtttgaggaaatccgatgaatcccatggatttcttaatgctgatgtcgaaaatcgtgatgtttccaattccatttctggagagaggaaaaaagatgagacaaaaatgatggtgagctattatgaacaaatagtgaatgagagaagagcagggttctggggccggtgcatgcaaatcatataccagactagcgcaggtgcaacaatgttgaccgatgtcacattttgggggcttcttgtgccatttttctaccgtgacaagtttgggttagcgttggtcactgatggcatgcactccctaaatgctgtttttctacttatagacacagttctcaacaatatgcccttcccctggtaccgaatggctttctttgttttctggagctgcgcctatgtaacattccagtgggttcttcatgcttgtggaagcttatcctggtggccatacccgtttctggacctttcatcatctggagctcctctatggtacctcggcatggcaatcgctcatatcccctgcttctttttgtattggttggtcgtcaaggcgaagcacacttatttcccacggatgtttccacatgcttatgttaggacagtatagatctaaatatcagtagcatactatttcaacacctgcttggctcaagtgtacacccgtatagtctcattgaattcgccgcacctttgagatgggcctgagctctgaaaacaagccggtaccggcggcttgatcaatgaaatgcagaggttcacaatcacctggaaacagagtcttgtcctgtcttgctccttctcttgtaaagcatgtaatcagccacaactactgcatctgttcgaaccctaaacccttaaaatactgcagttgttcgactgctgtagttacaatctatacaaataaaataccgtaaaaaaaaaaaaaaaa

SEQ ID NO: 8111 - DNA, 3523 bp, Zea mays
  misc_feature (1088)..(1088): n is a, c, g, or t
gtgaggtagtctgctggagatagtaggatccaatagactctctattctgctttctatcttactttttattttcgattttattctgtaaacagtgtaatgtacattgcaaaacagtgtaaaactttccacgatcatttacacgagagatggcagtaaaaaagatggaagaaaacgttatggtcgtggattattggtttattaggatttctacaaagttggcatgccacagatacttctcctgtgaccacctgtacacaaaacgaacattaacaattaacggaagatctcctcgacgtgaacattattaacttattaacgattaaataaaggaaagcatgagctctatgagtttgtttggtttaactttttctgatgagtttttttagaatatggttgatgaagaatttagctatagaaaaaaatctaggtatcatgaaaattatgtgtggagaaagataaaaggaggtagaaagtgagacgataccgtttcatcgattttttgaaatcacgtcatgattaaaaattgctctaatgtttatcttactataacgtgactctcatccaaacacgatacaaaatatagtcgcttcttccatggcttcttatacgtcaagcaaacactcaccaacccgccggattggattcatccatcgcaccagcttcaaccacgcatgtagcatgttggatgaatgtgtgggggtggggtcacgctagcttctggtctggccggctgcaccagctacaaccacgtgtgctacggactgccgacgagacatgttactttaatccaaagtacatgttcattgctgcgatttttatttatattttaatataaagtataaaacacaaacatatatatattttgttggttaggtgaatgtaaatgcaagtttaaaactacaataatggtttgaatctttatttatacataatttttcttataaccaattaaatgtttaaatgtggatccgaccaagtcagagggaccatgattgattagaaagaaatataagtttttttttttttttgtaaaagtgaatacggaaaccgtggaaccaggaaaacttgtaatttagacgctgcttggnagagctatacttcaataatttcaggtctattttagcttcttctatccaaacaggtcgagctcaacgagctctagtttaaaaaaaattaaaacaagagaccagttttatgaaattttttatgctcctcaaagtgtgcttcacaaacactgtttttatacctctttatgaagttacataaaaattacccaccagctattcgttacatgatgtatcgattcatatctctttctccacccgctaaacatcaagggtaattaagaaaactcgcacaagtcagttgtattatagaagctggagtctatgtgcaagtcaaacacttttgaaccctatcttatcaatcttttgaagttgtctttttggtgaagttggaaaatggaagctgcaatttaaaaatgaagccctctcaaataggatcttaatatagtatagattttggtctctaaacttaatgtgtcgtgtcccttaggtctctaaatttagcaatattgtgtcatttggatctccaaactttcattaatatgatttagcgttgtacaccacgtcgacatccagcttgatcaaattttttggatgtactgattaggttacaacatccgttttttttctagtttgagtgacacatcatgccaaatgtgaggatgatgatatactttacttaataaaaaacatggtgcttcgtctgcttgatctttgctgcagtcaattgctgccgacctgatcggtggcggcctcggctctcttgttgctgctgtgacaacagtcagtcgtcagttggaactggatgcaccgactcctccgcgcgggcgcatcacacagcgttgagcgatacagtctgcgggcaagctgaacgatggtaacggaacgtcagtggctctgaaatcttgtagggaaaagaacgtggaagcatgcataccgacttggctgacgtgctgactatatataaaaaaaatcagagttcacccacaccgtacgtagcagagcatcagtttcataaacaagtccatacgtactacttcaccttcaagcagcagcagcagccatggcagcacccaccgtcgtctccttgctcgccatggccgtggtggcgatagcagcgcttcaagctacggctgccggtccgccgccaccgccaccgtacggcaggccgacgaactgtgttcagacgttatacgaggtcagcagctgcgctccgttcctgtcgaccggaacggttatctctggccctccggcgagctgctgcgcgcccctgagggcggttctcaggacgccggcatccatctgcctctgccacgccattggcggcgagatcaacgagctcttgcgcattaacatcgaccccatccgactcgccttgctgcctgttgcctgctgggcgatcgtgccgcctcagctccctgccatgtgtttcgtttttttctcagttgctatgattgatcgtactagtatctaatcatgtatttttcccatcaataccaccttgtaatttctttcttttgtacacagttggacctgtgccacccatattcaacatcccgactatgtctccgtcgccgccggtgactcctccgccacctatgcctccggcgtcgccgatgaggcctccgccctgggcctcgacgcctcctggccacatataggcctactaggcctcaacgcctcgtctagacgtctacctcatccatccacaacgaccagcttggccaaacgccttgcttcggatgttttacttctgaagttcgttatgataacactgaaggctttgttcggttgagattgaattttttttttgacttttttaggatttaaacccactaaatctcactttattcatatggattgagaccaaacaaacaagccctcaagtggtaccatttagacccataaactttaaaaacatattccttgttccttcaatttgtttagtggtgcatctacgtgaatcatatggtctacaaatagacgcggccatatggtcacaaatagacggccagtgcatcatttaataactttaggactttaatacaccacttaacaagtttagagatccagaaagacattttcaaaattactagacccaagtggtattcctggatcgatcatgcttaaattcttaacaaattattaagggttagtttgaaaactccattttgtcaagaaaaaatgaactatttttctttgaaaaaatgggatttccaaactagttctaaacaaatatttttgctctctaaaaatttgaactagtttgttctatgcagaaaagtacaaatcatatgcctaaagtattctaaatatataatgtatcggctggtaatttatttaaatttatttgtattttatttattattatcggtagtattttattacttgtagtcatgtttgctatttatttaaatgccatttttataaattataatattagaaagtctctataaata

SEQ ID NO: 8112 - DNA, 1832 bp, Zea mays
cacacctgtttataagtgccagtgcggatacaacatttgtgtctgggttgggcggcaacctgtgtaagcttggctgggcgcgagcttttattcctacacagctagattttttggtacaatttgctcaggtgcatagcgcacatgtgtggggatgggaaacaacgagggtgtggatgggaatgtgaaacgacgagggtggggacatgggaatcgggaatggcagaatgccatgggtggggacatgggaacgacagaatggcagaacgccacgggtggggacatgggaatcgggaatggcataacgccacgggacatgggaatcggaatggcagaaccaggaatggtagcctacaccttaccgccttaatagtagtaaagatttgtctttggtgtaacagaacaatgagatgggaatgcgagtgggaggaagtagactaagcatgacttgagtttcattgaccatgcctaaaacattactatatgtgcctaataataacaaaaacacaagctgttttttatgaaaatagcaaagcaaggctagagaatatactgctgctaaagtaatcacctgatccttgcacctgcaaaaaggtaggacatgaagactgcaagtaatccaatatactgctgccaaagtaaatggtcaagtagaccaattaaagtctttaaatattcctaaatcattctagcgaatccttcaatttctttagaatattattgcgttgtggatcttgattgaagcaagtcagcaccagtcgtgtttcagacttgaaaataaggtacgacggaagctgccaatttccataccttgtcgctatggggtactgtaggaagagtccgtccaggatgcgacagagcttgctgcagtgtagggtgtgcccgccgcagatgtaccaccgcccaccaataccctgcacataaatgtcatcgagcgagaacctatgtatgaattgcgggccaaccaatacttgacagataaaccttgaatctgcttcccatactccaaactgttaataacaactcccaaaacggaacttgttcgaggtgatgcaacccagcaaacatgtgtatatcatagagaaaggaattgatctttggcaaaacattactgtatgtgcctgataattcagtgtaaagagaagtgggtaaaagatagagcatgtactattacaagacgttttgcatgaaatgtgcagatatgatgatacacttgctagtgcatgagaaaatgccaaatgaaatattatcacatataatccagggcagacagtgctagaggctcccacatgagtagggtctaggaaaaagataaatcgaaaagtttacatatgtttgttgctaacaagaacagaatgacattattggagtgagttgaaccattggcaaggaataagactgatctaatctatatggagttcattggcctggaacactaactgggtcagatgtgcttttctattcaagcactgctctgtgctctatcagttacaattgtagccaaaattacgatgctttggtgaaaaatgtaagaactacaccctaactgaacaagagcctaactaatataccctagcacgagatgaaaagaaaaaaagatctacatagaaccaaacatgtattcaaaataccggtgtttggtatatattaccttgaactcagtacactaaaatcatgtttacaaagtcaaacgagattctaacagaacaattaaattggcatgtacaccattgaactgaacctagacaaacgggattcgaacaaactaaggcttatgaagttgtccaagaacagtttcaaaatatggaccggtcatctataattataatactaaa

SEQ ID NO: 8113 - DNA, 789 bp, Zea mays
cctcgaggccggccgataagccaaacactccggcagctgtggtggagacgcctccgcctcccaaacacccgaatcaaactaacagccaccgatggcgtcgccgtcgcggttgctcccgcccacgcctccttcggccgcccagccccgcggcccgcgggatcgcctcgccttgccgcgcctccggtgcctcgccgccgccgcagcctccgcctcgcccactgatggcgctgtgctgctggagcgtggcggttccgcggcggtggccgtgcgggagttcgtcacgcttgacgagctccgcgctgccgtgcgcctccgcgtccgcaccttccacgagtacgcagacgactccgtcggaaccgaggatcacagaaaggctcttgcagatagggagtttgaagcattacaggataggatttctgggaagatgataaattttcgaagagtttcttgcataaacgggactgttccactgtccccatcattaatgtcagctgaggaactttgttctatgtgcaagtttgtggaggatggaaaagagagattagtagttggtagtttagaccttaatcagtgtctttggctaccagatgaattgactggaaagaggcctggggtacgaccgttgtttcctctttctacgctattgcagaatacttatgatcaaaacatatttttgatagttgttattggtatttttgaacttgctttggtcatcgctttgttgttgttttggcaataaagatagactcactacatctaacttctttcttgtcaaaaaaaaaaaaaaaa

SEQ ID NO: 8114 - DNA, 665 bp, Zea mays
aagccaaacactccggcagctgtggtggagacgcctccgcctcccaaacacccgaatcaaactaacagccaccgatggcgtcgcgtcgcggttgctcccgcccacgcctccttcggccgcccagccccgcggcccgcgggattcgcctcgccttgccgcgcctccggtgcctcgccgccgccgcagcctccgcctcgcccactgatggcgctgtgctgctggagcgtggcggttccgcggcggtggccgtgcgggagttcgtcacgcttgacgagctccgcgctgccgtgcgcctccgcgtccgcaccttccacgagtacgcagacgactccgtcggaaccgagttttgtcaggatcacagaaaggctcttgcagatagggagtttgaagcattacaggataggatttctgggaagatgataaattttcgaagagtttcttgcataaacgggactgttccactgtccccatcattaatgtcagctgaggaactttgttctatgtgcaagtttgtggaggatggaaaagagagatttagaggtggtagtttagaccttaatcagtgtctttggctaccagatgaattgactggaaagaggcctggggtacgatcgttgcttcctctttctacgctattgcagaatacttatgatcaaaacatattt

SEQ ID NO: 8115 - DNA, 959 bp, Zea mays
acgcggggagcaccaccagcagcagcacaccagcacccagaagcagaagctcctatatcctgagctcctggcacagcaacaatggcgagacccagtgcagctgctgccggcggcttcttactggcttgcgccgccctgctcttgttcgccggccaaagcaacgcacaaacaaccttcatcttcccattcgcatccctctttcctgtaggttacgtgccgccgatagtgaggatctacagcaagcagaataccgggctgaacatggccgttcgctacggcaaagttgtcctcgtcacagccaactcttgggaccaaacacagctatggtggaagatcccccctctcacgagcctttttgatggagagggcgccaagtactggctggtgaacgtcgcaaccaaacaagccatgacgtgcccaaacggtccaatgcaggtgcaactggcagaattcaacccttacaatggcgcgcagatgtgggtgccgagcacaccccgtctccaggacggcgtcttctaccagataaaaccatacacgcaggattccaaggccctcaacggcttggggggatatgtacatgacggcacggagatcgggatctactctgacacacctgtgtcttccaacaccttatggttcacaagcaatgtcttcccctttccgttctattaagaatggcgaatgaacatcaagggccctcgtgtcgtacttgttgttgcgtgcttgatcaagaataaagacgatacttgagatcttttctttcttttttttttcaaaatgtgatgcttacttgtgtccatgtgccttgcatgttttcacagaatttgttgtctctttttttcttcaaaatttgaacaagttgaatgtgttccttatgctatgtctctctgtttttctttttttggttctcaagaattccatgtaactgcctgattagcacgcaagcatactactatgct

SEQ ID NO: 8116 - DNA, 7809 bp, Zea mays
  misc_feature (1699)..(1699): n is a, c, g, or t
  misc_feature (6766)..(6766): n is a, c, g, or t
tgtctaatcaatcaatccatccattgtcctagcatcgaaccggatgggaaatggtacactgccacttgaatgattcaagctctggaaaaaaaaacagagctatagcagtcgcattgaaaattactacagtgtaattggagcagtgaaaattacagtgtaattatcattactatcaaccaacatagcaaacatgcaggcaaagacggcggcaaacttttccgccataaaaagcgcgctagtcactgctagtcaaggctgtagtcgctggcgctgccactgccactggcggtttcagttagtggaggatgaactcctggttccacttccacaggctgcggcgcaagagagccggggcaggggcgatcgcgaacgccgccgccgccgaacccccgccgccaccaccctgctcgccgaacagggcgtcctactacgtgccgagccgggaccgcgccgtcccgcgccgcccggacaacaaccccaagctccgggacacgcagttcccgcgcagcccgcaggcgagcgacaatgtcttcgacgtcgtcgcccgctccagcccggcgccggagctcaagctacggcccatcctcacgaggccgcctcccaggcccgacggcggcggcggcgcggccgtgtctcccacgggcagggtgcgcccacccccagggttccaccacgccgccacgccggaccgccgcaggcggaacaaggcggaggaggaggcctgcacgcggcgtgccagcgggctccggcaggcgtacgagggcctggtggtggtggtggagtcggcggaccccgaggaggacttcctggagagcatggcggagatggccacggccaacggcgtgcggtcgccgcggggcctggaggagctcctcgcctgctacctcgcgctcaacgccgccgaccaccaccgcgcaatcgtcgccgcgttccgccgcgcgtggatgcacctccacctcctgcgccgctgcatgcatgagcacgagtcgtgtgtcgtggcagattagctctactctagctgctgctgcttcttcagcgatcgcgacgtgcctgctctgctgactgctgtatgatgcatgatctgttgggtatagcgcagactgtgcgtagttcttgcccagagatcgtcgaaaaggcacgctgcctcgtttttttcgtgcgtggaaacttcagttcagccttgtttggttcttgttgatgatgatttgatgctgcaaagctgaaggatccatcgatcgatcttcaggaaagggtgtcgaccgtgcgccgtctttacagatcgattgatcaggctagctgctcaactcgtctttacagattatatttttgtgtttatctttctatggacctccagacatccgaatccatccctagtccagggtgcgaggccaggcccccatgctactctacgctcgatgcttgcttgaggtgtgaaatggacgtgcctgtgcggtcttgaatcgagagtaggagtagccctggctggccgctgcagactgcaagtgaagtgaacgctgttcaggcatggtcaccactcaattccacaggccacagcaacaaagcgttatcatgattagaatcgactcatcgagcaattagaccagcagctgcaggcaggtaggagttaaggttccgcagtgcagttggaagtccacggggccgagagaaggcaggcagccagggaaggattggtgaggcnatcaaagtggaatcaattattatttttctatcaaacactaaaaacgagttcaatttaaataaagtaagcgctcaaaccaaattcacattactaaattagtgatctgatttcaagatgtttctaatactcacacgagaccagcaaaacaaaaggatcgtgaatcggacaccgaaaagtccaactcggtccaaaactgtgtcacgaataatagtgatgattttatgagcacgaaattttgttctcaaatgcgaaactaaagcaaacaaactcccattgagataaaatgatttcatgagcaccaaattttattctcgaatgcgaaactaaagcaaacaaactccgattgagataaaattttacacacacgtgaacaaatatgtttccagggtctccacaaatttttaccctaatcgaacttgtgaatcaatcgtagatctgaaaatacgaacataattgtggtttttgttagggttttctagaacgaattcaaaacgagatcaactaagatcacaatcacaaactgcaccaacagggcgtaagtagtgattctagtagtatatctcacctatcaacaagcccccaaccaaatcctctcaagagattcaaaggttttccaaaaaaacacaagagaggccaaaggaagagcaagagaccaaaacaaattcaaattaaaattgagatggagaagtgaacggacattgtgggtcgtactgacgacccttcctctcatgaaacttgtagatcaaaaacataatcgtcgattacaatcattgtggatctctcgactcaaccggtgtatacctaaagagagaactatgagctctaaaatctgaagtcgcaacaaaatggcagccaagagatgactgtaacaacaaccctctcctctatttacagaggattgtttccattttttaaactaccattatttacatagagtgtatccattccactcgggcgaaatggaccaattcatagagttttcgatcttacggttacgtgcttcacacgaagttgcttcgtctttatgcactattcgttgggggtgccacatgacgccaccgattcccactggaaccgtcgccgaattttgaggaccaaactccgcaaaatccgtcattcgtagcgctaggtggttttaaggtccaaatcgacgtgagtatcacaccgcgtgcgcgccccacgtactggacacgtgtctcgtcagtcctcgaccgcgctgacaacgtggcccactccgtcattgtcctcgcacgagtgagtgtcccagctgtcagccaccacggccggtgacccaacctcacctgctgtgacgcagcgggaggcgcagcgctcgtgatgatggacctgacctgatggcgacggcgagaaggccgcagtagggactgcgcagcgtatgggcgccggccgagccgacgctgggaacggaaatctccgactgccctgcaaggaatgtctcgctttcagctcctttgaggaaccatgggaatgggacaaagtaggtttcgtccttcaatttcgtgtcaggtggagtggagcagtcgagcgactggccatggctcgccgttggcaggccggcgaaacctgacatgtaggcccatggccgtccgccctgcaaacgaacgtgtgggccttaagtgaggcatgcaacggcctctctgcgtttttcttcgttttctgcagccacagcctccgatagggtttcatttcctgattatctccaacagcttattcattcttatacttatatataaattttactttacgaacagtgctgtctacagtatagaatagtacaaaataatattttaaagtaaaatttagataaattgttacagtgctgtctacctgacatccaacttctaccactacgattacactgtcctgtcagtctcaactctcaacggcaaccagcttcatctctttctcagttgcttcttctaacctgcacgttttcttgcttctggtacaacaaaacttcagagacttaatatccgggatcctaaactgtaacaacacgaacaccaagcagtaaataactttgcaaggtaccgatttcataaaattctaaaatatgagatggaaatgaatacctgcagccttagtggttctcggctccttcagctctctttctagtggggagcgctgggaatgcttcctcaaactgtgttgaagttgagacaagtcccaacgagaaaggccccaaggatccaaactccaaactttctgccgcatgtaacaaatctgctgtggcgggtgaggaaggctcgcagatacgatttccttggccgttttgagcaagtgctatccctgatgacgatgatggaggcattgtctctcttcctactgccagctgtttggttccaccttctgttgccacatgctccctgaaacaaacgaaatctgcatccggaactgtgctcttgcctgaatagccactctgctgcacactgttttgcttcttgggcgattggttcgttgcactttgagctatggtgtcttcttcggtttgtgaaccggaaaatccttgctcggctgagtaataccggcgaccaggtaacctctgtctttgttttcttgctcgtatggtatctctttcaagcatgatacgctccctgtatgtttgataactctggaaatgaaaacatgaacagggattgaatgagtaaccacttgaagaaagctttaccaagaaacatagacacatgctttctggttatacacaaaaaaaactacgccactgtgtagcctaacaaaaccttttatctgcaattttttttctctgaccctgcccatttacaattggcgcgcaagaaatcatgcaaaaagctggatcatttactgaaaaagcgcaaataaggaaacaaacaaacaagatcatgtgatgagagtccgtaccacattgggaatgtatgtgccggttccatgcgtcttaggagagaaacaaaaccaagaaacaggataattatctgaattggttgaaggagatgaaggaaatgttgatccattgggggacaatggcacgttctgctgccaaaacatatccacttgtgcctcgccatgtgattgttgtgaatcatctcctatgctatgagaacaatacacaggagataatttccttctctcgctatcagtagatgaatctaatggcaggcttgaggatctagtgctagtttttaacttcaagatcatgtctggcatattgaaggaatcctcatctagcacatcagcaaaacatgcttcttcaacagcctgtaggagttcatcaaacaatgactccaggtggtactgaactttgcgaaggcatcccaagtacaactccagatcccctgagagatccagcatatttgacagcaacaggggtgggagtagcttttttcctgcaaggggagcagtccaatctgactcatcaacaaaacaagaactggagaaatccaagatatttgcactagtcgagttagccaatctatgcgatggatgccctgcataaatctgttgcggcacatttaatctactgatctggtgtaaaccttcctctgctgcataattctcgaagcactctttactgttgccattaccattatcttgagaaaaggatgagtggctccttgaacttgctgaagtttgtggattttctttcaaatcagatgcatattccatgaaccagattttattccaaggaagatcctgaaaaagaccaggcaaatacttacctgaattcttatgcacatctgtcacactcgagcccatgtcaggcagttctgatgaatgacatgaacttccgttttcaccctcatttatgcaagaagatttaaacatcgatccatcttcactaagtgtactctcgggaccaagcaagggttggaatgcactactagcgtcaatgtctagtctttcaccctttccgtgtctcttcagtgtatttgagaaaaatccgtaaatttcatcacaaatgtactcggatggtaacaagagaatttgaccaagcttttgtgctccgaatgagaaagcactccgaatacgataaaagtttgctgcaaagattagcataagtcaagaaaacttatcataagatccttccaataaaaggattttgagtatacgtgcaggggcggccctctattcggtaaacatcccacacacgatatttggtaaacataataaatgagatgacacagtacagaatgaaatgaattagtgccttcttaattctaacctttgctgacacttctgccgagattattattcgccttgagtggatcgactatatttaaaaacttctggcgaaattgtgtgtcgcatccgtcaaactcatttggaattacaacgagtctatccagagagccttgatggaagtccttgccaagcaataactcaccttgtacttctgtgggttccactgcaagttgccaactttgaataattagactagagatcatgccactggtgattcatcaacgagatcacaaaataagccaagagcatataactcaccagttaagctcggcaatgatgacaaatcaacaggaccatttaagctaatgccatatcgatcccagtcaaacttgctaaaatattccaaaaacttataaaggacctgttaaataaatcaggtagtacatgcaaaagaagttagttgaaatatcgcataagcatatttgtaagaactaagaagcccaaaagaaggtctgacttcagaaaattacctccagaggtccatgcagagacttgtggaacatattgaatatgtaaagaacaagtgtttccaaggcataagtagatatcagtccatgatgggctcctaatatgcgactttcgtggtagcaccaagccttggttaacataatgctccttttgaacaaatggtttttcccaacctgacggtcaacctgaagcagcagaaagagtaactttctcagccttcattgttttcaaaccccaaacgtgcgcatgtgaaagaaaaaaaagaatttgcttttgcttaccagctcaaggaagcagaacgtggacacaccgccaatctggttgaaagagacatccacgataatattctcaatcacacattttatnagcttaacctagttgtagaataaaaccaaattaaagttagcacacgggcaatatcaaaatgtgccaacaaaaaagtgatgtgtatcaagtatatatatcaactactctgacacaaaagtgggttaaacgttaagatgcacatatatatatatatatgcagaatgcaccgtacctcagcgtcgatgaagtgcaggcctgttagtttcaactcagcgtcacagttttcctgttccgactggagcatgctgcgaacatcgtcaatgagtgtactgtttaaccatgtgttccccagtacagttatatcaacgtcgccgtcggggagatacgtcctcagcggcactgacccaaacgcaaagacctggattataaatgttaatacaaaaacaatgtcatttcaaaatgcgcgcgctaatggacaacaaacgactaaattaaggagaaaaatgtaacattgcatttcaactaacattagtggatccgtggttgtgctgtgcctgtgcgtgtgtgcacgaactactgtctacggtgacgacgtacgaacgaactcctataaacaccaggatgatgcgtcttattacgtctttaattgcaaacaaaacagaagttttcagatctccatgcgtgcgccagagtagaatgcagtagcagcctagaattggtgtagggcatggaagtatggataaagctagaattaaccccaaatcccagcggcttggttaggacttaggtgaaggagaagtacgaggagcatgcatggaatggaagcagcaagaggcacgcatgcatgcatgaagaaagagagccttttgacgctgagggagaaagctacggcgcgcgacagcgacgaccacagtccacgtcacgtcactaaacgcacgttgttttctcgcgcaagcgacggcgaatgaggcgaagccgacaggtttatccatccgtcgtgccgtaaaaactatacaattaaaggaaaaaaatagatagtcaactgtaatcggaaaaatagatatatatgcatagatagatagaggatattgttattattttat

SEQ ID NO: 8117 - DNA, 1525 bp, Zea mays
aaaaccctacgaagaaggtaaaaaggagggcagccagcggaagaaacacccggaggaagccccgattttgacatctcgtatgcgcgattgctggaatcctcctcccctgattttaccgcacagcagaaaagaagataaaacacgacaaaaatctaaggaaaacgcaatcacatcttctcttcgtccgctgccgtcgcctctcttcattggtggcagcttaatccaaccccagtccaacccgccgccatgcaggcgctgatggccacggacaaatgcttctctccggctagggcgatgtccccgatgccgattatgaggccccctgcatcacccgacattgccattcagtatctggatgacttgttgcaggagcaacagaagctcgggcccttcgtgcaggtgctcccaatctgcggcatgctgttgaatcaagagatacggagaatatcaaacctgctttctaactttggagtcagaggaaatgagaggtcaccaccaattgcaagtccaaaccatatgcatccattgccccgggtgcctaatttctgtggaaacagttttggtccgtggaatgagatgcatcctgagagaaatggtttacccaggggagccatgggctggcaaggtgctgtacagaaccattcctcctacattgtcaagaagattgtgcgattggaagttccaacagatgcttaccccaattttaacttcattggccgtctgcttgggccaaggggacactcgctaaagagagttgaagctactacaggttgccgtgttttcatcagagggaagggctccgtaaaagatcctgtgaaagaggaacagctcaagggaaggcctggctacgaacacttgggcgatccaacacatatcttgatcgaggctgaattacctgctgatgttattgatgccagactggcacaagcacaggagatactagaggagttgctgaaaccagtggatgagtcacaagacaacgtcaagagacaacaacttcgagaacttgccatgttgaactcggtatatcgagaggatagcccgcatcagaacggcagtgcctctccgttcagcaacggtggcacaaaacagtgacagggaggagatccatctcagatccttcccagaaactctttcgtcagtcctgccctcgtgacagacatacatagctcctctgatgctcaagctcccgtgaaggtgctggaattcgtgacattctagctttgtgaattttgatatcccctgtgacattgacctgcggatgaggtaaactagtgacgaaaaaaaaaaaacctctcccatggctgcgtacttagattattccgtttattgcttccttgtcgccgactattagtgctgatagtgcagaggtgtcttaggtttcagtgttttgagctctttgattgactataaaattgactccgcgaaatatttgattatgatagtatttgcctcatatttttagcctcaaaaaaaaaaaagcactagttcatgcttaggattgtttgttgataagttttatatt

SEQ ID NO: 8118 - DNA, 1587 bp, Zea mays
ccgaattcagcacatgtgccaaaccgagcaacgaaaaaaaggtatcaccaaccggtggcggctgtcaaaaaacctactccaccttccgccgctataaaccctacgaagagcggaagagggtaaaagggtggccagctagccgaagaaacacccagacgaagcggccgtttttggcatctcgtatgtgcaacttcgctggaaccctcctcgactgattttaccgcacagcagaaaaggagataaaacacgacaaaaattgaaggaaaacgcattcacatcttctcttcgtccgccgccgccgcctctcttcattggtagcaccttaatccgaccccagtccagcccgccgccatggaggcgctgacggccacggacaaatgcttctccccggccagggcgatgttcccgatgccgattgtgaggccacctgcatcaccagaccatgccagtcagtatctggaggacttgttgcaggagcaacagaagctcgggccattcgtgcaggtgctcccaatctgcggcaggctgttgaatcaagagataatgagaacatcaaacctgctttctaactttggagttagaggaaatgagaggttgccaccaattgcaagtccgaaccacatgcatccattgccccggggacctgatttctgtggaaacggtttcggtccatggaatgagatgcatcctgagagaagtggttttcctaggggagccatgggttggcaaggtgctgtacagaaccattcctcctacattgtcaagaagatcgtgcgattggaagttccaacagatgcttaccccaattttaacttcattggccgtttgcttgggccgaggggacactcactaaagagaatcgaagctactacaggttgccgtgttttcatcagagggaaaggctccataaaagatcctgtgaaagaggaacagctcaagggaagacctggctatgaacacttggatgatccaacacatatcttgattgaggccgaattacctgctgatgttattgatgctagactggcacaagcacaggagatactagaggagtcgctgaaaccagtggatgagtcacaagacaacatcaagagacaacaacttcgagaacttgccatgttgaactctgtatatcgagagggtagcctgcatcagaacggcagcgcctctccgttcagcaatggtgcacaaaacagtgacagggaggagattcagctctgatccttcccggaaactctcgcgttagtcctgctctcatgacagacatagcttctctgatgctcaagctcccgtgatggtattggaattcatgccattgctaactggtgaattttgatatcccttgtgacattgacctgcggatgagaagactagcgagaaaaaactcccccatggctgtgtacttaggatatttcgtttattgcttgcgcccactattagtgcagagatgtctaagttctagtattttgagctctttgattatctataaagttatgactccgcaaaatatttgattatgatagtatttgtcgacataaaatttatatcttaagacgcattttgcgtggtctgctaagttttttttcg

SEQ ID NO: 8119 - DNA, 3797 bp, Zea mays
cagtccatccagccggatcacggccgacgcggaagcgcaggtgtgactggctggagggccggggtgctcggcaagcgacgcacgccaccgacacctctcccgtggcgatcggagccgcgcgctagatccaacaccctcaccggaatcgcggcggattccggcgccggcggccccgctccggatctgcattccgcgcaggggcttctcctgactgcctcgcgccctcgtctctccaaatactctgcaagcaatggatcggcgcagctggccttggaagaagaaatcatctgatagatcatcaaatgcagacgcgttgcagaattctaatcatgctgaacaggaagatagtgaattccgttgctgtcgaatttcacctcaaacatattcacatcttactgagtcagaggaaaaagtaaaagttttagaagaaaatgtgaaggtcttgaatgaaaaactgtctgctgcacaatctgagatcacaactaaagatgctcttgtgaagcagcatgcaaaggttgctgaagaagcagtatcaggttgggagaaagctgaagcagaggcctccgcactgaagcttcagctagaaactgttacattgtctaagctagcagctgaagaaagaggtgctcatctggatggtgcattgaaagaatgcatgaagcaagtaaggactgttaaagaagaaggtgagcagaagctacatgatgtagtatttgcaaaaaccaaacagtgggagaagataaaggccgagttcgaagcaaaattacttgaatttgaacaggaactcataagggctggtgctgagaatgatgcactcacaagatcacttcaagaacgggcagaactattgatgaaaattgatgaggaaaaaggtcaagctgaagctgagatcgaaattttaaaaagcacaattcaatcaggtgaaagggagataaattcgctaaaatatgaattgcatgttgtctccaaagagcttgaaatccgcaatgaagaaaagaatatgagtgtgcgctcagctgatgtagcaactaaacagcaccaggaagatgtcaagaaaatatcaaaactcgaagctgaatgccaaagattacgcggccttgttcgaaagaagttacctggccctgctgcactagctcaaatgaaaatggaggtggagagcttgggtagagaatatggagaccacagagtacgaagatcccctgcaaagaattctagttttcatcggcctatgtctcctgttcctgattatgcaatggagaacatacatcacatgcagagagacaatgagtttctgactgctcgtttattaacaatggaagaagaaaccaagatgcttaaagaggcattggcaaagagaaacagtgagctgcaatcttcaagaagcatgtatgctaagacaacaggaaagctccgaagcttggaagttcaaatgttgactggaaacaaacataagagtccatcaactccaaacatggatattcactttgatggtgcatttagccaaaatggaagcaacccacctagcatgacttccatgtctgaagatggggtagatgatgaaggaagttgtacagaatcttggaccaatgctctggtatctgagccctgtcaattcaaaaaagagaaggcagccaagagcagcacgacagaaagctccaataggttggagctcatggatgacttcttagagatggagagattagcatgtctgtcttctgaagttaatggcaatggcagtactgttgacaagatgaaggtagacaatgttggggctacttttgctggctttactgaaagagatggtgttaaagatttgcagtcagcttcaccaatgtcagaaactccatctaataaacagtgtctgtctgagaaatctccgcttttgaatttccagtcaagaatatcttccttactggattctgaatcaccagagaataatgctggaaaggtacttgatagcatcagaaacattctaaaggatattgaagatgaggcagattcggtgaatgtaaatgggactcatccttcagatgggaccttaagttcagagagcaaatttgccatggatcaagatcttaagaatgccatattgaaaattctagactttgtgaagttacttgatcaagaaatctccaagtttcaaggccagtcacctgattatgatggactatgtgagaaaacacaacagttctctgcattagtcgataaagttctgtcaaacgttgatgttctaaatgatattgtcatagcactgtctgttatcttgtcagaaactagccagattaagttcacattgttgagagacaatagcaatgaagcagaaagtaataacttagattgtgttgataaagtgactctacttgaaaataaggtgcagcttgagccagtaaaagacaatgttcctggtatctgcccactgttgcctcattcatcttctgatcctgagtttgaggggcctgctgatgctagattcgatgttaagactgcagtgaaggtgtactcgccggaggaatatgaacaacttaaatctgagaaggcaaatttggagggagaactagcaaagtgcaacaaaataatagaagaaacaatggctaggttaagtgatatggagaaaaaactggaagacctgacatctaagttggctgacagtgagaaatcaaatagcttgaatgagacacagttgaagtgtatggctgaatcctacaagtcacttgaatcaaggaaaattgaattagaaaatgagatagaagcgttacggtccagaatagatgctctaacagctgaactctttgatgaaagacagagtcatcaggaggacttagttaaatacagagatctcgaggagaagatggaaaggtatgagatggagaggagttcaattcttgtggatgaggacccagacaacaagtcaaagcaggagagagagatagcggctgcagcagaaaagctggcagagtgccaggagaccatattgattcttggccgtcagctgcaagctatgcgtcctccagccgagtcgctaggctcttcacctaatcggcaacgcatggaggagtttctgaaggatgcggcaggaacaaccgcaggagaatatttccagaaaccttcaggccaacctgatacagaccaggatatgcttgggacaggaaatgtgtctccgatcagtgggtacaagacacacatgatcccttctgatgcggacgttagccctttcccttctccaaacacctccaagcgcccgaagcatcgatcgagatcctcttcgtcttcctcattcaccaaccaccagttgccagacaaacagaaccgaggattcagtcggttcttcgcgaagagcaaagagtgaaactattccggatcgcggtgttaggtttgttgatttttggcgccaattgggtgggatggtggtcatgaatttctgtagagctagtgagggatgcttgcttgtgcgttctctcaggtcaggtgattcctttgggttgctggaataatactcagcttgcagtcgagcgggttgtggcgagagtgtgtgggggaatatttaagttgtcagtctcttctgctagagcttttctgggtttctgtgtgctcgaaacctcactaaaacctcactgtacatgtgcttacttgcttgaaggagcttggctgttggtttgtgtttaatcctcttgtgaattagcccgtgtattgtccttgtactggtttggtgtacaattaacctgcgcccatttcaagggtattgatgtcttccctcggttctaaaaaaaaaaaaaaaaaaaagaaaaaaaaaaaaaaaa

SEQ ID NO: 8120 - DNA, 2733 bp, Zea mays
ctcagctgatgtagcaactaaacagcaccaggaagatgtcaagaaaatatcaaaacttgagagctgaatgccaaagattacgtggccttgttcgaaacctgtctcgtcggcctgcagcactagctcaaatgaaaatggaggtggagagcttgggtagagagtatggagaccacagagtacgacgatctcctgcaaagaattctagtttccatcggcccatgtctcctatgtctcctgttcctgattacgcaatcgagaacatacagtacatgcagagagagaatgagtttctgactgctcgtttattaacaatggaagaagaaaccaagatgcttaaagaggcattgacaaagcgaaacagtgagctgcaatcttcaagaagcatgtatgctaagacagcaggaaagctccgaagctttgaagttcatatgttgactggaaaccaacataagagtccaactatgaacatggatattcattttgatggtgcactgagccaaaatggaagcaacccacctagcatgacttccatgtctgaagatggggttgatgatgaaggaagttgtacagaatcttgggccaacactctggtgtctgagctctctcagttcaaaaaagagaaggctgccaagagcagtgcgacagaaagctccaataggttggaactcatggatgacttcttagagatggagagattagcatgtctgtcttctgatgttaatggcaatggcagcactattgacaaaatgaagatagatgaagttggggctactttgtctgactttactgaaagagatggtgttaaagatttgcagtcagcttcaccaatgacagaaagtccatctaataaacagcgtttgtctgagaaatcttcgctttcgaaattccagtcaagaatatctttattactggattctgaatcagcagagaataatgctgaggtacttgatagtatcagaaacattctaaaggatattgaagatgaggcagattcggtgaacacaaatggaactcatcattcaggcaggaccttaagtttagatagcaaatgtgccatcgatcaagaacttaagaatgccatattgaagattcaagactttgttaagttacttgatcaagaagtctccaagtttcaaggccagtcatctgattataatgggctaagtgagaaaacacaacagttctctgcattggttgacaaagttctgtcaaacgatgatgtcctaaatgatattgtcatggcactgtctgttatcttgtcagaaactagccagattaagttgacactgttgagagacaacaacaatgaagcagaaagtaataacttagattgtgttgataaagtgactctacttgaaaataaggtgcagcctgagccagtaaaagacaatggttctggtctctgcccactgttgcctcattcatcttctgatcctgagtttgaggggcctactgatgctggatttgatgttaaggctgcagtgaaggtatgctcgccggaggaatatgaacaacttaaatctgagaggacaaatttggagggagagttagcaaagtgcaacaaaataatagaagaaacaaaggttagattaagtgatatggagaaaaacctggaaaacctcacatctaagttggctgacagtgagaaatcaaatagcttgagtgagacacagttgaagtgtatggctgaatcctacaagtcacttgaatcaaggaaacttgaattagaaaatgagatagaagtgctaaggtccaaaatagatgctttaacagctgaactctctgatgaaaggcaaagtcatcaggacgacttagttaaatacagagatctcgaggagaagatggaaaggtatgagatggagaggagttcaatgcttgtggatggggacccagacaccaagtcaaagcaggataaagagataggggctgcagcagagaaactggcagagtgccaggagaccatattgattcttggccgtcagctgcaagctatgcgtcctccagccgagtcactcggctcttcacctaatcggcaaggcacggagaactttctacaggacgtggtaggaacaaccgcaggagaatattcccagaagccttcaggccaacctgatacagaccaggatatgcttgggacaggaaatgtctctccggtcaatggatacaagacacacatgatcccttctgatgcagacggaagccctttcctttctccgaacagctccaagcgcccgaagcatcgatcgagatcctcttcgtcttcgtcattcaccaaccaccagttgccagacaaacagagccgaggattcagtcggttctttgcgaagaccaaagagtgaaacttctcccgattgggtgggatggtggaggacatgaatttctgtagagcttattgaggcaagccttcgtgtgcgttctctcaggtcaggtgatgctttgggttgctggaataatactcagcttgcagtcgagcgggtcgtgggccagagtgttgcggaatgtatgttatcagtctcttctgctagagcttttctgggttgctgtgtgtttgaaacctcactgtacatgtgcttacatgcatgaaggagcatggttgttggtttgtgtttaatcttcttgtgaattagcatgtgtattttccttgtactggtttcatgtacagttaacctgcgctaatttcaagggcattgatatacgtattatattgtgttgatcaatttacaggtccgggac

SEQ ID NO: 8121 - DNA, 564 bp, Zea mays
actcacaaagtctacagacgaaaattccaaatgggcgcacaactcagtttgttttaataactgcgggtacaactcttccatttaacacacagggaatatcagagccaaacaatgaggattacgatgttaggttacgtgatctaatcgtattagtcatgagaacttttcagaaaaaggctctagatgctaaaaggaaaggaaaggcttagaattcatgtaaatcttttacaaaagtagaaccgtagaagattttcctatttctgattgttttgtgcagtatttgataatttttgtccttgaggtggaatgagcttctcgatagagcaggaatttcaagagttacctggtgggcacataaatggttagaggaacgtaggatcgattcttatcctaattcttttttccttcgcattgcttactctaagttaagccatgtcactgcggtctttgtaaattctaagcagccagtgctgcaaataaacctatgagatgttcgctgcagctcttggatgacttaacatgcccatatgattgttgattttgtttaaaaaaaaaaaaaaaaaa

SEQ ID NO: 8122 - DNA, 1261 bp, Zea mays
ccggccgggaaatccctctccctctggattcctcctccggtcctcccgtttcccccttctccttccgcttcgccattccttctcggtcagaacgacgcgcatccccgcccgcacgttcctgtgctctcgcttctccggaggcgactcgggttgggacttgggaggctagcgagaaggtgctacctgggccaactcctccgatcgcccgcaggagaagggtacctctccgcctccccgccctcgtcgggcctttcccatcgccacccgcgaggccacgcgctccagctcttgtgaaccggaagggttctggatttcggagccaagcgaccagcgcggtggctcggccgggctgacactcccctcccctgtcgcccggtctcttccttcccgagcggaactcccctgcgtcttgccgcttctggagaaaaattatagaggaaggacatgcgggatccatttgatgcaccggttgatctcattaacccagaccataatggtgggaacaaactttctaggactggtgcagtgtctgctggggactatggtttacaaaatggacccaaatcctttgccccaaactccgacaccctagtcaggcatcaagtccaggttgcatccttgcacaaagacttagttttggaagatcccaatactcgtatcatggatcctgagaccaaggaactttactttagatcacaatcacaaggggacgagatcttgttgcttcgcaagaaaattgctgaggcatctctcaaggagctgagattactgggtgaaaaacatattctggagaggaggctcacagacttgaggatggctgttgacgagaagcaggaagaagctatatctggtgctttgcaacaattgaaccagaagaaaacccatcttgaggacaatatgagactggcaaatgaactaaaagttgaggaagaagagctatacttttttacttcttcattgcttagcatgctagcagaatacaatattcgcccacctcaaataaatgcttccatcattacaactgttacaaagcgtttgtaccaacagatgcatttgaagctcagatctttaaatgtgatatgactcaacctggaaatatatataatcccaatcttcagcaagtaaccctatcaagaaatgaaccttccccatcttataattcggattcaaataggaacactcttcaacagtatgctcaaggtccaagtgaccgacatatggatcaaatgtaccatggatccaattttcagcaggatactgg

SEQ ID NO: 8123 - DNA, 776 bp, Zea mays
atcaccctcggtatacccctctctcccgcgttcttcattcctaggtcagacggacgcgcatccccgcacgcacgttcccgtgctctcgcagctcgcttctccagaggcgactagggtttgaaggctaccgagagggtgctactgggccaactcctccgaccgcccgcaggcgaaggagctctccgccttcccgccctcgtgtcatctttcccatcgcgacccgcgaggccacgagcccacgagctccagctcttgttattcggaagggttctggattagggagccaagcgactggcgcagcggcagagcccggcggacacgctcccccctgtcgcccattctcttcctccccgagcggcacccccgcgtgttgccgcttgtagcatcagggagaaaaatacagaggaaggacatgagggatccatttgatgcaccggttgatctcattaatgtggaccataatggtggctatcaactatccaggactggtgcggtttctgctggggaccatggtttacaaaatggtggacccaaatcccttgctccaaactccgacactgtagtcaggcatcaactccagggtgcatccttgcacaaagacttagctcttgaagatcctaatactcgtatcatggatcccgagaccaaggaactttactttagatcacaatcacaagagggacgggatcttgttgcttcgcaagaaaattgctgaggcgcctctcaaggagcctgggtttgctgagtgaaaaacacattctggagaggaggctcac

SEQ ID NO: 8124 - DNA, 1221 bp, Zea mays
aaatatgaatgctcttcaacaatatgctcaaggtccaagtgaccgacatattgagcaaatgtaccatggatccagttttcagcaggatactggaggtactactccctctaattattttgaagaaggaagagtagacggtggctcacagttatacccatctgatggtgatgctttacctggtattgagggatttcaaattgctggtgaacctagaccaggatgtcaattaacagcatgcggtttccctacaaatggtactaccctttgcaatttccaggtatgttgttttctgctcttttgttatgattttttataattgctataaatgtcaattcttgtaaataaaacctttcaccccattgatgttgctgttttagtgggttcgccatcttgaaaatggtatcaaacagtctatcgaaggtgccacgatgtatgactatgtggggactgcagatgatgttggtactcttcttgctgtagactgtacgcctatggatgacaatggccgccagggtgatttggtgacagaatttgctaataatgggaataagataacatgtgatccagagatgcagagtcatatcgatgcatgtatttctaaagggagagctgaatttgaagtttttgtcctggcttattctcctgaggaatgggaactggctacattggtgctcacacgacctaattatcagattaagttcaaacagaccggtaatgttgtaattgacgagaagtactcacaaagtctacagacaaaaattcctaatgggcgcacaactcagtttgttttaataactgcgggtacaactcttccatttaacacacagggaatttcagagccaaacaatgaggattccgatgttaggttacgtgatctaatcgtattagtcatgagaacttttcagaaaaaggctctagatgctaaaaggaaaggaaaggcttagaattcatgtaaatcttttacaaaagtagaaccgtagaagattttcctatttctgattgttttgtgcagtatttgataatttttgcccttgaggtggaatgagcttctcgatagagcaggaatttcaagagttacctggtgggcacataaatggttagaggaacgtaggatcgattcttatcctaattctttttttccttcgcattgcttactctaagttaagccatgtcactgcggtcagccagtgctgcaaataaacctatgagatgttctctgcc

SEQ ID NO: 8125 - DNA, 1124 bp, Zea mays
ttcggggactatcgcgaggtggccaagaaggaaaagtagcggcggcatggggtcgcccaaggcggccaagagcatggtgaagcaacgcatctggcgtcaccggctcgtcgcgccgttcgctgccgttctcatcacggccgtcgtcgtattctccggcctgttcgcgcaggacccaagtgccacctcggagttcactgccgtgaacgcgggtaacaccctgccagtgcgcgataagtcggaatccacaggtgcagcagccagaggatctcccaacaaggaggatcttgcaacagctgcatttgagcaagaattggatgttggaaattctgagcccaagctttccaaggcaccgtgcctgcagcaggcgagagagggacagcaacggcagtgccggtccaacgagaaagaagcagtggaggatctgaacctgaagagaagcaatcgcccccacaggaccaggaaggagaagaaacctctgctaagtcaggagctagcttctgtgctcggacggtggtacacaaactggaggaagaatatgtcctttgtgctctgctggagcctcggctctcaacaaactcctctctaggttgctctcctcgggctttctatctcaaggagatgttttcgtgggtcgaggttgtatttttgttttgactttgtacttttgtacggggttcagagaggcctctcaataactccctgtactattttttttcttctttttaatgaaatgccacacgagtttattttgcaaaaaaaaaaaaaaaaatatgttttataaaaaaaagatcaaggattgtttgtttgggattataatatgtctagattatataatctaataaattttataattatataatccgtgttaagggcgtcttcaacggtactttaaaaacgatttaaaaatctcgttatacatatttttgataagtatcggaaagacccatgttttctaataatttgttagataactacgcactttgaagattaaattaattactaaattaatcacttcataaataatggataaatcattcactgcaccttctcgattctcatatagtgttcaatctgtgtgcgcatgaattttatatatcttcctgtcttaattcattcagggtacc

SEQ ID NO: 8126 - DNA, 2139 bp, Zea mays
ctcagttggaggcttccaagagaggttctgaagcaagtgtgggatttgtctgaccaagacaatgatggcatgctttctttgagagagttttgcatcgctctttatttaatggagaggcaccgagctggaattcctcttcccctagcccttcctcgcccgcgtgggcatgatgagacactgttacgagctacaggcttgccttcaacagcatacaatgggccatcatggcaacacaatcaaggaggattaccacaaagaggccctggagcacctggggtgcctgctggtggtgtgcggccacccttgccaccacatttgcattcacaaactgacggggctagcagaccagggcagccaagatctcacatgcctgggatggataatcatgtggtagttcaaggaaacaaagatgacaaaagtggagtgaaccagtctgtgcaggaggtggcggatcctaagaaggttgaggtggagaagcaggtcctggattccagagagaagctggagtattaccgcacaaagatgcaagatcttgtcctgtataaaagtcggtgcgacaataggctgaatgagattacagaaagggcgtcctctgataaacgcgaggtggaatcattggccaagaaatatgaagagaagtacaagcaagtagctgagttagcttccaaactagcagttgaagaagctgcatatcgcgatgttcaggagagaaaagttgagctgaatgatgcactgattaaaatggttcaaggtggaagtgttgatggtctgcttcaggttcgagctgatcgaatccaatatcaattagaagagatggaaaaagctcttagtgaacggtgcaaacactttggacttcaattcaaatcatccgcatcagttgaacttccttccggttgggaacctgggccacaagagggactcattgagtgggatgaagattgggataaatttgaagacgaagggtttagtattgttaaggataatggtacaatacaggaaaacccaatttctgctgaaaatggaaaagtgccatctctttgggatgatggtgatgatatgtctcctgttgcatcctctaatggtcatatcaaggaagaaaggcgttacagtgtaggtgatcaagtggctgagagtgaaatagcatatgattttggtgatgaatctgtgaggagtcctggaagtgctggaagaagtgcctcagggagtccatttaaatcttcccgctttgggatgcatgattcatctcccagtaaaagggaaagttacagtgaccatggcggttctgaatctgtttttggtgacaagtttggtgatgaaacttcctggaactttgatgatcaagatactgactctgtttggggttctactgcactgaacgctgaggcggaccaacacggtggcagtggcacacataactctttctttgggtccgaggcaggctctccaagtggcgctagtgtatttggaaagaagaggagttcgttctttgatgattctgtcccaagtacccctgcatacacatctgggttctctccaaaattcggtgaaagccgtgatgatagctcctcttatagctttgggaagtttgattccttcagatcccaagacactgggttcttcccccaggaaagtggtttctccaggtttgactccattagcagctccaaaggcgaggatgtatcaggattcgatacagggaatagctcaagaaattttggtcggtttgactctttcgatgacaccgatccgttcggttcgagcggaccttttaaagcatctggaagccggtctccacccaagttctgatacgttttctgctctgagtagggatttttgtgtcttgcgtcctgctgatttgtcaatacaaggttcagattctttgagcgaactctagcgtaacatgaatatttctcctttgctcgacatttcttccgtttgccttgtgtgcaatttttccaggccatctcacgtacaaagtggacaggtttgggttatatctttgtatttgtataaacatttttctgtatcttgtaaattacaccaagtctgtctttgtttatattagtttatacgtacgaaatcacttctcctccaaaaaaaaaaaaaaaaaaaaaaaaaaaaaaaaaaaaaaaaaaaaaa

SEQ ID NO: 8127 - DNA, 1340 bp, Zea mays
tcaattagcagagatcgggaaagctcttagtgaacgatgcaaacacttttgaacttaaattcaaaccatctgcatcagttgagcttccttccggttgggaacctgggccacaagagggactcattgagtgggatgaagactgggataaatttgaagatgaagggtttagtattgttaaggataatggtacaatacaggaaaccccagtttctgctgaaaatggaaaagtgccatctctttgggatgatggtgatatgtctcctgttgcatcctctaatggtcatatcaaggaagaaaggcgttacagtggaggtgatcaagtggctgagagtgaaatagcatatgattttggtgatgaatctgtgaggagtcctggcagtgctggaagaagtgcctcagggagtccatttaaatcttcccgctttggcatgcatgactcatctcccagcaaaagagaaagttacagtgaccatggtggttctgaatccgtttttggtgacaagtttgctgatgaaacttcctggaactttgatgatcaagatactgactctgtttggggttctactgtactgaacactgaggctgaccaacgcggtggcacgcataactctttctttgggtcggaggcaggctcaccaagtggcgctagtgtatttggaaagaagaggaattcattcttcgacgattctgttccaagttctcctgcatacacatctgggttctctccaaaatttggcgaaagccgtgacgatagctcctcttataacttcgggaggtttgattccttcagatcccaagacactggatccttccctcaggaaagccgtttctccaggttcgactccattagcagctccaagggcgagaatgtatcaggatttgacacagggaatagctcacgaaattttggccggtttgactcttttgatgacgccgacccattcggttcaagtggaccttttaaagcatcgggaagccggtctccacccaagttctgatatgctctctgctctgattagggttttgtgtcttgcgtcttgatttgtcaatacaaggtttagattctttgagcgaactctggcgtaacatggatttttttacttgacatttcttccattttccttatgtgcaattttcgagtccatctcacgcacaaagtggacaggtttgggtttatatctttgtttttgtaaacattttttctgtatcttgtaaattacgtcaagtctgtctttgtttatatagtttacatacatgtatgaaacaacttctcgccatataacctattatttccttcaccatattaacgttgatatggtatagcaggaaatcctgtcctt

SEQ ID NO: 8128 - DNA, 3989 bp, Zea mays
  misc_feature (489)..(489): n is a, c, g, or t
  misc_feature (2713)..(2713): n is a, c, g, or t
ccgttacaacggacggggtatctacctagtgtacacatataatcgtatcgttgattggattattcatcgtcaggtgtggggctgtcaggcggagatgggatagttagcggtagtaatcaaccaccttcacatcggctaggcgacaggtggttttgggcaaacaaagcatcatccgaagcaagcaacgtccatgacaggttttgctaatgccactgcactagaggacaaacaacaaggacaacaaggtgaccgtgaggaggaccaaggacggcggcaggcgggagtggacaagcgggatctcgcctcagaaatctcgcaacccacagcctggcctgctgtcatgtgctgctgctgcctaacggagtataattgattactatttcgtttctgtttcatgtaattaatgtatgtaattaaattaattgctcccggccatagcaagcaccagcaagaagagagagacagagagagttggtgaagtcggggganatggtttctttctccgcttcctaagattcctctttcttccccaaccccaccctacgccttttgccacgccgcacggccgctccctcccttcatgcgccgccgtatctcaggtcagcatcgccaaccgcagctccacctcccgatcccagccccaatctaggaggaggaggaggaggagaaggccactttcaggattctgacgaagccctccctccctcggccgcatcgcatgctaccacgactgaccaccaccagcagcagcagcagcagcagcaggaggaggagggcaggatgttcaagcttcaccgccaccgctcctccgaccgcgtcggcgagcgcttcgacttcagattctccaacttccgcgccgtccaggttgctctctctctctctctctcatcctccctcgggggctgtcctactcctccactctctcagtaccaaaatcatttctttcccccttccttccttactcacgtgtggcgcctacatcagcaaaggggtctcactcccctggcgattcagtggctaccttttgccattcagtcagtcaactccctcaggggcttcgttgaacttcgtttcacgagctgcctgctattcatgtgtacgtaggtgtaccccgaacgaaataaagtggtccttcctcttcattctaacaacggcctagcctaataagggggcacatactgcactgcccacttgtatcgttatattgcgtgtgccttctcattcattttcatttatcatatgaattccctgcagtttatcttactcacatgacatgtatgtatctccttgtttctgtgcctcatcgattcgctccattcttttccataggtccctgcagtgtcagacaggctcttcctttccatagtttcagtcgacagcggaaggacaattgcaaagtccagcaaagtagcttctcggagtgggatatgccagtggcctgacacaatcttggaacccatatggttctccaaggacgaagtctccaaagaattcgaagattgccagtacaagattattgtttccttggtctgtactggaatgcatacctcacctgttcttcttggatgttcgcttcctgcttcaatcttgataccattgttgggtctgtcactaacaactgccctcgtgtaatgttctgttccagggatcgacaaaatctggcattcttggggagatttttctaaatctgtctaattttctgaatatagtcgatccaaccgcaatctctttgccactgaagagatgcaacgccggaacagttttacaggtgtgtttcggttatttatcacacgtcttcgttttcatgggccatttgggcatagcttacatgatttggtagcgaatgaaaaaaaatgctggtattgcattcccatcataggtgccaactgttacataagtgcctatttcatgcttgtgcttttgagagcatacctgatggtgtccttactactgcttatgttgatggccatatttttcccctcacgtgcagcttaaggtccaatgtcttggcacaaagtctaagctgaggtaactagactgaaccctcagtatttcattcttgccaggttctgttcagtcttctcttccctcaaatcctgaattttgacaattctcccatttctatgtagtggtgtcagatcactgagggacatggctccccgtctcgatgaccgtagtccaacgccaaccaatgatgagatggacaataagtcagattgctctgatggtatgttcaacaggagtgttcgttcttcatccgaaaatcatctggttggaacttatcaagatgaatctggaaacagggtaagctactgcttaaaacaatttgctctgtcccaaacattgagttgtctttggactgtttctgatgccttgagagatctatcccattttcactgaaattgttgattacatgaataataacatggaacttagttgtcaatgttatatgttcaaccttgtaggtaaaacaccttattttcatgtttcaatctcagaccctggaagggaatgaaaaaagaatctgcctgtggatctttttctgcaaagctgatgaaaccctgtgcctttagtcatcaagcaaaagtcttgattttttttcagttattttggggtctgctatcttgcacaaaagctatgataagttctaattcctactcaatgatctatttataaatctaaaatcacataaaattcactagtggtcagcagnccacaaaaaccataacagtaaaccacatgagtacaattatgtgtggatgatctcatcctttacaaatgtccctctgtgggcacatgacctgcatgtatgcataaattcacaagatactcaaatgtagaagcttgtgaacctactgttacttccaccacgaagaaaacctttttaggcagtaaagattttttgcatggggattcttgcaagctcctcgcattggggtatagttttctatatggactgcaatttcaccagcagcaagtgacatatttttttggttacatgtcatgctctatcagagtattatgtgctatgctgattatctatcccagctttttcttttttgcaggaaacaagtttctctgcaccagggtcccatcggagttctaattctggagatagtactgcggatagaacaaacttctctcctagagacaactctagtggaggactttatgtgggaaggcaggattctgctagttcctatgctagttatgttagtgctggtcgtggcgatgatgggcttagatccaataattcatcttttagttctcgggcttcaggcccaaatttgctgcaagggaatactccaaaaatattttcaaatggcctttctcaattatctatgggggcatctgactcatctaaagatcttcttgaagctgctgaagaaacaattgaggagctccgtgatgaggcaaaaatgtgggaacgccactctcgtaagttgaaggctgatctagagatgctaaaaaaggagtgttctgaaaaatcaaagcaacatgctgagctagcaggcgagctgtctgctgcacaagctgaacgggattcctataggcatgaaatagaagaattgaagtcatccttacaagatgtaaacacacggcagacaattacaggaacacctaaacgttcagactggatagacctgcagaaggaacttgaaggtgaggtgaagtttcttaaagaatcgaatacagacttaaccatacaactaaacaggactcaagagtcaaatatagagcttctttctattcttcaggaactggaggaaaccattgaagaacagagagttgaaatatctaagatttcaaaggtcaagcagactgcttatcctgagaatgggctgttagtaaaaaaagacagagagtgggctaagaaactgtcaatgaaagaggatgaaatcacaattccgagggagaaatcggatcgtgctctcaacattggaaatgcagatggtgcagcttccaatgccatttatcttgatttggag

SEQ ID NO: 8129 - DNA, 3989 bp, Zea mays
catacaaaatgtaatttttatggagatggagagttaaatagagtcaaaaaatgagagtccttagagatgctctttatgtatacaaccaaatagccccctttattttctgattatggcggattaagggtggagttttattatgcacttcagtaccgatcgaaacaataggcgaacggcgaggtgtaatgagaataatttatatcaaaagagcaatcgcgcgattgatgggagtgagaaaaggaatgtaacgatacgtatgatctcctaggtttgactggatgatatgggagattcaatttcctatataactactacgtgattaccgatttttaatatctaattatgcggaaggattaataggtagtcgatattgaatgggtcgcaggggtcttcaccacgccagatacacaaatctgtttgcgtatttttagttaaaaataaaatagactaaacatgtagaatacaatagatattaatatatatatatatatatatatatatttaaatagggagaatcacttattatagtgagcagatataaagaggtgtttggtttctagtaactaattttaatttctttattttattatattttagtcttaaattaacaaatatgaaaatcaaaactatattttagtttttatatttaacaatttatgactaaaatggaataaaataaagagactaattagtctatagaaaccaaatatctcaagtcaactggacggttaaaataattagtcgatacaaaatcagtagtactctgcagccacctcagacaaaaaaaaagtagcgcgtgtgaaagagccgacatctgatttggacatgggctgtactccatttgcatgttgctgctcaacaatttattcctcaaaccatcagtgcaattgctagtattctgttaattcacatataaatagttactccatctgttcgaaaataataatcgttttaatccttaatttctatgtctatattaaatggatgataagattcaatattgtaatgctaaacttaaggaacgtttactatctaccatggaaaataacaggcaaaaaaacataacacgtgcttgttggacacagatatttgtttcaaaaggggcaacctagatcgcagaataattttcagaaaatccttgtaaagtgacagtgaagtctctcctaacctcccgtttccgtcccacgctttcccgtttccgtcctaccaaccccatggagcctggaccttgagcccgagcatcctgccgtgcctgctctgctataagcagctgctgctgcccaaagcagccgacgccaccgcccacacgtctcctccacctcccaatccccacttgttcgcctccccccggcctccctgatccgtgccgccctcccccaccccgtcaaccaggagcgcagccgcttgtcggtgcggaaatgcgggttcgtcttgcggcgccgcggtgagctattgattgctggtggtagctcgccccgggcaccggcgatgggctgcttcccgtgcttcggctccacgcgcgaggaggagctcaagtactacggatccaagggccccggcggaggcaatggcggtggtgggcgagcgaccgcgtcctcgtcctcgtccgctgcagctggtggtggaggcggccgggtagaagaggccgtggtggcgccgccgcgtgctcagaggggccccgcaggtgcgtgttgtttatgcgcgtctccgtctctccctgagaactgggatccttccgcttggtttgttgttgggatcggaaccggatccggccgaggtttgatgctccgtgttagtctcttcgcggtggttgggttggtacgaatggagcggctgattcttgtgcatgttgatgtgattgagggaaatgacaggaacgattctgtgtttccttcagatctttttacagtattattagaaggggggaaaggtatcgacttgtatctccaaattcagaaacgtgatgataatccgttgattagagaccgggatatgttttctattatgattagtatatttgcttgcttgctgagttgctggggtatgactgtcttgatctgcatgatcatgtagacaatgcatatgtgcaggggccgacaagacacgagctaaaggcaatgctggctcgaagaaggagctttcagtactcagggacgccagtggcaatgtcatctctgctcagaccttcaccttccgccagcttgcagccgcaacgaagaactttagagatgaatgcttcattggggagggagggtttgggcgcgtttacaagggccgccttgacatgggccaggtaatgagctttgttgtcaaaacggggcctcgacttttcttgtttcatgctgttggactagtacaaaagtggctcagtcgtaccaatggcgtcattgatctctctaggacattcaagaaaaagcagtgtttgcacatgtgtggtggatgcccacaggcacaaaaaaatatgtgttcacctatagctgatccaacttgtactggcctgataaattaggacactatggactgttatgtaggtccttcatttttaattcacaggatgaatgacatgaaacagactaacaagttttgcttgccatttgatttgcatacaatgacttgaaatcctgaactgcaagatgagacactgcattagtattttactgaaatgatgaataatctactgcaggttgttgctatcaaacagctgaatagggatggtaatcaaggaaacaaagaatttctagtggaagttctcatgcttagtttgctgcatcatcaaaaccttgtcaatttggttggttattgtgctgatggagatcaacgccttctcgtgtatgagtacatgccacttggatcattggaggaccatttgcatgatctccctcctgacaaggagcctttggattggaacactaggatgaaaattgctgcgggtgctgctaaagggctggagtacctgcatgaccaggcacagccaccagttatttacagggatttcaagtcatcaaatattctattgggcgagggcttccatccaaagctatcagacttcggtcttgctaagttgggtcctgttggtgacaagtctcatgtctcaacgcgtgttatgggaacatatggttattgtgctccagaatatgctatgacaggacaacttacagttaagtcagatgtttacagctttggagttgtcttgctcgagctgattactggccgaaaggccattgacagcaccagaccagcgtcagagcaaaaccttgtgtcatgggcacggccccttttcaatgacaggcgcaagctcccaaagatggctgacccgggcctggaggggcagtttcctacacggggactttaccaggcgcttgcggtggcatcaatgtgcatccagtcagaggctgcatcgcgcccactcatcgccgacgttgtgactgctctgtcataccttgcaaaccagatttatgatcctagcttagcgcacgcatccaagaaagcaggcggcagcgaccagcggaaccgggtcggtgacagtggaagggcgctttccaagaatgacgatgcaggcagctctggccacaggtcgccgagcaaggaccgggccgactcccccagagagcagttcccgggggctgcgaacaggggccaggacagggagcgaatggtggcagaggcaaagatgtggggcgagaactggcgggagaagcggcgagctgctcaggggagcctggattctccgaccggaggcgggtagcgtcagtcaccaaagactgtttcgcccgtgcgtgctctgtctcagactgttttttgcctttgtgtggtgaggatgaggattcccgtgtttgttaggtgtacatttgtaggtgtaaaacaacagaaaagggaacgttggggtgaaaatggagggaagagaaggatgcttgttctggatgtttatgagtggtgcctgtaaattatcggaaaattttgcaacggtgaaggactagccacgttggaag

SEQ ID NO: 8130 - DNA, 2669 bp, Zea mays
gggaacttaaatcccctctcgaattccgggaattgggtggaaaatgaactaactctccccccccctaatccactggaatccaagagaggatttaagtttccaaactagccctaagagatttcaacttgttagagatttaatcccctcaacgtctgttcgtttggtcctaaaacaaaggggggttgagagggattaaatccctaagtcaaagccttcccaaccccctttaaacccctctaatccctttgtttttgaatccaaacaaaacacatcaatcctcttctatcccctccaatccctaccaaactgaacaagccctaagatgttactgtccaaagtaccattgtcaattgacctacctcattccttgttaattgacctactctcccgccagcctgggccatcggcataagtttgcataaaggacccaagacttcactgcttttatgcatagaaatctatatgagtccttggccagttttagaaaaagcactgaaactagtttctctctgaaaaatgcccctgtaacctgttttcagaaggacttccatgtttaggttccgtcgaaactagcgcccacacgatcgatataacaagttttacagtttaatgttcttttcatgtaccgttgttgttgctcgatgcaccgttcacttatatgtatatatatttgttcgtcattcgttacgtttagagcagttcacaatcactgaagagcaaacttttgaacagtctgagcaacaatagtttcaaagaagccaagtgtccctttactaaactgattatctaataacttttaatcattttattttagacatgtgtttaattttactagaggtggagctacagggtatgccccagtatactctgttagccttcgaagtagagcaacatgatctgaaatattgatattctcaaaccactacttaagcaactcttagaaagacaagcttgtctattcgaaagagagtgttgttaaacatggtcaaccgatctggttgtgctaagatagattgcatggccataattgaacaaatgaaagtaacagaatctgacaggaagaactcccattctagcatgctgttatgcaaactgattttactaaatgtatgtggttgctgtctgatccaacaaacaaattatcccgtggcgtgcaagcaagcataacatacatcggtcagtttccaacagtttagctgttcaggggcaagtatgtacctgacagctctgactagcctcattattgtcttcgctttagttctctctctgccagccatccttcatccaacggcccggcctgtggacctggacggctgtggaaatgcctgcctggtcaaatgcccgccctattgccgcttcccctatggccttggcaagtcaagccacagaggaagtgcagacaggaatcttgcaaaacgatttgatggatgatataaaagcaaaacagcaaaggtaagataactgaaactaaaacaaccggggtggtgaacttatactctggaaatatctacgtgaatgcgtcaggcacctgaagaatatcacagtgatgtaagtacaagggtaactcactagctcctatagttcctaaactgcaaacatgtcaaaactggcacccactctggcagtctctattgactacaggaacatttccctcccctgaaaatgtggaacccagacgagtccctgaccgaaatcactttaccggtggcagcagaggcgtgctccaagaaagagtgacagtccccacacatgcggatgttcttcacgacgcggatggtctgcccagggcctgccatcagaagaccgtacatcgatgctagcttcatgctgtggtacatcaggaagtgcctcttctggtactcctcgacgtcgtgcagaacaaaggtggtgtctggctcgtacccggccttgatgcactcgaggattagcacatccaggccagcgtatatgtccctggactgtgggtgtgatttatcccgtgcgaaaaatgagtggaccatgttgccatgaaacgtccagctcctggccgggatcttgcgcatacccttttcatacatctctagccttgtgttctcagaggagcgccaccttgctgattcagatagtaggtttgaagtcagcacgtacgtggacgggtcttgtggttccaatgccagcagatgcttcatggcccgcctccgcacagccatgttggagtgcttgctgcagctgtctagcaaagaccgccaaactaatgcaccaggctgcaatggcataccacctataagctgctctgcctcgtcaaaacggccccagcagccaaggacataaacaaaggctgcatagtgctccatggctggttcaatgccatatgtgcttggcatagaaagaggggggggccacgtagctgatgtggagtctgagcttgtgtgactgcaagcagatatgaccagaagaaaggtaatggaatcaggcctgaccattgatctctccatctcagaccatatcttcaatatatcatccccctgatgaagaagaagatgggcagtgatcattgcattccatgacaccaagtctcgacaactcatccgctcaaacaaactgattgcatctttcaactccccacacttgccgtacatactgataattgcgttaccaactccacgagtgctcagaagcccgacctgcag

SEQ ID NO: 8131 - DNA, 1723 bp, Zea mays
caggtgaataggatctactatggaagttcgcattcttgattttagtagaacccgccaaggtacataaaaggtaaactacaagtttattatatatcttgataaacgatatacataatttgatacggatttgaatatttttgttcttatttgtaataatatcaaaagatcagccccaaatttgtttattcaacttggccaggccaaggcgaacatcccgagtcatcgtcaacgctggggttgagctggtattctggtcccggtcccttgcatgttccaccaccacgcccatggtctttggcaccgggcaccttcctggcttcctcatcgcaccatccgcagcaaataccacgggaaacacagccaccgtttcacagttcgcctcgcctcgcctcgcctccctctcctctatataaccagcggggcgttccgcgcgcccggccggggggacctgtccacagtccaccatacatatcactctccgctccgccattgttgctccttattagtagttcgtcccgcgtcccttgacagttctatctatccccaccacaaataagagaccacctctctgccttcttctcggaggtcggagaagagctctctgcttcattcggccggtccaactccaccgaccgatccaatccaacccactgaccatggggttcccgccggtgtgctgctgcgcccccatccccaagccggtcgtcgccttctgcaacctgctcggcgccatcaaggacgccgtcctgctgacgctcgccgccgtgggcttcccgcacgacgccgcgcgcggctcggcggacgcccaccagcccgaggaggtgaagacccggctccccgccgtggagtacgcccagctcctggccgagcagcagccgtcgcccgccacccacgcggcctgcatcgtttgcctggacacgctggaggcggcggacgaggtgcggcggctgggcaactgcgcgcacgccttccaccgggcctgcatcgaccgttggatcgacctaggccggacgacgtgcccgctgtgccgctccgacctcctgccaagcccccggggccgggccgggctgctcgggctgggccggctcgccagccgtctcacgcgcgttcgcgtttggtgaggaccgtctcggaggccacttttaccttttcggtggccaggccgcggtcgcagcccatcccggtggtgccggaacggcgcggacacgttagcgacggcgaccgggccgccggatggtcttaaatctgctctgccacttgccaaccgctaatcaaccagcgggcttaattagcagcggattggcttggtgtctgacagtcgatattatgacagctaaataagcagttaaatgtttctaaaaaaaaaaaaaaaaacggcagctaaatgtttcgtatacagtggcggacgcaggacgaaaattcaggaggggccaaaaagatcatatgagagtcatgattttctagttcgccaagtccattgaccgcaggggataagtcaaatcgttgcgaagagcgagatctaatttgtcgagcggatcgatgtcacgagaaaaacaggacaagggacggaggcgctaggaaggggcgaagtcgggtggcgtcgcatcgggaatgggtcgacgacggaaacagggcagcgagcagactgatttaggtggtgtcgggaagattagagtcagactggtagatgcaagtactgaaacgagaggatccggcgagcaga

SEQ ID NO: 8132 - DNA, 1061 bp, Zea mays
tcgaggcctgccgggctgtcacatgtcaccatacatatcactctccgctccgccattgttgctccttattagtagttcgtcccgcgtcccttgacagttctatctatccccaccacaaataagagaccacctctctgccttcttctcggaggtcggagaagagctctctgcttcattcggccggtccaactccaccgaccgatccaatccaacccactgaccatggggttcccgccggtgtgctgctgcgcccccatccccaagccggtcgtcgccttctgcaacctgctcggcgccatcaaggacgccgtcctgctgacgctcgccgccgtgggcttcccgcacgacgccgcgcgcggctcggcggacgcccaccagcccgaggaggtgaagacccggctccccgccgtggagtacgcccagctcctggccgagcagcagccgtcgcccgccacccacgcggcctgcatcgtttgcctggacacgctggaggcggcggacgaggtgcggcggctgggcaactgcgcgcacgccttccaccgggcctgcatcgaccgttggatcgacctaggccggacgacgtgcccgctgtgccgctccgacctcctgccaagcccccggggccgggccgggctgctcgggctgggccggctcgccagccgtctcacgcgcgttcgcgtttggtgaggaccgtctcggaggccacttttaccttttcggtggccaggccgcggtcgcagcccatcccggtggtgccggaacggcgcggacacgttagcgacggcgaccgggccgccggatggtcttaaatctgctctgccacttgccaaccgctaatcaaccagcgggcttaattagcagcggattggcttggtgtctgacagtcgatattatgacagctaaataagcagttaaatgtttctataggattgagtatacacggcagctaaatgtttcgtatagtagtgctcctaacagccatcttcattgtacatgaatgtcctctatccgatcctttcatatagtataacagttaaattattccaaaaaaaaaaaaaaaa

SEQ ID NO: 8133 - DNA, 989 bp, Zea mays
ccggccgggaccgcaacaccaccagcaatccttacttccattgatagacgatcgagtcgtgtgcgcaacaaccgagctagctaggatggcaggatgctgggcagtgttgctgccatcggcgctgctcgtgtggatcgtttgctgcaactgggtgctgatcatgagtgtggacgccgggtcaccgtacggcgcaaacatgactgatctgatgcgccatgtgcagttcttcgacgaggacagagacggccttcttactattccggagagtactaaaggttttattgcgatcggattgacccctgccttcgcactttctttggccacagcgacccatgctgctttcggccctttgacaacccctcctggaaagttaccgagcataaatatctacgtgtcccacatccacggagcagttcatccaagtgactcgggagccattgataagaagggaaactttgtccccaaaaagtttgaaagaatattccagaagttttcacacagtgaggaggacgccttgtcatggttggagatagaggcgatgctcgtcgcaaacagggactttcttagacctctatcatggcccgaggctgagacggagtggcagctgatccacatgctaggcaaggacaggcacgggtacctccacaaggacaccctcagaggcgtctacgacggcaccgtcttccccaagatgcgcgaccacaccatcgaccctcatgcccgtcacagcgatgcctgatgatccgatgagctcagctccatggatgataacatgggttctcgtctactgccggtgcaataataaaacagtgtactgtacatcgtcgtatgtaatgtacagaacgctatatacaccacgtttatccactgccagtgttttgtcgagtgtcgcaggcactcgttaatggctcgataacactcgacaaatgctttactgagtgtgcttggtaaataggactcggtgaattatactaaaaaaaaaaaaaaaa

SEQ ID NO: 8134 - DNA, 1557 bp, Zea mays
cattgggtacctcgaggccggccgggaaaatccttcactcgtccctctctcggtctgtccctttggagcgaaggcgaaccgcgtcgcgaacccaggatcccatcgagggcaggcgggcagatcccggcgtccgacggcgatgggcgaggaggacgcgagcgccgggggagatccgcagcggctgaagcggatcgccgctgcggcgtacgactacgagaacgatgcgcggtgggccgggtactggtccaacgtcctcgtgccgccccacctcgcctcccgccccgacgtcgtcgaccacttcaagcgcaagttctaccagcgatacatcgatcctggtttggttgttgaaccgatgtcctccatgacttcaactcagtctagcagaccagcagcgaagtcttcagctacaccatctagtgagaatgtcagagctcgggactcaggctctagcacgagatcaactgggacctcccaacatccaccagcagagaggactgcaaattcattacagctagacggacggacaataaacttttctatcaatgcctgggtactggttgtagctagtctcggaatactcccagttctacccaaccatatctcgagtaaagcataccgtctttcattgctaggaacaatatgctcgtctgcatattctttatatggcacttatgggaaaccaagagcatggaatatgcctgcaattcagtcctggttgcagtctattattgtagctaaggactttgttcacttgatgttctctcttatgatgttcacatctaatgtgcactttaagattgctctacttcctgtgctttgctgggcgcttgatcatgttgctcgattcctaaggcgtaattttacacactcttctttatacaggaagtacttagaggacccttgcctatgggtagagacaaacaacactacactcagcctactttgttcgaatgctgaaatcaccctggggtttctcatgatcatctcgcttttctcgtcgagacgcaatataatccagacatttatgtactttcatcttttgaagttgatgtaccattctcctgtgacatctggttaccaccagagcgtgtgggcaagaataggccgggctgtaaacccgtacatttaccgctatgcgccattcctgaacacacctatttcggcagtccagagatggtggctgaggtaggaaagcatggaccgcagcacagtgaaaatatgcctaaacagctactctgatctcagcgcctcgatcttttagaaggcgtgcttgcacagcgtgttctgttcttgtaaaggttgtattctcagttcatgtcttactgagctactgaaggcataacgctagagaatttcttacgatgagcagtagagcttgagcaaactgtcgatttgatgggatacagttacaggcataaagtgattgcacagaattttcataaggatgcttgctgcagtcaataggatggaacatgcgagtggcactattgattcttgaagtaataaatgatgttcttgtctattttattttgccaaaaaaaaaaaaaaaaagcggcc

SEQ ID NO: 8135 - DNA, 1063 bp, Zea mays
ctcgagcctgacccttacgccttcgctcgcgccgccgccgccgccgccgctacgccccgcacctcgcttcatttcgtgtcgccaagatgacgaagcgcactaagaaggcaggaattgttggcaaatatggaaccaggtatggtgctagcttgcgtaagcaaatcaagaagatggaggtatctcagcattccaagtacttttgcgagttctgtgggaagtttgctgtgaagaggaaagcagttggaatgctttatcccttgttttctggaaacttcgtaaccatattttctccaatgaaaccgactacaacaattcccatatttcctcttcagaaattgctgaatcaaatgcaaccagccaggcgaatatttattcaacaatccaatattcagtggacaatggccataaggttgatcatagatcccctctcagttatggagtggactctgtggaaaagtctttcagtgatttagagctcagttcttcagaaattcagaaacctgataacgggaatggtgtcaggatcaacaattcagatagcgggattcagaaccctagtgactggaatggcattgtaaccaataacttaaatgatggaattatttcttcagatgaaaacaatcttgtgaggggagctgagcatgctgcgataacaagaatcacatacgagactgctgtttctgggagtatcctaactcttgtttatggtgataatgggagcaacctggccaagcttacagaggtatctggtgctgacattatcgtctacaatccaccttccgagggcaacgaagctatgatcgtggtttctggaccaccggatcaggcacaatcagctcagcgcctactcgtcgagttgatcctacagggacaccccggcacctgcctttctgcttaatacggcagataaccttgtcgtgaaatatacaacgatggttgacgtgcagactgttagctggggaactgaattttatgactcgaactgcgtggggaatatggagtttgaaccatgtgattgatacgttgtgtacctttatctatacgtagtacttatccggtgccc

SEQ ID NO: 8136 - DNA, 10690 bp, Zea mays
  misc_feature (7132)..(7132): n is a, c, g, or t
  misc_feature (10270)..(10270): n is a, c, g, or t
cctcgaggccggccggggtctcggcggcgctctcgcggccgggcccatcctcgatgagtcaaccggcggttccacgagctagagattcgctgggaccggcgcttctcgtccgccgcgtacatcgaccttccgcccacctcgctcagcatcaaccactcctccgacgcgtctgccagtgcgccgcccaccccggtcgcggtcatcgcagacaattggggcgggtgctttgacgacggcgagcagtaccgcactaggccatccgtcgtcgtcgacaactggggcggattcttctatggcgaggacgtcgctccgtcagacaaccccacgagattcgtcctccccgttgcctccaccgacgagcccagcatcgacaccgcgccggcccgcgccaactctggagccgcggatgactccgtgtttgtgaccgccgaatcctccggctacgaggaaccctccggctacgacgagatggatgctcgactcgacctgcgcttcgccaggctgcagcagctgcaagctgaggaggtggacgagccgtaccgtgacgcggtgagcccactgcctcctctacccgtcgtctacgagccgtaccgcgaggcaagccatccgcctcccgtccacgacgacgttgcgggggtggtgtccacgggctcggatgatgacctcgacctgcagcagatcgccaaggagccgtccgtgtcgtcgccgccgcgtcacagctcgagagacgccgtccgaggtccttgccctcgtccactgcatcaccagctaactattcccatcgcggccaacctggaccaaatctgccgcctatccaggccctgcgatgtggccgaccggggtctcctctgtgacctgctctggtccgacccttcttccatggaggacagagagtgggcggacaacaaggatcgatacgtgtcctgcaccttcggcgccgacgtcgcgacggactgccgccgcgcgcaggacctggacatcgtttacagagcgcaccaggtggtggaggacgaatatgagttctctgtcgaccgacagctcgtcaccttcttctctgcccccaactaccgcaagctcggctgctccttcaccatcatcaagctgaaggcggacagaaacagcagctcgcccctcgggtgttcgaccaaatgtcccagccaggcactgcaccccattgtcaagcccaatctagtagtcgtgctgaatattgcaggtgctgggggcaagttatgtggaggatttgatatcaacgggttcacaagggttcatcagactggggatgtatcgcttatgccaaacgtatccattgagcttgtgtcaaacatgatggaacagggcaaacaaccttctgttgcagccattccaggtcttgcattgggtggtggcctagagttgactatgagttgtcaggctcaaatacctactcatgttgctcacaccatctgctcgcttgttaacaacgttatggcatcgcaggctcatgtcgtcggacaagggatcgtagaccgcgccgcgttcggtggcgatcaccaatggatcgtccaaggtactgccaatggtcacgggctctcctccaaggttgctgctgaggtgaacaatcagtttagagttggtattcagactactgcgattattcatgtgctgccaaggggtgtcctacagtttggctctactggtttggctttgggaaacaaaaaaattgtgatgtttgcaaagacgttgtgttctcagctaaacaatcgttcaagcctagctgcatctgcttcggctaaaaacacttcaagacagcatggccagtcacttattgataatgcaattgtgtcaaccagtacaccaccaaatgtattgttgattgcatctttgctttgggctgcacaacagaatggtcaccctgagctcattggaaaaacaccaatagtgaggccatcattagatgttgagagacacattcttctgaaaggagcttttgataaagctgaggaaatagtcttgagaatgaagcaatgggatggtactgcgggacttgtttggcagaaggatagcttaatggtgcccaagtggcttactgacagattgctcgcggcccgccgggtctcttcgggggccattacagctcttctctgttgtgcactcattcctggcctgttattgctagaattagtcaagttcacagagacttggcaagggactgtttgctgggagccaacaatcctattgttgacgcggagacacctttacaaacagaatgagttgtatgcgacactttttgagggagctatgattgggtacactccaggaggaatgcaatttgctcaagaaactatagagacgatgatttcaagcaatctcttcttgactgccgagatggccaatactctatctccatggccatggttcaattgcgttcaagagtgtgtgctgtggcagtttgatttattggatatatcggctcttcatgcatcgagaattggtttttcatttgtgattatactgacggaatctatcaaagtgctcaagatgctgctagtagaccaaggtgctgcaggacatttctttgtcatgatttgggatcctggtggaattgatgccatgtatcggcttgagggcaagccgaattttaagaaggggagaatgtcagcagcccgccatctgaaccatgagccactgtcactgtctcaacaaggaagctggaccaagacgagcaagtagctgatgaagatactttcagagtccggcgatagtttctgttgtgcaaaataccagtgtgcaagaggccgagcaaatgtaacgcatccaaaggcccacagtccgcttcgtcttggcccagaatagcgtgtaaaggttgcgtgtgtctgtgttgggctgtggcgctgaataagtacgcgcgccgtcaagatccttgtatcgaacaactgaacaaacaattattctctagaaatcacatctgttcttctcctacctctgctctctctgatttccttcttactccgttcccaagtagaccgtagttgtaacagtttctctcaccgccgccgacgcgggaaccagcagctgatgcgcgcgctcggcgattggggaagaatccgtcacacgcaaatttacgggaggcaagccagtcgatgcgggatgcgaataatattggggcaagaacagggaactgttggagggcttaaaatgagtttttttcccttaaaacgtttttagtgttagtttacgggttctcttggagatgctctaggggcggatataaccctgactccctaagacgctggttcgcttttctaagtacctgagacacttaatagactttgtgatataaccctgagcctctaaaccataaatgcagttacaaaataatatgcatggagggtcgaagcctgtctcttatatttttttatctaacccctaaaaactcctaaaaatctatataactaaatggttttttgaaaaaatagaaatttcttagaaaaattgaggttaacgaagtagcttttaacgggatattgcccttgataacccgcacgtccgttcggcatccagagtttccagactccacttcaacaagaagacaaaaagcgcaaaagctcgcactacgaaatgcccagactgcccccgaaaacccgcaccaaaacgtcaaaaccccacgtctccatgagtccatcagtccatgacccattgcttctcctccccgctcgctctcccccgcgctgtactttctcttcggcgaaaaccccacaaccaccgaccagagatggccgcggtgaaaccccaaccccatttctcgccgcacgccaccttctccgcgcccgatgccggacctgccgacaccggtttcgccgtcttccgcctcctcctgccctcgtccttctccgacgccgacaccatgcgcctctacgccgccgtcaacccgttgcgccgccgcactgccacgctgcaggcccgcgtcgagcccctcgaccccgcctccgcgggcggccgtgtcgtcgccgccatagttggccccaccgtccccgtccgccgcgtcgaggcctcgtcctcgtccgcggagcccctcgcgctctcgccggcgcaggaggcgctagtcgccgtgattgataccgagggcgcgctctgctgcgcagtcgagaaggaggctcgcggcaaggcccgtcccgggtgcatcacgtgcctgctcctggtcgatgctgaccggctcgaagcttcgaccgggagaggcgtcatggagaggatcgccctggaggccggcgccgacgtgcgcgtcgcgatgtgggaggagggcgcgcagccgccacgggggcagccgcttgaggaggttgtcgaggtatactggctattttctcttctacaattctcttaagctgttggttgtacgtgctacacttgaatacttgatacttactaatcgttcaaaaaaaaaactcgacccggggtgcatagatagaaggtcacagcgaacggtcccgaccgatcccgaccgagaaaccccctaaccctgccatcctgtcactaacggggtgactcacaggctgcccacacagcaaaggcacccaggccgacgttgccacagccgagtcgctcccccgagagcgagcgagaacagcgaggggatttttatttgtgagaaatcaggggtcgaacccccgggggacctcgccggctcgccgccttcaccacccgggataagcccggccctcgatacttcctaattgttattgtgcactgtgcattgcaaatgctctttttttggggacgtgcggattacgattgcatactgtacgtgaactcacgcgtttggactagtgcactgtcatggaaaaatgattgaacgtctttgtttacatggacataggagtcctaactataatttaacaacgtagaaaagtgcaacttatttaaaggtgcagcttgctctttgctgccgtatgagtaggtatagttgtttgttgctacgcaccatacctacctttatggatgattttcacgcaagcttgcacaatgtgaagtccaaaacacaaaggtattgtgcatcgaagctaacaatactcttgagattcttttggatttgacatgctgtgcactttttccagtgtaatattattttgttgaactggatccattttgttctcattgcatcattttagttatgcattaccaggtcgtggggtcgaagcagcctctccgcttttgcacggaaaggcttgcctcggtttattccttcctcagccactgggtctgtccctgccactgggtctgtccctttattgtttcagtgttgcattcatagcatctggaggtgcatcatgagtccatttctgtctttgtttccatgttggaagaaaatatgagtaacttataggatactataggtctataatatctagcccaatgaatcacatataacaaaactttgttcttgtatcacctaatacactgtagcaatgaataatctacttggtttctgattcatttgctgcaaaacgaaattatgcaatatgcataaaatggcttgctaaataatcagggactcccattgaacttttttgtttgaaaggtctattctgtggagtttcaattcgatcatatgaaactcagaaaatgcttaattaccatgaaagtttattgctgtgatttgctactcaacagtttcagttgatgtttcttattatttttcagataactggagatagaacagctgtaaggaaagctctagttgctttgtctagctttcttcaaggtgaccttccaatcggtaactcaacaacttatgttaagaaagaaggttcaatactcccatgggcatcttcagaagtacctgggcctaatatgggggcttcgtgctcagaggcatccacagagtttgcacaaggcagtgttgctaagactcattgtccagaaggtaatacaggagatgctcaaagtaaaactcttcagcaagtttcattcaggcttctcttgcctacctatcttgctggaggtttgattggcaagaagggcttgattatcaaaggcattgaagttgaaactggtgcttgtattgatgttggtgcacctgtcgctggttgcaaggaacgtgtaataacaatttgcgccctagaggtttgaatttgaacacaaaaggctccctttcccattgctattctctcttttagtgaataaccggtgcttaactgtttgtttgataagataacaattttcacaatggttaaatggctgtttgacatctccatgaatctagaaactttgtattatgttttttgtgaatcatattgtatatctcattcattttatatatttgattcctgatccttgtagagcccagactcggaatatcatatagtgcaaagtgcactacttctcatatttgacaggatgatggagatggaaaccaatacacactcaacatttgagaaagcatctcaattcttggtcagagtccttgtgctcaaaaaccagtttggctgtttagttggtttgggtggttctataatcaaggaaatggtgaatacaacaggagcaagaattcaaatattggacgatacagaaattccggcttgtgcctctacctttgaactagttgtacaggcaagcatatcttttgacacgaaagcaatataataagcagtttgctagtacttggttcttctgtgccatgctgcaattcattcagttttgaacaaataatagccattgtaacgaactcaaccttctgattctctactgtgcacgcttggtatttctaggacatagcttgcaaatgaaatgctaataacatgtttcaaaattctataaatatttttcatttgtttattgttccttttatagtgaatactctgtgtttcttcaaaatttgcctgtaatttctaatgttttctatttgcattggtagttaacaaatggtttggaagtcatgatttgtttcttataatgaatatggtaaatgaacttacttggacaaccagatttcaagaacagtatcagtgcagtagttcttgactggtaatggtgtttctatttgatttgttgaagatcctagtattccatgagtacttggttcatcactctcttttttttcacattttcgttctctgaactaacgatctaagcttatttatgattcttcagttctcctgcnatacattggacagcgttgtaattgttgaggtttatctttgtgccttacagatcactggggagctaatgaatataaggaatgctttatcccttgttttctggaaacttcgtaaccatattttctccaatgaaaccgactacaacaattcccatatttcctcttcagaaattgctgaatcaaatgcaaccagccaggcgaatatttattcaacaatccaatattcagtggacaatggccataaggttgatcatagatcccctctcagttatggagtggactctgtggaaaagtctttcagtgatttagagctcagttcttcagaaattcaggttatctcgtagaactttgttctatgcttatttatatttgcaccatgtttggtggctggcggaataggatttctaaggaagttgctgttgttttgtggaagtggctttattccctcgtgatcttgggcgcttggactgttaatccataagtctgtctttgatggcgcttctcgtgttgctcgtgtgttgatgctagctgtagaggagttacacgttttgggattttgttggggcatgaggaactcacctccttgccctagcacctcttgaagattgatttgttggtgttagaggttgtggtcggtctatgtgtttttgtggcacgaatgttttaggaacctaagtgtgttggaggtgcatggtggcgttgtaagggtccttacccctttttcttctaaatataatgatacacatctctccagtgtgctcgctgaagggctgagctacgtgtgcccaccattgttttcagatcgtccgactaattgcgattagtcacgattagtcgggctggtcggtactcttggttcgattagggtgctcgattcgatcaggagagctgatcgtccatatcgtacgattagtcggcgatatggagcgattaatcgggctgataagctatcagtcgattattttgagacctatgttaagtgccaaaaagttgcagcagctcaggatttgcagcaaggagatgacagtgatagtcacaatgaaaatgatcatcaagagccaactcaaaatgatcaagatgctgcagaaaaagcaattgatgacgaagaagaatctggagctgcaggtgatcaattcaagctggatgatgatctcatataggtgttgccttgttagtcatggtcttgtaaattcaagacttgcagtttcatagttccatatagacttgctggtgctattttcaacttttcatactgcttttattcaagaaaaaaacttttcatactgctttgttagtgaatggtgatcattttaggcttgatgtagcatcttagtcatatagtctaatctcttaattgagtttattctaagtatagtttatagtctatactctatagtctatagtctatactatctatatatatgccctggaaatatgcaggacgaccaggtgggtgattagggtcgatcaggggtgactaatcgccctgatcgtcgcctaatcacaactaatcggctgattgcctagtcagaacgatcagtcgattaggcatcgatcaagcgatctgaaaacactggtgcccactcctgccttgacttgcttcgaggtgttgactgccttgtactttcctcgacctgttcaccatcggtctccctcgtaccatcctctacccatcgcgtcctcaccgatcctcattggtgcttcattatggaggaagaatatggggttcttctcaccaatcatacttgggacttggggccgcgtcctcgtagcgacaatgtggtgaccgacaagtaggtctggactcacaagaggaagggtgactgctctttggacagggtacaaggcttaatgggtcttttggggtttcactcagcgtcctggtgtcaaatacgacagaactttcagtcttgtgtccggtcaagctagccactgtctgcatagtttgtcactagccctctcatagtcttggtctgtccatctgttagacgtcaagaatgcatttcttcatggcaccttgattgagaccgtgtattgcactcagctgactagtttcgttgacttagctcatttggacatggtctgcaaactcaacaagtcattgtatggtctgcaataggcatcttgtgcttggtatagccggtttggttcattttttctcttgttgggttttatggaggctaagtcggacacctcgctgttcatttaccagagatgcaatgacactatgtacctcctctttgtcaaaaaaaatattgttctcatagcctctagtgcgaccatcttgcaacacactatttcagcattgaagcaagagttcactatgaaggatttgcgctagcttcaccattccttgggtactgtagttgagcaccgccctaatgcgctgttccttcaccagtgatagtttactctagtcattcttgagcgcactggaatggtggagcgtaagctgtgtgccactctagtggatgctcaggcgaaggtttcctcaaatgctagtgctccagtcaatgaccccattgcctactgaagcctgataggggctcttcagtacctcaccttcatcaggccaaacatcttctatgttgttcaacaggtgtgcctccacatgcatgatccgcaggagccgcatcttaccgctgaagaggattctccagtaccttcgaggcacttctgactacggccttcttcttcgatggtcctcactgatcgagctcgtcgtctacatcgatgctaactgagaagtgtctggacacatataggtccacctatagctaccccgtgttccttggggcaaccttgcctcctagtcatcgaagcgggagattgtggtctcctgcttcgaggccgaatatcgcgcaatggtgaatggtgtagttggggtgtcctggcttcgccagctcctgcatgagctccatagtctccctcacccggagtatacttgtctactgcaacaacagcaacacagtctctccatcaatcctgtcgaacatcagcgcccgaagcatgtcgagattggtctccactttgtttgtgagcacgtcgccatcggggatgtttgtgtcctccacgttccaatgacttcacagttcgccgacatctttgtcaagggcctatcctcagtgttcttggtgtttngctctagtctcaacatctgttgtggctagagtttcgactggggtgttagactgttatgtgacttgggccaagagcccagcccaagagggatgtttaatgcagcgcaatacaagtttcacttatcttccacagaaaagtaatgtcagatgcttttaatagctttttcttcatcccctcttagctatgcccacatgtatctatatctgccgatttgggacttgagtggaatctgggtcacacattgacagcatcactgtagctgtagttatgatccttacaaacagtcaaataaatattgggcaaattactttttttttcatatttcagccatttagttgcatgataaatcttcattttttcatattagttcagccattcacgtgcttgaaccttttgtggcttctgttaggtttcatctgc

SEQ ID NO: 8137 - DNA, 4766 bp, Zea mays
cacaaaggcctccaacaaagccaattgggcttcagcgcttgattcggccatttgacagcctttcacaaagcgatctcgaaccaaaataacaacccggcccaatcacatccaccaacaaaaaatggcctaagtagcacaccgcgtacaattgaatgcacgtcaaacgcctctcttcttgacggggaggtaccttttttcatttttacatttaaaacattcaaaaattcaaaatgatgcatcaaaactgaaatattataaaaatggatgtctgccgcctctccgttgggtgacagggacctaattataaattttctgaattgtttggtcactgaagggatttgtagttcggtgggacagaccctcaaggtacattctcaaatatttatcgtctattattttattttgaattaaaacacggcaaatgaaaaaaatgaagagagtattaaatagagtgactagtatattctttatataaaattgtaacaataggctagttagcatggagtggtgtaaatcattacgtcgtaggctcgattgctctgccttccctccaccggatggtaggtacccttctaagaacttctatgtgaaaaaccctattttatgacagcaaacatgagtatagtgggaggtacccttctaaggatttttatggaataaatataattggatgtctgccgttcagtggaggggcgacaaataatcattttgtaatatagcagttttggggtattgttttgaaatttcaaataattgtaaatatagaaatatccattttcaaagaaaattactttattcttccttagaaaaatataaatcgctcgtgaaaatagaattccaaactagcaaaagagtaataaagcagcacccaagaccttcacgaaacccactccgagctttcacgatacaatcacgcaatatttgtcgctgagaaattctcaactctggaagaaaaaaaatcgcagcacggaaaaagagagtccccctccccaccaccacatcccggtctagggtttgcgccatcccgaaccatccgctcgccgccggccgctgctgccgccatgggctccggtgacgacgagcgctccacctccaagcaccatcaccgcgataaggacaaggaccgtgaccgctcctcgtctcgccaccatcgcgacaaggaccgggaccgcgagcgctcctcgcggcaccaccgcgacgatggcgaccgggaccgggaccgccatcaccgggacaaggaccgggatcgagaggagcggaaggagagggagcgggaggagcgtaaagcacgggagcgggaggagcggaaggcacgggagcgggaggagcgggaggagcgggacagggagaaggagaaggagaaagagaaggagcgggcgcggcggcgcgaggagagggaccgcgaggagcgggagagttccaggcggcgcggggatgcggatggagaggaggacgacgaccgggaccgcaagcggcgccgccggtcctcgcaccaccaccaccgggacccagagccggagccggagcctgcatcccgggaagaggaggaggtggacgccgaggaggctgagcgccggcgccagcggaagaaggaggaggacatggaggccgagcagcagcgcctcgacgacgagatggagcgccggcgccggcgcgtcaaggagtggcaggagaagcgccgcgagcagcagcagcaggacggcagtgttgccagtggcgcttctgctgctgtggcggccgaggctgatggcgccaaagcggggaagaagtggaccttggatggcgaggagtctgacgaggaagaggacaaggaggacggcaagaaggctgaggggaatggtggtgctggtgacatggacgtgggtttgcccagtggaaatggtgatgccaacggtggtgctgagatggaggaggacgaaattgatccgctcgatgccttcatgaattccatggtgctgccagaggttgccaagctggagagtgctgcagtagcaatggatacagcccctgctgcaggtgcagatggcaagaatggtaagagctcaaaggatgtcattagtaatggggataagaaagggtcaaggaaagctacggggagaattatgcaaggggatgattcagactcggactacgatgatgctgatgatgatggggctggagaggatgatgaggatgatgaggaattcataaagcgtgtcaagaagacgaaggctgagaagttggcgatcgttgaccattcgaagattgactaccaaccgttccggaagaatttctatattgaggtgaaggacatcaccaagatgacatccgaggaagtggtagactaccggaagcacttggagctcaaggtgcatgggaaagatgtgcccaagccaataaagacatgggtgcagagtgggctgacaagcaaactccttgataccatcaagaagcttggttttgagaaaccgatgcctatacagacacaggctttgccgatcataatgagtggtcgtgattgtataggcatcgcaaaaactggatctggcaagactctagcatttgtcctcccaatgctgaggcatgttaaagatcagccccctgttgtccctggagatggccctattgggcttattatggctcctactagagagcttgtggtccagatacattcagacatcaagaagttctctaaggtgcttggcatcaactgtgttgcaatctatggtggttcgggagttgcacagcagatcagcgaattgaagaggggtgccgaaattgttgtttgtacaccgggaaggatgatcgatatcctttgcactagcagtggaaaaataactaaccttcgcagagtgactttcttggtgatggatgaagctgatagaatgtttgacatgggttttgagcctcagattactcgtatagttcagaatacccggccagatcggcagacagtacttttctctgccacatttccacggcaggtggagatactggctcgcttggtgcttaccaagcctgttgaaattcaggtgggtgggaggagtgtcgtgaacaaagatatcacacaactggttgaggtccgaccagacaccgagaggttcttcaggctattagagttgcttggtgaatggtatgttaaggggaaaatccttgtttttgttcactcacaagataagtgtgattctctactcaaagacttgttccagcatgggtatccatgtctgtcccttcatggtggcaaagatcagactgaccgcgaatcaactattgctgatttcaagagcaacgtgtgcagcttgctgattgctactagtgttgctgctagaggattagatgttaaagaacttgaactggttgtcaattatgatgtccctaaccattatgaggactatgttcatcgtgttggtagaacaggtcgtgctggtagaaagggctttgccgttacttttatttctgatgaggatgagcgctatgcaacagaccttgttaaggctctggagctctctgagcaggctgttccacaggacctaaaagccctggctgatagatttatggctaaggtgaaacagggaactgagcaggcccatggcacaggctatggtggtagtggttttaagtttaacgaggaagaggatgaagcacggaagaccgcgaagaaggctcaggcaagggaatatggatatgaggaggacaagtcagattcagattctgatgatgaagggggagtgcgtaaggcaggaggtgatctggcagcacaagctattgccaatgctcatgcagctgctgctttggttgcaaacaaggctgctaataatgcaaatcagcaaataccaggatctgcaacagcccccttgattcctttactcacagcatcaaaccaacaaaatgatgaggccactgctcgggcacttcaggctgcaatgaacttgcaacaaaatctggcaaggatacaggcccatgcagttccagaacactatgaggctgaacttgagattaatgatttcccacagaatgcccgttggagaatcactcacaaagagacactggcccctattcaggactggactggtgctgctatcactacgaggggaacatatattcctcaaggaaaaattgttggtgcaaatgagcgcaagctttacctgtttatcgagggcccgacagagtcttctgtgaagaaggcgaaagcagaattaaaacgtgtccttgaggattgtgcaaaccaggctctaaatcttcctggatctgctcaaactggaaaatattctgttatttgagttgcagagtagataacaatgtggccgagtatttttttaggagcttataatggtttgcacacttcaaagccgctgatggattgctacttctgatgctcttgctgtctccagccttttattttgtctgatactcttttataaggcaactatggttacttaatgtgacatgattattatgaaattgtcggggtattttggcaatttctactgatgagttttcattgcctttggacagaagacttagaacacaggcggtgaccgagtgctgtaatgcaaaggaaggcggccagttttctggtgcggttttgaaagtgctggttgtgttatgacactttgaaaactgatcttattattttcttgtttatggatatcgttccctttttgtgagaggcaatacaaagtttgtgtgactatggtctaattaatccaggtgtacgtattgatttgcctattcggaagctgagaagctatagctttctctggtggtttggtcctatttacccttca

SEQ ID NO: 8138 - DNA, 1089 bp, Zea mays
taagctccctctggcgccgcccgccccgattcactcttctccctaaacacctcttctcgtagccggtagatcttccggggtcgccatctccggccacggcggccggcactcggagtaacgctggagctcgaggcggtggtcggcggccatgtacaagaatcagctgcaggagctggcgcagcggagctgcttcaacctgccttcttacacgtgcctgcgggaggggcccgaccatgcgccgcggttcaaggcggcggtgaacttcaacggggagcagttcgagagtcccgggttcttcaccacgctccgccaagcggagcacgccgccgcggaggttgcgctcgccgcgctcgcgcgacgcggcccgtcctactcgctcgccgcccgcatcctggacgaaacaggggtttataagaatcttctgcaggaagtggctcaaagagttggggcgccgttgccattgtatacaacagagcgatctggccttggccaccttccggttttcacatgcacagtagagctagctggtatcacatttacaggtgatcctgctaagaataagaaacaggctgaaaaaaatgctgcttcagctgcatggtcagcactgaaacaattggtacgcgaggaggtgaattcatccaatgagccagaaaacattgatgagcaggagcagatcaggatcgcccgagccctcctcaattatcgcttgaaggagaagatggcgatggccaactgccctcatgtctcaccgttcccccagaaatttcccatgcagcaagagcggaagccctctttcggtcaatcttctcaatccagccactcgaagattctccctttattccgccctaaacctaattcaagaccaaagtcaccagcatctactgacggtgtgtcgaaaacgcctgggcggacccccgttgacagcctagatcaaagtgccagatcaagatttccagctgcagaggcagctccctatgtgccagttgggcactaccgccgtataccttgccataacatggctccttccgtcacaattaggaccgctgttcctgtcttctctgctccccactccccctccccctgcacgcc

SEQ ID NO: 8139 - DNA, 7134 bp, Zea mays
  misc_feature (2921)..(2921): n is a, c, g, or t
  misc_feature (7100)..(7100): n is a, c, g, or t
gaaaacaagtaaaaaaatcgatccggttttggaaccaatcgatcgggttttggtttctgaaaactaaagttttagggaacccaaaaccgaaccaaaatattgggttaaacaattgcccaattcatcggtttctaacctaagaattttatgaaaactatacgatttttttttaaaaaaatacagaatcgcactaggtgctagtacataaataaagaaaaagaaaatccgaacacacgaaggagcgtgcctggtgctgggaccccagctgtcatccgcctggctagtaaccgtaggcaggcagtagcattaaaatcttccaaaaaatggaacagaaaaagaaaatataaacagcccccctcccgttccacccgcaacacttcgcactcttctccccctcttctcttctcgtagacggcagatctccaggggtgtcgccgtctccggccacggcggccggcgctcggagcatcggtggggttcggtgcggaggtgggcggccatgtacaagaaccagctgcaggagctggcgcagcggagctgcttcaacctgccgtcttacacgtgcctgcgggaggggcccgaccatgcgccgcggttcaaggcggcggtgaacttcaacggggagcagttcgagagccccggcttcttcagcacgctccgccaggctgagcacgccgccgcggaggtcgcgctcgccgcgctcgcgcggcgcggcccgtcctactcgctcgccgcccgcatcctggtaagccgcgcgcgcgggcgcctcttgccccctatccttcctcctccgcgtgcccctcgcttttgcgcgagtagtttcccctggcgtggtattttttttagttctatttctcggggtgcttgtttcaaacgcttctcgacggtggaatttggggatatgcgggtgcttctcgtccgggtttagttgatcgtctgtagatcgctcgaaccatctgctcctgcaggtcgtcacggagttctcgtgggctattgattatgcagggcgagtcgtccgcgtttgctcggtttaaaaaaaatggcgtctagtttggctgtttagttcgcacctcctgttccagcgccgcggcatgtacgttcgaatcgtacataatgttggcgattttggagagatttagcaacacatcacccgttgcgtttgaatcgttctagtggtataatctgttttcttgtttttttctttttttctaaaagaacgagttgtgaagtcataactttaagaatctgcttggattgggttggagctcgtgagcagcatgaattgcaggggataattggtacggaaagctgtaactcttttcgtgcaaaaaattcccggtgccttttcttttttttgttagttttaaaagagaggattcttttgattcaagaaaaaaaggttgcaatactcgagcccgcttattttttcagccatcgggttaaaaaaaactcttcctcatcttttatgaccaaaatacaatcatgtcgttctcttgccactgtgatttcatttttttattataagtgggcgcggattagttaatgaacagagcttagttcccactctacgcgatggatgtactaaacgcaatcaagcctcttaacttgttcgtaccctgcgccggccattaacccgccactattctttaatctctctctcgcgccgtaacggtgacgttgcttctgataaacaaacccggcattgactgacaaattaggagtttcttacagcttcggtattaccgctagggttccgtccgtccccgcaccgatattggtggtagactgcgaaagtcttcgtgccattaattggtaaaccccgattagccaaacctgtccattattaatgggcgcattaattggtatactttaaagagtagtatccgcgtacacttgacttggaagccgagttgcaaatggagggtacgctgtacgcagtacagacggggttttgaattgaacgggattaaccagcgcgtggaactgtcagtgtgaaacggtggggaaagggggatttggtttcggtctttatagtgcctgatattaatgcgagtgggtggggggaattgaatcggaggccgcccgcacctaaccggggcatcgcaggtcaatgccggtgggcccgagtggtttagtggcaggcagccccccctcagagcccaccatggggcaagggcagagaaggggtggtggtggtggcgttgttgcgcctatgcgtggtgtcttttctcgatacggtccggtcagatcaggtcagccatgggggctgagagtgctgggagccggcttgctaccagaagtgcgccttcctagtgctttgtttgctatccagcgtctgggatttggctggcttccgtggattgatgagacagtgtgagtgtggctgctggtgctagtgcggggacgtcgctttgctcccggccttttaggcagggttcttggtgcaggattacgggccgagtgcgatggccgccttgctgcatggtgggtgttcttgtcggtctgtgttctgcacaaaggtggttctgtgcaatttgggagtttggattgtgaccacatggtaaaaaagcagctactatttggccagaatttttaaaaagggtgatctggaattggatggcagaggggtctgcttctgaatttgtttttcttttttcttttgttacttttgatttatcaatcaaaatgaggtggtttgcaatgacatggtccttgggtaccatgtaagttcagattggtctccagtagacaggttactatcgctggtcaatgcgtatttggatgatttttatgctattaatactgagagtagggtggttgctacaataactttgaacactgactcagcaaaatgttaggcatggtcaatgatcctcatagttgactgtcttcagtgcctcttttctttttttctttttttngggggggggggggggtataagaaattggtttggactaccaaaaaacgatttgcctggttggaggattactgctttactgatacatgatcgttgaaaatattaaattcctctagtttaaaatcatagaaaatgagaaaacttaacaagcaactatggtttgatatgtggtggtaaatgataagtacctgcaactaagcacggagctcgtactcctgcagattggaaatgtatcctgtcacggacattataacatccatgtcttatgaaaaacaaatctgaaagtctgtagaccttaccttgtagtgttccgtcagctgctgatggcattgttgtctaaatcctttcgtatcagtatattcggaactgatctttatgaaatgctatttcctttttattggccagcttatatccagtatctgcctgtttaattttggaactgactgcaatctggattaatactttagtgaatcatgattttgtgatttggactaatactttagtagatgtactttgtactcattgcctcttatagtcagttagtggacagctcacctaccacttcaacctatttgagcatcatttgaatcataatccttgcagctgaagtatctgattagcattgtcttgatccagaagtcatcttccttagcattctggaggcccttacttttttctggttcaattagttttgtttcaatgaccagtaataaatgcttttacctgactaaaatgtatatcatgtgtttgctcagtcaaaacattccctaccatctgtctgttggcattaatatttttatgtgactggttattctttaatcttcatagaatgttgcatcctcaactttgattctttgatttacagtaatttcagtcacttgcttatggtgatgatttctgttacacaggatgaaacaggggtttataagaaccttctacaggaggtagctcaaagagttggggcgccgttgccattgtatacaacagagcgatctggcgttggccacctgccggttttcacatgcactgttgagctagctggtatcacatttacaggtgatcatgctaagaataagaaacaggctgaaaaaaatgcagcttcagctgcatggtcagcactaaaacaatgtgagtattacatattgtgttccgcacatattcatgaaagaaattgtagctatgttgcttattcacgtttgtctgcaataactgtaattgatgaaaagagattgcaacttggttaaaaatgttatcaccatggcttcaaaagatatatattttttatgttaggatatggatattgacttaatcctgagtaatttatcatgagaaatttgagctaattttcaactaattatgtttttatcatgccaagtcatgcaacctttgtagttttgtgttttataccatcaatccattatatatgtaagtcaagtgatatcttatatctagcaactagcattgctacttctcattcatttggagtatatgttcctaattcacttactatgctaagcagtaggttatctggcttcacttactatgctagtggaattgaaccaagtttatcttgtacattatgcctgtttctgttttgtgtctttaaaagaagtgaagtatgatcggcaacatcttgtgatgtcattctctatttatacactgacaccttctcatactgtttcatatctctgcaacagtggtacgcgaggaagtgaattcatccaatgagacagaaaacagtgatgagcaggagcagatcaggattgcccgagccctcctcaactatcgcttgaaggagaagatggcgatggccaattatcctcatttttcaccattccctaagaaatttcccatgcagccagagaggaagccttcttttggtcaatcttctcagtccagctactcaaagattctccctctattccgccctaaatctaactcaagatccagaccagagtcaccagcatctactgatggcgcatcacaaatgcctggccgggccatggatatccacactccaagcccaagatcaagatttccagctgcagaggcagccccctacgtgccagttgggcacttccgtatgccttgccacagcatggctccttcagtcacaattaggactgctgttcctgtgttctctgctccacctctcccaccgccgtctgcacgcccgcagcagcttcctccactcatgagccacccaccaccgattcggatggcatccccagttcgcatgaggccagcctctccaatgtttgcctcctcagctccagctcaagggccgaaacttgtgaggcctgttcaattgaaggatgtgcaagatcaaccaaggaaggaaacagctccatccgtgatccctgttcaggtaaaggacgtgcaataccaatcaaggaagagctcaatgtctcctgtgattcctgtcgtggtaaaggatgcacaacgccagcctctcccagttcagacgaaggatgtgcaaacccaaacccaagccccaaaggaatcacttgcagatccaattccagcaatcaggcctgcagtcaagattgatttgcctgctcaaggcaagaaggaagcttcagctggtgctaccagcgaagcgccatcttctgccactggcaataatggtgctatggaacgcggtacatcatcagacgttctcttggcaaggcgatcaagggctgctgtggacggggatggcgacaaggtggaagcaaagcacgaggccgaggctcaagcggtggcagaggcagccatcaggcagctggagatcaattgacttcagaaaatgcgcgccaccatcttctcccagattttgtaattagctgccttgcctcctgtgcacattccgttctgcttagtccgtgtatgtcttgttccggttagggctgtctgggcaagctgcattgtggtaggaacacctaggttttctgttgaggagaaaaaaacatggagtggtggtaggcggtttgcccagtgtttagttggagacggttattacttcgctggatatgcaattggtctgcttttacccccgaatgatgaggtggactgcgaggtgcctctaagggaaggattctgaattcctagttattgtcgaaccgccgtaatcctatccagcttcttttttactagtagtactacaatgcaaatgatgatgcattggtggttggtgtatgatgaaaagtggagatgggtttttatgccgcttttcgtcctggctactacagtatgatgaaaagagaaatcgttggatgaacaaaagactggttggtagatttctgttgcgcgtcatccttgtgggtaatctgaaccacttccgtatggattttggccgtgacgttgtccggtccagcccttggcaactgagccttgggggttgggaccacgcctatcgctctcgcttcgctcgtcatgtgctttacacatctcgtcgtcgtccgaaagagttacacagaaaaaccgaagggtttggtcgcactagaaactaactagaaattggttgctgctgggtcgtgaccacataccagacacttggctccgtccaaaagccagccacggctgatgaattgatgatgatacgatcagaaccgcatctccgctccttttttttctccctaggaaagaacaaaagggcgatcagaaggcaggatcgcagctgcactgcgctgcgaggcagggccaggctgcatgccgagcatgtgtgcggcctgatcgcacaatgatggacaaatgctcgcctgtggcgcctgccgccgcggttcctgcccattttgacctgcctacagcgtgctgacccgacccccagcgcaacaagccaagcgaggccacaggaaacactcatcgtcgcggcattgccgttgccgtcaagtggaaactgccgtcttggccgctggccgcgtacaaattaaacatgtccgcttgccgttctgctgcactgcacactctggccggtggtctggccgaaacagagaagagatgaatagagagaaacagaggaggggtagacaacgggccacggcacagccgcacagcaactagtacgacgtgccagtacagcggccatgacatgaatgccactctggtcgaggcagagccgcagaggcgtctagcgtaggggctgccccctgcctgcttcagtggacagtggttcgtctgaccggcaagcaattctcgcaatgnatttcgatggacaggggggggggggggggggggg

SEQ ID NO: 8140 - DNA, 2069 bp, Zea mays
gtttgctctcggggcccactaggtgccccggggcacttcgcactcacttcgcactcttctccccctcttctcttctcgtagacggcagatctccaggggtgtcgccgtctccggccacggcggccggcgctcggagcatcggtggggttcggtgcggaggtgggcggccatgtacaagaaccagctgcaggagctggcgcagcggagctgcttcaacctgccgtcttacacgtgcctgcgggaggggcccgaccatgcgccgcggttcaaggcggcggtgaacttcaacggggagcagttcgagagccccggcttcttcagcacgctccgccaggctgagcacgccgccgcggaggtcgcgctcgccgcgctcgcgcggcgcggcccgtcctactcgctcgccgcccgcatcctggatgaaacaggggtttataagaaccttctacaggaggtagctcaaagagttggggcgccgttgccattgtatacaacagagcgatctggcgttggccacctgccggttttcacatgcactgttgagctagctggtatcacatttacaggtgatcatgctaagaataagaaacaggctgaaaaaaatgcagcttcagctgcatggtcagcactaaaacaattggtacgcgaggaagtgaattcatccaatgagacagaaaacagtgatgagcaggagcagatcaggattgcccgagccctcctcaactatcgcttgaaggagaagatggcgatggccaattatcctcatgtttcaccattccctaagaaatttcccatgcagccagagaggaagccttcttttggtcaatcttctcagtccagctactcaaagattctccctctattccgccctaaatctaactcaagatccagaccagagtcaccagcatctactgatggcgcatcgcaaatgcctggccgggccatggatatccacactccaagcccaagatcaagatttccagctgcagaggcagccccctacgtgccagttgggcacttccgtatgccttgccacagcatggctccttcagtcacaattaggactgctgttcctgtgttctctgctccacctctcccaccgccgtctgcacgcccgcagcagcttcctccactcatgagccacccaccaccgattcggatggcatccccagttcgcatgaggccagcctctccaatgtttgcctcctcagctccagctcaagggccgaaacttgtgaggcctgttcaattgaaggatgtgcaagatcaaccaaggaaggaaacagctccatccgtgatccctgttcaggtaaaggacgtgcaataccaatcaaggaagagctcaatgtctcctgtgattcctgtcctggtaaaggatgcacaacgccagcctctcccagttcagacgaaggatgtgcaaacccaaacccaagccccaaaggaatcacttgcagatccaattccagcaatcaggcctgcagtcaagattgatttgcctgctcaaggcaagaaggaagcttcagctggtgctaccagcgaagcgccatcttctgccactggcaataatggtgctatggaacgcggtacatcatcagacgttctcttggcaaggcgatcaagggctgctgcggacggggatggcgacaaggtggaagcaaagcacgaggccgaggctcaagcggtggcagaggcagccatcaggcagctggagatcaattgacttcagaaaatgcgcgccaccatcttctcccagattttgtaattagctgccttgcctcctgtgcacattccgttctgcttagtccgtgtatgtcttgttcgggttagggctgtctgggcaaaagctgcattgtggtaggaacacctaggttttctgttgaggagaaaaaaaaacatggagtggtggtaggcggtttgcccagtgtttagttggagacggttattacttcgctggatatgcaattggtctgcttttacccccgaaaaaaaaaaaaaactgcgaggtgcctctaagggaaggattctgaattaaaaaaaagaaaaaaaaaatacgagggggggcccggtaccca

SEQ ID NO: 8141 - DNA, 3573 bp, Zea mays
tgtcaaacgaaagacatcttaagggttgggattttgtgtataaggtatcgccgcatgggaggttacctgttcctaacgatgaagattacaacttagacccggacacatatgatggagagttcttccaagaagatgggctagaagggcgatttgagatagacttaaccgaagctatcggaatggacgtagatattgaaatggttgttgatgacgaggatgatgaggtgcaaaatgataatgacttagtaatccttgaaggcaatgatgaggttgcgtcttccgatggtgttgagattgaaatgcttgatagtgatgatgagagttttgatccggctaaccccgacacatatgaagattatttttaatcgatgtaatgctatatgactttttatttcgcacctgtttttaaatacatctttttatatgtgcttatttgtttactcttaattgcagattgttggacaaatatggtgggcggtttcctgaggaggaggagggggaggaggagtaggacggcggacgatatagagcaggtcgaggcacagcaggcggcgcagcaggacgaccttgtccagcagcaggcggagcctcaggtcgacgacgaccagcagcaggatgactacgaccagcagcatgacgcctctggttctggtggctcaagttcgaggagcatctacctgtgaggccccgcgagtctccctccgcgtcccatactttgggacaggcgaccgctgattcggccggatggggagaggtatgtaactttatgttcttcattctattatgtgttcaaaatcataatataaactaatacttcttatttatcacttggacaggtcttggacggttctggattatgctggggtcatcgtcgccccccaatggcatcctgggccttctatgccgggaacacttccctggacttgtcgagtacgccggagtgacgagcccagcatacaccttcgaccactacgccgtcgcccccgatgcagtagatcgggacggcagacaattcaacaacaaggcggagcgggtcaagcaagagctgtgggtaagtcttcctcgcactatattgtttaataagtcgcatttgttgcatattcttgaaataatgtatggatacatcgtctttgtatgtaggatttcttcaggtgcgatgctggatacgaggccagggcggatgtggtgtctacgacatgctgtaagaagctcgtcgtgggcctgcactacgaggcgcgcatccaggccatcgtcacttaccacggctccgtccttggggagaaggtgaacaagaaggacgcccgaaccatgtcgttgactccggaccagtacttgcaggtaaatacaaaactttattattggtactaaatatgcttatttttatcttctgatatgcggtgtacttatatttttttagatgattcctcattggtgcgccgcgcatcctgagtgctgggagcagatggtgcagaggtggtgctcggctgagtgggatgaggcgcacaacgctagccgggaacggcgtttgctgatgcaaggtccctcccaccatcaaggcagccgcagcctgggcaaatacgcggaagcatgggtacgcgctcttttttatttaggtatataactttcgattagacatgatttctaaccatctcgttggttttctcgcagtcggcggcacatggtggcgcgccttgctccacgttctcggcatatgccatggcccacaaggggaaggcgacgtccgacgtcacctacaacccggatgacgggcccgaggcgtacaccaaccccgccatccacagccgcctcagtgagtacaccgccatggccaaggaggtccatgggccagattacgatccgaggaccgaggacatcgacggagatgtcctcatgagggtcggaggaggcaagaggcatgggcggtactggattgccgacggggcaatcgactcgtcctccactcccactctctctcaggtgcgagcaaggagcacgagcgcgagcccagccatacgacctcggcaggacacctcacagcatcgtatccagcaactccaggttattccttatctattcatcgttcattgatttttatatatcttctctttgcattatcgtaacattagggcgaaatattacagactcagctagatgatgagaggaggcaacgtgaggagctggagaagaggatggcggagatgttcgcgtacatgcagagccttggcgccgcacagggtcatgctccaccacctccgttgttccctgcagctgaccctacagagttcactactcctgtgagtatcaaaattttagtactgcatgatatatattcatatgttctcacacatacaatctcttctctgtgcagggtcaatcggcggcgtcgaacaaccctcatgcttcgtccagcccttcgccgaaccagtccagatgcccacctcgttgatgatgtgttttgtgatgatccagacttacctttatgagtgttggtgatgtttgttacactttatcttgtgagatacttggtgatgttagtgatgatgcagacttgtatctgttttgtgatgatcctgactttagtgagacttgtgatctgttttgtgagactttgtgatatatatggtgttgatgataaatgtgttcattctgtgatgtgcttgatatataatgtgatgtgaatgatatatatcttttgtttgtttggatggaacaacaaaagcaaataaaaaagggacattctggtcactttgccgagtgtaacactcggcaaagggttgctttgccgagtgctatgaccatggcactcggcaaagaaggaaacctgggaaccggtaaagacatctttgccgagtgctgacagtggcactcggcaaagaaggaaacctgggaaccggcaaagatgtctttgccgagtgcttttgccaaggcactcggcaaagatactggcaaaggggcccactggagggttctttgccgagtgccaggccaccagacactcggcaaagaaaccttctttgccgagtgccattagggctctcggcacagggactggctgtggggtccactggaccagtctttgccgagtgtcgccgtaggcactcggcaaaggatccgtcaccgttacttggcgccgtgacggtgacttttctttgccgagtgccaggtgagcactcggcaaagactttcgaccgttacgtgcgccggctgacggtactcggcaaagaagctgttgccgatgtacagttcgccgagcgttctttgccgagtgttacactcggcaaagccgttgccgagtgtaaaatagcatttgccgtgtgtttcgaacacacggcaaagaagctgattccggtagtgtatgtggaaaacaataccactacgacgacctaggctcttcttaataaagaaatattcatttcaaaaaggataatgaataatagaatttctattatttgacatgtgaaaaattgtaacaacttgattaaaagctaaaatctatactataaatttatgaagtgacaacaagggttgcgtcaagagtttgtatatcttaagacaagatttcaacaaaataca

SEQ ID NO: 8142 - DNA, 847 bp, Zea mays
aattcggcacgaggtttcgcactcggcggcacatggtggcgcgccttgctccacgttctcggcatatgctatggcccacaaggggaaggcgacgtccgacgtcacctacaacccggatgacgggccaggcgtacaccaaccccgctgtccacagccgcctcagtgagtacaccgccatggccaaggaggtccatgggccagattacgatccgaggaccgaggacattgacggagatgtcctcatgagggtcggaggaggcaagaggcatgggcggtactggattgccgacggggcaatcgactcgtcctccactcccactctctctcaggtgcgagcaaggagcacgagcacgagcccagccatacgacctcggcaggacagctcacaacatcgtatccagcaactccagactcagctagatgatgagaggaggcaacgtgaggagctggagaagaggatggcggagatgttcgcgtacatgcagagccttggcgccgcacagggtcatgctccaccacctccgttgttccctgcagctgaccctgctgagttcactactcctggtcaatcggcggcgtcgaacaaccctcatgcttcgtctagcccttcgccgaaccagtccagatgcccacctcgttgatgatctgttttgtgatgatctagacttatatttgtgagttttggtgatgttagttagacttggtcttctgagatacttggtgatgttagtgatgatccagacttatatctgttttgtgatgatcctgacttatatttgtgagacttatattagtgagactttgtgatatatatggtgttgatgataaaaaagtcgacgcggccgcg

SEQ ID NO: 8143 - DNA, 1989 bp, Zea mays
ctccgccacacccctaaattaggatttaattcttgttaagttagaatcatgcaagtagaaatagatctttgcatatctacaaatctatcagtttcgaattgtccacgtttttggacagcccgtggttgcgtagatggtgttagtttccatgctctactccggtccgagacagagtttcggcgtcacctccctgttgttctccggacagtacactctccctgccaggacgtgtatccggagaacagcggggaggtgctgccgaaattctatctcggatcggagtagagcatggaaactaactccatctacgcaaccgcgggtgggattaggacctatcctcacctattagaaggtaggaacgtagtgtacatgcattacatgtctatattaaactatactcggttatatatgttagaggatggaggaccgtgagtggatgtacacgggccgcgttcgacgtaatgatgtcaccccagaatggattaggaagaccgatgctttcgtggaacgggcatatggcgaagctgctaaaggagctagcctagtcccttgtccgtgcagcaaatgtgacaaccggaaaagaaaaccaaagaaggccatggtagaacatatttggaagaatggatttacgccggactatactcggtggatcttccatggtgaagcgcatcgcacgagagaggaggtggtgagacaacgcgtcgaggattacgatgctgatgccggggtagcagacatgttgaacgactatcacgaggcacagttcgccgaaggacgtacggaggacgagccagaggcgaccgcaaaggcattctacgacatgtttgacgcggcacagaaaccccttcacggcaagacaaaggtttctcaactggatgccattgggcgtataatggcgttcaagtcgcagtatagcatgagtcgagacgccttcgatggtttgttgacagttattggcagcctgcttccggaggatcacgttctgccaaagagcatgtacgaggcacagaaactccttcgtgcactcaagatgacgtatgagcagatacatgcttgtccgaagggctgcgtcctatttaggaaagaacacactgaggcaaagtactgtccgaagtgtaaatcgtctaggttcatggaggtagactctggtgatggacagaagaggcagctcgacatccccgtgacaatcctacgccaccttccgttcataccgaggatccagcgtctatacatgacagaggaatccgcgaaacagatgacatggcacaaaaaaggcaaacgatacaatcctgacaagatggttcacgcatccgatggtgaagcatggacccactttgatgccattcaccatgagaaagccaaagaggctcgtaatgttcgtgttgcgctggccacagatgggttcaatccctatggaatgaccgctgccccatacacatgttggcccgtgttcgttatccccatcaatctcccccccggcgtatgctttcaaagacagaacatattcgtgtcgttgataattcctggacacccggggaataaaatgggcgtgtacatggagcctttgattgatgaattggtccgtgcttgggaggaaggggtatggacgtacgaccgagctacgaagacaaacttcaaaatgcatgtttggtaccagtactccatgcatgactttccggcgtatgggctattttgcgcctggtgtgttcacggtaagttcccatgcccagtttgcaaggaagctcttaggttcatttggttgaagaagggtggcaaatattcgtcattcgataaacatcgacaatttgattgaacgaattcttccggcgatggttcgaggctatgtccctgagcatgtctggctagcgcttgcagagttgagctatttcttccgccagctttgtgcaaaagagttagctcggaccatgattgcagacttggaaaggatggcacccgtgttactgtgtaagctggagaagatctttccac

SEQ ID NO: 8144 - DNA, 2263 bp, Zea mays
ttttttttttttttttgttttttttttttttttaaaggagcaaagacaaacttgcgcttgctactacataaaaaagcagcctcccatatagaaagtgcttgtagcatcccaaacctcagacacaaaaagggaaccattccatcatcccacaacactacatatcatccaacacgttgtcttgcttcagacataaaagtcatcattgaacatgattgacatcgactcacccatatcatccagcggatcatcatatgtgccgacctcggaatcaatgtctgagtcaaatacgccactgttgatgtaataaggccaatacctggtgtcgtcgaagaagacggggtcatgaggaagccttagatctcgtatcctggaacacttcagtttaagcgcatcgtccatttgtatgttgaagcactcgcgaatgtcaagggattcgaggcgagggcaacggtcaaggattgacatgagcccatcatttgtcagattgttaccaatcaactcaagttcttggagtcttggcatggtgctagcgatccctaatgcttctgtgccaatatcctcctttcgtgaaatagaccagagctcattcagcctgaagcgtttaagctgtgggcaggctctcccaacagcctcacacgcgctgccatacaataagcataatgtaacatctagctcctccagctgagggaagcaattaatcgcctccgcaaaacattgatcggtgaaattgcaggcggagagatggaggcacttcaatgagggggccctctgagaaaggtagcgcaggaggtcgtcgttgacgaagatatcggcaaagaacgcctccatggtgcccgcggagcggtcgattgcggcgcgcgccatggcctcgaccttctcggtctgcagtcgcttccccgacctctgagaaaggcagcgcaggaggtcgtcgttgacaatggtatcgtcaaagaacggctccatggtgcccgcggaggggtcgattgcggcgcgcgccatgtcctcgaccttttcggtctgcagccgctccccctcgtagccatagctcatgtgcctcatgtcgacgcggcgccacagcatggggtccgaggccgcgagacggtgccaggtgcggcagaccagcccggccccggtcaggatctcgatcacgtccaacttcccaaacacggacacgagcgcgtcagacggcatctcaccccagtcgcgggcttcgttctcggcggccataggtgattcctgcagcggcagcgaggacaaggggagttgggttagggttcgccgcctgggtgtggggagacgcttttttttgaacggagattttagtactatgcttttcttttttgaagaaagcacgtaaggtttgctacatatccccgcaggaaggcatggggagatcactgcggaagctacttgtagtttacaaggaagacttcacaaaacaaacatgggataacttggcttaagcatacaccgataaaacgaaaagaacagaagttcctctctactccacaagcaccatccttcaaagcgcaacaatggcagaggcttatctatccccacggcgaaagttgtgtacccagggcttcaacatctctagcatcttctccatcacttccatatccatataagataggctcgcccctcagttctgcataaaagaaatggaatcaaacagaattacaagcgtgttgttaggaattttttttgtcaaaactgtcggtgtttgaagtagtggatctaaccaaccagtgagtgttgcgtacccagatctagatggtgatgcaagttgacacaaacgatttatcctggtttaggctacgaatggcctacttccaacacaggagctatgaggcttatattacttgcatcaaagtgctcacagtagaggttacaagcacggcaggagagggcaggacctcaagtccctgggagtgattaaagcaagtgccaataccgaatgaaggggaaaactgccaagtgttcgcccggtctctccccttatggatacgtggactgtcctttttataggcccaaggagtgttaccttgtagatggtatccgactacatgttgtgaagggatgtcttcatacctatagatagtatggccttgtactttgtcgttgactggtgctgagatccaaggccaaggccaagggctcggttacgtaccgagcccccctggcatggggttgcccataccatagtggttgacacagtgcccgtcatgggaaaaagttttttatgggatgtggtagctctact

SEQ ID NO: 8145 - DNA, 3827 bp, Zea mays
  misc_feature (3560)..(3560): n is a, c, g, or t
tgtatttaaatatgaatagaattatagaaagtacatataggggatttgagaaggagaatgattggaggtagcctcacacccggattcctcagtaggcgctatggcctcgaatcggagcccttcccccagcctgcagccttcaactacaacaaataatgaaatgccctaaagtatagggttactcgctggctaggaagcaaatgggtattataaattataatctacttcggaaacctttttgccataccgaaacttctttgttttacctttcgatgcacaggggaagtacgagtactactaccacctttcatccacagcaaacacagcgcctgcagccggaggcgacttttccagcagtccctctccctctttctcgcacgaaggaggcgatagaaatggtattgctacaggggcgctgttcaccacaagctttagtcagacactgctatactagtagataaatccttaatcctcgatcaaaagaaggaaaacgcagtagagaatactagcagtagtgagtactttatactgtagatgggccccgggtgctccctctttcgcttcacttttcagatacacaggtagcagccatagatatttttttggtgcggagcccaaactccgaagcagcgcacaggcagcgtccgctcccgtcgcgcacgcgcaggcacagacacagcggcaaggcaaggaccaggtcacccgcgcctcgtctacctccgccctgacggattgccctctctgcgtcgagcaagcatcgcccgcccagccccagcccccaggcaaacagaggagcagcagcaggccgagaggcgtgttgccgacccattcttaaatgcgtgcaacggcactactccactccccactaccagctgctccctccctccttcccttccctcctacctctctctctctctccctccgttcgtttcttgactcttctcttctccccatcagccagcagtctctctctctcacacacacacaagcagcgacttgctcacagtagtgctccccggacagaatgaccaaagacgaggagttcaagctggtcaagatccaggtttcccctctctcaccctccccatctccctctctctctcatgttgtttttgtttgagacctgactgaactgttcttcgcttgcttctcgcagaaccatgcgctgaaggtgaacatacactgcgacgggtgcaagcacaaggtcaagaagcttcttcagaagatcgaaggtacttctcccctccacacacacagcctttattgttctaccacacaccccatttcctggctctcctgcagaacagcgcttactctaaggtggtggtactttgttttcagttcccctccttttctctccccccaccccctggcttggctgccaatacctatcttttgtacccggccataaaaactggaaaactttggccacttgcaactagaagcaccaccatccccctgttccttgctgaatgcgttaacgcgacaggaaaggaaatcccggctttccatgcaacgggcgcttgatgtttagaccggattgattgttagtagagtatcatccttctaccttaaagaaaacgagagataagaactagcaaaacttgatcccagtgtgtgttttactgagagctatatagctaggttggaccagatttttaccaacggttgaggtgaaatttcctgtcgttgtttcaaatagatgggcaggaaagtattctggatcgctgccctgccccactcactgcagaaacccgcatgttgtgacatgcaatggtcattcggtgcccagtacttggtagtaattagtaattactagttacagttgctcacgagcagcctgtgacctctctctctgtgtctgtgtgtgcctctgctgcatctcatgcttggcaggcgtgtactcggtggccattgatgtggacaaccacaaggtctcggtgacgggcgatgtggactcggagaccctgatcaggaagctcaccaggggcggcaagcacgcggagctgtggtcgcagcccaagggcggcggcaaccagggccacaagggcaataatggccagcagcagaaacagcagcagccgcagaaccagaaccagaaccaccagcagaagcagaagcaaggtgccaatctcagcaaggatgggcacaacaagaacagcaacggcggccagaaggaccaggggaagcaaggaggaggaggaggggctgggggcctcatgcagggcctcaaggcgttcaagaaccagcacggcaacaagcaccagctccctgagctcagctcggacgacgatgacctgtatgacgacgacgacgaggaggagtttgacgacgactacgaggaggagctccgcttcctcggggacaagatgagccagctcgggttccacggcaacaaccagaacaagaacgggaacaacgctgctgtcaacagtaaccacagcaacggaaatggcaagaagggtaacggaggtggtggagccaacaatcatcaccagaacaacaaccaccaccaccaccagaaccagaagaacgtaaacgtgatcaacatggcagcagcaaatgccaagatgggcggcggcggcggaggaggagtccagaaccaccagaagaacgctgctgcgatcaacatggccgcggcggcggcggcaaacgccaagatggctaacggcgcccagaggaacgctggtgccatgggcggcatgctgggcctgagccatggcctgggagccgccgccggtgctgctcctcctgggttccaaggctacgctgcaggcttcaaccacccgtcctcctacgctgctgccggctacggaggaggtctccagcaacagcatctccagcatcagcagcagcagcagcagagcaacaacctcatggcgagcatgcaggggtaccatcatcaccaccctgcggcgacggcagcgatgatgagcaatctgaggggtctgaacggcaacgtgatgatgatgcaccagcagccccagcagcatcagcagccgcagatgatgtaccactcctccccgcagatcagcccttacactggctactacaacccttacaactactactaccacccccaccctggcagcgctggctacccgcccagcaatggggatgtggagaccatgttcagtgacgagaacaccaagggctgtgttgtcatgtaaggggatgcagctacaatcctatgatctagaggttgtaatggtggcgtggtgatgcaatcctgctggtaccttattttccttttctttctttctttctttctttttttttcctttcattattttactgctattttatggttttttttcgcatgtatcaagaagagtgaatcatggtgttgactttagatgtgttgttgaaagtagggggggcaacttgagagaaggtgatcagacagttgtaatgtaataccttttaggcttttactgcctagtgcttttcctgactagactgggctcatgcctaaggttcccaaagcaagaagtcttgccctgacttgctttctataatttgtatattatataatctgggtgtttgtggctttggacttntggcatttgatttgaatggtgctcgtggtggatcatggcttagagtaacagtggagaggatgaacaactgttaacagtcaacatttgggggtgatgcattcatggcaaaatttgtcggtaacagcattggagttgacttggtgaaacaaaaacatgccatgtggatacaaattaattaacactagttaattacaagcacaaaggactcaagagcttttcaagttccggcagcttaggccctgttggaatcgtagtatttttgcagtt

SEQ ID NO: 8146 - DNA, 1905 bp, Zea mays
aggccggccgggccgggctctcactactaccagctgctccctccctccttcccttccctcctacctctctctctctcttcctccgttcgtctcttgactcttctcttctccccatcagccagcagtctctctctctctcacacacacaagcagcgacttgctcacagtagtgctccccggacagaatgaccaaagacgaggagttcaagctggtcaagatccagaaccatgcgctgaaggtgaacatacactgcgacgggtgcaagcacaaggtcaagaagcttcttcagaagatcgaaggcgtgtactcggtggccattgatgtggacaaccacaaggtctcggtgacgggcgatgtggactcggagaccctgatcaggaagctcaccaggggcggcaagcacgcggagctgtggtcgcagcccaagggcggcggcaaccagggccacaagggcaataatggccagcagcagaaacagcagcagccgcagaaccagaaccagaaccaccagcagaagcagaagcaaggtgccaatctcagcaaggatgggcacaacaagaacagcaacggcggccagaaggaccaggggaagcaaggaggaggaggaggggctgggggcctcatgcagggcctcaaggcgttcaagaaccagcacggcaacaagcaccagctccctgagctcagctcggacgacgatgacctgtatgacgacgacgacgaggaggagtttgacgacgactacgaggaggagctccgcttcctcggggacaagatgagccagctcgggttccacggccacaaccagaacaagaacgggaacaacgctgctgtcaacagtaaccacagcaacggaaatggcaagaagggtaacggaggtggtggagccaacaatcatcaccagaacaacaaccaccaccaccaccagaaccagaagaacgtaaacgtgatcaacatggcagcagcaaatgccaagatgggcggcggcggcggaggaggagtccagaaccaccagaagaacgctgctgcgatcaacatggccgcggcggcggcggcaaacgccaagatggctaacggcgcccagaggaacgctggtgccatgggcggcatgctgggcctgagccatggcctgggagccgccgccggtgctgctcctcctgggttccaaggctacgctgcaggcttcaaccacccgtcctcctacgctgctgccggctacggaggaggtctccagcaacagcatctccagcatcagcagcagcagcagcagagcaacaacctcatggcgagcatgcaggggtaccatcatcaccaccctgcggcgacggcagcgatgatgagcaatctgaggggtctgaacggcaacgtgatgatgatgcaccagcagccccagcagcatcagcagccgcagatgatgtaccactcctccccgcagatcagcccttacactggctactacaacccttacaactactactaccacccccaccctggcagcgctggctacccgcccagcaatggggatgtggagaccatgttcagtgacgagaacaccaagggctgtgttgtcatgtaaggggatgcagctacaatcctatgatctagaggttgtaatggtggcgtggtgatgcaatcctgctggtaccttattttccttttctttctttctttctttctttttttttcctttcattattttactgctattttatggttttttttcgcatgtatcaagaagagtgaatcatggtgttgactttagatgtgttggtgaaagtagggggggcaacttgagagaaggtgatcagacagttgtaatgtaataccttttaggcttttactgcctaaaaaaaaaaaaaggagaaagaaaaaataatgaaatagaaaaaacaggaaatttattaaga

SEQ ID NO: 8147 - DNA, 1906 bp, Zea mays
attcttattcttaaatgcgagtgggcggggggaagtgaggtgagtagagtagtagtggcttggcttcacctgcaacggaacaagaacagaaccactatcactcctccgctcttcaccatcagctgccgcttcctctcttctcccgcccagcagccagcagtctctctctctctcacacacacacacacaaaaaaaaacagcgacttgctcacagtagtgctccccggacagaatgaccaaagacgaggagttcaagctggtcaagatccagaaccatgcgctgaaggtgaacatacactgcgacgggtgcaagcacaaggtcaagaagctccttcagaagatcgaaggcgtgtactcggtggccattgatgtggacaaccacaaggtgtcggtgacaggcgacgtggactcggagaccttgatcaggaagctcaccaggggcggcaagcacgcggagctgtggtcgcagcacaagggcggcagtgcccagcagaagcagcaggcccagcagcaacagcagcagaagcaaggtgccaatccgagcaaggatgggcacagcaagagcagcaacaacggcggtggccagaaaaaggaccaggggaagcaaggaggaggaggaggggttggtgggggcctcgtgcagggcctcaaggcgttcaagaaccagcacggcggcaacaagcagcaccaccagctccctgagctcctcagctcggaggatgatgacggcatgttcgaagacgatgtcgacggcgagttcgacgacgactacgaggaggagctccgattcctcggggacaagatgagccagctcgggctccacggcggcggcaacaacaaccaccaccaccatcacaacaagaacgggaacaacgtcgtcgctgtcaacagtaaccacagcaatggcaagaagggtaacggctgcgctgcagccaatcgccaccagaacaacaaccagaaccagaagaacgtgaatgtggtcaacatggcagcagcgaatggcaagatgggcggcggtggaggagtccagaaccacaagaacgctaacgcgatcaacatggcggcggcggcggcggcggcggcgaacgccaagatggctaatggcgcccagaggaacgctggcgccatgggtggcattggcatgctgggcctaagccatggcctgggagccggcggcgctgctgctcctcctcctcctggcttccaaggctacgcaggcttcaaccacccgccctatgccggtgctgccggctatggaggaggtctacagcagcagcagcagcagagcaacagcctcatggcgagcatgcaggggtaccatcatcatcaccaccctgccgcgacggccgccgtggtgaacaacttgaggggcctgaacggcaacatggtgatgatgcatcagcaccagccgcagccgcagccgcaggcccagatgatgtaccactcgtctccccagatcagcagcccttacaccggctactacaacccttacaattactactacaaccacccccatcccggcagcgctgggtactccgccagcaacggggaagtggagagcatgttcagcgacgagaacaccaagggctgtgttgtcatgtagggcgggacgagaacaccattcctgctacctttctttctctctttcgtttctttttcattattttactgctcttatggttttcgcctgtatcaagagtgaatcatggtgttgacttagatgtgttgttgaaagtaggggcaacttgagaggggtgaccaaacagtggaatgtacaataggagtgccttttaggcttttttactgcctagcgatttgccctggctggcttgttatgatctgtactataatcgtaactcgtaagatctgggtgttttgggtttaaaaaataaaaaaaaaaaaaaaa

SEQ ID NO: 8148 - DNA, 2354 bp, Zea mays
  misc_feature (1076)..(1076): n is a, c, g, or t
ctatctcattttctgtattcctgcaactcattgtgtgcatttttgtattattgctcacagaaacatcttaattagaataacaccctttcttttcatttggtttgcccatgtatttttcggtattaacttgttcataatgtccataaatcatatacgagaggaatacttgctcagttattcttagtttagtagtcaatcttccaaaggaatgtttgttgacgattagtaatcctgtgctcacaataagaataagtgtcatcttagattaaggtactatttctatcctcaaatctagttgcatttccttctcatcttttcctgtttcatttcagagccttgcaaaacaacacatttttgcataagaaaatctgtaccatctctgatgttgcgacactggtttcttcacttttatcaaaatgccccttctgagtgcagtaccaaatactccatttcaaattataatacttttgagatttctagatacataccttttgctatgtacttagatatacattgtgtcgcgaaagggcctctagttgagttgattaggtggtcggagtagcactcctcaggtcctagattcgactcctcgtgtgagcggattttaggttgtgattaaaaaatctcctcgtctatcccacgccaaagcacaggtctaaggcgtctcagtggcggtcgtggggtagggcatgtgttttggggttttcttgacatgtgtgagaatgtcttcttaatataatgctgtgggggtggtcttatccccgcaagtcgagtttttttagatatacattgtgtctaaatacatagtaaaagaaatgtatctataaaaatcaaaacatcttgtagggagtacaacttggtgaataggggaatgaatgggtagtaaccatctgtgtatttttacaggaatcaataggaaaaaattacctaatattcttaaatttccatccgagttcttggtttttttcgctttggaaatgctttagtgaatatgtcctgctaaaatttggtattaatgaaattggacccttatggagcatgccaatatttttgctggtgcagggtagatgattggntgcctgtagaaacttggtatttattggacctgctgctgggttgttcctaactatagccatgttatattttgcaggagagtaaaaatcctgttgttagaagggtgctcactattaacaactcgaggtctagaatcggtgataacctcatggggcgacctccagagtctagaagttgttacctgcaacaaaatcaaggatgaggaaataactcctacccttgcagagcttttctccaatctcaaagagctgaagtggcggcccgacaacaagtcacttcttgctgcaagcctcgttggcactgggatgggaaagaagggcagggtatttttcaaaagggtatgaagtctgatctccttggtgctccattccctgtgatgcgcttcacctgttatctgccctgtaaggattgtcctctcttgcagcttatcttacctgcccatcaacgaatcaaagggaaggtgctcaacaattcagcaggtgttgctgcttagttggattgctagtcgaaactaggctaccgcacaaagttcctagttcttgacttgatcaaagtcaaccacgtttcttgatactcaaaagccgtacacaatgtggcatctgttcttccacttaagaccaaggacagtcataactagtcagaacctggtagtttgatgatgcacagtttcgggtaccaggcgcctgatttgtgtttgtacctgtgttcatgtgttgtaactgacaagctgaggtttgctcagaggagcctgaccgtagtatttctgtatgaggaaaagcattgcttcataaattatggcagagttaaattatggatagaaccaaaagaaccaaatgtttacagcacgatggtctaactgtcgaatgaaagtgtgcctgacgtctgacctgcactgcttatttctattactgttatatgcctgctttgattttttttaggatttctctgtctgctaagtgctaacctgatctcaaggaatgttgcgttgcataggtggggcctagcgcttcgcatgcgtggcaatgggtacccaaatacaaatacctaacaggtttttatccaatatatggaaactggtatgagatggtaatgggcaaaaatctctacatatcgggtagccaggtacgagtataggtgggtgctacccatacccgagatagaatataattgtatcattatcactattaccatctaataaagttcatcttaacaaatttttttttcttcggttattgtttatttaactgtcaagttatgtgaaagggaattaggcttacacc

SEQ ID NO: 8149 - DNA, 2099 bp, Zea mays
tccagcctcccacctccagcattccaaacctcagatcccccgcacgccgcgcctccgaaattccgaaacccaaatcagagcgccgcccccggcccccgctgcacgcaccgggcgggggcccatgcggccgcgcggctccgcgcccgcgccacaccgttggaaccgagcgggcgcgctagatgcctgagcccggcggccgctgcctcggcgacctcggcggtcagcgccaggtgctcaagggctggcctgacctgtggctggtgggggacaagcccggcctccgcgcgctctccaccgcggccatggccgccgcgccccagccgccgccgctcgaggccgaccaaaccctagcgctcccggacgtgcttctcctccgcgtcctcgcctgcctccctgagccccagctcacgggcgccgcctcgctcgtctgcaggcggtggacgcgcctcgcggggcgcctgcgccgccgcctcgccgtgcgggactgggccttcgtcgcgcaccgactgccataccgcttcccggacctggccgacctcgacctgttcccggcctccatcgccgcgcccaccacggcggcgccccacggcaccgctgcctccccgcttctcacctgcggcgcggtctcgctaaccctagacaccagcgcagacccgccgctcggcgcctgccggttcatcgacgacgacgcgctcgaccggggactcgccgccgtcgccgctagcttccccaacctcagccgcctctcggccaccgccgcctctgagtccggcgggctcatggccatcgctgtcggatgcccgacgcttcaggagctcgagctccaccgctgcaccgacctcgccctccgcccggtttccgccttcgcgcacctccagatcctccgcattgtcgccgcgtcccccgcgctctacggcaccgccgagggcggcggcgtcactgacatcggcctcaccatcctggcccatggatgcaagcggctggtcaagctggagcttcagggttgcgaggggagctacgacggcatcgcggctgtggggcgctgctgtgcgatgcttgaggagctcaccatcgctgaccacaggatggacggtgggtggcttgccgcgctagccttctgtgggaatctcaagaccctgcggctgcagagttgcagtaggatcgacgacgaccctggcccagcggaacaccttggtgcttgtctcacgctcgagagcctgcagctgcatcggtgccagctgcgtgaccgtagcgccctccacgccctctttttggtctgtgagggagcccgtgagatacagttccagaattgctgggggcttgaagatgatatgtttgccttggctggcctatgcaggagagtaaaaatcctgttgttagaagggtgctcactattaacaactcgaggtctagaatcggtgataacctcatggggcgacctccagagtctagaagttgttacctgcaacaaaatcaaggatgaggaaataactcctacccttgcagagcttttctccaatctcaaagagctgaagtggcggcccgacaacaagtcacttcttgctgcaagcctcgttggcactgggatgggaaagaagggcagggtatttttcaaaagggtatgaagtctgatctccttggtgctccattccctgtgatgcgcttcacctgttatctgccctgtaaggattgtcctctcttgcagcttatcttacctgcccatcaacgaatcaaagggaaggtgctcaacaattcagcaggtgttgctgcttagttggattgctagtcgaaactaggctaccgcacaaagttcctagttcttgacttgatcaaagtcaaccacgtttcttgatactcaaaagccgtacacaatgtggcatctgttcttccacttaagaccaaggacagtcataactagtcagaacctggtagtttgatgatgcacagtttcgggtaccaggcgcctgatttgtgtttgtacctgtgttcatgtgttgtaactgacaagctgaggtttgctcagaggagcctgaccgtagtatttctgtatgaggaaaagcattgcttcataaattatggcagagttaaattatggatag

SEQ ID NO: 8150 - DNA, 2419 bp, Zea mays
acacctaggctccaccaccgccatccccctgcccccgcgtatctcgcccccacgcccgcgtatctcgcccaacgcacactgtgcccctgccccacgctcgagcaggtagccgcagctcccgccggatccttccccacgcccaagcaggcaaccacggatctcgaccactcctgagcagtcatcgcggatctcgcccctgctgtgcccccgatgcatggctcctcattctcctctcggaatcgctccctccctccgcgttcggcaccgtgcacccccctcgcctcgcatggccgccacgggggtcagccgaggctggcgggaatacacgggccgcgtctggcatgcggctgaggagctttgcctccgcatcctcacatcctctgccatcagcctcctcttcgcgttgctcctgcatccacctctgaatcgaaaggtgctaggtaagaatgcagacgaggaaaccataaagacaacctacagccaagttctatcaccctgatggcccagaactcatgttttgctaagtcttctccacctaagtcctcaaaaatttgaacaaggccatattatcagataaaagcagatgtagctttcataggacttagttccagcaaagcaaaggttgacattgcaccaaacaatagcgtctatacttcattcttatggcttggagaagcctatgcaacatgacaagccagatgacatgtagatgagaaggttctgcatcaagagaaaccaaagcaaaatctttgcatcaagagagcaccgatgaaaagctgatgtagaggccagttgacaaacttatggaagaccagctgaccaaataattgaaaatctattgaactatgtatcaagttcattaatttgtgtaattctgaatgagaccttttatgctactgcaacgtctgtgaccacaaatgactgttgcagcaagaccatactccaggagtggagctgtctatatgaagagtgtaggtagagacaattggctaatattgtacaggttcagtttgcaggatcgtagcaacagggttcaaagacgtgtgtttgaaagggcagttgctgatgatcagcatgatggaaggtggggagttccattgctggtttaagctggagctagcttctgaagtccggtcaggtgtctgtatgtgttgcccttttttatttcatttcatgagagaggattgttatttgttccttgaactgtacttggtcgtacttgtgaataaatgttttagcatggttgttcaaaaaaaaaaaataaaaacaacaaatcagtgcatgatatttgagttatcgtatttataataatattatatatttataccatcaatataatattagtgttacgtgatattttatcatatgaattttgcatattatagtgatatttatcgttatgtatctatattttatactaatctttaactctcgtggcaacgcatgggcacacacctagtatatatatatatacatacacacgagagcgaaataacgcatgctgcgcggagacggttgtaacggcccatagaatttgcaacaaacccggtgggggcagctacagagatccgacgtccagcgaaggttacaggatggaggatatagatcagacgcccagtacatcactgttttagccgaagcgcttgcgcggaggtgagctttacctatgagccaatccaactgtgatcgtgacacaatttgcagctggaataataaaaataaaaaacaaaatgggcaggggccaggggacgtggttgctggtcttgatgggttgacgtatggagtgggctgctaggccaaggtaagtgcgatctcctcttttttttagttttctgtttttctatattcttatatatatatatatataagactccatttagaatctaatttaaaatagaattataaaccctaaattaaatgcacaaaaactctaacatgaggtgcataatcttatatctatttattttattatttggctagcttaattctattcaattggacattcaaaagcatgagaatcccagtaatatccaaaggtttcaaaatccctaaaacactatcttaaatatatttatttatttatttcatcatcattaatttttttcctatcgattttcggctttacacaaacactgacacaacccatgtgctatgtaaatgtttgagtttattagggaaatggattgttatctcaatatatatgttgtttatcgaatattatttataatgccaataactgtgtggcatgagttaaaaggagtttctcagagctaaaattattgaagaattatttaaggtctatattgtctcaagaaaggttaaatggctaacaaatttatgtaccgagaagaaattgttaaatggtattaatatcaaagtcatcactttgcatctaaaaatgttaggagacatttttaag

SEQ ID NO: 8151 - DNA, 3065 bp, Zea mays
aagagaagttctaaagttgaaaagcgaagaactgtgaagagcacactttgtaatgagagaagttcacggagccattgcgtggtttgttgcattcagccaccagcactgtcagcattcatttttaaaaaatcaagctttttcacactatgctttgcatctatagattatcctggatgtcccagctgtgggaggaaggttgatgcttgtggacatggctggatctgaaaacatagaagcagcaggtcaaacgggatttgaagccaagatgcaggtgtgttatgcaacagattcttgtatgctttagcatctatgtgttccaaacttccaattgcattctgaacaattgcttctaaggagtgtatttaatagatcgtttgacactgatcttgccacatgagttgtaccactcttaaaagcctataatattttattacatgtgcaatctataatgtcgctaaattttccacagacagcaaaaatcaaccaagggaacactgctttgaagcgagtggttgaatctatagctaatggtgattcccatgttccatttagggacagcaagctcacaatgctactacaggtacactactacaaaaatctacatttgttgatacaacctctcctctctagcgacgatctaaatatttcctttattgtatttcaggattcattcgaggatgacaaatcaaaaatcctaatgattctgtgtgctagtcctgacccaaaggaactgcacaagacagtttctactttagaatatggtgccaaggcaaagtgtattatccgtgctgctcatgccgcaacacctagggacaaaatgagctccgaggagtcatctgcaatgctcaattcaagaattgttgcaatgaaccagttcatccacaagcttcaaaaagagaacaaattgagggagaaagagcgcaatgaggctcgcaatgtgctaaagctgagggaagaggagctagcacaattaagagcaaagctcaacctgatagaagggcatggaaaagctactgagaatgagatcaattcaaaagttatggagaaaacccagacattgaggggtgaactcatgaagatggaagaagcgatgtataagcagcagcaagagctctgtgtgctaaggcagcgactgcaggaggttgagcgtgaaaaggctgatagttgtcagccagggcagcaggatataattggaggtagactgctggcacggctatcagagatgcctgcaggccttgatcaatcaatggcaatcgacatgtctatggacttagatatgggggatcagacgtccatgcaagatgtcaaggtaataaaggaggatacttgccagcagggccaaatatggaatcacacaaccacagcagcaagtgcttgcacagggtctgtggtgcaagaagatgatgtcaggctgtccgggtatcctgaaaagactgtcctcagcactgtgtttgaggagggagatgaagattatgcagagaagaaatgtggccttcaagaggaggtacgcaaggaggttgtagatgagaactttaaggtggacatagcacaacatacactttctgagccagatcatcctgcaacaaggaagcatcatattgagaacatgctcaggctctgtggcaaccatcgtgaaatagctaagaagccaaaggttcagtcaccagcaaaggaaatgttctggaatgagaaccagtctccagcaaagcaagtgtttgggaatcagaacaaatcaccagcaaaccaaatttttggagacgaaaacaaggagccgttggcatggggagctatagagacccccatgtgcgacgtcagagtgactgacagcccagtgtcttctcagctttctccaatcgtatgccaagttgtggatgcgccattatcggcgcaaccggatacatgcagtgcagtggaagagagtgatccgaacaaggagaacagccttgctggacagaaggatggcggcctcttggaagtttacataaaatgggagtctggcaacctgatcaaagggctgaagctactgcacaactcgtgcctttcagatctgaggaagtttatagaggctcacttcgaagaagcaggcagcaaacagaagcatcagttcaccttccttctcctcggggatccgtccggtgctccggtgtcccgggacacggaagcttcggtgcagataagcaggctgcctcactggaacaaccagccggacagctacctggcgtgcctgcgcgcggccaagaagccgtctgcggaccacgtgcccttcagcccgctggacagcaatctgaacacggttcacctcgccggtgcggtgtcgcccaaggtcaaccagatgagccccagctacatccgggagctgagagcttgagctcccgtggtatctgttgcttgtccctcgtggatcgattatgttttgtgtaagatttgattgctagtctggtttgctaaccggaactactgcaacccgtgaccaagataattgcagcgaggagatgacaaatgccacctctccaaagttgtgtgcgctattttctttaccgaaaattgctggcaggtcgtctgccagacaatattaatagaggagatagaaagagctaaaaatgcaagcctaagaaatacaatggaaggcccaaacgagaaattgccctcaagcatttctagcctcttcttcaacctttgcaatcaggattatttgcgttgatgctaaaaaatccgtgcaatttttttatctctccaaagcttcctaacgataagtgtcgacattcttactgctacatatgaatacccgtgggcgtctccacgtacgccgccactcttaacacagagtccatgttcttcttcatggtcaggcattggtccataagactttacgtagcagattatatattatagataaagacaatactgtttatagagtgaaatattttaagaactttaaaataagttaggaggtgttataggagagctgttgaatagcctaagtacattgtctcccatatccattttggatatctacacaggggaatgaaagatgaaggacaattcactcatggttctgcaggtcg

SEQ ID NO: 8152 - DNA, 2022 bp, Zea mays
atcctctttagccggcctgcaggacaaacaggatttgaagccaaaatgcaggtgtgttatgcaaccgattcctgtatgtttgtagcatctatgttttccaaacttccaattgcactctgaacaatacttttaagaagttgctctgtgtgtttaatagacagtcagtttgacactgatcttgccacatgaatttgtaccactgtcgaaagccacacgtgtgatcaatagggttgctacttttttcacagacagcaaaaatcaatcaagggaacactgctttgaagcgagtggttgagtctattgctaatggtgattcccatgttccattcagggacagcaaactcacaatgctactacaggtacactactacaaaagaattacatttattgatactgcctctcccccctaatgatgatctaaatatttccttcattgcatttcaggattcattcgaggatgacaaatcaaaaatcctgatgattctgtgtgctagtcctgacccaaaggaactgcacaagacagtttctactttggaatatggtgctaaggcaaagtgtattgtccgtgctgctcatgccacaacacctagggacaaaatgagctccgaggagtcatctgtgatgctcaattcaagaatcgttgcaatgaaccagttcatccacaagcttcaaaaagagaacaaattgagggagaaagagcgcaatgaggcccagaatgtgctaaggctgaaggaagaggagctagcacaactgagagcaaagctcaagctgatagaagggcaagggaaagctaccgagaatgagattaattcaaaagttatggagaaaacccagttgttgaggagtgaactcatgaagatggaagaagcgatgcttaagcagcagcaagagcttacttcactgagacagcgactacaggaggttgagcacgaaaaggccgatggttgtcagccattgcagcaggatataattggaggtagattgctggcacggctatcagagatgcctgcaggccttgatcaatcagtggcaatggacatgtctatggacttagacatgggagatcaaccggtcatgcaagatgtcaaggtaataaaggaggatactcgccagcagggccacatatggaatcacacagccacagcagcaagtgcttgcacagggtctgtagtgcaagaagatgatgtcaagttgtccgggtatcctgaaaaaactgtcctcagcaccgtgtttgaggagggagatgaggaggatgcagagaagtagtgtggtcttcaagcggaggtaccgcaaggaggttgtagagagagtactttaatgtggacataacacaacatacactttctgagccagatgatcctgcgacaaggaagcatcggattgaaaacatattcaggctctgtggcaaccatcgtgaaatagctaagaaaccaaaggtccagtcaccagcaaaggaaatgttctgcagcgagaacaagtctccagcaaagcaagtgtttggggatcagaacaaatcgtcatcaaaccaaatttttggagatgaaaacaaggagccgtcggcatggggtgctatagagacccccatgtgcgatgttagagtgactgacagcccagtgtcttctcagctttctccaatcgtatgccaagttgtgggtgcaccattatcagaggaactgaatacatgcagtgcagtggaaggaagtgatccgagcaaggagaagaacagttcttgctggacagaaggatggcggcggcctcttggaagtttacataaaatgggagtctggcaacctgatcaaagggctgaagctactgcgcaactcgtgcctttcagatctgaggaagcttatagaggctcatttcgaagaagtgggcagcaaacagcagcagcagcagttcatcttccttctccttggggtatgtcattcggctctatccatgtcatgctttcacccaagtgctctgtgctacgtgcttctcatccaatggcgctcatctatcccatgtactatcttggggaaa

SEQ ID NO: 8153 - DNA, 2469 bp, Zea mays
gagttttcacccatcccttcccagttctgtccctctcgaaccctaactccaaaaaccctcgctctcctctcatggccgccgccgcagctgacgacgcagccgaggtggagcggctttacgagctcggcgagcgcctctcctccgccaatgacaagtccgagcatgcggcggactacgaggcgattattgcagcggtgaagggacagagtgccaaggcgaagcagctcgcagcgcagcttatccccaggttcttccggagcttccctgcactcggcacgcgcgccatgtcagccatgttcgatctcgtcgatatggaggagctcgcgatcagaatacaagctattcgtggctttccacttcttggcaaagatactgaatttgtgtcaaaaattgcagatgttttgggtcagctccttacaagcgaggaaaatgttgagcgtgatgctgttcataaagcgctcatgtcccttatacggcaagatgttaaaaattcattacaacctttatttaagcatgtggagcaaggatcagagattcgtgagaagattatttgttttcttcgagacaaggtctttcctcttaaagcagagctgctgaaacctcaagcagaaatggagagatttataacggatttgataaagaaaagtgtgcaagatgtaactggttcagaattcgaactattcatggggttcttgcgaagcttgagcatatttggggattctgctcctagagagtcctttcaagaactaattgaaattattcaagcacaggctgatctgaattcacaattcaacgtttctgacattgaccacattgagaggtggatttcatgcatgtatatggctcttccgatcttcatgagaggagcatcagcaagcaagttcctcaattacttcgttaaacaaattgttccagcatttgagaagattcctgaagaaaagaaactggatttgctaaagactattgcttcaagttcaccatatgctgcagcacaagattcacgtcagctgcttccatctgttgttcagttactcaagaagtatatgcctgggaagaaggtggaagatatcaaccataattatgttgagtgcttgctatacacttttcatcatttggctcacaagactccaaacacaacgaacagtctatgtggttacaagattgttactgggcaaccatcagatagacttggagaggacttctcagagcattacaaagatttcacagagaggttaactggaacagaagagacggtacgagcagcctcaaagcgactaactcaggggatggcagatttcaacaaggcaatatcttcagcaaaaactgacgaggaaaagactaaaattaaaggcgatcagcaaacttcaacaaggacaatgaggtcatataacaatatattggcaatgacacagtcattgcattcaaaatcccctttatttatcggtgataagaaaatcactctgtcatggatggagcagcccaacaaagcagcagctacgaaagcaggggggaagaggtcacaacctagtacaaatgggaatgaccctgcaaacaagaaggggagaggaggaatgcaaaaccagctagtgaacagagcttttgaaggactgtctcatgttggaagaggcagtggaagagggcggggcaggggtggccgaggaagaggaagaggatggagtgggtaccactgagatgacctggaaattctgttcaaacctgacaagggatgagctttctgcttccaccagagagtaaactccaaggtcgatgttttattggtgtgcattactgcaacgcgttgaaatggatcaaggcacacaacagcagaaatgcgtacacagagaaaggatgctaagaaatgtctgcaagtttgtgcatctttcttattcatttaccatctcatcgtgttctttgccaccctaaccgtcgtgtcacttgcgttggctggctgtttgatgaactgggcagttcgatatctttgttctttattttattttacagtgtttgaagagacgaccaagcttgtgctgactttgtttgagttcgttttatgtttcgtccttgtactgacacagatgtattagtgatgtttaacttttatgtaacgattgatctagctgtaatataagttaagcatttaagtaagcaaaaaaaaaaaaaaaaaaaaaaaaaaaaaaaaaaaaaaaaaaacaaaaaaaaaagggcggacgataaaaagggtggaggcttaagaaaggaaaatgcgaagcatatgtttctatagggacatctaaattaaatgaactggacgtaaatttacagggtggtgactgaaaaaaccctgacgggaaaaaacttaatggtaccgaagtaaatccccttttagaaaattggctttaaagcaaatagggcaataccgattgacttgacaaaaatttgccttccctaaatggggaatggtacacgccctgtagggacgcattaagagcg

SEQ ID NO: 8154 - DNA, 2148 bp, Zea mays
cattgggtacctcgaggccggccggggtggtcaaagaaacaactttcaccgttaccttcccaggttccgttccctccaaaccctaactcccgaatcccctcgctctcctctaatggccgccgatgccgacgcagccgaggtggagcggctttacgagctcggcgagcgcctctcttccgccaaggacaagtccgagcttgcggcggactacgaggcgattattgcagcagtgaaggggcagagtgtcaaggcgaagcagctcgcagcgcagctcatcccgaggttcttccggagcttccctgcactcgccacccgcgccatgtcggccatgttcgacctcgttgatatggaggagctcgcgatcagaatacaagctattcggggttttccacttcttggtaaagatactgaatttgtgtcaaaaattgcagatgttttgggacaactccttacaagcgaggaaaatgtggaacgtgatgctgttcataaagcactcatgtcccttatacgagaagatgttaaaaattctttacaacctttatttaagcatgtggagcaaggatcagagattcgtgagaagattatttgttttcttcgagacaaggtttttcctcttaaagcagagctactgaaacctcaagcagaaatggagagatttataacggatttggtaaagaaaagtgtgcaagatgtaactggttcagaatttgaactattcatggggtttctgcgaagcttgagcatatttggggattctgctcctagagagtcctttcaagaactaattgaaattattcaagcacaggctgatctcaactcacaattcaatgtttcggacattgaccacattgaaaggtggatttcatgcatgtatatggctcttcctatcttcatgagaggagcatcagcaagcaagttcctcaattacttcgttaagcaaattgttccagcattcgagaagattcctgaagaaaagaaactggatttgctcaagactattgcttcaagttcaccgtacgcgacagctcaagattcacgtcagctgcttccatctgttgttcagttactcaacaaatatatgcctgggaagaaggtggacgatatcaaccataattatgttgaatgcttgctgtacacttatcatcatttggctcataagactccaaacacaacgaacagtctatgtggttacaagattgttactgggcaaccatcggatagacttggagaggacttcacagagcattacaaagattttacagagaggttaactggaacagaagagacggtaagagcagcctcaaagcgactaactcagggaatggcagatttcagcaaggcaatatcttcagcaaaaaccgaagaggaaaaaactaaaattaaaggcgatcaacaaacttcaacaaggacaatgaggtcatataacaatatattggcaatggcacagccattgcattcaaaatcccctttatttatcggtgataagaaaatcgctctatcatggatggagcatcccaagaaaccaacagctacgacagcaggggggaagaggtcacaacctgctactacaaatgggaatggccctgcaaacaagaaagggagaggaggaatgcacaaccagcttgtgaacagagcttttgaaggactgtctcgtggtggtagaggcactggaagggggcgtggcaggggtggccgaggacgaagagggtggggtggctaccgctgagatgacctggaaactctgttcaaacctgacatgggatgagctttctgcttccacttgagagtaaatgcaaaggtcgatatttatttgtgtgcctcagcgcaacaagtttaaattggaaggcacacaacagcagaatgcgtacagaaagagtaaaaaagaatgcttgagaaatgtccgcaagatctgtgcatctttcctattcatttgccatcaagccgtgttctttgccaccctccgtcgcttcacctgagttggctgtttgatgaaatgttggcaagatctgtgcatcatctttcatattcacttaccatctcaccgtgttctttgaaccctaacagtcgtttcacctgtgttggctgttaaaactcaacagtaagatatcgttcatttattttatttgattttaccagtgtttgaaaaac

SEQ ID NO: 8155 - DNA, 555 bp, Zea mays
ttccacgcgtccgaggacatacagtgcaggatctgttcatgataaaacagtgtcacctgttgctccgttgttaggccagagtgttcctgacaacagcgtgcgccatgagatcaggaatccaatagtcccaggatatcatgcaggatatgcagcaccaggggatcgacctatttatggtccgccacctccaaatacaagcagagctccacaaggaaattttccttgccctcctgtttccacacaccatagttctgtgatgccaccgccacctattcaaacctcttttgttcgtcctatgtatcctggtccagggagtccctgggagaacactactccaaatccaccgcccttcagccacgtttctcctcgcatgatgcctggaagtaacttccgtgttaatccagcttctcttccttttgtaccctcttgtgttacccctgtttcacagcttcctggaggatcagcacagcattctgagaaaatgccaccatcactacctctgccaactgtagctcccccaccatttacacctctagatatgccaccaacacaccc

SEQ ID NO: 8156 - DNA, 5665 bp, Zea mays
  misc_feature (174)..(174): n is a, c, g, or t
  misc_feature (397)..(397): n is a, c, g, or t
  misc_feature (1588)..(1588): n is a, c, g, or t
ttagaaaggattgttttagaaatctatgagcgaaagactatcggtgacggcgtaggagcgagagcaaccacacaaccgactagtgagaatgaagcttgttggatgatgcaaggactagagtgtcgcgagattacttcatgacttcgattcacatttagcagaaaatagctatanatctagaggtgtaaagatgcaaaaaaaatcgacatagataaaatcatatgcatgttgggtgtggagaattgagctagaatgacatggagaacaaagattgaaaaaagcattaactagagactgaggagactctggccattaggtttgattcatgccataataaattctagtgtttagttagacgagcattacatagttatttattttccgctttatatctatngtgatgtctagttgtctacattgaaagcaccggtgttaattcattggtggatcgatagccaccaatcggtattatctaagttgttcgtttcgaattaaaggtataaaataccggagaaaccaatatagattaaaatcaagctaatagtctaatcgacattaaccgtcgttaccttttccgtcacgttctatgtgtctggaaaacctcattttcatacagttgatgtccacactagtacacggtgctgagactaccgggaagttccaccaaccagtcttgaggttgcagcggtaagttctatagtcctacccgtcagccacaagaagtttgcgtacatttcattttttatttttatttacacaagtaaaaatgactccattttatttgaggtttgtctccgtctcagggaagcactgtcgagagacgccaatcggctgtggccgaaccgtcgtcgaattctccccgtggcagcccgatcatggcgtcgccgccggcggatccgcacccgaagaaacgtagggtcgccgacgcccaggacccaagctcctcctccaatcctgcacccacgcggcgtccttcccctgctccgcctcctcccgaaaccctaggtgctgtggcgtcttcaacctcctccccacctccgacagaaaccgcatcgctgccgccggagggggtgaggcttcaaaagcttcgcaaccaagaggagttgagaaatgtcttccagcgctacagccgtatccgcaagtacatacaggagcataaagacggcggcctcacgcccgagctggagcaggactatctctacctcatctccgcctcccgaggtggctaagctcccctttctctctatagtgacgtcatacaacaacactggcattacattcgttgttacttgatgttgtgatttgctatagcctgtgtaagtatgtaggcttgaatcagctccacattcaaaactacgtttgtttgttgctgctgcaatagtttatactgagggagaacgaatactgggttttaggaatgtttaatagatagactagagttcagatctaaacaaatggaataatgtaattctacataagaattaccacttcacatggatttcaagaagtagcttattcattttcgctaacttccttttgttgatttgcaaccgacagtaatttattgatcttcaattaacttatctgnttatgcattccatttgttttgagtacctcgtaatgacattgtatatcaataatgataaattctgcatgaaatctctgtgctgataactacaatttggaagttgtttgaagtactaccacatcattgatcgaaatcaagatgaacttgttgaaattcagatatgttgtttgttatatatctttaaggtaagacagtgttattcatgattaaattatccattatctatgtaactataaaacttgatcctaagagcttacttcactacagatgtcctaattttctctgtagcaattatgcttctccatgttttgtgaccagtttgtctagcaatagggaggacaaaattttctgggacggtgaataaatccaagaattgtacaatctgagtttatctccccatttattatttgttacagcttttgctcgaagggcagacctggtgcagtagtgagagctgtcccactaagtcaccaagtcatgggttcggagcagcctctctgcatttgtagagagaaggcttgcctctgtttaccccttccctagaccccatttgtgtgggagcctttgacactaggtctgccctttttacaacttttgctcataatgtatcaaatttaaaggcgtaaccttttcctttggtttaactttattaactagcagagcattatttggctaaaacttctgaagtacatcaggacttcattttcacaacttaaggctgttatttttgaaagaatcagtctcttccatgtttacaaaccatccttatcttttccttgttcatccatacaggttgtgaaagtgtacagtgttttctatctttgccaatccctcgatttgcctcacgctgtcctactgcactcgaggcggcgactaaagttaccatcaacatgtacaattgcaacatggccactgtaaagagaggggaggatttgaaaagtgtaccatacaagacggccgaggcatgtatcattggcttaacttacgtatgctctgcagcatcttctgaagaactcaagtcatctgttatgaaaggaatctgctctgtcgtttatagaactgtcctctccttcttcatttcaaccttggaggggaaggatatctatcgtatggactatacaaaacgtgcaatgcttcaggaccctgtgacgttgttagacactttaaaactggagttggacaatgctaagcaaccaacaattgataatttgtctgagctgggagctatttgcttgctttgcacattccttttgttcccagagaatatactagaagcctgttttacgctgcttgattctgcagaatgtgatgatgtaaaaggagaagggttataccttttaaatcagctgacctgtcatctgacctgtaatgctgcaaatgatgctatgggtgataagatcgatgagcagtgtcctgtgatggaaggaaatttgtccgacaccaataaatttgttgattcaaatcctgttgtttcggaaaatgccatggagccaaatgagtgttacatcacaatggccatctctaggcatccatttctgagacgttggatattatcaaggtacaagaaattatgtgattcctgtaaacctgccgtggtttctgaggtgtcatcttgtttgaaagttttgggctctttgtcagaaccttccgatgataaaagtcacacgggcaatgagtcatcagtgctggagaaacttgacaacaatgtcagagaaaatatgcgaccagatgaactaatttcttcatctgagcagggagcacttgcaaaaactgagagtgtcccggccgggccatgtaagttttcacagaataagaatgtggacatggttcgttctgataatcagaaatctgatgagctcacggacgcaaaattggatgacttcaaaggaggaactgttgtctctgatgcacagcatcaaggttcaagatctgatttgcttatgccaaaatctgtgtatgattctgctggaggatctacatcacttacttctccaggacaacattttggaagggcaaagcatttattttctgaaccatttgatatttatggcacttatgttgcgagggatgtgatttcagtttcaaaggaactttgggttggttcactgggaaatagagcaactgaggcactagtcagatctaagtttgaggagtttggcccattagtaaattttttgttctatccatccagaaaattttctttagttgagtatagaaacatattacatgctgtgcatgcatgtggatatatgcagggttcatctatttggggcggttttcttcaagtaaagtatttagacaggcttataggtagtaagggagttattcgtggtatagctattggtgaaagccgtcatgtttatgttgctaaagtcaagaataaaaaagacaaagatgaggtctttgatgatttaaagatggcagggctgaagtggccatctgggattactgatattcctggagaaaatgctttgcttcttgaattcgagacggcagttgatgcagctactgcaaaattctatattaggcaccaagctcgtccaaatgtttgttccagggatatgaatctacctggtcatcaacttttggtgcaaaatatagaccactcagtccctgacatcgacttaatcaacgccttctctcaattcggtgaggtcatcaggtggcaaatcaatagggctgatagtaactgctttatagtttatagatcacaagatgctgctgcccgtgcgaaatcacacttgcatggagcgcggtttgggttgaagtcaattagtattgaatcaaggacatacagtgcaggatctgttcatgataaaacagtgtcacctgttgctccgttgttaggccagagtgttcctgacaacagcgtgcgccatgagatcaggaatccaatagtcccaggatatcatgcaggatatgcagcaccaggggatcgacctatttatggtccgccacctccaaatacaagcagagctccacaaggaaattttccttgccctcctgtttccacacaccatggttctgtgatccctccgccccccgtgcccgccccggttgttcgtcctatgtatcctggtccagggagtccctggggagaacactactccaaatccaccgcccttcagccacgtttctcctcgcatgatgcctggaagtaacttccgtgttaatccagcttctcttccttttgtaccctcttgtgttacccctgtttcacagcttcctggaggatcagcacagcattctgagaaaatgccaccatcactacctctgccaactgtagctcccccaccatttacacctctagatatgccaccaacacaccctccgccactacctatttcccagccaccttcagtgccgccacccccaaattctcctcctccgcaaccttttgctgattcgtctgactcacaaaagccaagttctcatcctcaatggcagggtcctcttttaaaaagtggcttgcattactgcagaatctatgcaagcagaatagagttggatgcctgcagatatgaaaatactgtttctgaaccggcagaatggccttcagcgctagatgtgacaaagcgcacagctttccagcatgtgaagacaactttcaacaatacaccgcctaataagagagaggtctgccggctcgtgccttgttcaaatggtgatcagagagggttccgggatttcataagctatctggtacagaaagaatgcgctggcgtgattaggattcctgctgtgaaggcgatgtggacgagaatactgttcatccttcctcccacatctgatgcatgtggcatggtaggaatcccccctcttccagctgacaccatgattgttgtaactttgcccaaggaaacaaccgtcgaagcatcataacaattttgtgtgctacatgtatgtatgttagctttgtcggtgtaagctttttgtggagctttgtactccatagcagtcatgtaaaaactgtgcataattgttggctactatacggtgttagcatcattatacagtaggtcagctcagttcttctgtcgaaaaaaaaaaaaaaaaaagaaaaaaaaaaaaaaaaaa

SEQ ID NO: 8157 - DNA, 1541 bp, Zea mays
ttgggtacctcgaggccggccgggtttccgtcggctgcattcctacgcgcgtgttctgtctgtctctctcggccccctctcgctctccgacgactggtgggccgctgccggcgccgccgccttaacccaggtgttgaggctttcgttggtctcctcgccgtcgacgagcacccaccaggatgaattctaaacgtaggaggagtcatagcccagttgaatacaaggaaggccgtgacaaagattatgggacttctggaaagaaggataagtcaagagatctagatgacacatgtgatgctagaagaggtcatgaaaccgataggcactctgataagcattcctttggaacatcacgtgaatccaagaagcatgatgactatcggaggtaccatgataagtatggtgatgattatggtaggagccatccaagagcctctcggtcagaccgggaatcaagggctgatacttattatgatcgctcaaagcatgataacacatctggtagatcacgtggtgatcagcgagattttggcagtaggtacggagaaaaatctgttaatcgagatcagaggagtataaatgaaggaaagcaggagtcccctcgtggctatcaaaagaatgatggcggagaatacaataaacatatggatgcaagaaagcaagagtacaaaggttatggagatgatagagatcattacagggttgttcgtaagaacaaggaaaccatcaaagaggaggaggactcgaagaggagaaatggaaaggaaattgagaaagaagctttggtggaaactagggataagaaaagaagtttattcagctctactgggccaaatgtggataatccaggcgatgtcaaactatcctcagccacaaatgaagccttggataacgctgcagaaaccgtagacggtgtgaatgcagctaaagttgcagctatgaaagctgctgaattagtgaataggaacattgcagcatttggtgctggaactgggcgcctatcaactgatcagaagaaaaagcttctttggggtaacaaaacgagtaatccctctgaggagacaagtaaacgttgggacttattttctgaccgtgagcgccaagagaaatttaacaaactcatgggtgtgaagagcagtgccccagttcaggaaaacacggtcgagaacaaggtcgggagctcggcggaagaagccaagaaactggaggagctcgacaccaacctggagaaacattacatagcaggcctccgcaggagagatggcaggacagtcggccttggcctctagaaactctgcttgcagttgcagatgctgcggcattgaaaaatgcagagagcttgctctgtacaatctacagtgccttgtttattcttgcacttacaaaatttcctgtacggcttacgttgactgtttccgggttatcttgaagctctagaacatgtgtccctgattgacactcctgtactgcgtttgcataaccccgtcattcttgagtagtaattcaccggttattgtttaaaaaagatgtatctatatata

SEQ ID NO: 8158 - DNA, 1660 bp, Zea mays
gggaccctcgaggccggccgggaagggccatgagccccatgactgtgtctgtgtgaattgcctttggatcgtcctagcagccttgtcgtcgttagaggatttggaacccgttccattcgccgcctttctttttcttctcccgtccaccctacgagcgcgcacgctctcctggctatagcaaccgccgtcgccgccccacgctacgtgctcgagtctagcctcgtcggttccttcgtcagttcttcgtcggatcctttgctggcgaccaacacccaccagcttgctgtttcccccttctttttgcttgcttcatcgaagtcctttccaggatgaattctaagagtaggaggagtcatagcccagttgaatacaaagaaggtcgtgaaaaagattatgagacttctggaaggaaggataaatcaagagatctagatgacacatttgatgctaaaaggggtcatgaatcgggcaggcactctgataggcattcctatggaacatcacgtgaatccaggaggcatgatgactataggaggtatcatgataagtccggtgatgattatggtaggagctatccaagagcctcttggtcagaccgggaatcaagggctgatacttattatgatcgctcaaagcatgatagcacatctggtagatcacgtggtgaccagcaagatgttggcagtaggtacggagaaaaatctgtcaatcgagatcagaggagtataaatgaagaaaagcaggagccccctcgtggctatcaaaagagtgatgttggaggatacaataaatgtactgatgcaagaaagcaagagtacagaggttatggagatgatagagatcattacagggttgttcataagaacaaggaaaccatcaaagaggaggtcctgaagaggagaaatggaaaagaagttgagaaagaagctttagtggaaactagggagaagaaaagaagtttattcagctctactggaccaaatgttgataatccaggggatgccaaaccatcagccacaactgaagccttggataactcagcaggaaccatagatggtgtgaatgcagctaaagttgcagctatgaaagctgctgaattagtgaataggaacattgcagcatttggtgctggaactgggcgcctatccactgatcagaagaaaaagcttctttggggtaacaaaaagaataatccttcggaggagacaagtaaacgttgggacttgttttctgatcgtgagcgccaagagaaatttaacaaactcatgggtgtgaagagcagtgccccggttcaggaaaacatggtcgcgagcaaggccgcgagctcagcggaagaagccaagaaactggaggagctcgacaccaacctggagaagcattacatagcaggcctccgcaggaaagatggcaggacagtcggccttggcctctagaaactctgcttgcagatgatgcagcgttaaaaagttcagatagcttgctctgtacaatctacagtatcgtttttattcttgcacttacaaattttcctggctggtttatgttaactgtgttgccgggttatcttgaagctgtaaaacatctatgcctgattgactcctgtattgcgttggcataacccgtcatctggggtagtaatttgtaaaaaaaaaaaaaaaag

SEQ ID NO: 8159 - DNA, 1361 bp, Zea mays
ctcccgtccaggttcactccgccactccggccccctcatcttcttcccgtccccctcttcgttgcccccagatcccgcaaaccgcgaaaagaaaccgcatatcagcgggcgctgctcgttctcatcgccccccctcgtctctcgcggagccgaccccgtccccattcggacctcagctagccaccaccaccatggcttcttcgaagaggagatttggtgctgccggcggcgcggacaagaaggatctattccatgtcgtccacaaggtgcccgccggcgacagcccgtacgtcgtagccaagcacctccagctcgtggagaagcaaccggatgtggcgatcgtgtggttctggaaggcaatcaactcaggggacagggtggacagcgccctgaaggacatggccatggtgatgaagcagcaggaccgttccgaggaggcaatcgaggccatcaggtccttcaggcacctctgctccaagcaggctcaggaatccctcgacaacctcctcattgacctctacaagaaatgcgggaaagttgaggagcagatcgagctcctgaaacagaagctcaagtcgatataccttggcgaggccttcaacgggaaggcgacgaagaaagcgcggtcccatggcaagaagtttcaggtctcgatccaacaagagacgtctcgtattctgggcaatcttggctgggcttacatgcagcagaacaacttcgaggccgccgagctggtgtaccgcaaggcgcaagctatcgagcccgatgccaacagggcgtgcaaccttgggctgtgcctgatcaagcagggcaggcacgacgaggcacggcaagcgctcgaggacgtccgattgcgcagaatctatggatcagaagatggaaaggtggttgcccgtgcggagcagcttctccgcgagctaaacccgttgcaatgcgtttcatcgccgttccaggttggcctcagcgtccatgaagggatcatgggtgaaccagacctagtagtgatgaacgagtggacgccgttcaggtcgaggaggctgcctgtgtttgaggagatagcaactttccgggaccaaatggcttgttgatgcattactttgcatggtttaatttatctgtcagtgtcacactcacatccctctagaagtttttgttcgtatactgggtgtgggggcgtgacggtgaggaatagagatcagtatatatcatatagctggggttgatgcaaagcgttgcctttaggatagtatttggttcatgttatatcactgtatggttcagatttcagtgaacaaatgttcgtgcgtgccctgatcttgtacaggatttacagttggctgttgtgaaaaaaaaaaaaaaaa

SEQ ID NO: 8160 - DNA, 1312 bp, Zea mays
attgggtccctcgaggccggccgggagatcccgcaaaccgcgaaaagaaaccgcctatcagcgggcgctgctcgttctcatcgcccacctctggtcctctctcgcctctcgcggagccgaccccgtccccattcggacctcagctagccaccatggcttcttcgaagaggagaggtggtgctgccggcggcgcggacaagaaggatctattccatgtcgtccacaaggtgcccgccggcgacagcccgtacgtcgtagccaagcacctccagctcgtggagaagcaaccggatgtggcgatcgtgtggttctggaaggcaatcaactcaggggacagggtggacagcgccctgaaggacatggccatggtgatgaagcagcaggaccgttccgaggaggcaatcgaggccatcaggtccttcaggcacctctgctccaagcaggctcaggaatccctcgacaacctcctcattgacctctacaagaaatgcgggaaagttgaggagcagatcgagctcctgaaacagaagctcaagtcgatataccttggcgaggccttcaacgggaaggcgacgaagaaagcgcggtcccatggcaagaagtttcaggtctcgatccaacaagagacgtctcgtattctgggcaatcttggctgggcttacatgcagcagaacaacttcgaagccgccgagctggtgtaccgcaaggcgcaagctatcgagcccgatgccaacagggcgtgcaaccttgggctgtgcctgatcaagcagggtaggcacgacgaggcacggcaagcgctcgaggacgtccgattgcgcagaatctatggatcagaagatggaaaggtggttgcccgtgcggagcagcttctccgcgagctaaacccgttgcaatgcgtttcatcaccgttccaggttggcctcagcgtccatgaagggatcatgggtaaaccagacctagtagtgatgaacgagtggacgccgttcaggtcgaggaggctgcctgtgtttgaggagatagcaactttccgggaccaaatggcttgttgatgcattactttgcatggtttaatttatctgtcagtgtcacactcacatctctctagaagtttttgttcatatactgagtgtgggagcgtgacggtgaggaatagagatcagtatatatcatatagctgggcctggggttgatgcaaagcgttgcctttaggatagtatttggttcatgttatatcactgtatggttcagatttcagtgaacaaatgttcgtgcgtgccctgatcttgcacatgatttacagttggctgttgtg

SEQ ID NO: 8161 - DNA, 2148 bp, Zea mays
tatttgagtaacaaagagagtttgatattgaatgctgaaaattttctagccggagacaaaaattgtaaacatatttgagtaacaaagagagtttgatagtgaatactgttggtgtaaatagaacaagtgtaaggggtttcttgtataatggtgaaatataatgtgagcttgggggtgttgtgaggaataactcaccccaaatcaacaacatggtatatggagctagggttcgcaggcgccgccactcgagctccgccttgcgcgtgtgaggaagaaggcggtcacccagccgagcccggagccggagcaggaaaccgtggtggagaagcgcgtggaggaggcggatccatggagcgcagctcggcgggcggccccctggcagctggcgtggcgagctcatccgcgcgtcctcgactcgtccgcgccggtgccggccgccgtccccgtcctgtgcgacggcgagctcgtcggcgtgggctcccgcccctatgcgcaccagctgcgcactcccccctgctcgacccctcagttcctggtggtcgccctcgggcccctccgctggtgtggctgctgggattgctgctacggacgctggtgctgtagctgctcccaaggaagaagagaaggccgagtacctcaaggaccgagcaagtttgctgttgctgctcctgcagctgagaaagggggaagaggaggaagcctctactgctgcggtgagcgtggagttggggagagtgaggtggtgctgctcctgcagctgagaaagggggaagaggaggaagtccctactgctgccctcgtagctgttgtggcctgtgtagctgtggaggccggtaggagctggtatggggttctgaagcgagttctgaactgtcctgtctgcttgaagccggagctactgctctgcttgttgtggtgaaggagtagatgtgcgagctcatggaggagctgctggagcatagcctggaggcgtctgctaatcccatgaaggtggtggagtacgtgcagaaggagtcgccgctgatcgccgtggtgctgaaggcacacatgcactgcgaggcctgcgccgaggggatcaggaagaggatcctcaatatgaaaggcgtccagtccgtagaaccagacctcaaggcatcggaggtggctgtcatgtccaaaaaggtccggagagtggaggcggtggtggcggaactggagtgtaggaactctgagctgtttggcgagaagggtgaactggaggagaaattggtggctgccaaggaggtgttggcgaggctgacggcgatgacgagggaacaggaggctagggtgtttgctagaaggagagagtctgatttggtgaaggagaaagaggctgttgctaaggctcttgatgctgagaaggctgaagtagcaaggttgaggttgaaaattgaggagctagagaaatgtagcggtgagaaggatggtgacatcaggaagatgaaaccagcctactttgccaactatgcccacatgggtgaaggtactcaggaacaagctcttacatactcatgtaggcatcaaaaggagtgggtcatagattcaggagcatctaagcatgtcatgggcatatccagctctttcaaagcttacatcccacatacacattatgagtttgttcaaattgctgatggctcatcccaacgaatccatggtgtagggtccatagagtgtacaccatctcttagctcatcctcagtcctacatgtcccatcttttccggtcaatctcatttctgtaagttcaatcattgatcagttcaagtgtacagtaacgtttgatgaaaacacttgtgtctttcaagagaaggggactgggagaaggattgggactggagtcagacgtgatggtttgtggttcatcggtcatgaagaatcagcattgagagcagttgctgaaagggatgtgaaggaaattctgctacttcattgtcggttaggacatatatcttttgagaccttaagacggctgcaccctgctatgtttaagggagtggacaaaagtaggcttgtatgtgatgcatgtgagcttggcaagcatactagatccatctatcccagtattggtcttcgcagttgtgaaccatttactatgatacactcagatgtttggggtccttgctctgtt

SEQ ID NO: 8162 - DNA, 1482 bp, Zea mays
aaccaaagtggaaagtgtgaccgggatccccatccgttccagccccccagaacccagagctccaaacctaggccggagccgcggtgcaagcagctacgtggattggacttggacgtctggctctggaggtcccaagttcccaacgcttgctggagttgagatctggtgggcttccggaggagacgccgacggtttgcgaggtttgctggctccgtggcgtcgcggaaggtcatggagcaccgcgccttcgactgcagcgggagtgatgatgatctccctccaacatatcaaattagagtaccgagaatgcatttcagtgggaacagaaggccattagcaggcgcattttctcagccaagaccacacaacaagttggatagcgatatacatcagattgagcaacaggcatatactggtgttcttagagcattcaaaatgcaatcggatgccctgacatgggaaaaagaaagtctaattactgaactaagaagagagttgaaagtctctgatgtggaacacaggatgctattaaacatggtcaatgaagaggaggctatccatacaataaggcagtcaaggcagggatgtggaatgcaatctagcttgccttataatagcgtagttgatcacaaccttggacctatcaagcggcagaagaaatcacatcccatctattcactccctgtggatccccattcacccagcatgcctttgaaagcattggtgggcaacaagacatatacactggcacctgaaaacataagacggggatctgcctatcaaacccttccacatcaggttggttggctggcatctgatggtgctacgaaaggtatggatgggagaagcggaaggtatcacacgaacgagtattatgcttcacataatgacatggggcttttgaacttcaatcgtactgacatacctgatactgaaactcttgtgaaaaaggtggagagggtattatcccggccagatgtgtatgcaattgaaagggcaaaggaactgcttataggccaagagcagtcattgcttgatgcaattgccaaacttgatgaagcatctgaccatgaaagcgatgatatgctagttgggagccggatacacgccaccattgggtgacgcgggcagcacgcctctgacacggggcgatgctttggagttcagacctctggcagcaggcggagaggcaacgatatgtgaaatagtgctgtgtattgtaaaacgctacctgttttagtccggtagtagcctagtaggttaggttcttttggcagcctggcaaatctgtgcatgcgccatgcagtgtgatgggaatatatgtcttgagcaccatcacatgtgatgtgatgctgtctcgtttcatctccaaaaaaaaaaaaaaaaactcctcgaaatatgggtcgggtcactagttgtagtattgtagattgattgcccttccccaagttgcacaacttggaaacatgggtcggttttact

SEQ ID NO: 8163 - DNA, 1367 bp, Zea mays
gactcctatagggcgattgggtttctcgggaagttccaccaggccgaaacgtttctttagtctttaccctaaccttccagcgaaggcacacagccgccgccgtttcttcatcttctcgcagcgccggcgctccatcttcccctcccttccgtactcgcgctcggcacgcgggcaacggcagcggcgctcaggctctcagcgacggcgtcagcggcttcccctcccgactctcgccagtcgcctcgcgccctagcctccgatcctccgcacaccggccggtgacccagcgttcagttagtggtccattgaagtgtagctgtattgcgatcttcaactgctggggccatggcctacgagattagtgagatcaaaaagattggcataggtctggtggggtttggcatcctattctcattccttggtgttatccttttcttcgataggggcttgttagctctgggtaatattttctttttaactggagtgggtctgttactcggttggcaatctatgtggcagcttttcacaaagaaggcaaaccttaagggatcagtgcctttcttcattggtttgtttcttctgtttgtccgttggcctgttgctggtataatcatggaactatatggatcttttgtgctcttcagtggttatgggcctcctatccaggccttcctgtatcaaataccaatcattggttggattctgcagtacccattccagctgcttggtcagttgaggcgtaaacgcacctgaaatgttctgcaactgccaagatactctttgactcttcatggttaaagtaccgtgttgttgtgatgtttatacatgattctcacttgtacccttcaatccttcacgttgcgtcttcaactcttgtgcatattcgtactctgagtcattctggcattgtccctttttgcgagcaggctatggtttattgttcatatttagacaataagagttcataagttgatggatgctccgactcttgaagcaggacctcagtgccttttggtcatcacaacaacaatggggccagagtgatcacacctgatttatttctgattctggaatctggacacaatttgacaaattattttgcaagttgcacggacggaacccttgaagaaaactagagaaaacaaaatcttacagtggagcttgatagcccacctgatgaataccacgcgtgatctgcttcatttttttgtcagatgcaatgttcatatggtgagacgcctttggtatttgaatttcgttgcagatagtgacatatggttctatcagctgaagagtgatgcctttttccattgttttgattggaaatgtgatgctgttaatgtttggaacaatgatttaaaaaaaaa

SEQ ID NO: 8164 - DNA, 4350 bp, Zea mays
gccgaaagggtttctccaaaaccctctccaacaaaatcgcaaccgccggcgaggatcggcgccgccatgtcccagatcctccgccaccgcctgtcggctcactaccacggagtctgcggccactgctgccgccgcctcagctcctccgtctacggcggcggcgggagtcgccgcgccgtcgccgcgccgccgcaggacggcgagggcagccgagcggtgagggtgtctgtgtggtgggacttcgagaactgccacatccccaacggcgtcaacgtccaccgcgtcgccccgcgcgtttccgccgccctccgcgccgccggcatccgcgggccgctctccatcaccgccttcggggacgtgctgcagctcgcgcgctcctcccaggaggcgctcgccgccacgggcgtctccatctcccacgtcccaagcagtgggaagaatagttctgaccgctcttttatggctgatcttgtctactggattgctcagaatccgccaccagttcattttttccttatatctggcgatagagattttgcaaacatcttgcatcggttgagaatgagcaactacaatgtactgcttgcttgtcctagtagtgctaccagtgtactgtgcagtgcagcaacaatcatgtggccttgggaaggcttagttagaggagaggatttgtcaccaaaacgttttaacaacccgccggatggtttacatggatcttggtatggtcactaccgaggagcccttgacgacccccccctggagaaggaatcagaggaacccatcaaggtagcatctgttccgaagcagttttcagtaccatctaataccaagcactgcccagttcccaaacatgtaaaaaatgcaattctggaggtactacgttcatatcctgaaggggtgaacatctcactcctccgaaatcagcttgtaaagaacaaaattgatctgggtacaaatttctttggccacaagaaattctcttcctttcttgaatcaatgccacatgttgttaaattattaggttctcgattaggtgaaaacgaactatatgcaattgctgccaacaaaaaatttatgcagcctggtgatggggctcttgatgaccccttcctggagaagggagcagaggaacccatcaaggtatcatctgattcccagcattgttcagtaccatctgataccaagtctagttcaatccctaaatatgtaacagatgcaattctggaggcgctatgttcatatcctgaagggatcaacctttcactactccaggaagagcttgcgaagaaaaaaatttgtcttggtccagatttttttggccacaaggatttctcttgccttatacaatcaataccagatattgttgaattagtatgtcctcaaactggtggacaactatatgcaattgctgtcaacagaagatcactgcggcctcgcggccgaggtactaagacccttagctcagctcaaggtaatgccagggagaataacccaactggaacagctcacagtaataagaagaatacactaagttctcttcgaagcatttacaagagcagaagcttcacagagacactaagtgaacatccacctacattttctgtcttaccttccccgtcaaatgggctatctgaggaccaaattgagtgcccagtggtggatgtgaatgggtcgacagagtcaccagcaaagcacagggaagttggtgaaatgactacccctggaactccctcttcctcaggggtggaaaatgctgctaatgaatatggcttctttaaaaggatctggacaatgtggaatggtcccaagaatgttaagtctgaggtttctcaaaattgtgaaagcacttctgctgaagtgattgatgatttgcaggtttctcagaattgtgaaagcacttttgctaaagtgattgatgatttgcgaactcctttggaagagtataatggtgatcaccgtataaagcttttgaggaggatacatgaaacctcttccaaaaatgatcgctcagatggtactgagggcatgttagcagtaagtgataatttatcgatttcattaggtgatgatcattctgaaaaaataaagagagatccatcaattcctgaaaacccagaaccatgcagaaaacctgctgctgtttccatgattaaatctggaaaaaaggatgatatttctgaaatgaataggggcatgtttaactgggcttcaaggtggtggccatttgggaaatcagatgcagatagtagtacaaccaacataaatgccactgatgaaccgaggactgactctattgaagaatttgaatcttcaaacgctccaactaatggaagtgcacaacaggtggttcatgaaatatttacaaagcctgacttgtggtctgttttggagcaacagttatcagaacctcttgggtctgaggttgttttgaaagcaaagacaaggcagggatgaatacaaatgaggtccatatattgatttcattatgtgttgtgtagtaaactcagcatcgcctcacattttgaaaattatgatcaaccattgcttgcttgagcatccatcatataataattcttctatatgtttccttctgcaagtaaaaaggatttatgagaaatgcaaaatcatgttttggatagagcagttattatatgattgcttttcttggccaggcaggaattggcacacagattgcagaagttaaattgctggcctttgaaaggcctccttgataaagacctgcatcacctggtacatctgttaatttctgaaaagaaatggattgaagaaacttcttccagaattttccctttccgtcttaccctccctcgcaagagaagatgtgtcccatcaagttccagcaaatccaacggcctcagttacattttttcaagtgggaagccacaaaagggcagatacgttgacaataacagtaggaaaagcaggtccctcactagagaggagatactatcagattgtcacaagctggtgaaggagcttctttctgagcatgaatatggattcaacatcggaattttcaaacgccgtttttcccaggagtatggatacgagcttgaacaccggaagctcgggtatctggaccttgaaacgctgctgcatattatgcctgatgtaagggtgaaattcccaagggtcatgcgctcagaacacgggaacgggcaggctggcagcaagggagacggaaaccgaagcagcggcgatgacttgatctgggaggagcttggtcctgtatctgccacaactgaaaccgccgccgccgccgctgatgcaggggccgacaaggaaacatgctatcgtcctcccactccttcagacgacgagttctcggacagcgacagcataaaagaccggcagcctagaaggaacgccgagcagcagagctcgcttctccagatcattggagcttggaacagcagcaagggtggcgacgtctctaacaacaagcctcaggacatcgacgggttggtggactgttcgagaagcagcccgggcagtgctggcaccagcgcagcttcaggaaaggtgcagacgttgtctccgaagctaccgcacaagcagtactccttcgtgtcggactccggagaggagagcgatccggataagctggtggagagcgtcttggacagcctgcagaaagcacggggcggctcgaagctgcacaactgagcgtctgctgccatcgaattattgtttttgcaacctaacgagtcgtgcttatggtggtggccatggctgactgtcaaggacagcggcgcctgcaagcatcagccggagagactggtgaataaagctcgtcttttacttggactaggccgtagtacaatcggaacagtccttggtaattggtatgttaacattggctagagaccgcctcccatttctgtttcttgtttctttcttttcatgcaggatggttgtccgcccaatctacacgctcattttcttaacaaattggttaacacggcggggcttagacggtcgttcgtcaccagtgttggtattccaagcccaatcttttttttgcttgtagtatagtaaacataaaatgacatggcacatgctggtgtctagagtattgctgtttctggagtcccaagcattcatgtgatggcacattggaatgccagttgtactgcaatagtgccaatgaatcctatctaacactagaccaaaaaaagttgggcaactgttcagggttgtgcttttcctgtcctgttgagtgccatctagtctagatataacaaacaaggcatcctgaccttgcagcagcagcacattcacaggacaggtggatgttttttttaatttgttaatttccatgttcgcttt

SEQ ID NO: 8165 - DNA, 1371 bp, Zea mays
tgagtggaagaagtagacagcaataaacagaggagatcccgccaacgctgaccaaatcccaatttccttaaaacctccaaaaggaacgaccaagaaacagagtcaaaagccttggagatgtccaacttaagaaggatatgtggttctttcttcttatgcagcaacttcacaatttgttggacaagcataaaattgtcatgaatcctcctccctctcacaaaggcactctggttcacagaaaccagtgagggaagcaaaggggccagccgagtagccatgagcttagctaccaatttggcaaaactatgaatcaaccttataggccggaaatccttaacctcaacagcatccatctttttaggcagtaaggagatataagccgtgttaagcaggcggaatttgaaaacatggccacgctggatgacatccaaagacctcaacacatcacctttaataatattccaacaggatttataaaatcgacctgtgaaaccatccggccccggggccttatccggaggcaaatcttttaccacagcccacacctcctcctcaagaaacggagcatctaaagcagataaatcatgattgtggatggccaactcatccaagtcaagagtgtagctcctctcctcagccctacccaaaatgttctcatagaaatcagaaacagccttctgtttatcttcttgggaggtgaccacctgatcaccaacgtgcagcttaggaatgaagttcttcttttttctgtatctagcctgctgatgaaaaaaggaggtgttggcatcaccctcctgaatatacaaaatccgagaacgcagtcgggcgatggttctcaccagcgaggccaaaccaagacaatgaagcttcaacttccgtctcagccactcctcatcatcagcaagagccctttcatctctttcaatttcccagcgatggagaagctctttagcaatttctaattgtgatttgatgctcccaactttcctctggccccacttttgcaggcacctgctgagccgctgcagcttcatgaacaaacgctcaacggcacaagaagatcgcaccggagcctcccaactttgcttaactgcatcaaacaaaccaggaaccttcaaccagaagctctcaaaatggaatctgcgtttacccttgttggccacattcaaaccaagcaggagcggacaatgatcagagaccccagccgccaaactttgcaagacagcatcaggaaaaatgtcattccagccatcacagcaaaaggcacggtccaacctcacaagagtaggagaacgcctttcattggaccaagtaaatttccgacccaacaacggaagctccaatagatcattatcatccaaaaaacgccgg

SEQ ID NO: 8166 - DNA, 2326 bp, Zea mays
cggttccattccaagtccacctgcccctcctccctccctatctatcctgtactctctctcagtttctctctccccccgttctccgttccacatcgcgtgcgcattgagacgacgagtttctagagcgccgtaccgcgcacggctcccgagccccaccgcaaagcgccggaatcgtgagcgcgtccggcctcgcctagctgctccgcgccgagaggcggccgaggaggacgggcgatgtacccggtggtgacgggcacgccgccggcgcggctgccggcggcgtcgcgggtggacaaggccacgagccacctgctgcagggccccgactgggccgtcaacctcgaaatctgcgacaccctcaacgccgaccgctggcaaacgaaggatgtagtaaaagctgtgaagaagcgattgcagcataaggatccaaaagttaaattctttactttgacgttattggagacaatgatgaagaactgtggggaatatgttcattttgaagttgctgatcagcatgttttacaagagattgttaaaattgtccagaagaggcatgatatgcaagtgagggataaggctttgttacttctggattcatggcaagaggcatttggtggacctggtggcaaatatccacagtactactggtcatacattgaactaaagagggcaggagtaatgttcccacaacgtcctgtagatgctcctccaatatttactcctcctgcaacacatcaggcatatggttcacctagatatccttctggaagtctaaatgagagaatcacatctgaagctggaacgttgagctttgagggcttgaataatattagaaatgcaacggaactgctgtatgatatggtgaatgctttgaaccctgctgaccgcatggcagttaaagatgaaattattgcagatcttgtaaatcaatgtcgttcaaatcaacaaaagctcatgcagtttgtcagttccacaggggatgaagacctgctaaagcaaggactagaattaaatgatcgcttacagagtgtcctcacaagacatgatgctattgcttctggttctccattaccagttgagacaccgattagagaaccacagagagaggatccaaatcctgagccatctacaccaattacacatgataataaggctcaagttgaagaggatgaagatgatgagtttgctcaaatagcacgaagaaaaaacaaatctgtgatatgcggtgatgaggcatcatcgagtgctggtgatcaggccctggtacctgttgatccagcactttctgaagtttcttcggttgcgagcaatgcaatagtacctctcgacgcaacttctgttagtggaaccaggacgaaggagcaggatatgattgaccttctcagcctcaccttgtacagtcctgaatcatcagaagactcttcaactcagaaccaaaatgggagtcagccgagtgtcacatcaaatggatcagaaacactgccaagctatcagcctgctgtggcgaacggggcaaattaccctgccaacacccaggtttatccaacaaatcagggatatgttccatacaataactatgtggcaccatgggcccaaacgggaccggttgcacagcctggggcatattcgactcaaacccagcaatatgtgtcgagcaatccggcacccccatgggctatgcctgcaagtgccaattcagctaatcctttccagcctgtgacataccaaacgccaaacactcctcctgctgcttctgttgccccttcagctgctccatcagcgcaacatgttccatctccagaaccaacaccggtgcaaagttacaacttctctattcctcaaacatacactggttcgaacgtggctacaaatgctcgggtgaacggaaatcagcggccaaaagaaactccagtggcagcagccagaccatattacatgccggacaatttgttcggagacctgatcgacgtgaagagttttggcgccggaagcaagatcagcaggtctaccagcatgccgagtccaaagggtggtggccagcctatgatcggtagaaacaaataggcctctgctgtttaagatagggatgagcatatatttagctggtagccactgtcgtttggtttgatgtaaatttgctgtcttttttcacgtgtcaatttgcggatttgttactttggtcaatttcggagttgctgcatgtttaactttactagagaattgtagagaagtcattgctccagatgatcagtgacatcattatcgtgacggtttgatgacggaaaccattgcctgcttcgtgttttccgaaaaaaaaaaaaaaaaa

SEQ ID NO: 8167 - DNA, 2358 bp, Zea mays
  misc_feature (697)..(697): n is a, c, g, or t
  misc_feature (710)..(710): n is a, c, g, or t
  misc_feature (906)..(906): n is a, c, g, or t
accatctatagcaccaatacagtcctggaaaaaggggtaaaattggggtctgcttaagattggatggggttgcaaggaaggtggacatatgtagacacatgtgagctgtgtgattgcatcaagaaccgctgcaaagtgtcgactaattgtttctccactatgttgaaaaaattcttgtaaggtttcattacttgcattttttgccattgcatataagaaaatagcaacttgctcttccactgcaattgctcttgtatcagcaaggagatttttttcacgcaatttattgaccaaggcttgaaaaattccaacctccattcggaaatgtcttttgcataaacactcatgtcctgttaatatctctgtaactcgtcgagcccctgtcatttctgatgtatgcataggcctcttctcagatgagtgtgatgattctacttgtaaggtaggaagaacaaaaaagacaaactcatcctcactttgtgatctacgatagttcgttggattcatgggtaccgcggccgcgtcacgccccaaaatggataattaatacaaaggtggaaatataaaattttgattagaaatacattagcgtagtcacataagacagtaacgaaccaacctttgtgcaaccgaatgcaagatatatagacaatcaagtagcctgtagaaggatttgcttgctgttgtggaaatgaanttgttggcatganagagtgagaggcagcaagctgatgagcgcatatatatatacacctgtatgcagtaacgcaacggctagggagcctcgtgagcacgcagcaacaacggctagtttcaaacttaaaaaaaatgatatttcaaacttcttacttcctttactttttcctacgctgtagccaaacaagccttctatcatcttcctctggntttaaatcctataggattagaaaatacatccattctatttcctgagtttttcctattcccgtgtttctgaaatcctgtgttctaaaggagccctaagaagctactagtactagttgaattcaaaggctggtttgcaaatttctaataaatgaatttgagcccgttttgccttctctcaccgttaacgtcaattagagtgacacgctagctatgactaacaccgccgtggccacaaacgatttggcaagtagcgatgataggtcaagatagtcaagatagtgaggccgacctagcagggcagccgtcgcaacatgactgacgtctgatctttatatatacactagtatttcttcatgttgcatcactttgagatgtgcgtaactgtgtcagtatatacaacttttttttttttttttaacagaacgagtgaagtattattattatcaatacaaagcaaaagaacgatgagcagagcagctgctgctccatcaattcacaaccgattctgtgattatgtacatggtcatatatatctctctgtctctactgctctatctgcaataatcaaattgtacaaaagacgacccgtgatccactagactagtcgtatctcaccgtaaccaagcaccgacgcgggcgtgacagggaagcaaagcaaaaaagcaaagcacaagcaagaggggatgcgcgacgaggcaagcgacacgtacggacagcggcacgttccacgtgacgtgtacgcagcaaccaacaaccaaccaaaccagctagagcttggtgcggtcgcggcactgctgggagcgcacccgcatctcggggacggcgaagacgaaggtgcagtcggagtaggcgacggcgtggcgcctgaagacgccgaagatggcgacctcgccggggatcctggtgctggcctggagctcgacggcgccggcctcgacgtcggcgaccagctgggcgaggcccgcggcgaagcggtcggcctggagcgtgagcgcgaggctgacgttggcgtcgccgcggctgggcacgcggccgggctcgatctccgcgtccccgacctgggcgccgcggtaggtcacgtccgtgtggccccccgacgcgtaggcgaaggaggccgggttcgggttgtgcacggccaccacgatgagcagcgtcacgttcagctgcagcgacatggccgggaacgtcaggcgcggcgcgatcccggccagccgcgtcggacaccagccgcgtcgtggggtcccgcaccttcagcacggtcaggaagaggacaagcagggttatggccagcagcggcagaggagggccagcgtgacgacgacgcataggcagaggcagcggcgccgtggagggggcggcttggtggattgggattttcggagggggggaaggggaggttgggtggtgggatcgtgggggcgggcggcgtggcgaggggaggaactggaaggg

SEQ ID NO: 8168 - DNA, 524 bp, Zea mays
cgccgcggtaggtcacgtccgtgtggccccccgacgcgtaggcgaaggaggccgggttcgggttgtgcacggccaccacgatgagcagcgtcacgttcagctgcagcgacatggccgggaacgtcaggcgcggcgcgatcccggccagccgcgtcgacaccagccgcgtcgtggggtcccgcaccttcagcacggtcaggaagaggacaagcagggttatggccagcgcggcgaggagggccagcgtgacgacgacgcataggcagaggcagcggcgccgtggagggggcggcttggtggaggaggcgtggtaggcgggggcggacggggctgtgtgcgtcggaaggacgttgccgccggtggccgccattgggtggattgggattttcggagggggggaaggggaggttgggtggtgggatcgtgggggcgggcggcgtggcgaggggaggaactggaaggaactggaaggggaggcagagcgggccgggagggagtttttagatactgcagcttcaattaat

SEQ ID NO: 8169 - DNA, 788 bp, Zea mays
gagctggagcggactcaccatcgtcgtctttttttcggccctacttctgtctgactgtctccacggctgccgacgagccgcgcaaccgaactcattgcaggaggactcgcacagatcggtgagcgagcaagcgagagatggctgggaggctaaccgcggcagggtcccgcatcctgggcggcggcggcgcacgcgccgcggcttccgccctccgacaccgcgccggcatgggcctccccgtcggccgccacatcgtccccgacaagcccctccccgtgaacgacgagttggtatgggataacggcacgcccttcccggaaccctgcatcgaccgccttgccccgcacatcggcaagtacgaggcgttggcgtggctgtgcggagggctagggttcttcgctgccctcggtatggctgctgttgtgaacgacaaggcctccaatataccatatactcccaaagtctacccgtacgacaacttgagagctgagcttggtgatagaccatagaaggttttttgtctgtttgacaaggcactttgatgaatatgatctgagatctatatctcctttccatcagagagaagcagggggaaacttatttaccatggttttttttgtgactgccttgttgtaaaccaccgttatgtgatttgctgaatattgtgaagcatgggtttgccctacaataatgcaaccagctctgaacctattcctgatgctaaaaaaacgagtattaccaaccccttgccagcattgtttaaaaaaaaaaaaaaaaaaaaaaaaaaa

SEQ ID NO: 8170 - DNA, 730 bp, Zea mays
actggatacagcacacgaggcccgagcaaagcccacctagcttccttctgtctccaccgccgccgacgacgagccgcgcaacccaactcaccgcacgacgactcgcactgatcggagagccagcgagcgagatggccgggaggttaaccgcagcagggtcccgcgtccttggcggcggcggcgcacgcgccgcggccgctgccctccggcaccgcgccggcatgggcctccccgtcggccgccacatcgtcccagacaagcccctgcccgtgaacgacgagctggtgtgggacaacggtacgcccttcccggaaccctgcatcgaccgccttgccccgcacatcggcaagtacgaggcgttggcgtggctgtgcggagggctggggttcttcgctgccctcggtgtggctgcggtggtgaacaacaaggcctccaagataccatatactcccaaagtctacccgtacgacaacttgagagctgaacttggtgatagaccatagaagattgtttctctgtttgacaagccacttcgatgaattgaacatatcttctaccagacaaaagcagggaaagctgttgtttaccatgttttttttgttgtaactacctttatgtaatttcctggatcttgcgaagcatggattttccctacaataatgcaaccggttgcactggcaactattcctgaaaaaaaaaaaaaaagcgcccgcccacgcgtccgcggaac

SEQ ID NO: 8171 - DNA, 2605 bp, Zea mays
  misc_feature (2537)..(2537): n is a, c, g, or t
ggggtacctcgagccggccgggccggcgcccaccgtttccgcccctcgtcctcgcctcttctttcttcgcctcttctgcaccgcgctctcgctcgcccctccgccgcttggcctccaccctcccgctgccggctccgccgattggacttccgcccgtcgctggccgtcggcgcgcccgttcctcgcaggtgaattgttcaggctgaattgatcggtggaagctgtgcattgactatttttttaatctcagaatcaaagagagaaattgaactgggaggctgctaattgcgagagaagtgatgtctttcgttaggcaagcagacccatcagtgtcctgtgccgagaccacttacatccacaaatttgtgccaccaggaccagttttcccagcacagagatttgtctctggcaccgacttgcttcaccacgggcctcaaccatataatgctgagggctacaagcagtctggtttcaatggcacagcgcctcatgcatttcagagcttttacaatactgatagctatgctgaatctcactttaatgaagcaccatattctcctgcaatcttcgatatatctcagcagaactctcaatctttatcggacaaccaggcctctgatcttgtagagttcgatgaggatgagatgagagtaaagcttcaggagcttgagcatgctttacttgacgatggtgatgagatcttttttgacttgtcagggagcattaacgatgagtggaatgataacattaagacaaacaatgaatgggtcaataccatgaagaatattgtgagccccgactctccaaaagaggcatcacctgagtcaagcatctgctgtctcgacaacaatgttggagaagcgcggaacccgaaacagttgctttttgactgcgcagaagcgatatccgaaaatagcatcgatgaagcacagtcaatcatagcagaactacggcagaaggtggcaattcaaggagaaccttctcagagacttgcggcctatctcgtggagggccttgctgccacactacagtcttcaggaaagggcatctacagggccctgaggtgcaaggaggcccctactctgtaccagctttcagccatgcagatcctcttcgaaatctgcccatgcttcaggctaggcttcatggctgctaactatgctattctcgaagcctgcaaaggcgaagatgtcgtgcacatcattgactttgacatcaaccagggtagccagtacataactcttatccagttcctaaagaataacagtaacaagccacgccttttgaggataactggtgtcgatgatccagagtcagtgcacagagctgttggaggactgaatgttgttgggcagcgactagagaagcttgcagaggactgtgaggtacggtttgagttcagggcagtggctgctaacattgaagatttgacgcctggaatgctaggtcgccgtcccggagaggccctcattgttaactttgcattcctgctgcaccaccttcctgatgaaagtgtctcaattatgaaccaaagggatcggcttctccgtatggtgaagggtctccgaccaaaactagtgacgttggtggagcaggacgcaaatactaacactaccccattcccttccaggttccgggaggtctatgactactattcggcactttttgattcactggatgccacccttccaagggaaagcccagatagaatgaacgtggagcgccagtgcctcgcacgggaaatcgtcaacatcttagcttgtgaaggtcctgaccgtgtggaaaggtatgaagtggctgggaaatggagagctagaatggcaatggcgggctttgtgtcgtccccatttaacagcggcgcgattgatggcataagatctctactgaaatcgtactgcgataagtacaggttcgagaaggtccaggacggtctccactttggctggggcgacaagacgctcgtcttctcttcggcgtggcaatagaagcttgcttgtactattgcctatctgagcactttccagcgtttttaggagcatctggggcaagggctgtaaagagatttctgtcgccgtattgttgacctaccatataagtacactcgtagctaaccttagcgtgctgcctgcctgtaggcttgtgacttgtgaggtctacggtttacctagtttcttagatgaaagtatgttgtgcattgtacacctactgaactacatgtagactgtagagtcgcgggtgtatttaattttgcccttcttttggaggggcagaatcacaatacgcgtgattggatacctggccgcgtgcgtctgggctctccacattccgttgaccgcatttaaccagtgattggtgggctgtatgtatggaggcgagcttgcacgcaccgatgcaactcagtggctttttgttgtgtcaatttgcatgcgtggagatacggtgagggagcatccctgcgcatccagaccaccgcgagccttgcgcccacgagctggacgtcccatcatgctgaatatgtcgacatttgttcgtgtatnaagtactggatgatgatgatgctctaaaaaaaaaaaaaaaagcggcgcttttttttttttttttttac

SEQ ID NO: 8172 - DNA, 1170 bp, Zea mays
cattggtacctcgagccggccggccggtcccctcgatgatccagagtcagtgcacagagctgttggaggactgaatgttgttgggcagcgactagagaagcttgcagaggactgtgaggtacggtttgagttcagggcagtggctgctaacattgaagatttgactgctggaatgctaggtcgccgtcccggagaggccctcattgttaactttgcattcctgctgcaccaccttcctgatgaaagtgtctcaattatgaaccaaagggatcggcttctccgtatggtgaagggtctccgaccaaaactagtgacgttggtggagcaggacgcaaatactaacaccaccccattcccttccaggttccgggaggtctatgactactattcggcactttttgattcactggatgccacccttccaagggaaagcccagatagaatgaacgtggagcgccagtgcctcgcacgggaaatcgtcaacatcttagcttgtgaaggccctgaccgtgtggaaaggtatgaagtggctgggaaatggagagctaggatggcaatggcgggctttgtgccgtccccatttaacagcggcgcggttgatggcataagatctctactgaaatcgtactgcgataagtacaggttcgagaaggtccaggacggcctccactttggctggggcgacaagacgctcgtcttctcttcggcgtggcaatagaagcttgcttgtagtattgccgatctgagcactttccagcgttttaggagcatctggtgcaagggctgtaaagagatttctgtcgccgtattgttgaagtacactcgtagctaaccttagcgtgttgcctgcctgtaggcttgtgaggtctacggtttacctagtttcttagatgaagtatgttgtgcattgtacacctactgaactacatgtagactgtagagtcgcgggtgtatttaattttgcccttcttttggaggggcagaatcacaatatgtcgacattgtttcgtgtataaagtactggatgatgatgatgctcttttgtactggtcatgagatgggataaagttacaaaaaaaatcgccaatccggtgcaccattgcatgtacaggtcatgagatgacattttggggtttaccttttgacatctgaggtcgtgaatgctgctgc

SEQ ID NO: 8173 - DNA, 2660 bp, Zea mays
gtcctgtgtcatgttctttgtgattagttttcttctaaagttcacactttagcaacttggttttaattgcactaacatttcttaaccaagtgttggctatttagtgttgaattttacaggatcacctattcaccccctctaggtgctctcacaatttaattgcttcacacatttagttcacataatcgaatagccaaattttagaattgataaagtttggtattcggttttttttggtatttcggtacgatatgcggtaaaaaccgattacgataccgaaaaccgaacttctaagacacaaaaccgaaactgaaccgacatacgaaaaaaccgaaatttcggttcggttcggttcgattttcggtttatggtaaaaaaaagtgcccgctcctactcaccgtaggctttaagcttttttctactaatggtagctagcataccatgacaagattttatatttaaaccaaactaactaatttgtaaggttccgggtaaatgtttcctgaaaacctttccgggtaatagttcggcagctgctacagtattctgtgaggttagcatacgcgacacgagcaaaacacatggggtggttgcatctgcctgcgtaaacaagagcaaagtagatgatacttgctaccgaaaggtgtcgtcccctgctaactaaccggcccttttctgtcttaaccactgcaaactaacttttgattggctctgacgacgagcgagagtatccgacgcgcaggaaacaggcagcgaaggcagcataaggagccaatgctttctttctttcttttttcttttttttaaaaaaaaaacaaatcatgattagccggcccgtatggaacgtccaaagctcaccaatgatatgcgagatcgttaaaggcgagttctttcacgtcgaggacaattattattgttccggaaaaaaagaagagctgtgaaatcccgaagcacttgctcttcttcttcctcacgcaaacgcaagtgatgtctagaacaacctcctcctcttccgtctccaccgttagttgtcgttcgccagtcacaccggccaacctggtggattctaactctagccgtgtcagcgttggagataacacggctgcgccgagatgatcgacggcacacacgacacacctggtccgagtccgacatcaagtctgaattggtgacgacgaaagttcagattttcagacagcacacgcgggtcaagactcaagagtccatgtccatggctgaatttctggaatctggaagcgatggctgctgcacctgcatacgcatacttgcacagcataacaaacaactcctgcacgcaaaccattttccttttggccggagttggaaggaaaggtcggctgctcacctgcttaaccaaccaccatgtctgtctgtcggcctgtccgtggtcgactgctcgtcgttcccaccattccacaccacaccacgctccacgcctcctcaagaaagaaacccagctataaaaccgctcgcgatccccaggtccactggctcagatcacacacaccaccaaaggccaaagcgggacgggagccacagagatagctagcaagaaaccacagatggcggcgatagcggcggccacccaggcggcggcgacggtgctactgctcgcggcgctggtgctggcggcgggaccgggcggggcgcgggcgcagtcggcgtcgccgtcgagccagtgcacgtcggcgctggtgagcctgtcgccgtgcctcagctacatctccgggaacgtgtcggcggcgccgccgtcgtgctgcgcgcagctgggcaaggtggtgcagtcggacccgcagtgcctgtgcgtggcgctcagcgcggacccggcgtcgctgggcctcaccgtcaaccgcacccgcgcgctgggcctccccgacgcatgcaaggtcacgacgcccgacgtcagcagctgcaagggcggcgccgccgccgcggggggagcgcctgtggcgacgcccgcggggcagacggcgccggccacggggtccaagacgacgcccgccacgtcgtccgtgcccggtgccgccgcgtcgccgccgggctcggctgcccgtctcgtcgccggcttcttcgtcgccgcggccgtcgtcgctggcttcgccgcgtgatccgaagctagcttcggtaccgtttgtgcgcgtaggaatcgcagcggagtttgtgttgtttgtttcatcggtggtggtggtgcatttgtgattcgttcagtggccgtgagagagagccgtctcttattcatcgatcgactcgattcgtcacagcaatcgcgcatcgctctgaataaagacatcgcctgtctcggttttttctttattgcttctcatttggctatgagaaaatttaagctactccctaataaggggtgattataatctcccaaacaaacactccctaaatcattaatagctggtgagctggtttggtgataatacaattagagttgattgaggagattttgaatagtaagagatttccttctatcagggtgttagtttactttgtaacgattcctgctaaaaaatgatgaatttgtactaatattgatgagctagaaaagttccaagcctcaatctaatctaagactgtcttcaggacgttagttccaaggtgataatacaattagagttgatgagctagaa

SEQ ID NO: 8174 - DNA, 3378 bp, Zea mays
taggtgcccatctttttcatttacaaaggtcaccagactgcatttacaaatccaatagtttcggatcataacagtaagacaatttgaggtagggtcaaccatagttgagatagaactaagggaccaaaaaaagttcagtcaatagaccaactttcagaggttagcatatagaacaggacttgaaagttaaaagaacttttatcatagtatgtgttcaccaccacctctagtacacatttggttgtcttgattgtgaaaagaacttttatcatagtgtgtgctcagttgctcaccacctcctctagtagtgattagttctttcatatttggttgtcttgatttttcatatttaggattagtaattagtttgagccaactttgaggtatcactatttccaactttctgtatcggttttaccatcttgaaacatgaagcttatggaagcttcatgtcctgcttctacggaaggttggtgtggctattatgcattgcttctactgaaggttatgcgcccttgcatttgcacttgagttaaaatatgttcctatggctattatgcatatactatgcataccagtcttccagcttatggacgctccatgcttacttccttttgcttctcagatttcttagtctttgcttatttccctgaaagtttgtcttgttccatttagctcgcttggacatttgaaagacaaggtaccaagttggaatggcggtggaagctgcagccttcaccaaacacgcagcagactatatctgagatcctggattttcttatggatgcaaatatacgcttaagtgtatgtccctttgcttcacctcttcactttttcagcctacctgtgattctgaaacaggtttgccaatcgctaagctctgcttatgttgatgaccaagggatgaattggttcttgaggcgcagatgaatataaacttgatttccctgaattattcctaccaaagctactgaaccacttcagcacgtttcttacttggccctaaatttacggaattctctatattttcctcactttaggaagaggttgtgaggaaaacacaatcctttgacaagttgaaacaagaagctgagaagtgcttgcaacaaagtgagagatttaacaatgagaaagctgagttcgaacaagccgccttttcaaaggtaccggtttcttatgctactgtgtccactcagtgaatattgcaggtgatactttcttatgctgctccatacgaaatccagcataccgatgtgtatacatgccctcggcttctttgcattgatgtacactgctatcacttaaaacgctggttgctgggtcttgcctttttttgttccctttcctgttgatgtctagatgccaattcttctatcatttggctgtaattttcatcttagtttatctatgcgttactcaccacttgtgtgttcctctagtttggcacgaggttgaattcgaagaaggccaagctcagacaactcagagataaagttgtggagctcgaacccgctgtcaagcctccaaaggaggaggcaggtcaggagcaggatgaggaggaggagaactcaacggaccggacagagctcttcgagggagagaatgacaaagaagcaagcgccaaggatgaacactccggcgagacaggcagcggcaacgttcctagttctcctggggaatcggcagctacctccagaggaagaggacgagggagaggtcgtaagaaggcaagaagataggctgcctagactgacaatagcaggtcctactcggaaattcgctagtcgtcctggtgcgcctttagccggctagtctcatttccaagagcacgtgtctttcatgtaccttcgtgttcgcgtgctgttggcaggcagagtattgcctgtgaaactgattgtccgtctgcttcgtctcatcagtggaaaatattttccatttcatcacatgtgtcagtcatgtcccatgcttttcccccccccccggaaaaaaaacgaatgaaaaaaggggggaggaatgtttgaccacgtgtttttagtgcactttgaagccagggcggccagtcagctcgcagagtcaaacatgcacagagtgctctcctggcgtctgcgttggctgctggactggaccaaataatcgtctgcgcttccgttccacgcggcaagaacatttcctgcggttgaccacaccacctgctccccccctccccccaccccccagccttcgcggcaccggcagacggggaggaagcaccgccgcccgcctccgcgggagagcaagcgggagaagacgaaccggatctggaagcgaacctaagctgcgcggtaagaactctgttgctgatctgatgcgattcgctggtggcgtggctggctgttccggctgctgggttactgcttgctttcgcagtgaatttgttcgtttttttgtttttgttagttctggtgagtgttctttttcttcctttcctgaatcctgatcgtttgagtagatggctttttggagggtgagttcttgcttgcgattctgcagttcttgcttggctcctgagatggaccgattgttcgtggcatctttttttttattattattatttggaagggggatgttcgcgatatctttagtaattgtgttgttcatggaaattccttggggtggagatgaagtgaaactattttctcgtcttgctgttccccatacccaaactagctcaactctgtgcatcaaaagctacagatttccttgaggccgtagattgattggcatgctgatatcggcatagctcgtctccctcagcatacctttccattttcttcaggaaaggccgtttgattcggtttcttgtccatggcccataggtttgtcattgaaaacagtgcgaagagtgagatgggtgaagctctgctaagagattcttcaggtttcttcttggggatggaatcattgccgtgtccatcttggtcaggtgtgtattaagctctactatttcatatctccatttccttcatcagcaagagagagaaaacacttataactcgcacttattattgttttccttcgaaacagttgagttggagatgggtgcaaccctgaacaaggaattgagaactcgagattgttcgtggggctggaatgttgggcccatctgttccaggtatgacagaccccgcttcccttgtgattgtttcttatttcatacgtacgtactaccttgtcttgccttttgcggatcaaattattaggatccatcacgcgctccgctgaaccttgttgctcttttacgtattgcttggccgttcattctttctgcttcacaccacgagcctgatgcttagagggaactgattccataggcaggcagcgcacaaggctatgcctgca

SEQ ID NO: 8175 - DNA, 1290 bp, Zea mays
aaaaaaaccggtccccccgtcgcgcccgccacagtcctcgcgtgcgcccagcagccgtctccaacggccgatccatgcccgtctggcgtctgcctcagtcgcatcccctcgttgaggtcgacagcgacggccatggcggcggcctcttctgcggcgccggcgaggcacagctgcgcaaagctctcggtcccagtggaggaccccaaagcagtgacggcgggcggtggcaccgtcttcgtcaaagccacgtggctgccgtcccgcttctccctcgccgtgaccgatggtgccggcgcctgggtcgccgacgcctctgaccacgaggtgcgcctccgcgccgagcagtgggatcagcccgtcgccgattacatcgccctcgccgagcgctacctcgccttccaacagcctggttccacgtattccttccatgacgccggcaaaggccaacgcaggctcgcttggacatttgaaagacaaggtaccaagttggaatggcggtggaagctgcagccttcaccaaacacgcagcagactatatctgagatcctggattttcttatggatgcaaatatacgcttaagtgaagaggttgtgaggaaaacacaatcctttgacaagttgaaacaagaagctgagaagtgcttgcaacaaagtgagagatttaacaatgagaaagctgagttcgaacaagccgccttttcaaagtttgtggccgtgttgaattcgaagaaggccaagctcagacaactcagagataaagttgtggagctcgaacccgctgtcaagcctccaaaggaggaggcaggtcaggagcaggaggaggaggaggagaactcaacggaccggacagagctcttcgagggagagaatgacaaagaagcaagcgccaaggatgaacactccggcgagacaggcagcggcaacgttcctagttctcctggggaatcggcagctccctccagaggaagaggacgagggagaggtcgtaagaaggcaagaagataggctgcctagactgacaatagcaggtcctactcggaaattcgctaatcgtcgtggtgcgtctttagccggctagtctcatttccaagagcacgtgtctttcatgtacctttgtgttcgcgtgctgttggcaggcagagtattgcctgtgaaactgattgtccgtctgcttcgtctcatcagtcccccatattttccatttcatcacatgtgtcagtcatgtgacatgcttttcccctgcgcgtggaaaaaaaccgaattaaaaaaggggggaggaatgtttgcccc

SEQ ID NO: 8176 - DNA, 1277 bp, Zea mays
cggacgcgtggccggcggagctcctgttggctctctgtgctactcggcagggcagtggcgtgcagcatcagtgcaactctgcacgccatcccgctggccaccctcagccgctggctagtggattaccaccaccgtctctgcgctacagaattttgtcatccggaatcagattccttcaggcagctcgcatgcaaaagtcaagcggctctacgttattccctcttcacttcattgtcagcaatcctaaaagctcgcagcagcagctagcagctcgttcttgttcgtcagctctagcctaccctgcgctggctcttctttaattctgcagggaagttccagtttcaggtagagtgcaggcggagaaccaatgggggcggcgccgtcgtccgacgactcgtcacgcgccggagacggccgggctgtggcgagcagcgctgcctctggcactggcagcaacagccaccaggcccagtcgaagcgggcgccgccgcctcacaagttccacgagatagttgcgcaggaggcgacgacggccggcggcggcggcggcactgctgctgcagccgagctggaggatcaggcgtgcagcaccggggtgtacctggctgggaaaaccaagaagtactgggtggacgagaagaccaggtgcaactgcttcgtgctgttcgctagagcgctgtccatcacttggggcgacgatcccagatactggatctggcgtcccgtcagagaaaccaatgacgccgagatcgtcgaggctgcgtcgctgcagaacgtgtgctggctggaggtgcacgggaggctggagctgtcgcacctcacgccggggtgcagctacgacgtggccttccaggtgatgctcacggagccggcgtacgggtggtcggtgccggtgaacctgcggctcaggttccccgacggcacggttcaggcgcggaaggagaagctgcaggggatgcccacggagcagtggctggagctcagggccggggaggtgaaggcgccggcgcagccggggggagcgggacgcagcggcgagctggagatctccatgttcgagtacgacggcgggctctggaagaaggggctcctcatcaagggcatcaagatcgtcccgaaggagtgattattaattagtgtttgtaactttgtttcagggtgactgctcctgctcgcttttgcctgtcaggtgtgctaagaacttcgtctaagataattggaataattaatgtgtgtggcactgcgtatttcaacgcttcgaaaaaaaaaaaaaaaaa

SEQ ID NO: 8177 - DNA, 1407 bp, Zea mays
ttgggtacctcgaggccggccgggttagaaaagcattaacgtttcaggggtaaaagctctcgaacaaagagggtgtaccggcgccaccgccagcacacaccagctcgccggagatcacaagaagatacaggaccgtgctcctcgacgccgcccgacatggcggacgccgcctctggccgcggccacgtcgtctaccctccccgctccgccgaggacatcttcaaggactaccgcgcccgccggtccgccatcctccgcgccctcactcacgaggtcgaggacttctacgcgcagtgcgatccagacaaggagaacctgtgcctgtacggctacgcgaacgaggcgtgggaggtggcgctgccggcagaggaggtgcccacggagctgccggagcctgcgctggggatcaacttcgcgcgcgacggaatgaaccgccgcgactggcttgcgctcgtcgccgtccactccgactcgtggctcctctccgtcgccttttactatgccgctcggcttaatcgtaatgaccggaagcgcttatttggtatgattaatgaattgcaaactgtttttgaagttgtctccggtgcgagacaacaacaatctaaagagaggtccagtatggacaatggtggtagagccaagcctgtaaagatagaaaataatggaaaagtcacagacgaagcatacgaagatgacagtgatcacggtgaaaccctatgtggaacctgtggtgggatatacaacgcggatgagttttggatcgggtgtgacatgtgcgagcgatggtaccatggcaagtgtgtcaagataactcctgccaaggcagagagcataaagcattacaaatgcccgagctgcagctccaagagggcgaggcagtagcaaaacccatgaacgcaggaagcctccgaatgtgggatgtatggtgcagaagaggcgcattgcaaagtttgcaggcaggagaaggccaagagacctccatttacaagattagaactatattgctatcttccctgtgccttatgcttactttttttacatatgataagctgatgtgaggaaagataagacatttggcaaccagaggcacttagttaaatgcccctagatatacatgggggtaaaagaagaggaactcatgttttgtcgaatatatggaactttttttcccctcttacagtaacatgtactccatcatacataatttatcacgcagatcaatgttgaggacaaaagacctgcgtgcccctacgagaagaatgatgccatctgctgcgcttctgattgacaacaggcccggggtctcaggtcagcaccacccacctctctgtgtgacaaatttcaaatgttaaatcgttcagtttcatgggacgggaaggagcaccccttctgataaggatggctgca

SEQ ID NO: 8178 - DNA, 3145 bp, Zea mays
  misc_feature (94)..(94): n is a, c, g, or t
  misc_feature (270)..(270): n is a, c, g, or t
gtgcgcataacagtgggatagaaggtgctggcacacatgcgattgttggaatagatggagtaggtggggacgagatgatgacgctgacaacatngttgtattggacgaagaaacagtacgggagcagatgcgtcaaacctgaaggcgagcagtccgggcaggagcggatgctcgggattgagcagaccggatgcagggcgtggccctgacggtgaatgagcattgagctcttatacagtttatatagacggtttatatagagtacaaganttagaagacaagacaaaccacagatacctatggcagtctatgatacacaatatctaaactatcaaatatactttaacagatttgttgaacactattctgctgtcatcagttttctgtggaacttaaaagtttttttttgtatgaaaccatttatatcaggatgatttgaggagggaacttgaattggatcctgagcttcctgcagtactgctcatgggaggtggagagggcatgggtcctgtcaaaaagactgccagagccctaggagaatcattgtttgacaaagagcttggaaaaccaattgggcagcttattgtcatttgtggccggaacaaaacgctaagcgcctccctgcaggcagttgaatggaaaataccagtaaaggtataatccagaacttgttttaaaaggattgaaactggttagtccttgaaacaaaaatgggtgtatctttttttcattcatcttgaatttctttaccaacaggttaggggatttgaaacccaaatggagaagtggatgggagcttgtgattgcattataacaaaggtatatcctcctccattatcggttcttatcatgtttcttctttcgaaggtttttgtgggtttcctaattttgtttctcttctgttatggtttcttaggctggaccaggtaccattgctgaagccttgataaggggtcttcctataatccttaatgacttcatacctggacaggtttgtgttcctactattattctgcactcatgcagttttattgccataatgtgcatgtgaagtgtatgtctttttctgcatttctgatctccttaataaagggtcttagtgtgtaacgtgtttggatcatatgcgctacttatatatttgtattttgattgaatgcaatatatatgaattaaaggttattctaatgtgttaacatgttctcacatacgtttgtgtgtttttgcatgtatgacaggaagttggcaacgtaccttatgttgtggacaatggtgcaggtgtgttctcgaaaagccccaaggaaactgctagtcttgttgcccgctggtttggtccagattcagaggaattgaaaaaaatgtcagaaaaggcactgaaattggcccaaccagaagctgtctttgacattgtcaaagacatgcatgagctctcccaggagcaaggtgtcatatcacagatatctagttccttgacttcatccttcttcttaccatcgcctgaaagcacccctctccaacttatctgaaaccatcaagctaggattgatattgttgacatcgtgaacttggcattctccctacagtgtgggcgtgctttcggctgatccgctcacatggtagttatgggcagggtcgtttgactgacaggttctcgcgtgtgatgatgtttgccttcatgttaacttttgtaaaaaaaaaacattcattcatattatgtttctggctcccttcgtcatcaaaggggaattggtggtggtggtggcttgtaaaatacactcaaattttgtgcatggacatgtcagacccttatcatgtatactagctgatgtgatccgttcatgtaagtggaagatgtgtataatatgattacagattgttggagtggaactttttctctctctctatctctatctgtttttagtttggtatatggtcggctgttgtacgagtattttggtggtgaactgaatgtgccttttgtcctgcactgcgctcttacagcaggcattgaatctctatctgcaccgctgaatgaagtcgataccagaattgcattcatcagttcatagctttcctgcttctggcccgttgactactactgactggtagtagtagtaggtgagtaggaccgggagtgctagccttttttcatgcactgcacggtcgttggacgaacgagcccggccgttctgtctccatccgtccatcaggtgtttcagattggatctcaggagaggggcagcgtgagtgcgagggaccggagactccgtcctgacaatgatgaagcccggaccttttaaagggcaaaaggcgacgcatgatgatcaggctgctccgttcggaattgccctgtctctctgcccgcacagcgccgccactgaactgtgtgcatcagtggagcagctgcaccatccgctccgcttgcctgcctggttccactagatgcggatctggaggcgaaacgaaagccatcccatgtcttgccacgccatgtattgtatggactcgtagcatcgcaacagtgctgccaggctccgacgcacgctccagctccacggacaagcttcgtggccccggcacgctctagaaactgacgcatctaggcgccagcaactccggcgtacggaagttggactctgcctgccgggttagccacacgtcttgttccaactcctccagatcattcttggttttgcccctggttccgacgagacatcaaactttgttagttattagttgtacaggaatagaattgtccttttgttgtcggttaagtactttgcagtttgcaccaccatttactgcttgtatctgaatttctgaaagtaaggagagaagggggtgtagagtcagtcattgcatcatcaaccatttcctaccactatttttcacaggcttgttacatcttgattctcttgtacatcatccatccgtatacatacgtacgtacgtacacggattggagtcgactctcctaccacaagtcctaactgcaacggaagatctgtatctaacaatatccacagaaacattaaactaaataagaaaaaaaaaaccatatgcacaaacaagaagaaaaaactacttatatatgctacaaacaaaaggaaaaaaacgagtagtacgcacaccaaccacgagtctgcag

SEQ ID NO: 8179 - DNA, 2032 bp, Zea mays
ccggcctcccccctccccctccgctccccccaaccccagaacatccggcgctttcaccccccttcccctcccctcccctcccctcgtcctccgcgatggcggcgtccatggcgtcgccgcgggggcggtcgatccgggagacggtgctggagaccgtggcggcgtaccaccagcagcagcgggccaaggggaagctgcgcaagagcctcacctacgccggaggcgagctctcgtccgcgggccgggcccgcggggacggccccgcctccacctccgtctcctcgctctgcgggcccgacgacgacgacgagcccttctgggaggaggaggagggcaccgtcgagctcgtccagctcggggccaaccgcgctaagaacgtcctcatcctcatgagcgacaccggcggaggccaccgcgcctccgccgaggccatcaaggacgccttccgcatcgagtttggcgacgagtaccgggtcttcgtcaaggatctgtgcaaggaccacgccggctggccgctcaacaacatggagagctcctacaagttcatggtcaagcacgtgcagctctggaaggtggccttccacagcacctcgcctagatgggtccataacttctacctcgccgctctcgcctcattctacgccaagaaggtggaggctggactgaagaagtacaagccagacatcataattagtgtccatcccctcatgcaacacattcctctgtgggttctcaaatggcaaggcctacagaacagggtagtctttgtaactgtgatcacagacctcaacacatgccaccctacatggtttcatgctgatgtgaatagatgttactgtccttcagaagaagttgccaagcgggcagcactggatgatctacaaccatctcaaatccgcgtgttcggtcttccgattcgaccatctttctgccgtgcagttcttgttaaggatgatttgaggagggaacttgaattggatcctgagcttcctgcagtactgctcatgggaggtggagagggcatgggtcctgtcaaaaagactgccagagccctaggagaatcattgtttgacaaagagcttggaaaaccaattgggcagcttattgtcatttgtggccggaacaaaacgctaagctcctcactgcaggcagttgaatggaaaataccagtaaaggttaggggatttgaaacccaaatggagaagtggatgggagcttgtgattgcattataacaaaggctggaccaggtaccattgctgaagccttgataaggggtcttcctataatccttaatgacttcatacctggacaggaagttggcaacgtaccttatgttgtggacaatggtgcaggtgtgttctcgaaaagccccaaggaaactgctagtcttgttgcccgctggtttggtccagattcagaggaattgaaaaaaatgtcagaaaaggcactgaaattggcccaaccagaagctgtctttgacattgtcaaagacatgcatgagctctcccaggagcaaggtgtcatatcacagatatctagttccttgacttcatccttcttcttaccatcgcctgaaagcacccctctccaacttatctgaaaccatcaagctaggattgatattgttgacatcgtgaacttggcattgtccctacagtgtgggcgtgctttcggctgatccgctcacatggtagttatgggcagggtcgtttgactgacaggttctcgcgtgtgatgatgtttgccttcatgttaacttttgtaaaaaaaaaacattcattcatattatgtttctggctcccttcgtcatcaaaggggaattggtggtggtggtggcttgtaaaatacactcaaattttgtgcatggacatgtcagacccttatcatgtatactagctgatgtgatccgttcatgtaagtggaagatgtgtataatatgattacagattgttggagtggaagtttctctctctgtgtgtgtttttaggggtgtataatatggtcggctgctgtacgagtattttggtggtg

SEQ ID NO: 8180 - DNA, 3535 bp, Zea mays
gtttaagaatgcccaatataagtcttgatcgcagttactcatattccagagcttaataccctcaaagctaaagaagatggcatacacattggttctgctgtaagacttgcacaacttcaaatttttcttaaaaaggttgtagcagaacatgatttgcctgaaacttcgtcatgccaggcaatagtacgtcagttaaaatggtttgcagggtacacaaatcaggaatgttgcatccattggtggtaacatttgtactgctagtccaatatcagacctaaatccactttggatagctgtaggtgcgaaattccatataatagatgtgaacggtaatgttagaactacccttgcaaaggacttctttcttggttatcgtaaagttgatataaaaccagaagaaatattgctttctattatactaccatggacaaggccttttgaatatgtcaaagaatttaaacaggcacatagaagggaggatgacattgctttggttaatgctggaatgcgtgtgtatttacaagaaactgaacgaaattggataatatctgatgtttcaattgtctttggtggggtagcagcagttccacttagtgcttcaagaactgaaaacttccttactggaaagaaatgggactctgggttgctggatgatactttcaatttattgaaagaagacatctctctttcagagaatgcacctggtggaatgattgaatttcgcagatcgcttactttgagtttctttttcaaatttttcctgtctgttacccatgaaatgaaaataaaagggttgttagcagatggattgcatgcagatcatctgtcagctgtacagccttacagtaggcctgttactgttggaactcaaagttatgaattagtaaggcaaggagcttctgtaggtcagccaatggttcatatgtcagctatgcttcaggtcactggtgaggctgaatacactgatgacacaccgacacctcccaatactttgcatgctgctttggtgctgagtaagaaggctcacgctcgcatattgtctattgatgattcacttgccaaatcttcccctggctttgctgggctgttcctttcaaaagacattcccggtgttaaccatactggaccaattatccatgatgaggagttttttgcatctaacattgttacttgtgttggtcagatcattggaattgttgttgctgatactcatgataatgcaaaaactgctgccaacaaagtacatatcgagtattgtgagctcccagcaattttatctgtagaggaagctgtcaagattggaagctttcatccaaataccaagaaatgccttgtgaaaggcgatgtagaacaatgttttctgtctggtgcatgcgatagaattgtatcaggacaagttcatgtcggaggtcaagagcatttttacatggaacctcagtgcactcttgtctggccagtggattctggaaatgaaattcatatggtttcatctactcaagctccgcagaagcatcagaagtatgttgcaagtgttcttggtcttccacaatcaaaagtcgtttgcaagactaagcgtattggtggtggatttggtggaaaagaaaccagatcagcaatatttgctgctgcagcatctgtaccctctttctgtctgagaaggccagtaaagcttgttttggacagggacgttgacatgatatcaactggacagaggcacagtttccttgggaaatataaggtgggatttaccaatgaagggaagatactggccctagacctggaaatttataacaacggtggccattcacttgatctatcccttgcagtactggaacgtgctatgtttcattcagaaaatgtctatgacatagaaaacatcagaatcaatgggcaagtatgctttacaaacttcccaagtaatactgctttccgaggttttggtggtccacaaggcttgttgattgcagagaattggattcaccatatagctacagaactccaacgaagtcctgaagagataaaagaacttaattttcacaatgatggagttgtgctacattatggccagttgctccagaattgtacaataagttcagtttgggatgaactaaaagcatcttgtaattttgtggaagctcgcaaagccataaataattttaacagtaataaccgctggaggaagcgaggaattgccatgattccgacaaaatttggcatatccttcactgcaaaattcatgaatcaggctggcgctcttgtgcaagtttacactgatggcactgtcctggtaacacatggcggggtcgagatgggacagggtttgcacacaaaggtagcccaagttgctgcctcgtcattcaatatccctcttagctctgtatttatatcagagacaagtactgataaggttcctaatgcatcaccaacagcagcctctgctagttcagatctgtatggagctgcagttttggatgcttgtcaacaaatcaaggttcgaatggaacccattgctagcaaaggaacccacaactcgtttgcagagttggctcaagcatgctacatggaacgtgtggatctctctgctcatgggttttatgctacacctaatattgggtttgactggacgattggcaagggaactccattcaattatttcacatatggagctgcatttgcagaagttgagatcgacaccctaactggggatttttacacaaggacagctgatattgttatggatctcggattttcaattaatccagcaattgacattggccagattgaaggagcttttatccaaggattgggctgggcagccatagaagagctaaaatggggggatgataaccataagtggattcgacctggacacctcttcacctgcggtcctggttcttacaaaataccctctgtaaatgatatacctctgaatttcaaggtttctctattaaagggtgttccaaatccaaaggctattcattcttccaaagccgtgggagagccaccatttttcctaggttccgccgtcttatttgcgataaaggatgcgatctctgcggcaagggctgaggaggggcacttggactggtttccactcgacaacccggcgacaccggaaagaataagaatggcatgtgtggattccattacaaagaaatttgccggtatagattatcggtccaagcttagtgtatagcggctgctgggctggtcacgggagaataaattggaaacagaagcccgcatttgtaaagtttcatgccctttgtgctaaaaagaatgggagggacggtttagtgttacttgtgggaaactttaaccctaacaaaggattgggtgatgtattaatagattgagttagttgggtctgacatacacatggatgagaagataattacacggtaaactctaaggccctgttcggtttttatggattggagccctggattgattcctagccggattacttctctaatttatatagattttgatgagcgaaaatattaaaaaaaaaaaaaaaaaaactcgagaaggg

SEQ ID NO: 8181 - DNA, 1376 bp, Zea mays
actttggcaggctgcgagcagtctgacagctacacacacaggcagacgccgttccgcgggggaaaggtgcggacgcctgaatcctctccaactccggcaccgcattcgcacgcccgcgaagccccgaatcggagaggacagaggagtcatggacgcggcggcggcggcggctgcggctgcgagccccacgagcaagaggatcgcgctggtgacgggagggaacaagggcatcgggctcgagacgtgccggcagctggcgtccaggggcgtcagggtcgtcctgacggcgaggaacgaggcgaggggtttggaagcggtcgagcgcgtcaggtgcgcccgcggcgacgccgaggtttacttccaccagctcgacgtcaccgacccctgcagcgccgcccggctcgcggatttcgtcagggatcagttcggtaggctggacatcctgatcaacaatgcaggaatttcaggcgttcaccgtgatccagttttgtctgctgcggtcaaggataaggtcgatggcatggatgtaaatcagagagtcgaatggatgaaagaaaattcgaaagaaacatacgaggaggctgtacaatgtatgaaaacaaactattatggtgccaaacttgtcacagaggcactacttcctcttcttcagttatcctcctctggaagaattgtcaacgtttcgtcaggctttggactactgagaaatttcaacagcgaagaccttaggaaggagtttgaagacatcgacaatcttactgaaagtagactggaggaactgatggataagtttctagaggattttaaggccaacttagtagaggcgcatgggtggccgacaggtggatcttcagcctacaaagtcgtcaaagcggcgctcaatgcgtacacgaggattcttgccaagaagtatcctacgctgcgtatcaattgtttgacgcctggttatgtcaagaccgacatgtctatgcacatgggggtactgacacttgaggaaggcgctcgcaaccccgtgaaggttgctctcttgcctgacgacggaccgactggtgcttattttgatctgaatggcgaggcgtcctttgtgtgatggtatttctcccttttcagcttcagaataaaagaaagagctatgaagtagttagtgccaatcagtattgtagttcgacttgaatacttaaactagcacgttgagcaaaccgtagagctcaacaccagggatttcctcgtcttctgtataatatctctggtgatgattgtatatttgcaatgaaccatgcagatttggtcgcgccaaggtagtgtttggttggcacaatggtaatggcaacaggaatgaaaatggactgcgaggggaacgatggtggggttcgttt

SEQ ID NO: 8182 - DNA, 1276 bp, Zea mays
gcttgcattgcattggcactttggcaggctgcgagcagtctgaaagctacacacacaggcagacaccgttccgcgggggaaaggtgcggacgcttgaatcctctccaactccggcaccgcattcgcacgcccgcgccgccccgaatcggagaggacagaggagtcatggacgcggcggcggcggctgcgagccccacgagcaagaggatcgcgctggtgacgggagggaacaagggcatcgggctcgagacgtgccggcagctggcgtccaggggcgtcagggtcgtcctgacggcgaggaacgaggcgaggggtttggaagcggtcgagcgcgtcaggtgcgcccgcggcgacgccgaggtttacttccaccagctcgatgtcaccgacccctgcagcgccgcccggctcgcggatttcgtcagggatcagttcggtaggctggacatcctgatcaacaatgcgggaatttcaggtgttcaccgtgatccagttttgtctgctgcggtcaaggataaggtcgatggcatggatgtaaatcagagagtcgaatggatgaaggaaaattcgaaagaaacatacgaggaggctgtacaatgtatgaaaacaaactattatggtgccaaacttgtcacagaggcactacttcctcttcttcagttatcctcctctggaaggattgtcaacgtatcgtcaggctttggactactgagaaatttcaacagcgaagaccttaggaaggagtttgaagacatcgacaatcttactgaaagtagactggaggaactgatggataagtttctagaggattttaaggccaacttagtagaggagcatgggtggccgacaggtggatcttcagcctacaaagtcgtcaaagcggcgctcaatgcgtacacgaggattcttgccaagaagtatcctacactgcgtatcaattgtttgacgcctggttatgtcaagaccgacatttctatgcacatgggggtactgacacttgaggaaggcgctcgcaaccccgtgaaggttgctctcttgcctgacgacggaccgactggtgcttattttgatctgaatggcgaggcgtcctttgtgtgatggtatttctcctttttcagcttcagaataaaagaaagagctatgaagtagttagtgccaatcagtattgtagttcgacttgaatacttaaactagcacgttgagcaaaccgtagagctcaacaccagggatttcctcgtcttctgtataatatctctggtgatgattgtatatttcc

SEQ ID NO: 8183 - DNA, 5452 bp, Zea mays
  misc_feature (2230)..(2230): n is a, c, g, or t
  misc_feature (2446)..(2446): n is a, c, g, or t
  misc_feature (2717)..(2717): n is a, c, g, or t
  misc_feature (2723)..(2723): n is a, c, g, or t
cttacgaaaacgaaaccatgggaactgatgttttatatgagttgagatgtatacgcgacccttaaaaccatagcgcagtactagatctcagagcaaacagattagagaagaactgaggagttggggctgtcgctttgcagcccgtgacacattcattcatggcagcctacacaagctgatggggaacactacgagtgagactcccgattctgcgcagtacttaatataataatataatacgcgtcgatcattagtgcttgtttgaccatgtttgctgccgcttgacctctagtatcgtgccaggctggcgtcatggcttgtggcttccaacggccatgcagatgcaggcacgcagctaccatgtcctgcaactgcttgttgcatcactccatccatgcttcagacccaagggattggatgtcagctgtcatcttcggtgtaacgtctcgctggtcctgtcaagaaaaagctgggaaagattactcgtacgctgttctaaacagactgtgattagtcaggtcttctggaatttaacctgttttgttcctacggtttttttagttcaactggtgtctgtaaaaactcatgcggaatttctgcgttccaaatcggcccgccccttgttgacgtttgaaggctggaatgcaccttgaaatcaggatctgtattgtttttggagattccaatacctccttctcagtcgcctgctatctccaagctgtccaaagtcgtcagtttccctccccctacaggctacaaactcctcaccgcaccaccgcgactgcgagagaaaagggggagggggaggagcgaggaggagtaggactgtaggaggagcgacgcatcgcaacgccaacactcacagttgactatcccaccaaggtaacggacacaagcttccctgcagctcgctctcgcattctatctccctcccagtcccagacccagtcccagctgttgcagcctccgaacatgccaaagcttcctgcactgcacccctgtcagtcaggcctctagctgcagccaaaaaccgctggccttgaacatctccccatccgcctcccgcggcctgccacgcgacatgattgcgtcgcgggctgctgcggagctcagctgcccccgcacgccgctggcgacgccttctgcttgcccgcctctgcccgcccgtcttccctgatccctcctcccctttgcttccgcacgaagatctgggcgtgtcttcttccgacaaagctgtatgtggtccgctccgcttcacaacccccgccgtatcggtcttgttcgttgtcctgccagatacagataggtggctaccactggctcgcgtgacctgttggcttgcttgctcctctccaggttcaggcaggggagagtgcctgtttcgatggggaagaagggcaagtggttcggcgccgtcaagaaggtcttcagccctgaatccaaggagaagaaagaggaggtgatggttcccggcccccattcgaaaattctcttgcgtttttttccccactaggatttgatcgggttcgtgtttcccccacgcccgggattccgtagagttcagtacaaaaaaaaagaaaaaagacggcatcttgttcggccttttctacactattctcacagctggtgaatttttggttctgcattctgcatccatgtcaagcaaccaagacggcatttcatcctcccctctttacgactgtcttgcggatctgtgatcaaagcgccgcctttttttccccttgcatttgtgttttttgtaactaaagttcgagctggattctgatcacaacccagaactttgccattggaattaaccggggctaaggaggaagtcagcagctagcaacccgacgccggtagatctgaccccgtctacctccttggaagtcaatctttcggtgccaccgcctccagctcctcccccagttcttcaccaggccgaggaggttggggtccctgaagccgagcaggagcagagcaagcatgtcgccgtggaggaggcccctgctgccgccccagcgcaggcgtcggtgctgccacctgctgtgccaacccaggagctcgccgcagtcaagatccagaccgccttccgaggttacctggtaatgtgaaaaatcatcacttccgaatccacctgtttgtttctgtgccatttggacgttagataggaacaattgtggcagttggaaattggtttatgtagatggccgcattaccaagcacatgnaagtgttcgtttctgatagcttttgattaggtctttgatatttgggggggtaggaggaggtttgattccctccccaacccccctgatttcgtttccacacatcaacatgaccgggcatgcaagcaaatgtctactggtgaccaccctgcatatttgctctttccgtgttctagcttttaggtgtcggcagcttgccaaccttgcaagcgtgagttntctagttgctgttactgagtggtatctcttagctgaatactttagctatttacatcattgcatgtcgtgctttcatctacctatctttgtgggctaaatgggaatttatggctgaagaagtagattttcttgctttagttgaaccttaggaactgttacttttctggtttaattcctttccttcaactagttcttcactttttaggtctgccctgttgtttatgccaatgtgcatttgtccaaagggcctacagatcattcttgcaaagtnttacanaaatgattcttgaacaactggcggttggtggcaaccacctttcgtcacccattttggtgttcttttcaattattttttgatactgatagcctgtctgccctgctattgagcctgtctgccctgctattgaactatccatatgagatacgctattagtggacgtagtttctgttctttgggaagtaggacttcatgggaattttacttgtttcatagtaaagcggaatcttacttttacactttgccacaaaaaaaaggaaagaaaaaaacaagaatcttacttttacaaaacaatgttatgctgagagtgttcggtcattgtgataacgtaggcaaggagggcactacgagcactgcgaggccttgttcgattgaagtcattggttgagggtaattcagtaaagcgtcaatctgcaagcactctgcgctgcatgcaaactctatcacgggtgcagtcacagatatcttccaggagagcaaagatgtccgaggagaaccaggctctccaacgccagctcctacttaaacaggaactggagaatttcagagtatgcaaaccttctcaaagctctaatctgcttaaagccttgagatagttataagatattattgagagaactaaacatattctgtctgtgaataatgatatatcagatgggtgagaactgggatgacagcacccaatccaaggagcaaatcgaggcaagcctgataagcaggcaagaggcggcgataagaagagaaagagcgcttgcatatgcattttcacaccaggtaggaactcttgctctcagaacatctatatatacttgatcctccttgctctatgatggtaaagcttaaaatgtctcaaaatgtgttgtttacagtggaagagtacatcgagatctgtcaacccaatgtttgtagacccaaacaacctgcagtggggctggagctggctggagcgctggatggcagcaaaaccatgggaaggccgcaatggggctgacaaggagagcaacattgaccggggatccgttaagagcatgagcttgaaccttggagagggtgagatcacaaaagctttcaaccgccgggactcaaagctagaaaagccatcgccgccaactccaagaccggcccgtccaacttccaggcattcccctttgacgccctctgctagagtggcaccgatacctgcgaggagaaaatttgtcacgcccaagaacgggctttcacaggtggacgatgacgcgaggagcgtgctcagtgtgcagtctgagcggccaagaaggcacagtatagccacctcgactgtgcgggacgacgagagcctcacgagctccccgtcgctcccaagctacatggttcccacagaatctgcaagggccaaatctcgcctccagggttcagcaacggccaatggcgcagagacacctgagaaaggaggctcgactggaccagccaagaagaggttatccttccagggtggaactgtgtctgcctcgccaatgcgacgacattctggtcctcccaaggtggagatcgcgccaccacaaccagaggccttggtagtcaatggtggaagcaagtgacacatatgtgatgagtaccaggatgagaaacggattatgaagatattagtttcattttcatccatgaatagaagttaaaagtggtatcatatctatgaatggtttcaattgtttttctgttacaaccacattatttgctatatacgattcacagtacctgccagttgattccattggttgtttctgtaaaacaaatatcaatttgtcactagaatctgtgatgtttgtatgtaaacaggtcctctatttatgtgagacatatatttcttttctttcagaagatccccttgaagtgtgttacccttgcaagctatttatttattttatctaagaagtttctgtctgtaaaccactacctccgttttcagagaagagttaaaatacaaaacgacacactaacaatccattgatctaaatacaaaaactaattttacaaaaataatataaaatcatcatttttctcgaaaagcgtaagagaactacactgcattatattatagtagaaggaaaggggcaaaagacctcggatacatgacactccttagttcttacggaggccagaaacaagcatacataaaacaattcatatagttcttacggaggccagaaacaagcatacataaaacaattcatagggaaaagacaaacaacacactctaaaacaccctatgatggtctgatcctaagtaatggagagtggccaggaaggataatcccttggcactagccacttgccatttctccctctcctcatgagcaggctacgggaaaagagtgagattaggataaactccatcaaacaccacttatttatattgttccagatcaaccatgctcctagagaaagaagggaatctagctctttcttcctcaaaccagagacatgagctgaagccctgtcccaccaaaccataaaagcagatatctccttgctagggggctagactgtgcatgccaaaacaacattagactgtgcatgccaaaacaacattaagatgttgtaccaaaatactctagagaaaacacaggacaccaacaggtgattgatagtttcgaaatcttggtcacacaagacaccaacaggtgattgatttcagcggcatggccaccaaggaccgaggtgagaccggtctggcggggctcagtgtcccg

SEQ ID NO: 8184 - DNA, 2200 bp, Zea mays
tgggacctcgaagcggccgggccgggtaagccaacactcacagttgactatcccccccggggcccgcccgcccgcgtccctgcagctcgctctcgcattctatctccctcccagtcccagacccagtcccagctgttgcagcctccgaacatccaaagctcctgcactgcacccctgtcagtcaggcctctagctgcagccaaaaaccgctggccttgaacatctccccatccgcctcccgcggcctgccacgcgacatgattgagtcgcgggctgctgcggagctcagctgcccccgcacgccgctggcgacgccttctgcttgcccgcctctgcccgcccgccttccctgatccctcctcccctttgcttccgcacgaagatctgggcgtgtcttcttccgacaaagctgttcaggcaggggagagtgcctgtttcgagggggcgtggagcggagccggagccatggggaagaagggcaagtggttcggcgccgtcaagaaggtcttcagccctgaatccaaggagaagaaagaggagaggctaaggaggaagtcagcaggtagcaacccgacgccggtagatctgaccccgtctacctccttggaagtcaatctttcggtgccaccgcctccagctcctcccccagttcttcaccaggccgaggaggttggggtccctgaagccgagcaggagcagagcaagcatgtcgccgtggaggaggcccctgctgccgccccagcgcaggcgtcggtgctgccacctgctgtgccaacccaagagctcgccgcagtcaagatccagaccgccttccgaggttacctggcaaggagggcactacgagcactgcgaggccttgttcgattgaagtcattggttgagggtaattcagtaaagcgtcaatctgcaagcactctgcgctgcatgcaaactctatcacgggtgcagtcacagatatcttccaggagagcaaagatgtccgaggagaaccaggctctccaacgccagctcctacttaaacaggaactggagaatttcagaatgggtgagaactgggatgacagcacccaatccaaggagcaaatcgaggcaagcctgataagcaggcaagaggcggcgataagaagagaaagagcgcttgcatatgcattttcacaccagtggaagagtacatcgagatctgtcaacccaatgtttgtagacccaaacaacctgcagtggggctggagctggctggagcgctggatggcagcaaaaccatgggaaggccgcaatggggctgacaaggagagcaacattgaccggggatccgttaagagcatgagcttgaaccttggagagggtgagatcacaaaagctttcaaccgccgggactcaaagctagaaaagccatcgccgccaactccaagaccggcccgtccaacttccaggcattcccctttgacgccctctgctagagtggcaccgatacctgcgaggagaaaatctgtcacgcccaagaacgggctttcacaggtggacgatgacgcgaggagcgtgctcagtgtgcagtctgagcggccaaggaggcacagtatagccacctcgactgtgcgggacgacgagagcctcacgagctccccgtcgctcccaagctacatggttcccacagaatctgcaagggccaaatctcgcctccagggttcagcaatggccaatggcgcagagacacctgagaaaggaggctcaactggaccagccaagaagaggttatccttccagggtggaactgcggctgcctcgccaatgcgacgacattctggtcctcccaaggtggagatcgcgccaccacaaccagaggccttggtagtcaatggtggaagcaagtgacacatatgtgatgagtaccaggatgagaaacggattatgaagatattagtttcattttcatccatgaatagaagttaaaagtggtatcatatctatgaatggtttcaattgtttttctgttacaaccacattatttgctatatacgattcacagtacctgccagttgattccattggttgtttctgtaaaacaaatatcaatttgtcactagaatctgtgatgtttgtatgtaaacagatcctctatttatgtgagacatatatttcttttctttcaaaaaaaaaaaaaaaaaaaaaaaaaaaaaagaaaaaaaaaaaaaaaaaagcggcc

SEQ ID NO: 8185 - DNA, 2857 bp, Zea mays
cgcgacatgattgcattgcgggctgccgcggagctcagctctcctgtcctgccaccaccacgccgctgacgatgccttcctctcgcctcccgccccccccgcccggccgaaacggctagcccgcccttcctcccctcccctttgcttccgcaccaagatttgggcgggcgttccttcttccgataaagttgacacccgtcgtctcgtcgtgggcctggcagatactgataggtggtctggttcgtgacttgttcagtcctcctctccaggtgccgagccagggtgactgttccgaggagcgtggcgtggacccatggggaagaagggcaagtggttcggcgccgtcaagaaggtcttcagccccgaatccaaggagaagaaagaggagaggctaaggaggaaatcagcagctagcaacccagcaccggtagatctgaccccatctacctccctggaagtcaatgtttcggtgccaccccctccggctcctcctccagttcctcgccagaccgacgaggtcagggtccccgaagccgagcaggagcagagcaagcatgtcaccctggaggaggcccctgctgctgctgctgccccagcacaggcgtcggtgctgccacctggtgcgccaaccgaagagctcgccgcaatcaagatccagaccgccttccgaggttacctggcaaggagggcactaagagcactacgaggccttgtacgattgaagtcattggttgagggtaattcagttaagcgtcaatctgcaagcactctgcgctgtatgcaaactctatcgcgggtgcagtcacaaatacgatctaggagagcaaagatgtccgaggagaaccaggccctccaacgccagctcctacttaaacaggaactggagaatttcagaatgggtgagaactgggacgacagcactcaatccaaggagcaaatcgaggcaagcctaataagcaggcaagaggcagcgataagaagagaaagagctcttgcatatgcattttcacatcagtggaagagcacatcaagatctgcgaacccaatgtttgtagacccaaataacttgcagtggggctggagctggttggagcgctggatggcagcaaaaccttgggagggacgcaatgggaccgacaaggagagcaacattgatcgcggctccgtcaagaatatgagcttgaaccttggagttggagagggtgagatcacaaaagctttcaaccgccgggactcaaagccagagaagccatcaccaccgactccaaaaccggcccgtccagcttccaggcaatccccttcgacgccctctgctagagtggccccaatacctgcgaggaggaaatccagcacgccaaagaatgggctttcacaggtggacgatgacgtgaggagcgtgctcagtgtgcagtctgagcgaccaaggaggcacagcatagccacgacgtcgaccatgcgggacgatgagagcctcgcgagctccccgtcgctcccgagctacatggttcccacagaatctgcgagggccaaatctcgcacagcaacggccaatggcgcagagacgcctgagaaaggaggctctgctggaccagtcaagaagaggttgtctttccaaggtggagctgcggctgcctcaccgatgcgacggcattctggccctcccaaggtggagagcgctgtgaaggacattgctgcgccaccacagcctgaggccttggtagccaatggtggtggaagcaagtgacttgtattgacaagttccaggatgggggagcgggttatggtcttatggagggacatgtttcatccgtgaacagaagttaagagtggtgccggatctacgaatggtttgaattgttttcccgttacaaccacattgtttgctgtataagattcactgtacctgccagttggttccatttgttgttttctgtaaaacaaacatcaatttgtcactagaatctgtgatgcttgtatgtaaacaggtcctctatttatgtgagccatatatttcattttcagaaaaaaaaaaaaaaaaaacccgccatgttttcatcctccttgcgacttactccgtatattatatataagccatggtaaattgaaaataaatttgagtgatgctaatgaaactttggctgccaaattttcgtctcagcgcgcaaggtttaaacgatggtgggagactcttggacgcaaggagtgatattaagtgatttcttcagtatggtatgtataacaagaatagaatccgcaaatcaatactatgtgagttacaaaactgaatatgaagtcaaataacaatgagctacatttccaaattcctcgggtacggtttgtttttcaggtcaggcatcaaatatttcaccaagacaccaattcggagcaattttttgttagcgtcaacaccttggcatggaagcattcattgggcaacttgacacaaatttgcagaaacggcacttccacatctcctcttcagctacaagtttaggctcgtgtgatcctgtccagaagctgaggacgtcctggatttgatccctgaaccacctagcatcataagtgaaccggtattcttcaagaagggaacgatcttcctgtagctcgtatctcaagagcagctgttcttgagaccgtggtagcgtgtgacaggtaaccttgaaatatttcaatacatcttcaaaggtctttgcatcgaaccccaatgagctaatataccccttgacctcgtctgataacaagtagttggggtccaggttaaaatggctgaagaaattatctgctgggaatttctctgcgatcaaattgtcccatagatacttgtaacacattagttgaagccttccttttttttttg

SEQ ID NO: 8186 - DNA, 1909 bp, Zea mays
atctcccttccctcgatccgcggggtccccagctgtccaaagtcccactcccagcttccccccccctaaaaaactctcacacatcaccgcgagagaggaggctgagccgcggaggagcagcggcgcatcgcaacactaaccaaagtcctcctctccaggtgccgagccagggtgactgttccgaggagcgtggcgtggacccatggggaagaagggcaagtggttcggcgccgtcaagaaggtcttcagccccgaatccaaggagaagaaagaggagaggctaaggaggaaatcagcagctagcaacccagcaccggtagatctgaccccatctacctccctggaagtcaatgtttcggtgccaccccctccggctcctcctccagttcctcgccagaccgacgaggtcagggtccccgaagccgagcaggagcagagcaagcatgtcaccctggaggaggcccctgctgctgctgctgccccagcacaggcgtcggtgctgccacctggtgcgccaaccgaagagctcgccgcaatcaagatccagaccgccttccgaggttacctggcaaggagggcactaagagcactacgaggccttgtacgattgaagtcattggttgagggtaattcagttaagcgtcaatctgcaagcactctgcgctgtatgcaaactctatcgcgggtgcagtcacaaatacgatctaggagagcaaagatgtccgaggagaaccaggccctccaacgccagctcctacttaaacaggaactggagaatttcagaatgggtgagaactgggacgacagcactcaatccaaggagcaaatcgaggcaagcctaataagcaggcaagaggcagcgataagaagagaaagagctcttgcatatgcattttcacatcagtggaagagcacatcaagatctgcgaacccaatgtttgtagacccaaataacttgcagtggggctggagctggttggagcgctggatggcagcaaaaccttgggagggacgcaatgggaccgacaaggagagcaacattgatcgcggctccgtcaagaatatgagcttgaaccttggagttggagagggtgagatcacaaaagctttcaaccgccgggactcaaagccagagaagccatcaccaccgactccaaaaccggcccgtccagcttccaggcaatccccttcgacgccctctgctagagtggccccaatacctgcgaggaggaaatccagcacgccaaagaatgggctttcacaggtggacgatgacgtgaggagcgtgctcagtgtgcagtctgagcgaccaaggaggcacagcatagccacgacgtcgaccatgcgggacgatgagagcctcgcgagctccccgtcgctcccgagctacatggttcccacagaatctgcgagggccaaatctcgcacagcaacggccaatggcgcagagacgcctgagaaaggaggctctgctggaccagtcaagaagaggttgtctttccaaggtggagctgcggctgcctcaccgatgcgacggcattctggccctcccaaggtggagagcgctgtgaaggacattgctgcgccaccacagcctgaggccttggtagccaatggtggtggaagcaagtgacttgtattgacaagttccaggatgggggagcgggttatggtcttatggagggacatgtttcatccgtgaacagaagttaagagtggtgccggatctacgaatggtttgaattgttttcccgttacaaccacattgtttgctgtataagattcactgtacctgccagttggttccatttgttgttttctgtaaaacaaacatcaatttgtcactagaatctgtgatgcttgtatgtaaacaggtcctctatttatgtgagccatatatttcattttc

SEQ ID NO: 8187 - DNA, 1099 bp, Zea mays
aacccccgccgtatcggtcttgttcgttgtcctgccagatacagataggtggctaccactggctcgcgtgacctgttggcttgcttgctcctctccaggttcaggcaggggagagtgcctgtttcgagggggcgtggagcggagccggagccatggggaagaagggcaagtggttcggcgccgtcaagaaggtcttcagccctgaatccaaggagaagaaagaggagagcaacattgaccggggatccgttaagagcatgagcttgaaccttggagagggtgagatcacaaaagctttcaaccgccgggactcaaagctagaaaagccatcgccgccaactccaagaccggcccgtccaacttccaggcattcccctttgacgccctctgctagagtggcaccgatacctgcgaggagaaaatctgtcacgcccaagaacgggctttcacaggtggacgatgacgcgaggagcgtgctcagtgtgcagtctgagcggccaaggaggcacagtatagccacctcgactgtgcgggacgacgagagcctcacgagctccccgtcgctcccaagctacatggttcccacagaatctgcaagggccaaatctcgcctccagggttcagcaatggccaatggcgcagagacacctgagaaaggaggctcaactggaccagccaagaagaggttatccttccagggtggaactgcggctgcctcgccaatgcgacgacattctggtcctcccaaggtggagatcgcgccaccacaaccagaggccttggtagtcaatggtggaagcaagtgacacatatgtgatgagtaccaggatgagaaacggattatgaagatattagtttcattttcatccatgaatagaagttaaaagtggtatcatatctatgaatggtttcaattgtttttctgttacaaccacattatttgctatatacgattcacagtacctgccagttgattccattggttgtttctgtaaaacaaatatcaatttgtcactagaatctgtgatgtttgtatgtaaacagatcctctatttatgtgagacatatatttcttttctttcgaaaaaaaaaaaaaaaa

SEQ ID NO: 8188 - DNA, 1367 bp, Zea mays
ccgccggccgcgctcagtttccgctgtcactccctctccctctgttcgccactttataccgcccgcccaccactcccctccccgtttctctctgcttcatccttcgctttcccctgcgccaggcccgccccgcccttccagaacgacatcctccttccccgccccctccgatggggaacccgccggagctgtaccacaagatcctcaacatccccaaggacacctcgccgcacgaaatccgcgccgcgtacaagaacctcgtcaagaagtggcaccccgacaagcacccgccgtcgtccaggccggaggccgaggcgcgcttcaaggccatcagcgaggcctacgaggcgctcctggaccagcaggagaacaggggcgtgttcgagctgtgcaacgacggccgggcgggtgagaggacgcgcggcgccttcggcggcgccggcggcggcggtggcggaggaggaggaggcctcggcgccggcgtcggggcgcgcatggagaggacgcgcagcgacgggttctgcacgaggagcgcgcccggcacgccggcgagggagttcaagaaggtgtacagctccggcgaccccggcgggcgccgcgccttcgccgagttctccagctccatcgtgcgcaaggcgccaccgctggagcgcaagctcgagtgcaccctcgaggagctctgccgcggctgcaagaaggaggtcagcttcacccgcgacgtcgtcaccaagaacgggtcaaccgtgaagaaggaggtgacacagacggtggtggtgaagccagggtggaggaaagggaagcaggtggtgctggaaggcatgggggacgagcgggcggggtgcctgcccggcgacgccatcctcacggtgtccgagaagaggcacccggcgttcaagcgggtgggcgacgacctggtgctcaaggcggaggtgccgctggtgggcgcgctcacgggctggtccttctcgttccgcctcctcggcggcaggaaggtgagctgctcgttccaggacgaggtcgtccgccccggctacgagaaggtgatcgccggcgagggcatgccggtccccgggcagaagggcgcgcgcggcgacctgagggtcaagttggacgtcgtcttccccaaggagctcaccgcagagcagcgcgccggcctcgccgagatcctcagagggtcctgctgatccatcggccccagttccaagcgtatcaggttttcttggccgtgtccgtgtgttaagttttaatatgtatactcatagcgcgtgtgatgagtatataagtacataaagagagagggggcgtcgttgtacatacaggtcgtttatattatatatatataaggataaaaagaaatatgaaacgtg

SEQ ID NO: 8189 - DNA, 10869 bp, Zea mays
tatatatctaggaggcaatcatgatctatgtgaaggctaatagtgtatacacacacacacgaagtgatcgacatactaaaaaaaagtatgtaacctagttgtttcttttctttagggttgcggggacctggactgccacaccgttctttaattctctcactgcgtcgcgatatttcatcccacgcgtggataccatagagacattgttcttattgatgcgatattgatcgacaacgaacataacgagcatgggtagatgtgtaaccgctcctggcatgcaaggacatacattagctaatggtactatattggcacactcttcttccgatgagttatagtaacaaatgcatgatactctctactcgtatattatctcggttgaatatgacagagacgatttacatataggggatatactcagtatattggatttacttttgttttcgttgtagcacgaacgaactggagtatatgtatgagctaattatcagtatagtcgtatagcttatttgctcttatcggttagaataatcaccgtcgagatataagaccagctcactttaccctcgtccggtccttcgtttggcaccactttgctcgccgtatatatatcctcccaccaatcggcaatacatcccgatctcccttttccattgcccgcacagagttttcacctcggcgctcttgtcgcgtggtctggtctctggttgaagcgtcagaatcaagtagcacgcgaccgatcgagaccagacgtggacgcgcggaataaggtcaaaccagtacacctttcatgttgttcaaccactctacgctgttggatttcccccctttttccttccttgctgcagctgctactatatatatattcgttaagccctttctggtacgagcgagtatatgtcaaggtttggtgcgaccatttgcatggccacaatggcgtgcgaggacgtcgtcgatggtgtccgtggcttagggatcatcggcagcgcgattctaatccgatctgattcgattctaatctgatctgatccaaatttagagcctattgtcacttctagccgcgagaggattggattccttgggccaaattcggggatccatcggctctggaaacgtgaaattagcggcgcccaattgccgacgcatccggttttcttatggcacgtgttcgtggggcgtgccgcgtgggcagcctagtaggcgtacgctcgagaggcatgatttttacggatctggctttggcgcgtggatgtgtccaggggactctacgacgaaggtcgcaacgtgtttcttcattttatgctcccggtcgatcgcaggctcgcagatccaaagccagccgcgctacgtccaagtgccactccattgttgcccagatccaaagccagccgcgccgcgccgcggtactgcgtacgtcgagtacacgtgggcacaggccacaggtggccatggccagcagcagcaggtgccttcgcttctgctacctggcgaccttctcagtcactccgcacatgcgcgaggggcgggcggcgtgcttgcaacaaggaagaatccaaggagagagagagcagcccacttggccttgtgtaactttgcgaagaaatatggaccatctcagtgcgtgcgcgcgggtctgcgtcaatgccgtggcggaaaatgggatatcgtgcctcctgggtaatccgaaaaattaaccaggccttagttgtttcggatgcgttctgtttggtgcactccatggtgtctggcatgaaaactatcttctcttgcacaaccacataagggcatgtatagtgttcgcctcgattttcggaacgaatttacttagttttgttggaataacatcatttcccagctttcaagaaaaaaattcgcactttggtggtgaaagatctagacccttagttgagttttggtaattaatgataacacttatggaccaacctttctttttgagtgtgtgtgaaagaaaatactttaggcactgtttaaatgtactagagctaatatttagatgttaaaactagatggagatatccaaatagtctatataatagttcaacttagtctatctaactactagttgcaccctcaactactcattagttcattagttagttcaacctaactaaaatcagctaatagttagccaactaattccattagcaatttttagccagctacctattagctctagtgcattcgaacaacctcttagtttacaagatggggggcattgacatgtatttgattgctagaatgttggaaaacccaaatcaaacaaagcaagaagaagaccaaagcaagtcttggctaggaaggaccatatgcaatgcaatgcaaagacgaagggtaagctagacaccttcaagtcaagatacactttttgtatcagtgaagtgtcaataaagggtctagcgctaatagaccgagatagtgctgggaattaggtcggactataccaggacgacccgagcccatcatgctttggaccaaacaggctcaggtcaagaaggtctaaaaacatttggaccgtgtcgtgccagaccaaagagtagaaacggtggcctagcccgaccctaaagcacgttgggccttcatcgagccgtgacgacccaatcccgattcacataattgaaccacataaattttagatattacaacacatagtacataggttactaaattaaagaaattaaacactgcatgcttcattgggtcaagccaggcttaagcccggtccatgagtgcgagccatgcggtggcacggcatgtcggaaattaaagcccaaccaacctgcctttgggtcgtgctagcccgacctatagaacttttgtgctgtgtcgtgctttgggctcctgattttgggccgcgctcgttctagcccatgttcccataactagaccgatacaatggtgaagagtaagctaggggcttgagacacgacaaaacgtggaggtggtggagtatgagtggatagattgatgcggatggaccaaggtaagggtgacgagcaagtgacgctaagatcaataaagtctattttatggtttgagtgatccacatcaacttatgagaatttggatgtgtgcttatgacaaagctatgaacataaggtgtttcattttatcggctagatagtccaatttagaatatatggttgtagtaataagaggggcaaccatgaattgcatcacgcttatctagtgccacttgtgagttctaacattgcgttacgcttggtggtgagtggcggaaaagctaaggcctttgtgatttttgctaaaaggtagctgacggtgagttaaattatcgtcttgtgggaggtcatcacttagtgttggatgtgttttggaaaaggttttgtgtatgttgatactaactttggaaacccttcgttttggtttacactagtggaccaaagtggagaaggtattgcgttaggcatgtagccttttggggtagcagtgaatagattgacaaagtcaccatagatatcatcactcactcctatgaacatatgtgcatacaacataccatatgagcacctttgaaagattagatcgataaattccaagagattgacgaagttacacttactatgtcaacctaccaatataagcacctccaaaatattagcctaacatgtatcaaaatattaatgaaactattacatccatttgctattgatagtcacatcattctttagttccggtactacattgataaaaaaatggttacgcgtacgtgacatgccaaagagttaaattatactccccccgtcccaaattaaaaattcattttagataattaatagattcatagaacacttgatgtatgtgtttttatatgtgtctagattcatcatcctccatttgaacataaatataaaaagtaagagacagaacgaatactattttagaacatatggagtaatgaatatattcgaacaagaaaaacaaatgagttgagctatgtgcaattggcatgtatctattatatgcaacaatctaaaatgacatttgtatctatattaagaaatttgcgtagaaattataacacaacaattgcaagaaattatatatatttgtagccacaagaaaataaaattggatatctactctattagccgcagaaggttaaggtggtatctacatcttttcataaatacaggcacaataactagatagataatatagtatcacaagaagaaaaaataaattatatatgtaactatattattattatatctattacacgaaagggcatacaattatttatatatattgagaaacatagacacactaattgagcatatctaatagtataacacaatagactacaaaaaagagggcttatcaaatagttcttgtattaagaaacaaaggaaggaaaataaaaggacacgtatagcataaacaataggcacgagaaattggaacgatatctatagctataaataaataagtatcaaatgtcttttaccggcagctgcgtgtttttttttaagattttaacatctcggactgtagcgagctagtgcgaaacgcaaagcaacaaatctcacaccgtcacacgatcacgtccttgcccctctgagtccttgtccatgtccgttgccaacaattcaccctcatgacctctatggccccacacgtacgaccactagtagtactaggcgtacggagtacctctatttcacgatggcatccatccacaattgcagtaatccctctctccgtccctcccaatgttactccatctctctatttttaaagccggttccactcctcctccctcgctcactctcagtttccgctgtcaccccctctccctctgttcgccactttataccgcccgcccaccactccccgtttctctctgcttcatccttcgctttcccctgcgccaggcccgccccgccccgcccctccagaacgacatcctgcttccccgccccctccgatggggaacccgccggagctgtaccacaagatcctcaacatccccaaggacacctcgccgcacgaaatccgcgccgcgtacaagaacctcgtcaagaagtggcaccccgacaagcacccgccgtcgtccaggccggaggccgaggcgcgcttcaaggccatcagcgaggcctacgaggtgagcgacgagacggcgtcacccaccctgccgtgccgtgccgtgcgcgcgtccctgattaattgtgcattgcgtctcggcgtcctgccgtgtcctcacgactccgtcccttccctcgcgcaggcgctcctggaccagcaggagaacaggggcgtgttcgagctgtgcaacgacggccgggcgggtgagaggacgcgcggcgccttcggcggcgccggcggcggcggtggcggaggcctcggcgccggcgtcggggcgcgcatggagaggacgcgcagcgacgggttctgcacgaggagcgcgcccggcacaccggcgagggagttcaagaaggtgtacagctccggcgaccccggcgggcgccgcgccttcgccgagttctccagctccatcgtgcgcaaggcgccgccgctggagcgcaagctcgagtgcaccctcgaggagctctgccgcggctgcaagaaggaggtcagcttcacccgcgacgtcgtcaccaagaacgggtatctgctcatctgcgctgttttgctctgcctaactgaacaaggttgacgcgaaaccttgctagaaatgaagaaatccggtgagctatcgcttgtcggtagattattattatttttgtttccaagacaacgaacggagcggagaattttaatcgaggaagggctttgtgtgccgacgtgggttcagattttaacagtgaatcaatcgatgcttggaaaactaaactcgaggttaggcaagaattcagaaccggctctgatggcgacagacattccactcggtgtagtggttgtggcacccccccccccccccccaattcgccgcactgttcggtagctcctgatgaacagtgcaccatcacaatcagtttctgttttttttcttcttcttttcaacaacaaggtcatggcgcgagcacttgtgttgtgtttttacagtggggggggtggggggggggggggggtcgggtcactgcttttgtaccaccaccttgcatttgccagtggaatatttagctacctttgcaacgtcatagtaggccgtagacgtgaagcctttttacaccagtgggctttggtgcgagactccttttcccccccctgcaggtatctatgctattcttgcaagattatcctacctaacacaaggtcacgataacaatgtttcccaacgtggttagtatagtacagctagcttgggatcctatctccactacataatcctaacacaaggcccaagatgcttctttcgccacatatgcgttttagtacacgcgttttggatgtattcatatttgtttccttttttttacacgtgagggtgacagtgactcctgagcaagagcatccctcccttcctccttgttcctatggagggagactaatcgcaactagcctaatggctcgaagtacgtgctttttgtttgtgcaggtcaaccgtgaagaaggaggtgacacagacggtggtggtgaagccagggtggaggaaagggaagcaggtggtgctggaaggcatgggggacgagcggccggggtgcctgcccggcgacgccatcctcacggtgtccgagaagaggcacccggcgttcaagcgggtgggcgacgacctggtgctcaaggcggaggtgccgctggtgggcgcgctcaccggctggtccttctcgttccgcctcctcggcggcaggaaggtgagctgctcgttccaggacgaggtcgtccgccccggctacgagaaggtgatcgccggcgagggcatgccggtccccgggcagaagggcgcgcgcggcgacctgagggtcaagttggacgtcgtcttccccaaggagctcacccccgagcagcgcgccggcctcgccgagatcctcagagggtcctgctgatccatcggccccagttccaagcgtatcaagttttcttggccgtgtccgtgtgttaaattttaatatgtatactcatagcgcgtgtgatgagtatataagtacataaagagagaggggagggggcgtcgttgtacatacaggtcgtttatatattatatatgtaaggataaaaagaaatatgaaacgtgagccaaagccaagccttgtgtagctgtatcgcggcatgagctcgtggcatgagctggacgtgtttgttctgatggcaaatcagatcttctcgccccgcgcttttgtttctctgtcccgtcagacctgccgtctggtgtgtctggtctggttagccatctcgaaaaatgcgcttgcctttaccaaatccaaatgccaccttcacctgctggctggcagcagcttggcaggaagctggtgcagtgcagatgcgaggttgtccgatggatcacctgcctgcagatccagatgttttcgcctagtgtgcatgacggacctttgcctaatcccttccttggccgacgccgctttgtgtgttttccttttgtgctaatcacaggttctgcttttggtacctcaagtggttcagcaggaggaggattacccgcgcgagtcgaggtccatcgcagcagcacagcacctaccaccgctgcctgcgtctgcgtgcgctgatgggccatgcgtggcctcctgggccagcgggccaggcctgccgaaaccggattacctggaccacgccacgcacaaacgacctggagcccgcccgcgtactcgagtgcaaagtgcgggaattgaatgcaatgatctctcagttgttggatccgcgaagcggaggagctggaagtagttggtgttcgggcccccgctgttcgttgatgaggaagcacaaccaaaatcgaccctgttgcgctggtggttggttccatgccaattggtggcatttggtactaggctgcaaagcaacttggtgcgagtgggctctgctgcctcggcctgcctgcagcaccaacgccatacgggcgaccagattatcatgtgcaacagcaggtccgtccatccagcaaattcagcaggaagtacgtttgtaactgcattgcactgatggataacgtgtgattaactaattaattagtccgaacaagttacagactcatgtcctgtgtgtgtccgtccacgcctcgaggtccaaaaacaaaaaataaaataaaaatacaagtcagtagtgcatgaccgccgccgacatgttgagcagcggcgccagcgcgtcgggcgagaacttccgcgcgaacaggtagcaggtggacgtcagtcgcgagttgtacgcgcagggctccgcgctggtccggatgctccggaccagctccggcgtggcgtcccccgcgccgtacgtcaccgggtgggaggtccccgcgggccactccacgcgcgtgacggtgcggttcgagttgcgcgcgccgtgccgcaggctcacgtacgtctgcacgtagtgctcgtcggggtagcacgacggcgtgcagtgccgccggaacagcgggtagtacctggtgtccgccagcacgctcgcggcgaggtcgcggctgagctccagccactgggaccccttccgccactcccgcagcgtgatgtccggcgccatgcgccggctgtaccggctccggcaccccctgtcgtcccggtagtaggcctccacgaagctgtggcgcgaccccacgaggtagtcgtacaccgtcgtgaagttgtgcaccggtatgcagctctcggagaggaggacgaaccgctcgttcgagaagtccagcagcgcgttcgctagaagccgcctctcggcgtccaccagcgtcacggagccccacgacgttttctgaaaattaaacagccggcaggactcccgtacccctgatcagacgtacgaagcgagagtcctcggacacgttgacagagcaagtagtactcatcatgcatgcagcatatgtgcgacgacaatcactaacctggctggggatctgcctgccgtagaacggcgagtccgcggacacgttgatcgccaccccgggcggcgcgtggacgtagacggagaagcgctcctcgtgcccagcgccgcggaagaagcgctcccagagcggcgccagcggcaggacgccgcggccggccaggaacatgaaggccaccttgggcacgcgctcgaacgggtacctggcggcggccgccggcaccagcgtggcgcgccagaacagctccctgtccgtcatgtcgtgcatgaggcgcgtcggggccacgaactcttcgaagtcggggttgggctcgggccggcagcagatgccgccgccgccgccatggaacccggtgctcctcgggtcgacgctttcctgctgggaccggcggaccccggcagacacccacaggccggcgacgacgccgagcgcgaagatcacgaggaccgccaccaccttggcgaggccggtgatgggctcgttcctcgtgagcatcactttcaaatcgtcgagcgcgcccttcatgcccttgtcgtggacgaacgcaacaagcgcgtacgtctgtccgtagttgtacgacgacgagttgaagttgctaaacggcaaacacggctgcaactgcatgcagctgggcctgggcggtgacatggccgcgatgcatggcttgcagagatcggccaacgcgtacgataccaggatgaacgagcactgcagtccagcctacagtttctgattctccgacttcacgaggaaggcatggacaaactgcaaagtcgaggcatattcagttatgatcaggtccagggaacgtaggaatataggaataaaacaagccgggaagaaagagatcgaaggagagatcgaggaaaaggagacgaatccagcgcatgtctgagcccagaaacacgctgtaaaagttctaccaaaacatggatgcaacggcgatggattttatgataggcgtgaaagatatgaggttgatagatagcgtttcttgccttcttgggaacatcgacctcgatcaggtgtgtgtaccgaagctgtccgacaactcagagatggaagttaatctctacgaccggcgtggccagatgggattgtgaatttcgaagatttgtagtcgcaatccacaaaccaaaagaactttcgtcattagctagcgtattctcaaaaataaaggagtccataccacacactgcatgttctagattccaaacactttcatccatccaattttaagatttatggcttaggcagttaggctagatataatcttgcgacataagttcaagtgatatggtcggtttgtagtgtctcttctatttagcatgtttggattctccggtctaaagttcagttggctatagttggagatttaaaattttaaaccacctagctctcctgtgtggtctaaagtttgaaaggctatatggttattggcatgttttgcacatttgctacttgatgaaaaagaagcttatctcagaagatagtgaaaaacaacttctgcttgttggctgtctttaattcattctataaagctgctgaactgataagttgctgcagaaattgtctatttggtataacttctgcttaaatatgtgaagaagctgaaaataagttgtatctagtatctatctagttgacatatttggattctctggtctaaaatttagttgcctaaagtcgatttaaaatttagactactttagctcacttgtgtggtctagtttttttgagggtttagctaactttaaacaatactttagatctactgtttggagccacaaaagctgaaataatctaaagcttataccatgggatccaaaatataatcttaaaaatataga

SEQ ID NO: 8190 - DNA, 1631 bp, Zea mays
ctcagtttccgctgtcaccccctctccctctgttcgccactttataccgcccgcccaccactccccgtttctctctgcttcatccttcgctttcccctgcgccaggcccgccccgccccgcccctccagaacgacatcctgcttccccgccccctccgatggggaacccgccggagctgtaccacaagatcctcaacatccccaaggacacctcgccgcacgaaatccgcgccgcgtacaagaacctcgtcaagaagtggcaccccgacaagcacccgccgtcgtccaggccggaggccgaggcgcgcttcaaggccatcagcgaggcctacgaggcgctcctggaccagcaggagaacaggggcgtgttcgagctgtgcaacgacggccgggcgggtgagaggacgcgcggcgccttcggcggcgccggcggcggcggtggcggaggcctcggcgccggcgtcggggcgcgcatggagaggacgcgcagcgacgggttctgcacgaggagcgcgcccggcacaccggcgagggagttcaagaaggtgtacagctccggcgaccccggcgggcgccgcgccttcgccgagttctccagctccatcgtgcgcaaggcgccgccgctggagcgcaagctcgagtgcaccctcgaggagctctgccgcggctgcaagaaggaggtcagcttcacccgcgacgtcgtcaccaagaacgggtcaaccgtgaagaaggaggtgacacagacggtggtggtgaagccagggtggaggaaagggaagcaggtggtgctggaaggcatgggggacgagcgggcggggtgcctgcccggcgacgccatcctcacggtgtccgagaagaggcacccggcgttcaagcgggtgggcgacgacctggtgctcaaggcggaggtgccgctggtgggcgcgctcacgggctggtccttctcgttccgcctcctcggcggcaggaaggtgagctgctcgttccaggacgaggtcgtccgccccggctacgagaaggtgatcgccggcgagggcatgccggtccccgggcagaagggcgcgcgcggcgacctgagggtcaagttggacgtcgtcttccccaaggagctcacccccgagcagcgcgccggcctcgccgagatcctcagagggtcctgctgatccatcggccccagttccaagcgtatcaagttttcttggccgtgtccgtgtgttaaattttaatatgtatactcatagcgcgtgtgatgagtatataagtacataaagagagaggggagggggcgtcgttgtacatacaggtcgtttatatattatatatgtaaggataaaaagaaatatgaaacgtgagccaaagccaagccttgtgtagctgtatcgcggcatgagctcgtggcatgagctggacgtgtttgttctgatggcaaatcagatcttctcgccccgcgcttttgtttctctgtcccgtcagacctgccgtctggtgtgtctggtctggttagccatctcgaaaaatgcgcttgcctttaccaaatccaaatgccaccttcacctgctggctggcagcagcttggcaggaagctggtgcagtgcagatgcgaggttgtccgatggatcacctgcctgcag

SEQ ID NO: 8191 - DNA, 830 bp, Zea mays
gggacccgccccgcccggccgggccggggccaaaccaaaagcagaggggaaagtgccgtcggctctgactcttgggcacttggctgacgacccgttctctctctgcaactgcaactgcaacgcaccaagaaactgccggcgatcgatcggggaaggagataaacatggtgcacgggaagctggaggtcctcctcgtctccgccaagggactcgaggacaccgatttcctcaataacatggaccccttcgtgatccttacctgccgcacccaagagcagaaaagcagcgtcgcaaatggagcaggaagcgagcccgagtggaacgagaccttcgtcttcaccgtctccgacgacaccccgcagctccacctcaagatcatggacagcgatctcaccaacgacgatttcgtcggcgaagcaaccatccccctggaggccgtgtttcaggaaggcagccttcccccggcggttcacccggtcgtcaaggaggagaagtactgcggagaggtcaagctcgcgctcaccttcactccagcagcggaaactcgccaccgccctgatgacaacgaggaggggccgccttacagcagctggagttgatctatctcgccatgggatgcatgcatcatatatatccaccaagagaagagaggataattaattaatctactcaagagaagaatcagtgttgctgttatgcgaccctctatctatctatatatatgtgcttaatttgtcatgaacgactgccaatataaactaaactattcagagttgtttgcacaaaaaaaaaaaaaaaggcccctagggccctcgagcctcagcttttgt

SEQ ID NO: 8192 - DNA, 838 bp, Zea mays
cgggaaaaaaaaaaaacctgccgacacattgggtacctcggggccggcgggggccaaaaccaaaagcagaggggaaagtgccgtcggccctgactcttgggcacttggctgacgacccgttctctctctctctctgcaactgcaactgcaacgcaccaagaaactgccggcgatcgatcggggaaggagatgaacatggtgcacggcaagctggaggtcctcctcgtctccgccaagggactcgaggacaccgatttcctcaataacatggaccccttcgtgatccttacctgccgcacccaagagcagaaaagcagcgtcgcaaatggagcaggaagcgagcccgaatggaacgagaccttcgtcttcaccgtctccgacgacaccccgcagctgcacctcaagatcatggacagcgacctcaccaacgacgatttcgtcggcgaagcaaccatccccctggaggccgtgtttcaggaaggcagccttcccccggcggttcacccggtcgtcaaggaggagaagtactgcggagaggtcaagctcgcgctcaccttcactccagcagcggaaactcgccgccctgatgacaacgaggaggggccgccttacagcagctggagttgatctatctgccatgggatgcatgcatcatatatatccaccaagagaagagaggataattaattaatctactcaagagaagaatcagtgttgctgttatgcgaccctctatctatctatatatgtgtgcttaatttgtcatgaacgactgccaatataaactaaactattcagagttgtttgcaaaaaaaaaaaaaagaaaagagcggcccgg

SEQ ID NO: 8193 - DNA, 841 bp, Zea mays
cattgggtccctccaggcccgcgcccggggccaaaaccaaaagcagaggggaaagtgccgtcagctctgactctcgggcacttggctgacgacccgttctctctttgcaactgcaactgcaacgcaccaagaaactgccggcgatcgatcggggcaaggagataaacatggtgcacgggaagctggaggtcctcctcgtctccgccaagggactcgaggacaccgatttcctcaataacatggaccccttcgtgatccttacctgccgcacccaagagcagaaaagcagcgtcgcaaatggagcaggaagcgagcccgaatggaacgagaccttcgtcttcaccgtctccgacgacaccccgcagctgcacctcaagatcatggacagcgacctcaccaacgacgatttcgtcggcgaagcaaccatccccctggaggccgtgtttcaggaaggcagccttcccccggcggttcacccggtcgtcaaggaggagaagtactgcggagaggtcaagctcgcgctcaccttcactccagcagcggaaactcgccgccctgatgacaacgaggaggggccgccttacagcagctggagttgatctatctgccatgggatgcatgcatcatatatatccaccaagagaagagaggataattaattaatctactcaagagaagaatcagtgttgctgttatgcgaccctctatctatctatatatatgtgcttaatttgtcatgaacgactgccaatataaaataaactattcagagttgtttgcacgaaaaaaaaaaaaaaaaaagaggccctagggcccacctcgagagggggccgcgggtacc

SEQ ID NO: 8194 - DNA, 7373 bp, Zea mays
  misc_feature (775)..(775): n is a, c, g, or t
  misc_feature (5005)..(5005): n is a, c, g, or t
  misc_feature (5010)..(5010): n is a, c, g, or t
accttatacaaatatcaagatatgtgcaaaattaccttaccctactgttttttctagtaggaaaagaagcacatatgccatttgtctcatgcattatcaagtgacgatatatccttaatgcccctatgtcctaatacaaatatggagccaaatgatgaatcggcaccaaattatcaaaataccttatgatctgctgaaaaactatggaattcacatctttgacttcaatgacttgtatactttgacattgattttggatttctatggcaaaatactttatgatcagctggcaagctaaggaattcacatccctgatttgtatacttgacattgattttggatttacatggcaacataatttctccatctcttatgtcataaatgactgactaatgttgcaaagaatggattttaattgttaccgttttcacatgaaaattccctgttgcattgtgggtacttttgaagaagcctcacacattgaagaatcctttgttccacacagttatagagaaaaaattggtacgccatataggaaaggcacatggcagaattttcaccttagtcatatcttgtatctttgatctgctcttcatatttacatttatatccatggttgaagttcatttttaagtgtacgaggatgaaataatgaccactggccagtgtttgtctgaaatgaattcccaatctttctagttcactgggtggtgctatatctgatgaaacagtctggaaggatgatgattggttagccaagccaaaggttacttgnatgcgtgccttttctgatctgcaacattcacaatctgtactgtgtactccatgcccactagtatttaactacatgaaatcaccggcatttgtcatcatttatctggatgacctttgttctatagagacctgtgagaaccacataatgccatagaggtaatgtcgttccagagtttagccagagtttttagcaacagcaaaacccaaaacccatatgtaggatatttagaaacacggatggggaaatcaacatatattttattaatcatctacttccatgtgatgtagaagttcccttgcagttcctctctctctctctctcagaccaagagtcaaataagagcttacaacaaattaatggttgcaatgaagtttaacagttcagttatgaaggcctgaagattactgttgattgaagcaacactgttacttgacagcttcttctgttgcttgtgtttgcgctccattaaaatttggcattctttgacttgcctatatatttctttaattcaagtaaaagtagactatatgccccctcgttgaacagataagatgactgcatatcgttttattaagaagaaaggtctgaaacaggaagaaatcccaaaccacattcacacccacaacactctagaagactagaacatactttttctctctcgaaaacacaggagagctgcgcttcattatttaagaagcagcaaacaaggtcccaaaatgggccagcacaaagggtggcactttacagtagccagcacctgacatagacaaacttatccataaaaacacgtcacagcactcaaacacctaaatccggcccgtggcccggctaactcagtagccccagcaagggccaattcctggcatcctctccgatatctcgcagcacctgggacacatccgccacgccttcttcgaagatagtaattgcgatgtttccacaaccaccaagccactaaaatcaccacagaattgaactcatttccctgcggtttggggactcttctctctgcttgattccaccaatcctgaaaattgacctccctgggcattgggctaaggtgctgtaagttgattagagaaagaacttgaaaccagacctgtctaccaaacgcacaggccaccaacaaatgctgaactgtttcctctttctgatcacataacaggcaaagttcaagatgctcaagtcctcttctagcaagccagtccacagtccagcacctattgaggctcgcaagccaaatgaaaaacttacatttcggagggccccaggttttccaaacccttttagccggtttaaaggctactgaccctacgaagaacctttcatatgctgacttggaagagtagcacccggaagcagaaggggtccaaagatgcacgtcttgtacacccggagccaaattgaactcatttaggatgacctagagctgtagaaattccatctacgtttgagcattactgcacctcttatatgtctgacaccaacaaccattggtcatagtgtcctgtactgtttgtatctgctgaaccttactggggatgagcttgataagagagggtgccaagaccgacaaggattgccctcggtagccacctgccataccaaaacgtgctgctagcaccatctcccaccgcagttacaagcgaagcagtgaacatagcaagaccagaacatactgaaaagagagaccaaaagcaacatgaccaaaactaccacactattgcctgtgcccctcctaaaggtctcccaataagcttcaggaggccctttgctctagctgagtaccaaaggatgcactcataagttacagcttgcaacaccgttgtaaggcttggagtagagccgttaaaaacacagttgtcctgtcccaagccaccaatattgccagtgaattgaaccccttctgtagtccattgttacctctttaactgcctggtaggctggtaccactagcttgagaatctatgggttgatggttgggctgcaatggagacaaaagcaattttctgcaacctgcaaaatggtgaactagattttccaggcgaaaacacatgaaatccccccgggctgtggctcactagtccccccccccccccccccaagcagctgggtgggaagtcctcttttagtgatccggtccgcatttcaagaacggttctttactgcaagccaaatggagagcttgcagcaaagaggagcccaggacttccaaattcgtttccatggagcaaagcggatggaactaaggaaaaaggtattgtaggccgactttgctagagtaagaatcgttcctagtaagcctccaaacaagctgatcagcatcattctgcttcagcgagaaaccttccatcaagtctcataagcggagatattatgtaagaacctggacagagagctcctcttatgtcagctacccaacgatgggggtacatcacttgatgatcctcttgaattccctagttgatcatttttcagtttattgccaaatctagctgtgttcttgtggctgtgaaattatatctcccatgctgatacttgattcccttatctttgcttcattactacaccacagtaatttggatctgccattatgttactatgtaactctcatttgatatcaatcacagctgccacatacaaaatacaagtatgtttatctagataagatcttgattcatcaatcaccactgatctgagttttcgccactgcgatgcgaggaaaagacagatatctaataacatcttggtgaagatgttcttaggtcctttgctttctcttcaagtcagcttcctttgatttcattcctcaaactatcaatcacaggctgcagcacgtgtaatccgcatcggttcaagaacagatttcatgcttgggggatatttttgcatcctgcgataaattgggctgataaagagtctcatctggatcctgatgaaatggccaaggtaatgtagaaaaaaggaaacatttttgcctcgatacaatttacaaatatagtcatcttctgttagaacttttgatcgtgatgtctgttgtgtacactcagatgaagtctgcttttattggtaacctgccagaagatgttaatgaggagtacttgagaaagctttttggacagttcggtgaggttggtgcaccaagatttttgtcacatttttttgcaatttctactaaccaatattacatgcaatgttgagcaactatgacaaatgtgcaaacaggtagtacgggttgctatctcaagaaaaggacaatgtccagttgcttttgttcacttcgccaaacgttcagtaagtgtttatcctgaagagtatgtttttttgcacttaatttgcttggatattctttaaacagctgttttgcattgattgctgtaaaaaactatatgttatcaattacaggagcttgagaatgctatagaagaaatggatggtaaaacggtgagaggacctggtcgagggccgtctttcaagatccaggcatgaataagaactttatctgcttgggattctcactagcttcttgctctgcttatttgatctttctattttggatttgacaaattaatctcatgtttttttcccaataggtgtcagttgctcgacctacggcagacaacgacaagaagcgatctcgtgaagaagtgagaactagaagatcaaatgcatcaggagataggcgagattattctcatggaagatatggacacgattcacttgatcgtcaagtgaaagctccaagattatctaattatgtatgtatgataatcaacatggtgttaattattttggtttctttatttttcttccttctaatgtaaaaaactaacaagtgagttttgagtaaaggtgaacttcctataattcaatctgaaatgacttgatctactaagccttgaaatcttcaacttagctagccagtgactcagtagagctttggttcacttgttatacgtcaccttcattttgtggatgctatatttgttttgaaagtgaactgcacatcaatctgctacctctaggtggtcttatgatctatttgtatgataatggatttagctttgtgtctgtaaatgcctattatatttgtcttctctgtacaaatataacatgtagacatcagattctgtactgctcaactctgactttgaaggctagaagtgcaattattttactggaagctctcatgtgggtaggttaaataggctagaagcacaactatttccngtttntgtagcttggcttcttgcttatttatgttatgattgcaaaaaccgagcattagatattccagcattgaccagccgaattagcagttttctactatttgaatatatgtttttttgtaagtatgcttagttgaatggaataatttttatattgcagcaaagagaaaggatggtgtgttttttcatgtttgtgacaatgttttctgcgtgtttctctcttattaggtggccgatgctgctgacccctatgaatcagctgttaattcattaccttcagctgtcaaggaagtcttgcttcgaattctacgtctaagaattggtactcgatatgatgtaagtgatttgtacaggaatgtttccatttgttcccttttaacgtatgaaccatgaagcatggtgttcttttccatcttcctttctccagattgatatccattgtgttaaaagccttgatgagcttcctgagtcatctgctcttgctgtccttaatcaggtatccagttgttttacataaatgatttctgagcccttacctgaactatgttatcattagtcctcaccaagaagcacatgtagtttttgatatcaggtggagacaaacacaacaaaggagattattttgcatcgttggttgctaaaggtactaccccactcaatatctttccacctttcctttttactcttttctcctttcctttccttgagtttcttgttttgacctgcagcaccaggctgagacctttggcttaacacatgcattacacggtaccacttatttgtcaagaaatccggaaatgcatagcaagcgatacccacatgaagattatgattttgtgacacccaggtaggcttgcactcactcccctgttctggctggcttactgtaaatggtgcatgtggtatgcaagctcgtatggtaatctacactttacttgcaggagcagtaggtacgattcgtcagcccatcatccttcaacatactacgaagacgatccaccagtgtctgagtcaagggttagaagatatgctgaagaaaggtccaccattgtaagaagcccagaaccacgtccgcgatatgacgaaacagacataagaataaacccagaaccaagattaccatatgaatcaagacacaacgccgaaaagcatctcgatcgaagatacatacaagagcatagttcaaatattgaaagaccagctgaagaagctctcctttctagggaaaggagatttctgcctgctgcagggtacatgccgaacccaggcggctcggatttccgctccaggtcgcccgccgaatattcagcacaacgccaacaaatgaggtttgatccattcacaggtgaaccttacaagtttgatcccttcacaggggagcccatcaggccagatccgaaccagcgccgctcaggaagcctgtactgatcagattagttggagcgatatgccagataagaccctgaaacaaagctagatctggataactcttcttcttgtctgccaagtgtctctgtgattttgcttgtgggctacagatcatgtaccccgagcaccatgtgtgatccagtcggactaatcatttcggcattgaaaagtcggactaactttttttgtgcccataacgctacgtattgtttggtagattaattaaaaattcatccggtgaaaagcaaaaaaaaaaaaaaaaaaaaaaaaaaaagaaggcgtggtaatgcagaatttcaactgctacgtacactgcaagcgctgttttacccgattcgtctttacgtgttgccaaatgtttcattgacttcatagaactgatttcgactactttggatgctgagcaagggaccatgcctttctcacatatactcatctggagaatgtcaagcaagacggcccatctggacacatggcaagaagagataaactagctagctgcctcccaatgatgctactaccttctcttcgactgcttcaacgttcacatgcccctcccttgcatggcgtagtaaactgggttgcttgaaaaaacgccacttctaagcgtatcaacgaaatttcttgcaaattaaccaaccgttgcaagcgcctgcaggaatttcgagaggaatcctcaacctccgcgacctttgcgtgctaaagttattatagtccgttcaccttaaattaaatcatgtcatttcagcattgtcccaagtcaagcttctctagtcttaatcgagtttaaatgcatcggtatctactacaatatcaattctgtttagttaaatcctcatgaaacatgactagacggtgcatccatgcaattgaattgaagtcgcgggaagtataaaagcccggtcaaggggtagagaaatttgacttacacacacacacac

SEQ ID NO: 8195 - DNA, 2410 bp, Zea mays
  misc_feature (2203)..(2205): n is a, c, g, or t
  misc_feature (2207)..(2207): n is a, c, g, or t
  misc_feature (2209)..(2209): n is a, c, g, or t
  misc_feature (2281)..(2281): n is a, c, g, or t
cgtttcgcccttattttcgggggtaaatttttggggtatttggggcgggaaccatttcccaccgggaaaaaattttgccccaggattcccccaactggaattaaccccccctaaagggaaccaaaaacggggtccccccccggggggggcccccttaaaaataagggggacgcccacgcgtccgcccccccccccccccccccctgccgcggtcggccacggaaagcacgctccgagagatattttcttcatgcggagagattattgacgcgcgcataatgaaagatcagagtggtcactcaaagggatatggttttgtgcggtttgcaaagagggattatgctaatactgccaaaaggcaaaagaatggtattgaggttcaaggaaagaggcttgtggttgagctttcaatggatcaagatacagttttctttggaaatctttgcaaagagtggactttagaagaatttgaagaattgattcacaaggcattcaaagatgttgtttcggttgaccttgcaatggcgtcaaatcttggttcttcaaacaagaagaatatcaatcgaggctttggatttgtgagattttcttctcatgcagctgcagcacgtgtaatccgcatcggttcaagaacagatttcatgcttggtgatattttgcatcctgcgataaattgggctgataaagagtctcatctggatcctgatgaaatggccaagatgaagtctgcttttattggtaacctgccagaagatgttaatgaggagtacttgagaaagctttttggacagttcggtgaggtagtacgggttgctatctcaagaaaaggacaatgtccagttgcttttgttcacttcgccaaacgttcagagcttgagaatgctatagaagaaatggatggtaaaacggtgagaggacctggccgagggccgtctttcaagatccaggtgtcagttgctcgacctacggcagacaacgacaagaagcgatctcgtgaagaagtgagaactagaagatcaaatgcatcaggagataggcgagattattctcatggaagatatggacacgattcacttgatcgtcaagtgaaagctccaagattatctaattatgtggccgatgctgctgacccctatgaatcagctgttaattcattaccttcagctgtcaaggaagtcttgcttcgaattctacgtctaagaattggtactcgatatgatattgatatccattgtgtaaaaagccttgatgagcttcctgagtcatctgctcttgctgtccttaatcagtttttgatatcaggtggagacaaacacaacaaaggagattattttgcatcgtgggttgctaagcacaaggctgagacctttggcttaacacatgcattacacggtaccacttatttgtcaagaaatccggaaatgcatagcaagcgatacccacatgaagattatgattttgtgacacccaggagcagtaggtacgattcgtcagcccatcatccttcaacatactacgaagacgatccaccagtgtctcagtcaagggttagaagatatgctgaagaaaggtccaccattgtaagaagcccagaaccacgtccgcgatatgacgaagcagacataagaataaacccagaaccaagattaccgtatgaatcaagacacaacgccgaaaagcatctcgatcgaagatacatacaagagcatagttcaaatattgaaagaccagctgaagaagctctcctttctagggaaaggagatttctgcctgctgcagggtacatgccgaacccaggcggctcggatttccgctccaggtcgcccgccgaatattcagcacaacgccaacaaatgaggtttgatcaattcacaggtgaaccttacaagtttgatcccttcacaggggagcccatcaggccagatccgaaccagcgccgctcaggaagcctgtactgatcagattagttggagcgatatgccagataagaccctgaaacaaagctagatctggataactcttcttcttgtctgccaagtgtctctgtgattttgcttgtgggctacagagcaccatgtgtgatccagtcggactaatcatttcggcattgaaaagtcggactaactttttttgtgcccataacgctacgtattgtttggtaaaacattcaggagtaccccttttggtagattatttaaaaagnnncncncaacaacagatcgacgcgtcttgaaaaaaaaaaaaaaaaaaacggcaatctcgcatgtggggaaacgggttnttttttctcctcgggggggggggcccgggaccccattttccccttaaggggggccggatataaatatccggggggcggcggtttttaaaaccgcggggaggggggaacaccccggggggtaacccatgt

SEQ ID NO: 8196 - DNA, 831 bp, Zea mays
gggtacacctcgaggctcgtgccgggccggaaatgcatagcatgcgatacccacatgaagattatgattttgtgacacccaggagcagtaggtacgatctcgtcagcccatcatccttcaacatactacgaagacgatccaccagtgtctcagtcaagggttagaatgatatgctgaagaaaggtccaccattgtaagaagcccagaaccacgtccgcgatatgacgaagcagacataagaataaacccagaaccaagattaccgtatgaatcaagacacaacgccgaaaagcatctcgatcgaagatacatacaagagcatagttcaaatattgaaagaccagctgaagaagctctcctttctagggaaaggagatttctgcctgctgcagggtacatgccgaacccaggcggctcggatttccgctccaggtcgcccgccgaatattcagcacaacgccaacaaatgaggtttgatccattcacgggtgaaccttacaagtttgatcccttcacaggggagcccatcaggccagatccgaaccagcgccgctcaggaagcctgtactgatcagattagttggagcgatatgccagataagaccctgaaacaaagctagatctggataactcttcttcttgtctgccaagtgtctctgtgattttgcttgtgggctacagatcatgtaccccgagcaccatgtgtgatccagtcggactaatcatttcggcattgaaaagtcggactaactttttgtgtaacgctacgtattgtttggtaaaacattcaggagtacccttttggtagattaattaaaaattcatccggtg

SEQ ID NO: 8197 - DNA, 1352 bp, Zea mays
cgggccgcacagcgagtcatgattaggcgggaaaataccctaggctctcgccagtctccggtgcggctcaacaccgaccgaacccgtgaaaaattcgttctcctttcgatccgtttggcggggggctcggccggatccgaccggaggggcgccgccgatccatccggtcgcagccgcgtctgatttggtgcggattttggcgagataccccgctcctagctccgctgtttcaaggataacaaagatggcgtcgccgcggggcgggttcgatgagcaagatcgccggacggagaagggcaccgaggtgttcgtcggcgggctgccgcggtcggccacggaaagcacgctccgagagatattttcttcatgcggagagattattgacgcgcgcataatgaaagatcagagtggtcactcaaagggatatggttttgtgcggtttgcaaagagggattatgctaatactgccaaaaggcaaaagaatggtattgaggttcaaggaaagaggcttgtggttgagctttcaatggatcaagatacagttttctttggaaatctttgcaaagagtggactttagaagaatttgaagaattgattcacaaggcattcaaagatgttgtttcggttgaccttgcaatggcgtcaaatcttggttcttcaaacaagaagaatatcaatcgaggctttggatttgtgagattttcttctcatgcagctgcagcacgtgtaatccgcatcggttcaagaacagatttcatgcttggtgatattttgcatcctgcgataaattgggctgataaagagtctcatctggatcctgatgaaatggccaagatgaagtctgcttttattggtaacctgccagaagatgttaatgaggagtacttgagaaagcttttttgacagtttcggtgaaggaaaacgggtttgctatcttcaagaaaaggaccatggtccaggtggtttttggtcccttcccccaaacgttccagagcttggaaaattgttataaaaaaaaatgggatgggaaaaaccggtgaaaaggaaccctgccccaggaaccctcctttccaagaatccaaggggtcagtttgcctcaacccaaccggccaaaccaaccaccaaaaagcccatcttcttggaagaaaggggaaaacctacaaaattcccttgcccccccggaaataatggccacactttttttccccgggaaaaatatgggaaaaagatctccctttgatccccccacacggaaaaccccccaaaataaatcaaaactatagcggcccacatgcgtgcctacacccaataaatataaggtggttaaaattcaatatcaccttccggcggg

SEQ ID NO: 8198 - DNA, 3485 bp, Zea mays
  misc_feature (804)..(804): n is a, c, g, or t
ttgaacttcagctaaagtgtttcagaaacctgagttctcagtctaacgaggaaaccccttaggctctgttcgtgtttagggattggagcccccggatgatttctagccgggatactttctctaatttatatagattttgatgagctagaatgaatcctggttattccggtacaaccgaacggacccttaatcaactatatggttgagactacactgcaattgcatatacagaaagccaacctcgtggtcgtgaaatatcagaattcagtggatgatgggaatcacaaagcaataaatggaagatacatatacagagcattgtccaggttgtcgacatcaacaacaattctacacatctacatcatcaacatagacttttagttccaaacaagttagggtatgttagagttgaaacccaacaagatgtcaaaaaaaaagagagaaaggagatggaaaaatcttttgagagcactaaaaggaaaaaagacctaatcacggttcgggcacgtggatagcttctttacaagcacttctatccaagcataactccgttggtatattccattcctttaagtcccttttgattgcttgagttgagattgtgttgcaaccttgcaggtttcagcatctagttatacgcaaacatcagaaccgtgaagatcatgcagctaaactacaatttagctacaagtattgaacctgcaaacccactagtccgattccctaactacctaatcagtttgctacaacatagcaactgaacccttcaacagtgaaaatgattaggacttcctgataaccttnactgcttcattgccgcttctgatgtcactcattaaagcaatttgatgcaagagttgtgctatcctctgcacaaggaaaagcaagaatccaatgagtactggacatcaattacgacatcaatgcagttatgtgcttccttaatctggatattgctcggtggtagaccagtaacaggtaaagattattagtctgtgaagaataccgaatagtttgtcacaatcaccttaacccttaggatccagcacaacatttttaaaagttaaaaaaacaaacattagcaagaatccaccaaaactaaatatgatacatcagtacttaagtctgctaatcagtcagcactcatcaatatatatgtctggaatatgagaacaatggccacctcggggggaagtaagacagacccattgccagaggctcccacatgagtggggtctggccgtctgggaaaggatgaaccggggcaagcattcctcttcagacacagagagactgctttgaaacccagacttgtgactcagtgagacaactctcaccactacaccacatctgcccttctattgaccatcttaaaacaatttttggatagaatgtgatttaattgcaaatgaatttgaaggagaggagcttgattagattttgttcaagagctgctggagctagagttggaaaaagggaagaccgttaaatagacaagacaaagtccagtgcatttttgtttctccaacaaaggatcaagaggaattatttgaagctagtgacatactctggaagtgcaatatttctactgtttggcatttgcctccttgaacccggtattaacgagaatgtcaatatcggaatacatcaagaagaggactaataggccaagtatgaaattaagttgtcaccattcaatccccactgtcaacacatgccaactgatatattagcagcattgctaaggcgttgttttactcttgtttcacaaatccatgaagattctccctaagttttgaatttgatccagcattagaaaaccattatacaagcagtggctgcacatttcacaaaacatagtggccacagttcattgcagatgatgtcatttaccaaccaaacaccatctatatgatcagttcggcttcaattcaccacaaatccaatgatgcaagatcacgctaacagattctgaatttcacatcgatattgaacttcagataaatatcttgcttgatctatatatagcctaaatgaagtcaatcatatttctttggaatcgatcgcaataaccactagtttccatctaaccatactgtttgtcccaggggaacatccatgaaagaaactagctaactgaatacaaattcacataaacatcgctttggcatcacgaccaagattaagagggtacagagagatccaaaccttatccttctctttggagagaagcacgagcaggtcccgttccctcctatcccgccgacgggcgtacagaagtgtccccaccacagcagccgccaccgcaaccgaccacacggcgggcctcaccgccgggcacccacacgcgccatgcacgagcacccgctcctgaacgatcccgacaccggccgcccaagcgcgcctcgccgccaagctgcacctctcccatccccacagccactcatcgtcctccccctcgtattcaccatcctcctcgttctcctccttcgccactgctggcatcggcgggacctcctcgggctcgccgtccaggcccagcccctcatgcagccgcggcgggaagatggcgcagtcatcaagcccgccgtccacgtggtcaacagatggggcagtgggggtgacgacctcccagacatcggtgacgggggcgggcagcgaggaggaggacatggaggtgagggaggaggacgagagggagagagttagcgtcttgggcttcaggaaaaggtgcgggttcggggagggcaagaggagcgggtgtagcgcggagtacggcgaggccgtggtcgacgccgacgcggcggatgccggcggggactgcggcgccggcgacgggagtgctagcctcttgtggtcctggtccatggctgcgggcctcgccctgtggccccgggggctgctgttgttactttttcattggattttcggttttttctcggcagttaagggaacttatctcctgttcatggagcatatgtgttcgtatatcgctttaaatttggtgtgtccgtaattaatctaactagattggtattttttacacttatccctctcacctctactctgatgatatgggatgtaagtgaaaatttattagtcttattggattgtttataaaccccaaatttgcatagagtctatatgagcacaagatacgttattcttgtagtcttttttatgtgtaggctttggacacatactttcattttggtgtaaaacatttgcacttacccgcgttacaacatcttgaagagtatgtattagcgtttgaagaaggctaagtcctcagatgcaaacgtgtaaatgagatctattatatcataatctaaccatatgtaacatttagtatttaaatctttccaccgtcagctcatatagttttataaacaaacctaacaaatcatgattgcatctatagttggatcatgatctaatggatcagaaaattcgcttgcacctaaggactacttgcacaccagtcg

SEQ ID NO: 8199 - DNA, 868 bp, Zea mays
gagatgcccgggcgacaccgcggatcgctcgccagtcgccacgcggctccaccgtcgccaaacgtccccgaccgacggacgcggcgacgcacgttctcacacaccttccgccgcgggccttcttctcctttccgctcgcctcttctccacctgtctgtccgctctactgtatagaggaaggccgaaggccgtttccatttctcgaagccgcggcagcacgcgtcctgcttgcctcccggtcccggatcttgcccaccccgcaacgcgccgccacctccgccaagcaagggcagcttgatcatattcaagatggggaaggacaaagaagctgccaatctgaaggaggaggagacagagatcaaggccaagtttgttgagaaggaagaggccaaagactcgggtggtggcgcagggtctgtgggaggaaagagtaaagagggaaagaaagacagagagagaaaggaggaggagaagtcggtggagcatgaatatggcgaaggcgatgagaaggcgatcaagaagaaggataaaaaggagaaagacaagaaaaagaaggaagatgatggagattctgggaaggcagagaaagataaggaggataagaaggctaaagagaaggatggatcagagttgaagggttcaagtggtgagaaacaagagaaaatcaaagataagaaagagacaggagatggcaaagatgtgggggaggaagagaaacgcaagaagataggaaacaaagacaaagataagaaggataaaaaggccaaagaaaaggatgtatcggaaccaaagggtgacaaggatgaagatggtaagaagaaagaggccgatggcgatgaagacgaagaagataagaaggaggacaagg

SEQ ID NO: 8200 - DNA, 1387 bp, Zea mays
gcacgaggaagcgctcgtcgcaaaagctgtggcactgccgcactggcacagtggcacgcgattcctttccttccgcgtccgcgtccttctcggctgtctgtgcagttgtgctcgcttgctccccacgcccacgtcattccccgtccgctgcggctcacctccagcctcccggtcccgcgaccgctcgctatggccgacgcgtactggaggtacgcggccgccgccccgcgccagcagcagcagcagcagcagccgccgccctccgccggcgggggcgtcgcgcaccccggcatgggcggcggcgcaccgcagatggcccccgccggggggcagcagcagcccatgaagcggccccgccccaccgaattctcagatgtacccggtgcacctgacacggctggctattatccacgcgatgaagaaagggcagggtatcgtgctgctagagataccgagtctcttaacgcttcctacgaacgttttctacgtactgggcaaattcaatcctttggtggtggacatgctggagaacctattaggcctgctgtgggtggcaatgctgcctacccagttgatgatcgttcaatgatggctgctaggggtatggatagcagaaatattggtttcgttggtggaatgccagagccaccccttccacctgatgcctcaaacaccttatatatagaaggcgttccatctgactgtacacgtcgagaagtttcacacatcttccgaccatttgttggctttcgtgaggttagacttgtaaacaaagaaccgaaacatcctggtggtgaccctattgtcctttgttttgttgattttgcggaacctacacaatctgctattgcattggatgctttgcaaggctataagtttgacgagcatgatcgcaattcacccaatctgcggctgcagtttgctcgtttcgcaggtccaaaggggaattcaggacctggtggtcgtggtaggcgataagttattggcgttcctttttgccaggccagttccgtggtgaatacccatgtggatttgatattgcaccataggaataggattggtagttttggccttgtgcatccagcgttgcgacccttgtttcgctagatgttttttaggcagaatgcactagctggacataataggtccaaacatttgtagcatcgtgcattcgtgcaggcgtaaatcgtaatgtgttatattgctggagttgtttgtaatgtgctgttttgtatctctgaggcagtttggctgtcaaatccgtgggcttgacgaatatcaacaacctggctgctgttaccttttagaacttattcctgaagttgtttggtaaaaaaaaaaaaaaaaaaaagaaaatcgcgatctagaactagttaaaatttttttt

SEQ ID NO: 8201 - DNA, 3048 bp, Zea mays
  misc_feature (1136)..(1136): n is a, c, g, or t
ctgcaggaggtggtaatcactagaccttaatttctcctttctgtgaatgtaattccataaaagtgacattctctttgccttgtagaaagtgattttcttctcaaaagacatcaggactgggaagattcatttcagaatctttactacatgctccggaagaacatgttgaatatattctatggtaccttcttactcacagagctcatattgtttgcacaaaggatagtgtcacgttctttttgtaacaaaaagtcaaagaagtaggtcatcataatatatgcaaacacctataaccttgtctatggcaagcaataagcagttaactacatttcagttttctacatgctgatgagtggcatttgcacctgtacttctactaagtgttatttattgtgctttcactttattcaaaacatgaacgatagcacatagtgatacattttactcaaggtcatcttcatgtgtagttccattttgtgttccttatcagtttggaatttgttattctatatcgcattatttaatccggctcatgtcatctacaacagcggcctgacctttgctttgttgttatagtttatacaacacaatttgttgctctcttcattagtggaagctgtttggagaaaaagcagtctagtaatgcctacttatcacaatctacacgtggtctacgctcattactacggaaacatgtgagttcattctgatatatttgtcagtaatgtttccacagcattatttttttatgcttcacaccttacgtattccatggcacactgcacttgtttggtttggcttctttccgacgagcttttctgagaatctggatctctggagaagctggctatggggagaatcggctgtttctagaatctacgcatgtggaggaaatgcgaggaagccgaaggggcacgagagtgatttggccgacaagctgctcggcttctcgaggccgtggcccctcggccgatacccacgaaccgttgaaaacacgattctcggagaagcgcttcaaataaaatctgttccaaaatctgtgtttggggattagaagcaacttctggcagccagaagtcaaccccccccccccccccaataagctgaaacaaacgggtccatatattcttactaancaaccattaaggcactagtaaatgatactgatgtgtagactgtagatacatgttggccgtttttcaactgtcaactatatttgttggatgaagtcctttgcctaccgttgcctggtatgataatgggactgatacagtaatttcaaaataccagagacaattcaagcttatttaaccctttttttgtatctctataccacattaaaatcattttatctgaatggatcaccttgtaaccacatcagtttgcactgttgccagggcgtttgcttttctatgcctctttgcagcactgaagtggagcaggctactgaggacgaccttattgaactttcagaaatcgaaaggcgcaatgtcggacaggttttggtttcctccctgtttcgcctggtttgaatttagccactctgcagctaccaactggatgtaaaaacaaaagataactgaacctgcaggcactccatttggatgctttatctgacgtggataacaccacgcagtcgctgctttcgtttactggcaacgagaacgttcatggcctatacgacgttctattgaattacaagtacggcgcatctcattttgtcgtataagctcatccttgtttttgcctcgaaagttctgttgtataagctcatcctgtgattcttcaggtccttgctgaattcattatctgctgtggatgtcccagtcttgtattcaccccagccatttcaaaatggctgtctacacatcccagaggtatttttttcttcttctgtcaattctatatagttttatctcttttgtctgtctctgccttttttttgttactaggaaacttggtgacttggactcttttatttaggaagaaaggggaccatgttagtgcgacatgttagaaatgcaaactggtgcatgtggaagccctgattttgctaatgcataataattagatctgaagctgctacaccatcaccatgcttaaaatgttttgtttctgtattagtgcagtggaaaggaggttacattgaactgcgcaccatcctttagactgaattgcgtaattgcaaagtttggttttttttggtttaatataaaaaaaatctgatcctctgaacctactatgcatctctcaggtgaagtgtagggagatgaggagagcagacatgtcatccggcgggttcgacacagaacagggatccgcatttgcgtcgacggcaggcaacgtatgctacagcatggaagtaaaggacgcggttctgccgccatgggtggtctctgggctgtgcgccgccatgagcttggacgcgaccagctttgatctgacgatcgccacggagccgtcgtcgatgggcttgaacgtggctctcgactccatgggcaccaccaccacggatgtccagcctgaaggatccaccccctccagctgctctgcgcccacgacgcccttggtgggtgccgttcctgacgcggccctcgtccctgccctgcactccgcctcgctgcgccgcctcacctacacggacggcggcgggtacgttgcgcacacaaccgtgtgagcgcctctgagcttgagagcccggccctcctcggtatgcgcagcgcagcgcaggcttgttcttttcagaatttggagcctgccctggcctttgtcgtacaaggacgacgtgtcgttacacgcttggttgggttggatggtaactaaactatgaggccagccttcttctggtggtctggaaaaggaacacttgtgcttgaacccggtgtgtgctttttgcctggtcgtactgtcgttcaaaattgggaccgttcttaccctgccgtgacaccccctgttggtgtaagcccctgctgtttgaattctgaagactaccatcatcgttttgcggttgacaacggccgggttcttggttattttcgttcccaaccc

SEQ ID NO: 8202 - DNA, 2173 bp, Zea mays
gtcgccggcggcagcgcgcagtcttccctccgcccctccagctcctccaagctcctcagccccggccgcggtagtgccagcgcaagcggagctgagacagtgccggccccccctctgcacccctcactcagccgccgcctccgcaacagcggcagcctcaagggcggccagtccccaatgttcccgtccgggtccaccggcggtggccgccgcagccggggtggattcgaacctgccgagccgtcctctcccaaggtcacctgcatcggccaagtccgcgtcaagggcggtaagcgcaagcccaagcacacctcagccgccactctgcactcctgctccagacgcggcggagtcgggagcgcagaggtcagctttcgccgcgccggcgacgaccgggacggaccccagagcaagaaccagggctgggtgtaccagatcccggtcaacatctgcgaggcactcaagacatttggctcctgcggtggccgctcgctctgctcgccgtctcggcatggcggagccggcgagcggggcgcactccccaccgatgcaaactgtggcaagaagcggcggcagggcgctcctgctgggggtagctggctgtgcggtgctgccgtggcgaggtgccttctggcgatccaggaggaggacgacgacgaggtcggcaacggcaagggagctgcagttgtgccggcagaagagatgaggacatcggaagtggggctcgtcatggaagggtgggatgtcgaggaggagaaggctgtgatgatgggggatgtggaggtggagaagaaagatgagatcttggtagtggggaaggaagaagaggggagagtaagtgtctgcatccccccgaggaatgcactgctgctaatgcgctgccggtcagacccagttcgcatggctgctcttgccacccgcttctgggggtctccagctgcagctaccgtggagcaggtggacaatgaggtggctgggtgcctcaacgacaatgaggaagaagaagagaaggaagaggaggctgaggctgagccactggagtgcaaagatggagctcgctgttcagctgtttctgtcaaagacttgaaatgtgaagagtgtggttctgatgaaaatgatggcgctgaagcaggggagataaatcaagaaaaggcagaagctgaagagagttctaaatgtggagatctagtggaagaaaaggagggtgcatcatgcagagtaggggtggagggagcacaaattgttcggaaagatgccgagttggaggttcctttgggagaagttacagagatggaaaaccaagggccggacatggtggagttggtggtcagtgaggaagaagttccaggacatgagaaagttgacgaagagatgatggggaggagatcaatcaacagctattctccctcggcaactctgaaagaggaccgcaccaaattgcgacggttgagtagcaggaggtgtgttagcactagtagcagggcctcatcatccagtgatagggttggcaggcgacacagcttctcagctgagatggaggcacggcggtctagcttctcgagcttgaaggattcaaggagagctagtttctccattgatagagatggccggaggtggagcttctcaattgaacaggagcatcttgttgcgcagcctaaggtgctgatggcatccagaaaggggaagaagacgtcttctgaggcagagtcagaaaaggattgtgatgttgttgctccaaacagtgcagaggaaggtcaagaatcctatgacgatggaaaggaagaagacactactgagaatgtagcggaagaaggaaaaacaaagtctgcggaagcgaaccaggaagtagagaaagtagaaactagagcagaagagtgtgaaggtgggacagtaccagtgatacataggaggaagaagagtggtgagttaccagattgcctcctgttgatgatgtatgagccgaagctctccatggaggtctccaaggagacatgggtctgcagcaccgatttcgtccattggaagtcttaccagggcaagaataaccgcaatcactggcaacagaaggcttctgctgctggaacggtggagactaaggaaaaggagaatgctgaaggcaccaccattgtgaatgatgtacaagagagcaaagatccatcaacagtgaactcag

SEQ ID NO: 8203 - DNA, 762 bp, Zea mays
ggaggtcaatcagcagttattctccctcagcagctctgaaggaggaccgcaccaaattgcgacggtggagtagcaggaggcgtggtaacactagcagcagggcctcatcgtccagtgatagggttggcaggcgtagcgtggtcgcggccgagacagaggcacggcgttctagcttctcgagcttgaaggattcaaggagagctagtttcaccattgatagagatggccggaggtggagcttctcgattgaacaggagcatctcgttgcggagcctaaggtgctgatggcatccagaaaggggaagaagactaagtcttctgagccagagtcagagaaagattgtgatgttgttgctccaaacagtgtagaggaaggacaagaatcctgtgatgatggaaaggaagaagaaactaccgagaatgcagaggaagaaggaaaaacacattatgcggaaatcaaccaggaagtagagaaagtagaaactagagcagaagagtgtgaaagtggggccggaccagtgatacagaggaggaagaagagtggcgaaataccagattgcctcatgttgatgatgtatgagccaaagctctccatggaggtctccaaggagacatgggtctgcagtacctgcccggccggccgctccacttaccggcccagaataactacaaccacaggcacagagggctctgctactgtacagtggggactgtaaaatagagaatgctgaagcacaccgtgtgaagatgtacagagagcaa

SEQ ID NO: 8204 - DNA, 1075 bp, Zea mays
tgggaccccgggacctccgatctcccatttcctcacaacctcacccggctccatccacgcggctccaacgccagccacagcacgagccatggactcgcgcgtcgtggacggcgcaggtgggggtgccgacgcctccttgccggccgatccgccgagccccgtgcccgatccggccgcgggcgggatggatgcgcgcctcccatcggacctgcttcgtgcagtgctgcaaaggctgccgccgatcgacctcgcgcggtccgcctgcgtctgccgagcgtggcgcgcggttgcctccgaccgcgccgtggtcgaggccgccttctgtgcgccctggggagtgcggcgcgtcgtcggagagccggcgacgggggccttctggcgggccgcctcccttgggagatttgcgctgtcgcatgcgatccgccgcggggataccgtccccggtgtcgctctcaagtactccgtgcaggtgaccgatatcaaacgattcaacaacatgatgagtgaccatggcatctattcgagggagaggcttctggttccgatcagcaacccagaaatccttcttggcagcacctgctacatcgagatggaccataacgctaagagagaggttgcaatcttttaccccgagggacgcccaggtggcaaaactgactctgtggcaagcattgtctctgcggagaggagaaacaaaaggattctcgagtcggtgaggcggagcctgcacgtcgatgatggcactgctgcgtactacttatctgttactgagggtgatccgagggctgccatgacggagtactccgaggacctgaggtgggagcagcaacgcgcaggtcggtagattcatatatattccaatgacatatgttaagatcatggtgcttgatccttatcatttggtgtatatattgtacaatctggatggttgtaagtataaatacaaactttggtctaatgaatatagatgcatgtacgtgataataaataataattgccaaatggcatcggtgttgagaacaataaaaaaaaaaaaaaacaattggctggtgaaaagtattacatgacattcgtg

SEQ ID NO: 8205 - DNA, 9067 bp, Zea mays
  misc_feature (2128)..(2128): n is a, c, g, or t
  misc_feature (3308)..(3308): n is a, c, g, or t
  misc_feature (5527)..(5527): n is a, c, g, or t
  misc_feature (5801)..(5801): n is a, c, g, or t
taataggatacagaagggagtattgtttaagatcaataagagcttgttgatttggttactaaaagttaaggctaggcctaggcgtgaactccgtgcagccaccacgacgagtccacgagcggcgacagcgtgcgcacgccgagcccgtctcgctgcacgcgcacgcgggcttttttttttttgtttcgtcgtggggttccagccggagccgggcggttgtggtccctgtcggccgtcggcttcctccgtccgcgtctgcgtctgcgtctgcgtctgcgtagccagcttagactcggtgacgtcggaagagaggcggccccccagctagggcacccacgttgcagtggcgtggccgagtttttttttcttcttctttatatctgccgacgtgccgccggaaacacggaggcagtcgggctccggccgcgtgtcggggcgagggaccagctgccgtgctgtttgtttttcgactactccaagcatcatccatcaccggtggcgtggcggagctttccaaggccctggacccgggcggcgtggaaaggcacgtcgtggcccgctgctgcagcgtcgtcgtcggccggccggccgggcaggtcaggtcgtcgagcagacagcagaccacgctcgctcggttggccgtgcattgccgaatcgcatgcgcagaaatgtggacggataaatcatctctgtgctaggtggggccactggcactggcaggatgccagttgcagccactagtgcaggctgcagcctgcagggtcggcggggcgtaggggaagaacaagggcagaggcaggcaggcagcacggggcacgagacgacgggtggcccggcctcttcctcgcgtccgctgtcctgttgctgatggcgacgcaggcacaaacggtccacgtacagcagcgcaaaggcagctgccagcacagagcgccggcccggcccggcccaggaaagaagcactcgtacccatcgatcgcttcggtggaagctcttccggcccacctccgccatcttggtcgatggagacttctccttcgttcacgggattggactgacgtgatgagcatggcacaagtgcacagcacacctgtaggcggcaggcagggagacactggaagacaggcgacgcgagctgcatggcaggcgccatcgaagtcacggacgcgtccaatgctgctgcactgcatgcatacagccatacagggaacaggggaagaaggaaggggatccattcgccgattcagctagccatgcgccgtgcagcgggcagccacacacacgccggcggccacccagccttccctcctcagaccgtcccgccgtggcctgtggctgtggctgtagcactactagtctagtatgcactagcacctgcccacctggcagtctacgtcatattgaatttttatcatgttcaaaatacacgcttgctaataagacacgacctcatcctttcccctgtccctacagagaaaaaaaatgttgtcaataaatgccagcttaaatataatagaaaatctagaatcttataagatatatcgtgattttctctggtcctttattttaagacatcggaataataccgtgtataattcggtaccacatatatctagtttcaatcagttccatcatggctagaaaataaccaaaatgtcacataatacatctaattaattattagattgcaagtcgtaagatttgtttctttagacctaaccccgagggatactttgtttttaatcaaattttagggtagtcggaggcctaacgaaaacatcatttggattcgtccctggtcgtagtctcgtagaggtaagatccaacctaagttattttagaaactcaaatccactagagatcgaagaaaatcgagtgagaaataaagaatgttttcagttgatgctggttagccagttagccgtgcaagagcacatatggagtatgattggacctggaatttgatgatggcgcgactttattcatcctttttcctccaaactttaaagtgtaaaaaagtagaaaattaaatagaaataaatccttggattttacagtatacggtgtgagctcacaatttctaagaaaacactcattcattctggcagctttaaaaatctagctaacctantcttaacctgggtgcatgaaggcttaaacactgaaatcctgctgttattgagagcttgctttagaacacaaatgagtgagtgatgcatggcttgtcgtagttgaatactttcactaacaacatgcgtttggcatatcgtcacacggttctctctctctctaacccaacctagcaagaaaaccacaaaaaaaaacgaaacgaagtcgaggaaaagaagggaacacttgtttgactctggagccaccaagtccaaaacaatctacacgtactacgcaggtccgggacgccagaaagcagctcgccagcgtgcgtcactctccctccccgccctcgattcgaaacccacacaagcggagcggaaggggaggccactcactaacccctgattagctgctcattaactccacccccgatctgaattggcagtagcagatcggcgtgccattgcatcaccgccagcagcagcagcaagaccaccaaacccaacgagagagcagccgaggcaatttaatgcgttcccctcctctccccatccctctctagctactctgtagattgacagagagacaagagcgctcttgctaccaatctcctcctcgtcgccgccgcggccgctctcgctcccacgatccggcgctgccacgagcttccagatccgccgcccgggcaatgctgtagctgcccgcgccgagatgggcggcgtcggcgccggctctgctcgccctgctgcggctgctcctcctcctgctcctccgcgccgaggcctccgctctccacggtacaaagccttcgacacttccctttaccgtccccgtcggtctgtcctgtcccgtcccgtcccgctcgatccttccctgtgtccgctcccccctccgcattccgcggggttgctcgccgtggggcggtgcgcccgcgctcgcgcttcgggcgggcggggattccgcgccccgttccgcattccaccgaaacctccccgaccttgccgggcgcgctgctcctgctcctgctcctgccgccgtgcctcgctgccgtcccaagcgcgctcgcgcccgctgctggagcttggcatttctggtgcgtggcgcggaattcggctgctttttctttgtgcggattttttttagattacagcgcaggcgcatggttttcgcattgtgcgaaggatctgacgactggcgangaggcgtaaggtctacgatactgtcggtgggttcagttgcttgccactccgtccccgccccccgccccccgagtggaaaaagtgctctggccttttggaattttggctgacaccgacccgggatcatcctaaattcctaatcctacccaggagatggagaaggcaaggggtgtctacttagatagattggcacatgccttctctcgagggcattcatgctgcagccagaagtaggtgctgtctattgcgccttgttctacgggctcatgggattggttgttggatgcagaggttgcaatgtacgagcacatgttttgtttagcgaggctgtggttgctagaatgctagctgagcttctttaccatgcatgttttcttttctctaggttggcctctgtagtatggtgttgtaacaatggtgggggcgtgttgtctgaccttcctcatcaggcataaaatcttaggatctacatggaatgctgcataaaatcgtcacttgtcagcgaggcgatattcttcggtatacctccgttctcgaatatttgtcgcccgctaattcatttttgaactcaaacgcgacaaataaaaaagaacggagggagtaatttgtttcgactcggtagtattgaaactggaaagtgtattccatgtatggtgtccagtcttcaggaaggggagcaattttcttaggctatttggagaactgtagaagtactagatttgcattaaagtaacttatgcaaagctacaacattgtcggatgcagtataaagttcattgggaattcaatcttttgtttttctatctttccatatcacgtagccttgttttacaaatagtatttgccagtggacgttggccatttaactccaatgcgccacatgccttttatgatgttacagttacaccgtatatgaagtttatatataattatatgagaccgttgcataaatttcctccaccaggtttacataattttctccagtgtaaaccctaaccccgcgccgtcctgcagcgactatattacctagcccagcaccgagtccatcaaaagcccctgaagcgagatcgtttggacctcgaatttccccttcacatcctccgagtgcactacctccaggatctcctggtacataaccatgacaacttaaatactacaatttcaaaccttatttttttatagagtggcgtttactttcttctaattcttgaaggcgttgatgcgcgccatcattcacacaagcacccgcaccacagagagtcaaatcagggcccttcaccatcctcagcacccacacctgaaggtttgtggtttgtcagtgcaccttgtttatgcaattcacaattttatgccgttaggattccttgtattgttttaccgattctgttgcttatgccattcttctgtggtctatttttatcttgtactgttgctatcgaggtttgaactactcttatgactagatatgtgattgtattcgttacctatattcattgaataattccttggatctttagcaggttgttctagttatatctgcaccgagccactgactgcaacaccaattggttccccttgtggctgtgtcgagcctattagtgttatcgttgatctggacttagctccttatctactgttcatgagcatagctgagttagaagttgaggttgcagctgggacatttcttaaacaaagccaggtgaagatcatggctgcagttgcaagtatccaggatgaccagaagacacgggtgaccatttatttggtgccgctaagagaacagttcgatacttatacggcatccctaatatctgataggttcatggagaaaaaggttcagataaattcatctatatttggagattataaagttatcaatatcagctatcatggtaaggccgtgcacatggaataccccttaggttgtttgctcgacttatgttcatagctatggatctttgttactgcaggattgcaatccccgccatcatctctgcctggaggatcggatccttcaggaactgaagaatatcctataactgcagaggtgcctgatcagaagaaaaagcacaataaatcagatattttggtcatcgtggtagtgttagggtcttctcttggacttctgatgacatgtgctgttctgctgatcttactagtaagatggaagaaacttggacggcttcatgaggctatgacccctgcaactatcccagcanttaatagaagatatggtatggtgtttatagtattacttctattgtgctttgtcaattatctattgcttatggctgcttgggaaatatttttaactaaggctgtgtaggagttagcatcatgttaatctgttttttctagagcatttgttttcattttcaagttgccaagtctagagttttgtggtcaacaatggaaaaacttagcaccatttccattttggtgggagtatcatttactatttctatgcagtcgagttaaatgaaagttgttatntaatgatttcacttagtcttcccctgcagtaaatgtctctttgcaatctatgatagtctaagtttttagactcttaccaacttccttatgataaacatgcattaacagttttcaacttcaaaaaacgctgttagcatatggttgacaacaaaaactgttaggaaaggtcacacaagttgaacttcttgagtacactaaataatttgccactcttaaagctgccgttatgctgataacttaatgcatgatgcaggcaccaggccaactttgtcaaccagcatggtgagctctgcgtcagcatcagtgttttcaacagtggctacttgcacaacatctgtaaagacattttcactagcccaacttcagaaggccacagatggttttgattcaagaagagttttgggtcaagggggctttgggcgtgtctaccatgggacgatagaggatggaaacgaaattgctgttaaattgcttacaagggaggacaggagtggtgaccgtgagtttattgcagaagtggaaatgctcagtcgattgcaccaccggaatcttgtcaaattgattggtatttgcattgagcggagtaaaagatgtcttgtgtatgagctcatacgaaacggaagtgtggaatcccatcttcatggtatgccagccaaatagaaaaaatatggttaatgagccttgaatggaaagcgctgactacaataatccccataaaataatcagatgaggcttatttaatttgttaaacatgaactgtctgaatcagctggcattctaaaaatagaactgagttgtttgatggcgtagttctaatgaatcacatatatgtacaatattaactactgcgtccaaaacttaaaaattttctgatgatgtgtctcagtgaaacacagcactcagaactaaaaagtacggaagtccgtatttttctctgtgatgtttgtgtctagtgtaggattttttttttacttaacatgattgttttggattgatcctagccttgtttttttccctgtctaggcgctgacaaggctaagggtaagctgaactgggatgttaggatgaaaattgctcttggcgctgctcgaggcttagcatatctgcatgaagattcaaaccctcatgtcatacaccgtgacttcaaggccagcaatatattattagaggaagatttcactcctaaagtgaccgattttggtttagcaagggaagcatccaatgcgactcaacctatatctaccagggtaatgggtactttcgggtaaggcacactttgctcttaccccatcttatataacgatgtcaattaccatgtgaccgttagttgatgattttttactatttttctgcttcttgatacgttagattgtagtagtatgactttggttctctttgtgattgcttctaattacattatggatgtactcctagatgtcacagttggggaaaatcagctagtatgattatcttgattaaatcctagtgttcctgaattccgagaatgattattcctagagtgtgttgatactatttttttgtgtgtcaaacaatggcaatgcttgaggggtcgttcctttttattttccttgctaaatagttcgtgctatcacaataattgttttcctacactttgtacacagcagtgtcttgctttttatttgactcgattttatttttttttctctttgactgcacagttatgttgctccagaatatgcaatgacgggccatcttcttgttaagagcgatgtctacagttatggggttgtcttgctggaacttatatcaggaaggaagcctgtaaacatctctgagtccaaggatcctgagaaccttgtaacctgggcccgtcctctgctaagccataaggagggcctggagaagttaattgatccgtctctggatggaaattttaacttcgacaatgtagcgaaggtggcatccatcgcttccatgtgtgtgcacacagatccatcgcagaggccgttcatgggtgaagttgtccaggcactgaagctgatctacaatgatccagatgaggcttgcgacgattcctacagtccaaggaattcatctgaccaagacggtgactacgaaggagacctggtctttgagagtggaagctggggctttggggcctctgggtgtctagactaccggaattccttaccgtttgtcactatggactacagttctggccgaatagaagggccgcacgaccctcgcgcggcattgtcagcgggatcccatgcccagtcaccagtgctgcagaatagatcaggccccttgcggatgaagaagaagctggcctccttctaccgctctagaggcagcattagtgagcatgggcacctgccgcgccattgatcagtcagtgaactagtgttaggctgttagcttcggttgactctgggattgaggctggcgggggttgtcattacctgattcgtgcctcatgttagtgtacagttcgtggtgacccttcacccttgggtatgggtgttttttctctctctttgccttctgcttcttccccggaagcaatgaggatggggttggcaggtgctctctaattttcgcaaattgcggttcatttctcatgcatctgattggtttcttgccggagttctgggcatcatgttgttgtgactaggtggttgtactggatgcagttcgttgtaaacagacagtgtcagggatctacctcgcgttggagaggtgaactatacagccggctcagttcctcaaatgtcaggtggtacctgtgttaatatccttttggttccccccttgcatggtcttattgcattttttttttactttggtcatgagtgatgttcgttctagtcttgtggataactggatatcatggttccgtgttcaattcatgttctctagcacaagcggccctaccttcggacaacggtgtattctttggttgtaaacccaagattctttttactattactaattggagtttttaatgttgctaattggagtttttttactagacatgctagaaaaaaaagataaattgtaaactagaaaatattacaaagatccagtcattaatttgataggctcaagtcaccattgaaaataataattactgaactagctatgatctctaaaaacttgtccacctctactattatgagaaataacataaaatataatcccttctaagtttggggaaccctaaattttctataggattttctattttttctaatgagaaatttagtttattttcatatggaaaa

SEQ ID NO: 8206 - DNA, 2628 bp, Zea mays
gcacgagaccattacctagaacatcctaatcgaaaaagctactctgtagattgacagagagacaagagcgctcttgctaccaatctcctcctcgtcgccgccgcggccgctctcgctcccacgatccggcgctgccacgagcttccagatccgccgcccgggcaatgctgtagctgcccgcgccgagatgggcggcgtcggcgccggctctctcgccctgctgcggctgctcctcctcctgctcctccgctccgaggcctccgctctccacggttgttctagttatatctgcaccgagccactgactgcaacaccaattggttccccttgtggctgtgtcgagcctattagtgttatcgttgatctggacttagctccttatctactgttcatgagcatagctgagttagaagttgaggttgcagctgggacatttcttaaacaaagccaggtgaagatcatggctgcagttgcaagtatccaggatgaccagaagacacgggtgaccatttatttggtgccgctaagagaacagttcgatacttatacggcatccctaatatctgataggttcatggagaaaaaggttcagataaattcatctatatttggagattataaagttatcaatatcagctatcatggattgcaatccccgccatcatctctgcctggaggatcggatccttcaggaactgaagaatatcctataactgcagaggtgcctgatcagaagaaaaagcacaataaatcagatattttggtcatcgtggtagtgttagggtcttctcttggacttctgatgacatgtgctgttgtgctgatcttactagtaagatggaagaaacttggacggcttcatgaggctatgacccctgcaactatcccagcagttaatagaagatatggcaccaggccaactttgtcaaccagcatggtgagctctgcgtcagcatcagtgttttcaacagtggctacttgcacaacatctgtaaagacattttcactagcccaacttcagaaggccacagatggttttgattcaagaagagttttgggtcaagggggctttgggcgtgtctaccatgggacgatagaggatggaaacgaaattgctgttaaattgcttacaagggaggacaggagtggtgaccgtgagtttattgcagaagtggaaatgctcagtcgattgcaccaccggaatcttgtcaaattgattggtatttgcattgagcggagtaaaagatgtcttgtgtatgagctcatacgaaacggaagtgtggaatcccatcttcatggtgctgacaaggctaagggtaagctgaactgggatgttaggatgaaaattgctcttggtgctgctcgaggcttagcatatctgcatgaagattcaaaccctcatgtcatacaccgtgacttcaaggccagcaatatattattagaggaagatttcactcctaaagtgaccgattttggtttagcaagggaagcatccaatgcgactcaacctatatctaccagggtaatgggtactttcggttatgttgctccagaatatgcaatgacgggccatcttcttgttaagagcgatgtctacagttatggggttgtcttgctggaacttatatcaggaaggaagcctgtaaacatctctgagtccaaggatcctgagaaccttgtaacttgggcccgtcctctgctaagccataaggagggcctggagaagttaattgatccgtctctggatggaaattttaacttcgacaatgtagcgaaggtggcatccatcgcttccatgtgtgtgcacacagatccatcgcagaggccgtttatgggtgaagttgtccaggcactgaagctgatctacaatgatccagatgaggcttgcgacgattcctacagtccaaggaattcatctgatcaagacggtgactacgaaggagacctggtctttgagagtggaagctggggctttggggcctctgggtgtctagactaccggaattccttaccgtttgtcactatggactacagttctggccgaatagaagggccgcacgaccctcgcgcggcattgtcagcgggatcccatgcccagtcaccagtgctgctgaatagatcaggccccttgcggatgaagaagaagctggcctccttctaccgctctagaggcagcattagtgagcatgggcacctgccgcgccattgatcagtcagtgaactagtgttaggctgttagcttcggttgactctgggattgaggctggcgggggttgtcactacctgattcgtgcctcatgttagtgtacagttcgtggtgacccttcacccttgggtatgggtgttttttttctctctttgccttctgcttcttccccggaagcaatgaggatggggttggcaggtgctctctaattttcgcaaattgcggttcatttctcatgcatctgattggtttcttgccggagttctgggcatcatgatgttgtgactaggtggttgtactggatgcagttcgttgtaaacagacagtgtcagggatctacctcgcgttggagaggtgaactatacagccggctcagttcctcaaatgtcaggtggtacctgtgtgaaaaaaaaaaaaaaaaa

SEQ ID NO: 8207 - DNA, 1906 bp, Zea mays
gacgaccgttgaaactggtgctttaagtatagtatagataatgaatctccaacgactggacggatctgttaccattacaatctgttcgcagatccctaggcagcaggccatgccgtcgtcgcggtccctgccgcggagcgcaagcgagctgcccggcccgccgtcgccgttcagctccaacccggcgcaccacccagtctccattccgaccacgcccggcctctcgtcgtcgtcgtgctcgtcgttcggccgcatgcggtcaccgcccaccgactcgccgccgatcacgcccaccaagcagcagggcggcaagcccaagccgacgccggcggccgccgccgccgcgtactacgcgtcgctgtgcgcgcccaggcgcctcatgcagcgctgtgcccgcgccttccgccgcagcaggtcacgcggcggtgtcgtcaggacggtcaaggacctcgccgaggaacgggcggcggtgctcgccgccagcagcaaggtctccgacgcggcgtcggcggtgccgccgctgcctcctggtgtcgagaccgccagcagcaacggtgcccgcggcggcagcgtggaggtggaggataagcagcggcggcgccacgacgactgccaccccgaggtcgttcccgagaagatcatacgggaggacgcgccgccagttgttgcggagaccgctgccgcccccaccaccacggaggtggaggtggagtcccccaagaaaggagcggcgccggtgccagagcccatcgtcgttgtcgccgcagtggaggacgtggtggcggacaagttcgtggcggtggtgaaggaggcgatcaagaagccggagatggacgagaaggaggtggcgatgcggagattcctgggcagccgggtgaagacagcgatggagccgcggtcagaggcggagcagccgcggcgccgggaggtggcgcggagcaacgacgtgatcgaggcggcacgcaccaagctgatgcagaagcgccagtgcagcagggtcaaggcgctcgtcggcgccttcgagactgtcatagacacccagaaggacgccgccgccggcaggccacaacacatctaccgcaagtcagcttaaaacatactgcggcggcggggacgcatcgatcctccacgcttcgtgtcttcgccttaattaattaattaattgttatgatcatgtcggccagcccaacgccgtatgcatgcatgcacacggcgctaattaatccctgtttatttactactccgtgaaatgtagtttctccgtatacacggagcagtagtattctgtaaagaggaaaatggtggaaaccgatgttgcattctgcataaatttattaatagggctagtttcacaaccttattttttctaagaggttttattttttcaagggaatttaattcattttctcttgaaaaaataggattcacttgagaaaatgaagttgtcaaactagcctttataattatataaaaaaaaaaaaaaaacatcttggttagaactgtcgccgggctttttctcgtccaacaaagcatgcatattgttactgccaagtggccatcttctcatgttggagccgaaggaattgtgatcgatagcaaataagatgaatcatacaatttcaacccacttttaaaataatttttacctagttaaaacctacacaagagcactaatgagcgaggcaaccaccttcaagatctgctggtcgacggagtgtgcccgtcctcgtgggcttcgagtccgtcatccacgacggcgacttcatctctgtctccttcggacgggaccgcgcctctcgtcgacgatgctaaattcctcttccatgagtccttcggataggacgcgcctctcgtcgacgatgcaaaattcctcttccacgagtccatcacgtgggctccatccaaa

SEQ ID NO: 8208 - DNA, 2487 bp, Zea mays
  misc_feature (1892)..(1892): n is a, c, g, or t
cgggaacaccccgctcacgctgcgcagctccacgcccgcctcctcatctctgctggcgcgcgtcctcacccgcacccggtcctcctcacgcagctcgtctccctctacgccgccgcgggccgcctcgccgacgcgctccgcgccttccgcgcccacctacccagcgccaacctccacacctacgccggcctcgtctccgccctcgcgcggccgtacccggacctcgcgttctccctcttctcgggctcgcgccgccagctccgccccagcccccatgtcatctccgccgtgctcgccgcatgcgccggcctccagcctctctgcggacgccaggtccacacgtgcgcggccaaggtcgtaccgcccggcgacgtgttcgtctacaccgggatggtcgacgtgtacgccaagggcggggacatggagtcgtccagaaaggtgttcgatgaaatgctgaaccggggcgcggcgtcgtggaacgcgctcctcgttggttacgccaggtacaagatgtgcctcgaagccctgtcggtgttcagggagttggccgcgcaggggcgggaggtgtctctcgatcaggtgagcgtgtcgagtgtgctcagcgcttgcgctgtggcaggggccctgaactatggtcgccaggtacacgcgtgcgctaccaaggtagggctggagctcagcgcggtttgtgtcagcaacgctcttcttgacatgtacaccaggtgtggatgctcacgagaatcttccgctctgctaaatgctgtgggttgcagggatgttgtcacctggaacatcatcattcgtagctgcattcatgacaatcggttcaaggaagcttgtgtgctgttccggtccatggtcaggaacggtaccttgccggatgatgtagcctttgctactgtgttgcaggcgtcagcgtgtatgtcggcatgggctataggagcaagcatgcatgcctccgtcgtgaagacagggttcttatacagtgatggcgttgctagctcgctaatcaccatgtattccaaatgtggctgcttggacgatgcacaccgagcatttgtgaggggcaaaagatcatctgcatataatgtcctggacggccatgataactgcactgcagctgcacgctcctggcatgcaggcaattgatgtatttgagaatatgctagagaatggcattcctccggaccacatcacatttgtgagtgttctctcttcctgtagccacagcggactgttgagcaaggacgcaggtacttgatttcgatgacttgggttcataagatcacaccacggaatgagcactatgcgtgcatggttgacatgtttgggcgagcaggccttctaactgaggcaaagcgattcattcaccagatgggacctaagcaagatgcatcagtccttggggcactcctttgggcttgcatgaactgcagggaccttgagatgggtaaggaggttgccaagaagctttttgtgattgagccaggtaataccgggaactatgtcctgcttgctaatatctatacgtcacatggaagattggaggaggcaaaggaggtgcggaggtggatgatgtttcaggagttaaggaaggaaaagggatgcagtttaatcaacaattgagaaccaaatctgtaccttatgaatacttcagcaaaggtgaggcttctattgtctcaaggatggtacctgcactcgtcaaacatagaaagctcgctccctattttatttagacacagttaaggcaataaggcctactggagtttctgcatactcaagggttcatgggcatcccaggctcccagaagtggaatctgcaaggtatggctcattcgaacccatatgcgaagaagtttaattcctttattagtgagagcagaagccagaanaatgcagaacagttggtattcctacgcacgtcccagccgtgtccagccgtcccaggtatctccagctcgccctgggaaccagtgattcctggtttcctaggcgtccaggcagactcagcattcgcttggaagccctagtcgccttttcagcactggtggtcaatatacatgtattcctcgtagtaaccactgctacatgctgaactatacagaaaatgaggaaatagagcagtacagcatctcttgcaagaccttctactgtggtgccatcatgttggatcacatttttttggcagtcagatgagagcctcagggtcaggttaaggttccaagttagttttcttccacattagaccttgtttcgatgcacttgtatcaaactcaattcaagtaaaattataaaccaatccactccaacacacatggatcgaggtagaaaaagtgtatctaagcaaggcatagtgtgtagatgtttatcccttggcaatattcctgtttgagcttctcttcttttatccgtggctactcagagttggtatctgtggtagagataaaggaatatgaaacgtgacatagtgtgtagatgtttatttac

SEQ ID NO: 8209 - DNA, 826 bp, Zea mays
ccggccggatggccagcaaagctcaccgtggatcttttcctttgttccctttttcttttcagccgccacaccgcagctccggaaccgctgctgcccggcccattttaccaccgatccatggcggaggattcggcggcggcggccacgtggggcggcggcgacaagctcatcctgcgcggccttcagttccacggcttccatggcgtcctgcgggaggagaagacgctggggcagaagttcgtcgtcgacatcgacgcctggatggacctcgccgccgccggcgagtccgactgcatcgctgacaccgtcagctacaccgatatctacagcattgcaaaggatgttgtcgagggcacgccacgcaacctcttggagtcggtagcccactcgatcgcagaggccacgctgctcaagttccctcaggtctccgcagtccgggtgaaggttggcaagcctcacgtcgcggtgcgaggcgttctggactacctgggcgtggagataacgaggcagagaaagaaagaatgagacgctgtacagtctgatcggagatgaacaattattgtacccacacccacactgccgccataaaccacaatccacacttgttggcaacttggcatcaatgtttcctcccttctcgaacacaacttgtggcatcacgtttgatgaacaaagacagtttggcagctggttgacagtggtacagacagtctgagtctgaaatgggaatggtatttcctgatttcatgtaaaacaaactggcggccctcggttttgccgcccacatatggattagatgagattgaaaacaaaaaaaaaaaaaaaa

SEQ ID NO: 8210 - DNA, 1290 bp, Zea mays
aacagccggcttcgtgccggcgggtgcttgctggccatcgtacctcacccctcgtgcctcaagcctcagcaagacagcaacgcgaccgctgccacccctttgcggaatcgcggcttcggcctccggcctcagcggctcagccaaccacgacgccgccgtgcgcgccagcctccgtgggacacggctgccggcttcggtccgctctcggctctcgcccctcaggcctcagccacgccgcacgcggccggcacggcggcgcccgcctccacggctccgcgccgcggccccagccacgctacacgcggccacgccgcacgccagcacgctcagccgcgcgcccgcccgcctgctcggctcctcccctgctcctgctcggctgctccgtggtgcctgatccatggcggagaaggaggcggcggctatgtggggcggcggcgacaagctcattctgcgcggccttcagttccatggcttccacggtgtccttcaggaggagaagacgttgggacagatgttcgtggttgacatcgacgtctggatggacctcgccgctgccggcgagtccgactgcatcgctgacactgtcagctacaccgatatctacagcattgcaaaggatgttgtcgagggcacgccacgcaacctcttggagtcggtagctcactcgatcgcagaggccacactgctcaagttccctcagatctccgcagtccgagtgaaggttggcaagcctcacgtcgcggtgcgaggcgttctggactacctgggcgtggagataacgaggcacagaaagaaagaatgagatgctgtacacatgtggtgatggggagccagttcaatgctgatggcactgcggccataaccataatccacgcacgcttgttggcaactaggcatatccctttcacctctgaactgttggaatatcgggaatctgttcccctagttgctttattacgaattcagaatttcagatcatatctgggtagtaagatcaaccttcttctggtctgtaacatctttttttttgtccatgttgctagtcgttgctcttcataccaactcatttcttgcacaaccattgagcctcagtttattgctagtaccaacaaattcgtaaccatttgattctttttctctctctctcgatcaactattcgctgtccgaaccattttctatctttcctgatgtttatacatgatggaatatctatgcaaagatcaatataaaggcatcgcggaggtgcattacctagtatttagtagtgtggccgtttgttattaaataaa

SEQ ID NO: 8211 - DNA, 792 bp, Zea mays
atcaattagatcatttagttttgtctaaaaaaatagctttatcctagtagctcggtagcccctgatctgtttctactgctcggcccgttctatcacagatccatggcggagaaggaggcggcggctacgtggggtggcgacgacaagctcattctgcgcggccttcagttccatggcttccacggtgtcctgcaggaggagaagacgttgggacagaagttcgtggttgacatcgacgcctggatggacctcgccgctgccggcgagtccgactgcattgctgacaccgtcagctacaccgatatctacagcattgcaaaggatgttgtcgagggcacgccacgcaacctcttggagtcggtagctcactcgatcgcagaggccacgctgctcaagttccctcagatctccgcagtccgagtgaaggttggcaagcctcacgtcgcggtgcgaggcgttctggactacctgggcgtggagataacgaggcacagaaagaaagaatgagatgctgtacacatgtggtgatggggagccagttcaatgctgatggcactgcggccataaccataatccacgcacgcttgttgcttgttggcaactaggcatatccctttcacctctgaactgttggaatatcgggaaatctgttcccctagttgctttattacgaattcagatcatatctgggtagtaagatcaaccttcttctggtctgtaacatcttttttttttctccttgctgctagtcgttgctcttcatacccaaaaaaaaaaaaaaaaagggcccta

SEQ ID NO: 8212 - DNA, 1609 bp, Zea mays
ggctcgccggagacgcccgttccctcttccgggcgccgcctgcgcctctcgttctctatataaaacaccgccgccccgcgaacgtgctcggcaccgcgcgcgccccgcctccccaccggtctcgcagtccctcggccgctcgtcccggcagagcagtcgcagcacgatggtgaccaacgtggtggacctccggtcggacacggtcaccaagccgtccgacgccatgcgcgccgccatggccgcggccgacgtcgacgacgacgttctgggcgcggaccccaccgcgcgccgcttcgaggcggagatggccgcgctcctgggcaaggaggccgcgctgttcgtgccctcgggcaccatggccaacctcgtctccgtcctcgcgcactgcgacgtccgcggcagcgaggtcatcctcggcgacgcctcccacatccacgtctacgagaacggcggcatctccaccctcggcggcgtgcaccccaggaccgtgcccaacaaccccgacggcaccatggacctcgccaggatcgtcggcgccatcaggaaccccgacggggcgctgctgtacccgaccaccaggctcatctgcctggagaacacgcatgccaattctggtgggaaatgcttgtctgtagagtacacggacaaggttggcgaaattgccgtgaaccacggcttgaagcttcacatcgatggagctcgtattttcaatgcctctgtggcactgggagttcctgtacatagacttgtaaaagctgccgactcagtttcggtatgcctatctaaagggttaggcgcacccatcggatcagttgttgttggttcagaggccttcatcgacaaggctagaattcttaggaagaccctaggcggtgggatgaggcaggttggagttctttgtgccgctgcttatgttgctgttcgtgacaccgtgggaaagcttgcggatgatcacaggaaggctaaagccttggcagagggcctgaataaaattaaacagttcacggtggattcatcttcggttgagaccaatatggtgttcttcgatatcgtggatccacgcatttcaccgagcaagctatgccaagtcttggaacagcgcaatgttcttgcaatgccagcaagttcaaaaagtgtcaggttcgtcatccattaccagatttcagacagcgatgttcaatatgcattgacgtgtgtcgagaaagctgttgaagagctattgaagggcggtacaaagttggagcatttgacgaatggtactgccaaaaactcatattggcactagacgtcagcagggtgtcctgcttgtttgttatcaacgctagctgttaaaactcttctctattaatgaaatagggcacaccactcgtgtgcccgtttgttccaaaaaaaatctaggtgttaatttgtagtcacacctttgccggatggctgttgctgtttactcttcactcggatgtgttcgttcttgtgctgtatagcttaccttctcagaattacctggtccgtttccgcttcctggtaagacggatgcaatgaagtattgcaaatgcagaacatacttggcccagataatacagtttcttttgttaaaaaaaaaaaaaaaaaa

SEQ ID NO: 8213 - DNA, 1108 bp, Zea mays
ccccgcgtccgcccagcgtccgcccagcgtccgcggcaccatgtacctcgccaggatcgtcgacgccatcaggaaccccgcggggcgctgctgtacccgacgaccaggctcatctgcctggagaacacgcatgccaattctggtgggaaatgcttgtctgtagagtacacagacaaggttggcgaaattgccgtgaaccacggcttgaagcttcacatcgatggagctcgtattttcaatgcctctgtggcactgggagttcctgtacatagacttgtaaaagctgccgactcagtttcggtacgttctcaagtcgctgggttctgcggtcaattcgcaacaggcatgcgtatgaaatgaccgaccttcaggtagtaacatatgcgggcggtgattctactcatttctctgaaacattatgcgcaggtatgcctatctaaagggttaggcgcacccatcggatcagttgttgttggttcagaggccttcatcgacaaggctagaattcttaggaagaccctaggcggtgggatgaggcaggttggagttctttgtgccgctgcttatgttgctgttcgtgacaccgtgggaaagcttgcggatgatcacaggaaggctaaagccttggcagagggcctgaagaaaattaaacagcttacggtggattcgtcttcagtcgagaccaatatggtgttcttcgatatcgtggatccacgcatttcaccgagcaagctatgccaagtcttggaacagcgcaatgttcttgcaatgccagcaagttcaaaaagtgtcaggttcgtcatccattaccagatttcagacagcgatgttcaatatgcattgacatgtgtcgagaaagctgttgaggagctattgaagggcggtacaaagttggagcatttgacgaatggtactgccaaaaactcatattggcactagacatcagcagggtgtcctgcttgtttgttatcaacgctagctgttaaaactcttctctattaatgaaatagggcacaccactcgtgtgcccgtttgatccaaaaaagaaaaagaagggcggccgctaaagaggacacaagaataagaacgcgcgcatgggaggaaagag

SEQ ID NO: 8214 - DNA, 2325 bp, Zea mays
  misc_feature (1)..(1): n is a, c, g, or t
ngatctctgatgatatgctaagtataagcaatgacagagaccaaaaggttgttaaacttggtgtgatgtctttgcttgctgtgtttaaggacgttattccaagttatcggattaggcagctgacagaaaaggagctagcagtagaagtttcgaaagaagtgaagaagacaagatattatgagtacacacttattcgctgctacaaggcctacctgcagaaattgatatcgttggagaagcagccctacttttatactgtggctgttcgttgcatgtgtgctttattagacactgccccacattttaacttccgtgaaagcctattggctagtgtggtaaaaaatttaagctcctcagatgatgtagtaaggaaaatgtgttgtgaagcaataagatcattatttataaatgaaggaaaacatcgtggtgaggcaacaatagaagcagttaggttgattgcagatcatgtgaagctcaatgattgccaacttcatcctgatagcattgaggtcttcctgtctttgagatttgatgaagatattggaaaagatgagattcaggaggaaaaggtgaaaccaaagaggaataaacgttggcaaaaaaatcaggaggttccgaagcaattgccagttaatgataagaagaaaaccagacaggaactgatctcaaaagctagaaaggaggttgatgcagaccttagagcagtttccttcactcttgacccgaaggagagaaaagggatacaaaaagaaacactttctgctctgtttgagacttacttccgcattctgaagcatagtatggccgcttcaaattcaaggactaaggtgaataatgtttcccctggtggctcacacccacttctcactccatgcctggagggtttagggaaattttcacatttaattgatttggatttcatgggtgaacttatatcttgcctcaagaagctttctgggtatagtgaccgacaagacgaaattcccaatgataatgcactgtctgtctcagaacgtctgcagtgctgcatagttgtgtttaaagtctggaggagcaaccttgaggcactgaatgtggatctgcaggatttctttgtgcagctctataacctcatactggagtatcggcctgacagggatcatggcgaggtattggctgatgcgctgaagacacttctttgggaaggcagacagcatgatatgctaagagccgctgctttcatcaaacgattagccacatttgctctctcatttggctctgcagaagcaatagcagcattggtcacactgaagcatctcctccaaaaaaacagcaagtgccgcaatatgttggaaaatgattctggtggcggttctctgtcttgcttagttgcgaaatacaaccccgaagctacggatccatatctgagtggtgcactcgcttcagtcctctgggagctcagcctcctagagaagcattatgacatctcagtttcctcgatggcttcgaatatcttgagtatggcaaacctgaatcccacccagaacccagttcctatcttgaacgtgaaccctcttgaagcgtacagagacctgtcattggaaagggaactatcaaaaccggctagcaaagcattgccactgaacctcaaaaggaagcggcgtgccaaggagtttgttgcgctaagcccagatgtgcttcagaaggcagattgctcggtggacaaagacgagctcgaagagaagctgcagagccatttctccgtgctaagaggcatctctgagaatgagaggttgagggcagagctgaaccacacactgtcatccataaacatgtacaaggagtacaagaagcagaaaaggaaaaacatgaaagttaagaccggaaggaaaaaaacagcaaggctttagccgtttaaggctttagccgtcttatctgttccggaggtctttgcgctcgaccggtggatgggtgtaattttcagttttttttgggcatatttcccattgactactatagtgcagttttctgccacccttttgccgtttctgcacaccacactatgaaagacttgtttgcatttgtgattttgggaaatggtttagggaagttatagttttttccccatttttctcagtttctctatacgattttgaggggaaagcggatagattcttccctaacgcattatacattgatattcacttttttcattctcctattttaagtcttgtcggttacataagattggagtagatttagaggattggattcctttctattcaaaatagaaaaaggaagagatttaatcctctctaatttctctaacggaataaacttttcgga

SEQ ID NO: 8215 - DNA, 1647 bp, Zea mays
gggtacctcgaggccggccggccgcgccggcgaggtcgcacggcacctacccccgccccattctgcaagccttgctccatttgcgactcgcgagctcaccttccacaccctacctactcctccactctgagctcacaccaaacagcccgtgcaccaaggccaccattcaccgccaccaacaacaaacgggaactcttcacagcttcgcacctcgcgtcacaacaccaagacgcacgtaggagggaacctcaagcttcagtcgtccatggctcagcagcaaacaaatcctgaagaggtggtcctcgggcaggaggtcggggccgcgagggtggccactctcaaccgcccgcgccagctcaacggcatctccgacagagtggtgtacctcctcgcacagtttctggagaaatgggagaaggatgagaacgccaaattcgtcatctttaagggtgctgggcgtgcattttctgctggtggggacctaaagatgttttatgaagggaaatcaaatgattcctgcctcgaggttgtgtatagaatgtattggctttgctaccacattcacacgtacaagaaaaccatggttgctcttgttaatgggcttgtcatgggtggtggcgctgcaatggttgcgccactaaagtttgcagttgtcacagagaaaacaatctttgctactcctgaggctagtgttggattgcacacagattgtagcttttcctacatccattcccggctccctggatatttaggcgagtatctggctttaactggtgctagactgaatgcgaaggaaatgatttctgctggtcttgctactcattttgtcagttctgaaaaattggaagaacttgaaaaacgtctactggatttggacacaggtgctgagtctgcagtccgagctgttattgaagaattttcaacagatgttcaaactgatgaagatagtatattgaataagctttcaactatcaacaaatgcttctctgcagagactgttgaggatatcataaaagcatttgaatcagaagcgagcatagacggaaaccaatggatagctccagtcctaaagggtctgagaagatcatctccaactgcactgaagatcaccctgagatcgatcagagaaggtcgaaaacagagtttgcctgaatgtttgactaaggaatttaggcttacaatgaatatactgcggtctgttgtcaatggggatgtttatgagggcattagagctcttagcatcgataaagacaatgcccctaagtggaatcccactacccttgaggaggtgaagtacgaggacatcgaccgtctgttccagccgttcagtccggagctggaacttcaggtcccatctgatgattccaacaggtggagcggcaaatacgagaacacggtctatggcagagcttcccagtgactgtatacaagatcccccagccttttgttattttcatccgaaccactgcattacggaatattcagtttgcggcacgtgtgtatttcgagtgtttgtgtagcgcgacgttccaatgtatgaactgttgcaaaggttacacgatgacatgaagtttgatccaacaccaaaaccatctattagatgggaaagttctgcactttggatgttaaaacgccaccccccccctc

SEQ ID NO: 8216 - DNA, 1717 bp, Zea mays
ctctctctcgtctcgaccgaatgtttagtacagtacggaacagccgggtcgttctgataatccgggtgttgggcacggggttacgggcagccgacataccattcacgcgcctcctccagtgtcgctatctccagcccccactccctttccccgtcccgagctcgagcgcggacgcacgcacaggcacagtcgcacactgacacgaacgcggcgaatcccagcgtcggcgaaatctgcggccttttctctcctctgcaggccgtgggcagtggcgccgccgcgcgatggggtcggtgtccctgaacgtggcgtcatcccggcgcggcgggcggcgcctggcgtggctgtgctcgtccgcgctgctcaacctgctcgtgctgctctccctcctctccaccaacctcctggcgctccgcgcctttctctccccccgcgcgcactccgtccccgccgccggcgccgccaacctctcctcctcctccgccgccatctccgcgcaggtggccgccatcgcgcgggagatcgacgcgacccgcctcgtcccgcgccacggcggcggcgccctgcccccggagctgctcctcttcctgtccccgcacgcgctcccgctgggccgcgacgcgcgcacggggctcacccacatgccggcctccgtggcgcacgcctgcttccgctccccgcccacgctggcgctcctggccgccttcgccacctacacgccccacgccgcctgcccgcggcgcaacgccacgctcccgcaccgcctcatctccaaggcctgcgagccgttgccccgtcgccgctgcctctcccgtggcccgcgcgccgcgctcccggcctccaacatgggcgtcgacagccaccgctgggtgaagccgcgccacgaccacgagttcctcatcgacgacgtcctgcgcctcgccggcggcggcagcaagatccggatcggcttcgacgtcgccggcggcgccgccaacttcgccgcccggatgagggagcgcggggtcaccgtcttcaccacggtgctcgacagcgccgggaagcccatgaacgagttcgtggcggccagagggctgttcccgctgctgctctcgccggcgcaccggttcccgttctacgacggggtgttcgacctcgtgcacgtcgggaccaccgcgctggccgaaggagggtcgccagcgctgggtcaggccgggacggaggaggcgcttgagttcttcatgtttgatgtcgaccgggtgctgcgcgcccgtgggctgctctggattgacagctacgtgtgccacagcgatgaacggaggcagctgctcgtcaggctaattggtaggtttggttacaagaagctcaaatgggtaacgggagagaaggccggaacagggagcgcaaagccggcgatgtacctctctgcagtgttggagaagccggcacgaagttgaaatcaaatgaatggagtggatggatcatgtaattggctgttgttagcctgttaggtagttgttgctcaactggcagattgcagtgatgtgctgctattctcattcaagcagagaaggaaagcaaaggagggccctttgagctatttgttcatgttatctatctaaaactattcttttgctgtcagttatagtgtatggcaccagcaccatttcttcaaaaaaaaaaaaaaatgttaagtatgttcgcttgactttaattcgtattagtttttactgtttct

SEQ ID NO: 8217 - DNA, 1872 bp, Zea mays
gaagccttatgggttcgaggcatctctatcgctgaacactgggaccaacgacctctgaaaccctaaccaaataaacccaccgttcgaaatcccgaaaggccaaaaccctcctccgacccttcccgccgccgccacccccaccccgaccggcaccaccacctcctcgctccacctccgtccgccgtcgccgcgatggaagacgacccgtcgcgccaggtgcgcgtgcgcttcgtcacgaagctgccacctccgctgcgggcgccgcccgctgccatcgccgtccccgcggacctcactcgcatgggcctctccgagatcgtcaacagcctcctcgcagccgccgagccggaccaccagtcgcagcccttcgacttcatcgtgcagggcgagctcgtgcggctgccactccaagagtttctcctcgccaagggcatctccgcggagagggtgcttgagctcgagtatgtgagagcagtggcgccaaggaagcaggaggaaccttgcccccatgaagactgggttagtgctgtggatggatcaaacccaggttttatattatctggatgctatgatggtcttgcaagattatggaaagatgcagcagtatgcacacaaattttggagggacacaatgatgcaattacttctaccagattcatcaataagggatctgaaaccgagggcagtctgcatgtagtgactggctcaaaggataggtcactgcggctatacaagtgtgatacatcagtcattatggactacccaaagcgggttggggcttacaaaattctccgtggccacacggcatcggttaaaagtatctccgcagacccttctggcgatatgctatgttctggatcctgggatggtaccatcaagttgtgggcagttgaaggatctgatgacgatgatgctgtttcattgaagaagagaaggatgaattctgactcatctggacctgaagagtctcagttagagggttcagccacttcaacacttctgggacatacacaaggtgtaactgctgttacctggcctgaacggaaaacgatatattcagcatcttgggatcattctgtgaggcagtgggatgttcaaacagtgaaagaaacatggaatatgttttgtgggaaggccttgaattgcttggactgtggaggtgagggttcttcattgattgctgctggtggctctgatcccgtgttgagggtatgggaccctcgcaaaccgggaacattagcgcctgtttttcaattctcctctcattcaagctggatcactgcttgtaaatggcatccgagttcttgtttccatttggtgtcttcttcttttgacgggaaagtgatgttgtgggatctaaggacagcatggccgctggcgtctgtggactcgcatgaagataaggttttatgtgcggactggtggaaaggggacagtgtgataagtggcggagctgattccaagctatgcatctcatctggcattcaaattgtgtgatgaagttcttccttgtgcttctcgagtccatgctatcgagattatatgggttgacaaaccatttccagaagccaaataatgtcagatatgtctgtgggaagatatgcaacccttcagtcaagatcaagatacggcacatggttttgccagatatgtatgcagaagtgcatttcttgcataagtaagatccaaagcaattgataactatatcttgctcatcaactttttgtgtgtgttcaggtgcgtttggcaccaatattactctattattccaagaccatgaattaatagttgtagtctgggctgactgcctctgtttatgctctataacccgggcgattggcgcggccgcagcctggtataaactaacctaac

SEQ ID NO: 8218 - DNA, 1249 bp, Zea mays
  misc_feature (1034)..(1034): n is a, c, g, or t
  misc_feature (1145)..(1145): n is a, c, g, or t
  misc_feature (1217)..(1217): n is a, c, g, or t
  misc_feature (1227)..(1227): n is a, c, g, or t
cattgggtacctcgaggccggccgggaatccatctttatccccacgtgtgttatccttctcccgcccggggcctcgattttgtgggtggcggtgagctcctgccgccctgcttcgcaatcttcctgcacctcgacaacgacgccgtcgaccctcgccgctcgccgccaccgcggtctcacctcatcagcttgtggccgccacggaacgccaccgacaagcaccaggtgagcgcgagcagtctttgtccggtcggcgatgcagaccctccgccccgcgcccgcctcctttctcgtgccgcccgctccgcagctcctccgcacagcgccgccaccagccccgagagcaaacgctgctgctcttgccgcggtgtcgcacgggcggttcccctcgccgcaccgcgcctgccggcgccgtcgacgcgtgacgaggccagcgtcgtccggtgctagcgccaccgtggcctccgtggatgacgcgaagaaggacgtgctcatagcgctctcccaaatcatcgatcctgatttcggcacggacatcgtgtcctgtgggtttatcaaggatttggaggtcagtgaggccttggaagaggtctcatttcgtctggagctgacgactcccgcatgcccaatcaaagacgagttcgaacaaaaggcgaacgaggtcgtcgcagcacttccatgggtcaagaaggtagacgtcacaatgtcggcacaacctgcacagccggtatatggaggggagcttccagaagggctacagaagatttccaacatcatagcagtttcaagctgcaagggaggggtagggaaatcaactgttgctgtaaatcttgcctatacactagctggaatgggcgcccgggttggaatcttcgatgccgacgtctttggcccaagcttaccgactatggtttctcctgaaaaccggttgctagtgatgacccccctttgcaaccctattcttccgaccgagtatttgggcgtcaaaatggtgtccttcgggtttgctggacaaggaagggcgatcatgcggngtccaatggtttcaggagtcatcaatcagctgctgaccactactgactggggtgaacttgactaccttgtcatcgatatgcctcctggaacaggcgacatacacttaacanctctgtcaggtggctccattgactgccagcagtgattgttaccacccctcaaaagtggcttttcattgatgntgccaggggnagtaaggatgttctctaaactg

SEQ ID NO: 8219 - DNA, 1440 bp, Zea mays
cattgggtacctcgaggccggccggggaactgttgctgtaaatcttgcctatacactagctggaatgggcgcccgggttggaatcttcgatgccgacgtctttggcccaagcttaccgactatggtttctcctgaaaaccggttgctagtgatgaacccagaaagcaaatatattcttccgaccgagtatttgggcgtcaaaatggtgtccttcgggtttgctggacaaggaagggcgatcatgcggggtccaatggtttcaggagtcatcaatcagctgctgaccactactgactggggtgaacttgactaccttgtcatcgatatgcctcctggaacaggcgacatacacttaacactctgtcaggtggctccattgactgcagcagtgattgttaccacccctcaaaagctggctttcattgatgttgccaagggagtaaggatgttctctaaactgaaggttccttgtgttgcggttgtagagaacatgtgctattttgatgctgatggaaaacgttattacccatttggacaaggttctggaactcaggttgtgcagcagtttggaatacctcacctctttgatttgccaatacggccaactctttcggcttccggagatactggaattcctgaggttgtggctgatccgcaaggggatgtggctaatacatttcagaatcttggggcatgtgttgttcaacagtgtgctaaaatcaggcaacaagtttctacagcggtgtcctacgatagatccattaaagcaatcagagtgaaagtgccagattcagacgaagagttcttgctgcatccagcaacagttagacggaatgaccgatccgctcaaagcgtggatgaatggacaggggagcagaaggttcagtacagtgacataccagatgacatcgagccagaagagattaggccgatgggaaactatgcagtttctataacttggcctgatggatttagtcagatagcaccttatgaccaattggaaatgctggagcggttggtggaggctccgagtccagcagcagcgtctgcagtggcctcgtcatgatacagcagaaagaatgttcagttagcaaggggcaagaaggccgacttttagctcccagaaaatttatagctctgctacaaattttgaaagaattttacagtactgtagaaccatgctcattgaattttaaaaaaaggcagcagctttcgttcctcttaagccattgtgcagacccccgttctcactaaaccacaggctagccttgacaataccaaaccataaaagaaaacggttactgttataaagatagttttttttcccagttatatagaaaattgatataaaactagtgacaaacagaaggtgcatgggtggatctaatatgtttgttacatatgaatatagtgaatacaagtattattgataaccattgc

SEQ ID NO: 8220 - DNA, 1229 bp, Zea mays
  misc_feature (28)..(31): n is a, c, g, or t
  misc_feature (34)..(36): n is a, c, g, or t
taccctcgaggggccggccgggaaaaannnnaannnaaaaaactctacatatacccagcgcccttagccacgaacgcagtatccacattctcacattccatcccgcctctagatctgtcagctccttacacaaatcgtctaatgccatctttccaacacaatcgagattggcatcggcatgggtgcatggaggaactccataaatcgctttccatcgtcttattcatcacttgtatagctggagctgtagcataccctgatcgttctgaattattgtcccacaagacaaacccacagccacaggatttcccaagtgagcagctatatcgttcctacgtggtaatccagcgcttcaagagcaccattaccagcgaccccaagaacgtcaccgcaacctggatcggcaatgacatctgcggagaaacgacctacgtgggtttctactgcggagtactgcctgggcaaggtaacaacctgacagtaacggcggtccttttgaatgggtatagactacatgcaccgaagctgcaagggtttatagatgagatccccgatctcgcgctttttcatgctgcttccaacaattttggtggtggcattccacgcgtcgttggcctcgggtatttttataagctgaatgtcggagttgagcttccattacacactacggtatatgggttgactgtcggaagtagcccagcggcttcgattccttatgcttgcgtaactactgccctaaacttcacatttagtataggaactgacggtgctaaaggacgaaaatttcctggtgttacggatgccaaggccctccttctcaatcacaatagcctgtctggggcacttccggcggacttggctattccaggtgagctacctagctctggctaacacaggctgacagggccaatcccgcagtcgattggccacctccaggattccctcttcgagatgctcctcctcaacaaccagctttccggatgcctcccgcacgagctcggcatgctcaccaaggccgtcgtgatcgacgccggaatgaaccagctcacgggcccgatcccgtcatctttctcgtgccttaccagcgtcgagcagcttaacctggccgggaaccggctttacggtcaggtgcccgaggcgctctgcatgctcgccgggcctgtcggacgtcttaccaaccttacgctgttcaggaactacttaacttcgtggctccggcgtgcgcagca

SEQ ID NO: 8221 - DNA, 1757 bp, Zea mays
tccgattgacagttttttgttttggtcgggaatgggacgaaagatatgaaatgatgattagcggagccggagagccgaatcaaatctattaaccggtggcgctggaagggagttccctcgaggccggccggacattccatcccgaacctccagacctgtcagctccatacacaaatcgtgtaatgctatctttccaacacaatcgagactggcatcgtcattattggtgcatggaggaactccataaatcgctttccatcgtcttattcatcacttgtatagctggagcggtagcatactctgatcgttctgaattattgtcccacaagacatgcccacagccacaggatttcccaagtgagcagctatatcgttcctacgtggtaatccagcgcttcaagagcaccattaccagcgaccccaagaacgtcaccgcaacctggatcggcaatgacatctgcggagaaacgacctacgtgggtttctactgcggagtacttcctgggcgaggtaacaacctgacagtcacagcggtccttttgaatgggtatagactacatgcaccgaagctgcaagggtttgtagatgagatccccgatctcgcactttttcatgctgcttccaacaattttggtggtgacattccacgtgtcgttggcctcgggtatttatataacctcaatgtcggagttgaccttccattacacactaccagatatgggaattcgatgactgtcggatctaatccagtggttacgctgcctcctatgtgcgtaactactaccctaaatttcacatttagtattggaattgacggtggtaagggacgaaaatttcctggtgttacggatgccaaggccctccttctcaatcacaatagcctgtctggggcacttccggcggaccttggctattccaaggtgagctacctagctctggctaacaacaggctgacagggccaatcccgcaatcgattggccacctccaggattccctcttcgagatgctcctcctcaacaaccagctttccggatgcctcccgcacgagctcggcatgctcaccaaggccgccgtgatcgacgccgggatgaaccagctcacgggcccgatcccgtcatctttctcgtgcctcaccagcgtcgagcagctcaacctggccgggaaccggctctacggtcaggtgcccgaggcgctctgcaagctcgccgggcctgccggccgcctcaccaacctcacgctgtccagcaactacttcacttcggtggctccggcgtgcgcagcactgatcaagaacggcgtgctggacgtgaagaacaactgcattcctggcctcgccagccagaggcgccccgcggagtgcgctgcgttccagagccagccaaagacgacgtgcccgccggagagcaccctggtggcatgccccgccgcagctgccatggacgcggcggccctcggggagaggaaagtcagggactactccagctacgtgacgtacgctactctgcatgactgagccggcgccacatcggcatgcagtaggaaacagagttccttgctgtcattttggctatttgttcttgtattcatgatgcgtgtgcactagtgtgtgttgtgattgttgtctatttgcattgcacgtgtgttgctgtcacatctagatcgtccatttgaactgccatgtccattatttcatgaaaaaagttgttggtgctttaataaagttgtaccttagttatcttcaaaaaaaaaaaaaaaa

SEQ ID NO: 8222 - DNA, 1792 bp, Zea mays
ccggccggcagcactgcagcaatcacagacagacacgagcaagtgtgagtgaggaggtttgcctgcccatctccatcggccatcgctgcctccccagtccccacatccgcacacatttttacccctcgcggcggccccaccgaccgccggggcgcagcggcgtcgccgcgggcaacgccgtcacgtcacgtgcatcacgacaatctcctcctccgcctcgtcttcctgccaggccgcgggagcaccagcccagcggcagatcagtcgaggcgggcgattccagggtttagagaggagcggagatggtgaaggtcatccaggggcgcccggccgagatggggttccggatgccggcggagtgggagccgcacgagcagtgctggatgggatggcctgagcgtccagataactggagggagaatgctggtccagctcaagaggtatttgctagaactgcaattgccatttcaaagtttgaacccgtcacgttatgtgcaagtgccaagcagtaccccaaagtccacgagctgatggaacatcaaaccaacatcagggtcgttgagatgagcatgaacgattcctggttccgcgacatgggccccacttttgtcacctcataaaggggattcaggaattgcagaacaaacaatagcaggaattgattggcaattcaatgcctggggaggaatctatgacgactggagtcttgacagcgatgttgccaagaaaatagtcgagatcgagaggatccctaggtttccccaaaaaattatccttgagggtggaagcattcatgtagatggagaaggtacatgcattacaacggaagaatgcttgctgaatcctaataggaaccccaacatgaccaaactagagatagagaatgagctgaaggattttcttggagtctcgaaggtcatctggatacctcgtggactttatggtgatgaggatacaaacggccacgttgacaacatgtgctgcttcatcaaacccggtgtgatcctgctgtcgtggaccgacgacgagaaggaccatcagtacgaacggtcggtcgaggcgctgtctgttctctcccagtccgtcgacgcgaaagggcggcagctccaagtggtgaagatccacgtccccgggcctctgtacatgacagaggaagaggcacagggcgttgtttcatcggggcattctgtgccgaggccagcgggcacgagattggccgcctcgtacgtcaacttctacatcgccaatggtgggatcatagcgccttccttcggcgacaggtgggacgaggaggcgtatgcggttctccagaaggcgtttcctgatcacgaggtggtgatggtcgaaggcggacgggagatcgcgctgggaggtgggaacattcactgcatcacgcagcagcagcccgtgcgcccgtcctaggtgaaaccggcgtcgacgcgaagcgatgaagagtatgctgctcctgtgtttagtatgctgctcctgtcgttatcacgctcaccaatacgctcgcgaaataagccacgccagcagttcgttgacacatactgtatgagtactattatactatacggcacaaacggccaaacgccacacaggcgtggatcaaaattgtactagttcctgtctacaattcgtggcctttatcatcctgattggctgcccgtatattatttatcttaagtcatctatattcttatcttaagtcattacgtgcgttaactttgtcatagtatatattttgtcatgcggggttctacagtggacacaatataagttattttaaaat

SEQ ID NO: 8223 - DNA, 1751 bp, Zea mays
actgcagcaatcacagacagacacgagcaagtgtgagtgaggaggtttgcctgcccatctccatcggccatcgctgcctccccagtccccacatccgcacacatttttacccctcgcggcggccccaccgaccgccggggcgcagcggcgtcgccgcgggcaacgccgtcacgtcacgtgcatcacgacaatctcctcctccgcctcgtcttcctgccaggccgcgggagcaccagcccagcggcagatcagtcgacgcgggcgattccagggtttagagaggagcggagatggtgaaggtcatccaggggcgcccggccgagatggggttccggatgccggcggagtgggagccgcacgagcagtgctggatgggatggcctgagcgtccagataactggagggagaatgctggtccagctcaagaggtatttgctagaactgcaattgccatttcaaagtttgaacccgtcacgttatgtgcaagtgccaagcagtaccccaaagtccacgagctgatggaacatgaaaccaacatcagggtcgttgagatgagcatgaacgattcctggttccgcgacatgggccccacttttgtcactcataaaggggattcaggaattgcagaacaaacaatagcaggaattgattggcaattcaatgcctggggaggaatctatgacgactggagtcttgacagcgatgttgccaagaaaatagtcgagatcgagaggatccctaggtttccccaaaaaaattatccttgagggtggaagcattcatgtagatggagaaggtacatgcattacaacggaagaatgcttgctgaatcctaataggaaccccaacatgaccaaactagagatagagaatgagctgaaggattttcttggagtctcgaaggtcatctggatacctcgtggactttatggtgacgaggatacaaacggccacgttgacaacctgtgctgcttcatcaaacccggtgtgatcctgctgtcgtggaccgacgacgagaaggaccatcagtacgaacggtcggtcgaggcgctgtctgttctctcccagtccgtcgacgcgaaagggcggcagctccaagtggtgaagatccacgtccccgggcctctgtacatgacagaggaagaggcacagggcgttgtttcatcggggcattctgtaccgaggccagcgggcacgaggttggccgcctcgtacgtcaacttctacatcgccaatggggggatcatagcgccttccttcggtgacaggtgggacgaggaggcgtatgcggttctccagaaggcgtttcctgatcacgaggtggtgatggtcgaaggcggacgggagatcgcgctgggaggtgggaacattcactgcatcacgcagcagcagcccgtgcgcccgtcctaggtgaaaccggcgtcgacgcgaagcgatgaagagtatgctgctcctgtgtttaagcaggtgggttggtcccctgtcgttattacgctcaccaatacgcgcgcgaaataagccgtaggtacaagttccttgacaaatactgtatgagtactattaggccttgttggtgggtcggaacgattcctaaccgaattgtttatctaatttatataaattttgattagctggaacgattccgggtgtaatccgatagaaacgaacaaggccttatactatacggcacaaatgccacagtcgtggatcaaaatggtactagttcctgtctacgaaaaaaaaaaaaaaaa

SEQ ID NO: 8224 - DNA, 1824 bp, Zea mays
taccctcgaggccggccgggaaaaaaaaaaaaacagacagacacgagcaagtgtgagtgagcaggttcgcctgcccatctccatcgaccatcggccatcgctgcctccccagtccccacatccgcacacatttttacccctcgcggcagacccacgaccgccggggcgcagcggcgtcgccgcgggcaacgccgtcacgtcacgtgcatcacgataatctcctcctccgcctcgtcttcctgccagcccgcgctatataaagcgggccgcgggagcaccagcccagcggcagatcagtcgaggcgggcgattccagggtttagagaggagcggagatggtgaaggtcatccaggggcgcccggccgagatggggttccggatgccggcggagtgggagccgcacgagcagtgctggatgggatggcctgagcgtccagataactggagggagaatgctggtccagctcaagaggtatttgctagaactgcaattgccatttcaaagtttgaacccgtcacgttatgtgcaagtgccaagcagtacccgaaagtccacgagctgatggaacatcaaaccaacatcagggtcgttgagatgagcatgaacgattcctggttccgcgacatggggcccacttttgtcactcataaaggggattcaggaattgcagaacaaacaatagcaggaattgattggcaattcaatgcctggggaggaatctatgacgactggagtcttgacagcgatgttgccaagaaaatagtcgagatcgagaggatccctaggtttccccaaaaaattatccttgagggtggaagcattcatgtagatggagaaggtacatgcattacaacggaagaatgcttgctgaatcctaataggaaccccaacatgaccaaactagagatagagaatgagctgaaggattttcttggagtctcaaagtcatctggatacctcgtggactttatggtgatgaggatacaaacggccacattgacaacatgtgctgcttcatcaagcccggtgtgatcctgctgtcgtggaccgacgacgagaaggaccatcagtacgaacggtcggtcgaggcgctgtctgttctctcccagtccgttgacgcgaaagggcggcagctccaagtggtgaagatccacgtccccgggcctctgtacatgacagaggaagaggcacagggcgttgtttcatcgggacattctgtgccgaggccagcgggcacgaggttggccgcctcgtacgtcaacttctacatcgccaatggtgggatcatagcgccttctttcggcgacaggtgggacgaggaggcgtacgcggttctccagaaggcgtttcctgatcacgaggtggtgatggtcgaaggcggacgggagatcgcgctgggaggtgggaacattcactgcatcacgcagcagcagcccgtgcgcccgtcctaggtgaaacccgcgtcgacgcgaagcgatgaagagcgtgcgagtagtattagaccttgttcgtttctaccggattgatgggtcggaacgatttctgaccagattgcttctctaatttatataaactttgattagctgtaacgattccgggtgtaatccgacggaaacgaacaaggccttattgttttgtttgctgctcctgtttttaagcaaaaaaaaagctctctgctggtgcccctgcttttaggggcgattcacagcactctggggcgcgtctctaggggtcccgctctgggcccaaatcgtggggatttaggcccataggtgttccctgtgtgaatgtgttatcccttcaaattcccccacaatatacg

SEQ ID NO: 8225 - DNA, 1569 bp, Zea mays
ttgggtacctcgaggccggccggggaaaaaaaaaaaagcggcagatcagtcgaggcgggcgattccagggtttagagaggagcggagatggtgaaggtcatccaggggcgcccggccgagatggggttccggatgccggcggagtgggagccgcacgagcagtgctggatgggatggcctgagcgtccagataactggagggagaatgctggtccagctcaagaggtatttgctagaactgcaattgccatttcaaagtttgaacccgtcacgttatgtgcgagtgccaagcagtacccgaaagtccacgagctgatggaacatcaaaccaacatcagggtcgttgagatgagcatgaacgactcctggttccgcgacatggggcccacttttgtcactcataaaggggattcaggaattgcagaacaaacaatagcaggaattgattggcaattcaatgcctggggaggaatctatgacgactggagtcttgacagcgatgttgccaagccgggagtcgagatcgagaggatccctaggtttccccaaaaaaattatccttgagggtggaagcattcatgtagatggagaaggtacatgcattacaacggaagaatgcttgctgaatcctaataggaaccccaacatgaccaaactagagatagagaatgagctgaaggattttcttggagtctcgaaggtcatctggatacctcgtggactttatggtgatgaggatacaaacggccacgttgacaacatgtgctgcttcatcaaacccggtgtgatcctgctgtcgtggaccgacgacgagaaggaccatcagtacgaacggtcggtcgaggcactgtctgttctctcccagtccgtcgacgcgaaagggcggcagctccaagtggtgaagatccacgtccccgggcctctgtacatgacagaggaagaggcacaaggcgttgtttcatcgggacattctgtgccgaggccagcgggcacgagattggccgcctcgtacgtcaacttctacatcgccaatggcgggatcatagcgccttccttcggcgacaggtgggacgaggaggcgtacgcggttctccagaaggcgtttcctgatcacgaggtggtgatggtcgaaggcggacgggagatcgcgctgggaggtgggaacattcactgcatcacgcagcagcagcccgtgcgcccgtcctaggtgaaaccggcgtcgaggcgaagcgatgaagagcgtgcgagtaggtgggtcgttggtcccctgtcgttatcacgctcaccaatacgcgcgcgaaataagccacgcccagcagttcgttgacaaatactgtatgagtactaatgtactattatactatacggcacaaacggccaaacgccacacaggcgtggatcaaaattgtactcgtggcctttatatgcaccggcgctgcggtgtccgatgcaactgtgagcggcggctggttggctcggtgcgtacagcgccgatgcacctagggcgttgattaatccggccaaggccacccacccgtatgcagttggatgtgagacacggctctcctc

SEQ ID NO: 8226 - DNA, 1551 bp, Zea mays
ggcagaagggcaaaactttatcgggtccggatacattttacacatgacgattcgttacaccgggatgggccggcgcggagcggcgggactctcatttacacaggtctgctggaactgatctcggatcggagcactgcttaagctagctactactcactgataattttaactaaagacaccgctaatcccaggccaagcccatggttcttggtctcacacggaggaagggggagcctaggcgcggcggcggcggcggcggcaaaccggcgaagcgagcgagttcacatgacggagcaggcgttggggttctcgtcgctgaacatctggggcgcgtggaggtgggtggggccgtacgcgtaggctggcgcgggcgggtaatggacgccgccgccgttggggtagaagccggcgtggtggttgggcggtggggcggcaccgtagtagccgcctggagccggctggtggtacggcgcgtacccgtagtgcggcggcacctggtacatgccggcgtcggccaggggcggcggcgccaccgacgcggaggcggccgcggccccggccttgtccttcttctcctcggccccgccgccgccgccgccgccaccgtccttcttcttctctcccccgtctcctgcgcccttgtccttcttgtcaccaccgccgccgccgccgtccttcttgccgggcgccaccacttccacgtcccggctgagcttctccctgaggtacgccggcagagcggcgccgtccatggtgccggtcaccttcaccaggtccttggcggcgtcgaacgccacgtccttcacgcctttgatcttggagatgcggcgcttgatgcgctcgatgcagccgtcacagtgcagccggatcttcagcgtcacagtctcctccttgggcttcttcttctcctccttgggcttgtcggcacccttctccttgtcggccttcttctcgccgccgcccttctccttgtcggccttcttctctccgccgcccttctccttgtcggccttcttctctccgccgcccttctccttgtcggccttcttctctccgccgccgccgcccttctctttgtccgccttcttctcgccgccgtccgctttcttatccttctccttatccttgtccttctccttcttgggtgggccggcgccggcggagacgatctgcacgggcttcttcgccctggcctcgatgcgctccttgagctccaccgcgtccgccggaccggtcacgaccaccttacccgccgccatgtccggcgtcaccgactccacacctggggcgtgcttgatggccttgcggaccttgttggcgcagccggcgcagtgcaagtcgaccttcagcacgatgggctgcggcgcggccccggcgccggcgtccttcttcttgtcgccgccggcggcgtccttgttgcccgccttcttgtcctctcccatggcggccggcctttgtctgtctcgtcgacctgtctctgtggcggggcggggggcggttaccgagggcgctgggcgccgcggagttcgaggtggaaggctggggcgttct

SEQ ID NO: 8227 - DNA, 560 bp, Zea mays
tgatcttgaaaccacaccttcagtaaattgaggttctcttggtgtggtcggttagctctcaatccatgtggattgagtgtgattgggtgggttcaaatctcaaacaagtcaaagttcttctaaattttttccaatcctatccaatccatgtataatgggaataaccgaacaagacctaacagggatccagccccgctcggtcctagcttgtcgtgcagacaatccgaattcatggcatgaaagcaacctatgtacatgtcgttctagggcttcagtatcatgatgcgcatgttgtttctttccccgccgtttgcttgtttagcatcagtggtccttatttagtcatctggcaaacggtttggttttgtttgctgcaggtgatgcatagtaagcttgtaaatggagttgcttctctttattttctagtcatcttttatcatgaagtagatgtggcattctgatgaaagatggttgtacatattgagatgtgctgttgtggcatatatgaaatattggcatggtgtggatggtatatacgaaagttgtgcttgcttaatcag

SEQ ID NO: 8228 - DNA, 1693 bp, Zea mays
catgctgtaccgaaaacacttcagctacggatcgggctttgcggacggcaagtcagtagagtagtaaacaattagtggttgcagtactagcagcgaaccgtccatcccgcgggagtatttgcttgggcctgcctgccgattggaacgcgcgcgccaacgggcaggccgccgcgcggcatcgcatcgcatcgcgagcgtcacctcactctggtcaccatccgctgccctcgccggccgcgttcgacagcaacgtagaccgattggtggctccgtcccagggacgtgtgctattatagctagtgtttctccacagtatctctcggagattcttgtgtagttttccagcgcagccgaaacttaactgatggtgtagtaggaccccgaacccgaacgaatccaattattgatgggacgacggctaacacgccagcgacgtccttaaatcctcgcgtctgctttccctttctcagcctttaccccaggacgacgagccgctcgctgactggttacttattactagtagcctctctggtcctggtgcatcctcgcggaactcacaagtcacaaggctccactccaccctcctgcgcgcatggtgaccgcagcagcagcagcctcctctccccgcagcatgctccgcttcgcattgaccgcctcgtcgtccggccgccaccgaacgtgagtacgtggctctcgtccgccgtcaccgccagcggatcgccgcgaggtctagagcccccccgcctctgcagccagccggcgctcgcgatgcctcctctggcgccgccgcacggtgagaagggcggcaggcagcggcagggggcggcggcggccccggccccgcccccggccccggcccagcggtcggcgtcgttccacgggcgcgggacggagcagcggcaccaccagccgcagaagcagaggcccaagacgctgcccgacctgctcgccggcgtccggggggcgagcttccgctccgggtccccgcccccggacggcgacgcggggcggaggacgccgagcaaggttctggtcagcgtggcggtgcagcagagcatgtggccgctgcacgtcatggcgcccgccgagtggaccgtggcggacctggtggcggccgccgtcgcactctacgtcaaggaaggccgccgcccgctgctgccgtcgaccgacccggccgccttcggcctccactactcccagttcagcttggacagtctgaacccaaaggagaaaatcatggaactaggcaccaggagcttcttcctgtgcccaagatcttgggctgccggtcaggacgcttcgtcgtcctccggcacagcgaacggggtcaccagtgcggcatcagggaaaacaccggcctggcttagctacttgccgttctggccgaccatgtgatcggctagcacacgcacaccccaaactcttccaggtcctaaagaatctccaagtattgcatttgtgagacagatggctacaaggacattgtaaatgtatatgttttggagtttgtaagcatcttgaatggtgcacgtgcgatcctgcaaatcatctgtggcccatgttacaacccacagattcagggaaaaaatatcgaatgattatgtaattaaaaaaagtttaaaacagttttaatggcgaaaaattgttgtggtcatcttgttcaaaaaaaaatgcgagcggcccacaacacaat

SEQ ID NO: 8229 - DNA, 1168 bp, Zea mays
gctccgtccccgccggctgggtcggaacgtccacgtccaattgtgtcctactccttcggtccgtccccatttcttcctttccttggcctcgactcctcccgacgtgatcgctccagagaaaatttcgcgggtttagacaaacagcgattgggatcgagatcggggcaacatgagcaaggtgttcgagggctacgagcgccagtactgcgaggcgtccgcctccctcacccgcaaatgcaccgccgccgccgccctacagggagagaagctgaagcagaaggcggcggagatccaatccggcatcgatggcgctgaggcactgataaggaagatggatcttgaagcaagaaacctgcaaccaagcattagagctgatctcctagtaaagatcagggagtacaagtcagatcttaataaccttaagggagcgctgaagagggttactagtattaatgcacaacagggggcgagggaggagttgttggagtcaggaatggcagatacattgggggtttctgctgatcaaaggtcaagattgctcagggcaaccgagagacagaaccaaacaactgataggctcagagatagccatagaactatgctggagactgaagaacttggtgtctctatcctgcatgacctgagtcaacagcgccagtctctcttgcatgctcatgatgtattggacgaagtggataacaacgtcggcaagagcaggaggaccattggaggcatgatgaggagaatggatagaaacaagtggatcatcggtctcatcatagcagttcttgtcttggctatcctcgtgattctgtatttcaagttcgtgcactagtggattgcgttgcgtacgttgcatggacggtacgtagttttctactgcgaccagaacgaagaggaaggcagctgtgaatttgcttctatctacattttgcgatttcctgtatttattttcagttttctatttctttttaaatcatatttctgggggtgtgctcgtacggtaccggatgtgttgtgtgaggaaacaagttcaggccatgacgcagagttttgtatatctgattggtttctatttaaaagaaaaactgaacggataatcaataactaagcatatttgggtaatttgctgcaaaaaaaaaagaaaaaaaaagtcgacgcggccgcg

SEQ ID NO: 8230 - DNA, 1113 bp, Zea mays
tcccgtcgtgatcgctccagagaaaatttcgcgggtttagacaaacagcgattgggatcgagatcggggcaacatgagcaaggtgttcgagggctacgagcgccagtactgcgaggcgtccgcctccctcacccgcaaatgcaccgccgccgccgccctacagggaggtaatcctccacccctcccaaatctcttcgttttctagaagcaacctcaatctcggtaggctctccctccgaatcgtctcttggtaaaatatttggtcgcgcagagaagctgaagcagaaggcggcggagatccaatccggcatcgatggcgctgaggcactgataaggaagatggatcttgaagcaagaaacctgcaaccaagcattagagctgatctcctagtaaagatcagggagtacaagtcagatcttaataaccttaagggagcgctgaagagggttactagtattaatgcacaacagggggcgagggaggagttgttggagtcaggaatggcagatacattgggggtttctgctgatcaaaggtcaagattgctcagggcaaccgagagacagaaccaaacaactgataggctcagagatagccatagaactatgctggagactgaagaacttggtgtctctatcctgcatgacctgagtcaacagcgccagtctctcttgcatgctcatgatgtattggacgaggtggataacaacgtcggcaagagcaggaggaccattggaggcatgatgaggagaatggatagaaacaagtggatcatcggtctcatcatagcagttcttgtcttggctatcctcgtgattctgtatttcaagttcgtgcactagtggattgcgttgcgtacgttgcattggacggtacgtagttttctactgcgaccagaacgaagaggaaggcagctgtgaatttgcttctaaaaaaaaaaatacattttgcgatttcctgtatttattttcagttttctatttctttttaaatcatatttctgggggtgtgctcgtacggtaccggatgtgttgtgtgaggaaacaagttcaggccatgacgcagagttttgtatatctgattggtttctatttaaaagaaaaactgaacgg

SEQ ID NO: 8231 - DNA, 1344 bp, Zea mays
  misc_feature (2)..(2): n is a, c, g, or t
  misc_feature (10)..(11): n is a, c, g, or t
tnctaatcgnnaaatccttctctcggctacctccaccactgctctgctcagctcgaacgaacaaaaagaactcccctcggccctctcctcttgtgcttctgcttccccaaccgagtctcctcaaccccaggcactcgccctctttcccctcgcctcggcccgcgactccgatgccgccgccgctcctcgagccgcgcgactacctcggcgccggcgccacctcgtcgtgctgctcgtcgtcctgctcctccggccgcgagggcgcggggccccacctcgcgctgcggctcgggcttccggggtccgacgactcccccggccgcggcgcggacgcggagcacgcccgcgcccacgtcgacgccgcgctcaccctcggccccgcccccgcccccgcccccgcgcctcccaggggcagcgccaagcgcgggttcgccgactccctcgaccggtccgcgaagcgggacggcgttgccgcggatgacgctgctgggggcgtcacacgggtagctgaagctgctgccggagctccgcccgctgccaaggcacaagttgttggatggccgcctgttaggagctaccggaagaataccctagctgccagtgccacaaagacaaatgggggagatgaaggtaggagtgaggcgggatgctgttatgtcaaggtcagcatggatggagccccatacctaaggaaggtggacctcaagacctattcaagctatgaggatctctcgcttggtctggagaaaatgttcagttgcttcatcactggtcaaaacagttcatgcaagacatcaagaagggataggcttactgatggttctagggctgatgcccttcaggaccaagaatatgtcctcacttacgaagataaagatgctgactggatgctcgttggtgatctgccctgggacttgttcaccacattttgccggaaacttaggatcatgagaggctctgatgctgctggcatggctcctccaagaccaccggaacagacagttcggaacaaatgagggcggacagcttacttacctggcgctgaactgaagggagagcgacgctgccttggtcaggccttctttcacttgtgcagtgggaactgcgtcctgctgtctcggacgcccattttgcccacgagctggtcgtcacgtgctgtcgctttttgtctgggaaagatagcgtactgcttgctgtatgatactttcatctgtgttcggaagtttgtagcgcttcatatcctggaagggagtaaagaaaatgtccatgtgtccggtgagaatttcttccaaaaaaaaaaaaaaaaaacccctagggccaaaaaaaacaaaaaaaaaaaaacaa

SEQ ID NO: 8232 - DNA, 1443 bp, Zea mays
gcacgagacataaacaaggcaccacccagccgcaccatcgcctcctctcgggctagctccacactcctttgtcctctccaaacgaacgaacaaaaagaggccgcttccccacccagtcacctcgacctcagcccctctcccccctccctatctcgactccgatgccgccgccgctcctcgaggcgcgcgactacatgggcgccggcgccaccccgttgtcctgctcctccagcggcgagggcacggggccgcacctcgcgctgcggctcgggctcccagggtccgactcccccggccgcgacgcggggccggagccggaccacgcccacgtcgacgccgcgctcaccctcggccctgcccccgcccccgcccccgcgcctcccagggtcggcgcaaagcgcgggttcgctgactcccgcgaccggtgcgtgaagcgggacgccactgctgcggatgacgctgctgggggagtgaccggggaggagaagcgggtagctgccggccgctgccggaactccgccggctgccaaggcgcaagttgttggatggccgcctgttaggagctaccggaagaacacactagctatgagtgccacaaagacaaacggggaagatgaaggtaggagtgaggcgggatgctgttatgttaaggtcagcatggatggagccccatacctaaggaaggtggacctcaagaccttttcgagctatgaggacctttcgcttgctctggagaaaatgttcacctgcttcatcactggccaaagcggttcgtgcaagacttcaagaagggagaggctcactgatggttctagggctgatgcccttcaggaccaagaatatgtccttacttacgaagataaagatgctgactggatgctcgttggtgatctcccctgggacttgttcaccacaatttgtgggaaacttagaatcatgagaggctctgatgctgctggcatggctccaagatcaccggagcagatagttgggaccagaataaggaacgttgcccggcatgcagagtcgtgaactgaaaggaaaggacagagtttacatggcgctgaagggagcggtgtttttacgtgaagtgctccggttaagtctctctctctctctttttaacccccacatgtgcaatgagatgtgtgtggccctactgtaagacaccccattttgcccacgaggttgtcacgcgttattgtagatggtcgcctttgtgttatgaacgatcaaactcggtagtagcttgcttgctgcttcctctacgatactttcctccgtatttggaagctcgtacttcatatggtagaagtaagaaaaaatgcccatgttgcccattaagtttttttctctcgtgatgtgtgtgcgagcgaactaactattcagtggatctagaaagaatctgatcagtgagtctgtgtgccaaaaaaaaaaaaaaat

SEQ ID NO: 8233 - DNA, 1066 bp, Zea mays
  misc_feature (15)..(15): n is a, c, g, or t
  misc_feature (407)..(407): n is a, c, g, or t
  misc_feature (432)..(432): n is a, c, g, or t
ggcacgagcgacggnctccggctgctgaggaagctcgacttctggctctacttcttcagctacatgttcagtggcaccctgggcctggtgttcttgaacaacctgggacagatcgccgagtcgcggcggctcggccagacttcccacgctcgtctcgctgtcgtcttcgtttggattcttcggccgcctgctcccgtccttcttggactactactccgcgaagagcggctactccatctcaaggacgggatccatggcgtcgctgatggcgcccatgtccggcgccttcctcctgctcctcaacccgagccacttcttcctgtacctgagcacggccgtgatcggcacgtgcacgggcgccatcacgtcggtggccgtgtcggcgacgagcgagctgttcggggccnaagaacttcgggcgtgaaccacaancgtggtggtgagcaacatccccgtgggctccctctgcttcggctactccgccgcctacctctaccagcgcggggcgcggggcggcggccaccactgcgtcggcgccgcatgctaccgggagacgttcgtcgtgtggggcgccacgtgcgccgtcggcacgctgctctgcgccgtcctctacgcgcggtcgcgccgggaggctaccgggaccgccgccggatgatggagaagtaaggacgtcacgtctcgcccgcttagctaattgcctgccgtcatcgaggtacggtaggtggtactagctagcttagcacgcaggctagctccagaagtttgtcatctgagggccggcctgcgattaatcggtcatacacccatgacccatcaatcggccaagcatcatctgcctgtaggcgatgtgtaacttttgatccttgtttttttttttcactcttcgagtttctcttgactgatcccggtggaagggggtacagaaaaaaaaaattccttggtggaggctcatcatgacatgagtagatattgtgcagcaggttagccacctattttaatttgttattagtgcatatagttgcattttttttcgcccgtgcatgctctttgggtggtacatgcactt

SEQ ID NO: 8234 - DNA, 3252 bp, Zea mays
ggatgactcattctattccacaaaccaaacaaaaaagtgagaagtgagaagatggtggactagcttatttctcaaaccaacacgcaatataaaaacgttaatgagcctttatagtaaaaatatattaacatatgtctatatacacacttttgcatgctacaggagagagacatcatggacattgtcgccacttatgcctacagttacgggcgtctagctcactttgcatttctctcgctggtatggtgctagcacattgccattggtgtcaaaatgtttcacctccatatcagctacgaacgttgggagcatgagtagtgttactgatatacgaggagatatgtctacttttattaaatcctcctgttttttttattgcgctgcatgttccactcttattttatcttaattatacatggtatgtatgtttcacgttatctcagttaaacatgacacatagatatgctagcacgttgctgtacgtagtattgatcacgcatccaccgtgccgaaaggatcccgagcaaccaacggtctgaattctggagcgaggcagcacctcgttctgctcacaccgttggccgccttcctgtgatagcgtcggagcaggctgcttgcgtactcggcttaacagcaaaccacatatctggcttgcggccacatccatcgtagtcaggcattgaattgccggttcggctaaccaccggtgctgcatgggcattgggaccctcgaggccggccgggagcaccaccggagaaggacacgatgccttccccttcctccgcccactggctgagcctcgtcgggagcatctggctgcagaccgtcaacgggccgaacgcggacttccccgtgtactcgtcgcagctcaaggagctgaagcacatcacgcaggtgcagctcaacttcctggcgttcgcgtcggacgcgggcaagctcttcgggtggttctccggggtggcggcgctgtacctgccgctgtggctcgtggccttcgtcggcgccgcgttcggcctcgtcggctacggggtccagtacctgttcctggacagcgccggcctccggtactggcacctgttcctgctcacctccctggccgggaacggcatctgctggatcaacaccgtctgctacctcctctgcatgcgcaacttcggctccagcagccgcgtcgcggtgagcctcgccaccagctacctgggcctcagcgccaaggtgtacaccagcctggcggactcgatacccggcctggtggccagcggctccaaggccaagacctacctcctcctcaacgccgccgtgccgatgctcgtcgccgtcgcggtggcgccgtcgctcagggtggtccagctcaggagcgaggcgagcacggagtcggacgcggcattcctcgtaatgttcgccatcacgctcgccacgggagcctgcgccgtggtaggcagcatcgggtccacgtccggcagcggggggctgtcgtcgagggagcacgtgatcagcctcggcgtgctgctggccacccccgtactcatcccgctggcgctcagggtgcgagagagcctcaacaagatacgggccaccaagcgggagaacaggatccacgatctcggcgccgacgacgacgcgggcgctggcgcaggcgtcgtcgtcgacgtgggcggtgccggccccgagagcaaggagggagagggagacggcggcgtctcggagaaaccacgggaggagatcggcggcctccggctgctgaggaagctggacttctggctctacttcttcagctacatgttcagtggcaccctgggcctggtgttcctgaacaaccttggacagatagccgagtcgcgacggctcgggcagacttccacgctggtctcgctgtcgtcctcgtttggattcttcggtcgcctgctcccgtccttcttggactactactccgccaagtaagtgagaagcaaagcaagcattctgttcacacaccacttgctactagtatatatagttaatttgatcggtatcatcaccagtctatgtttttacaagtgttctctttaatcgtgctaactggccggtgtatatcattttcattgcattctcaggagtgggtactccatctcaaggacgggatccatggcgtcgctgatggcgcccatggcgggcgccttcttcctgctgctgaactcgagcgacttcttcctgtacctgagcacggccgtgatcggcacgtgcacgggcgccatcgcgtcggtggccgtgtcggcgacgagcgagctgttcggggccgagaacttcggcgtgaaccacaacgtggtggtgagcaacatccccgtgggctccctgtgcttcggctacctcgcggcctacctgtaccagcgcgcggcggggggcagcagcagccaccagtgcatcggcgccgcctgctacagggacacgttcgcggtgtggggcgccacgtgcgccgtcggcacgctgctctgcgccgtcctctacgcgcgcggtcgtcgtcgccgcgcagctccgccgggagaagtaataaggacggcacgagcctcgcccgcttagctatagctgcctcgtgtctgccatcgtaggtgcatggtactacgtagcagggctagctagctgcagaagtttctgatcgatctgagggcttcagaagaagtttctgatctgagggcctgattaatcacacaccacccatcgatcgaccaagcatcatctgcctgtagggctctacagatgatgatgcttttgatctttgcttcttctctttttttagtgtgtgtgtgtgtgtgtgtgttcttggagtttctcttgactgatcccgatgccttgggcgaggaggctgatcatgagtagatattgtgcagcaggttggccacctttttcacttgttattagtgcgtgtcgtatatatgatcggtacacttaattaacttgaaagaaattcaggtctagccagttccgtgctggtggtattatttcgatcgcatttgttggtatcctttttttttccttcggagtcttgatgggccacgtggtgggtacgtacttctatccacgcgttattattcagtgcaaggacaggaatacagcagcaacagtaaggaggttatatacttgggactttgagagtaaaaaagttttctgttgcatgacagatacatatacgtacatacatatatctgtggtagaagaatacgagtactgaatttccgttcttttttatttatcgcgttttagtttaaaaataaatt

SEQ ID NO: 8235 - DNA, 917 bp, Zea mays
gttgcattgcattctcaggagtgggtactccatctcaaggacgggatccatggcgtcgctgatggcgcccatggcgggcgccttcttcctgccgttgggcccgcgcggcggcggcctgttcctgagcacggccgtgatcggcacgtgcacgggcgccatcgcgtcggtggccgtgtcggcgacgagcgagctgttcggggccgagaacttcggcgtgaaccacaacgtggtggtgagcaacatccccgtgggctccctgtgcttcggctacctcgcggcctacctgtaccagcgcgcggcgcggggcggcagcagccaccagtgcatcggcgccgcctgctacagggacacgttcgcggtgtggggcgccacgtgcgccgtcggcacgctgctctgcgccgtcctctacgcgcgcggtcgtcgccgcgcagctccgccgggagaagtaaggacggcacgtgcctcgcccgcttagctatagctgcctcgtgtctgtcatcgtaggtgcatggtacgtacgtagcagggcttagctgcagaagtttctgatcgatcgtctgagggctccagaagaagtttctgatctgagggcctgattaatcacacaccacccatcgatcgaccaagcatcatctacttgtaggctctacagatgatgatgcttttgatctttgcttctttttttagtgtgtgtgtgtgtgtgtgttcttggagtttctcttgactgatcccgatggaaggggggctacagaagaagccttggacgaggaggctgatcatgagtagatattgtgcagcaggttggccacctttttgtcacttgttagtgcgtatcgtatatatgatcggtacacttaatctctacaacaacaaaaaaaaaaaaaaaaaaagcggccaaaaaaaaaaaaaaagcggcc

SEQ ID NO: 8236 - DNA, 649 bp, Zea mays
gccggccggtccgggattggcaacgataaaaaaacaaatgaaacagtgtcacagcccggccgggctcgcgacaaaagccaaccccaacgaccaccgggcctcaattggtgacagtagctagcgtggacgcatcgtcatcaatcgagcagaagggagggagagagagagagagatgaaggagggcacggcgaactgcatcgacatcctcatcgccatcatcctcccgcctctcggcgtcttcctcaagttcggctgcaaggtcgaattctggctctgcctcctgctcaccttcctcgcctatctccccgggatcatctacgcgatatacgttatcaccaaggactagccagctagcgccgtaaaccgggacaaggtgagagagctagctgatcagccagcggagtaatggagatgaactgctgagatcacttgccctgctgctcaatgtttctgaatgtaaagttcgtagcacgtacgtacgaagtgtgttttggatggagaatgaatctcagctgtgctgtgctgtgacgctgctatatagcttgtgccgcctgttctctattcactagtcggtgctcccgcgtaaaatttctctcagactcttgtgctataggatgtgtgattcatgccggacctttccctggacctg

SEQ ID NO: 8237 - DNA, 762 bp, Zea mays
  misc_feature (730)..(730): n is a, c, g, or t
cccgggccgctcccgggccggccgggaattgttgacagtagcgtggacgcatcgtcatcattcgagcagaggggagagagagagagagagagagagagatgaaggagggcacggcgaactgcatcgacatcctcatcgccatcatcctcccgcctctcggcgtcttcctcaagttcggctgcaaggtcgaattctggctctgcctcctgctcaccttcctcgcctatctccccgggatcatctacgcgatatacgttatcaccaaggactagccagctagcgccgtaaaccgggacaaggtgagagagctagctgatcagccagcggaggtaatggagatgaactgctgagatcacttgccctgctgctcaatgtttctggatggagactgaatctcagctgtgctgtgctgtgctgtgctgtgctgtgatgctgctatatactaccgattgatcctgaaatttgtcgcttttcgttcgtgtctgcatagtatgtgatgcatagtctgtaaaatttctctcagactcttgtgctatagtatgtgatgcatgcatgtgtttgcttgatgaaaaaaaaaaaaaaaaaaagagccctgcactgtaactcgtttcggccgtttttgggaggccaccacgccagttgcttgatgcacatggcacaggagccagcggcttccagccttccacggctgctggcacccgtcgtagtcagcttgtgtgctgctcagggnagggatggattggattttggatatgggaatgg

SEQ ID NO: 8238 - DNA, 791 bp, Zea mays
  misc_feature (776)..(776): n is a, c, g, or t
ccggccgggagagtatacctcccggccggccgccggggccggccggcaatcaaccagcgtgaacaaacaggagacgcatccagcctccagcagagggctccagagatcgagcaagatgaaggagggcacggcgaactgtgtggacatcctcatcgccatcatcctgcccccactcggcgtcttcctcaagttcggatgcaaggtcgagttctggctctgcctcttgctcaccttcctcgcctatcttccggggatcatctacgcgatctacgccatcaccaaggactagcgcggttccagttgggtgagagctgcaagctcctccttctcttctcagctgtgaagctactactactagtctactaccgattggtgaacctgaacctgtcgcttcgttcgtgtccttcgatcgctctctggttatattggtcgtggatcttgttaccgatttatttatcgtacagtaacttgtaccatgtgctgttctgtatttattcagtggtccgcgtaaaatctgcctccaacctgtgctatagtgtgatgcacgtgtctggaactcgtttcttggtggttggcgtgaaggttgagcgcttcagcacatgtcacagccggcggcctccagtattctacggctgctggcactagtggtagtaccatcagatcgcgtgctggttggtctgtctggttgaaatgcattgtgtcatgtccctgttatattataatgtgtttggtttgaggcatgaagtgatccatcgccccctcgcccgaaaaaaaanaaaaaaaaagcggcc

SEQ ID NO: 8239 - DNA, 2130 bp, Zea mays
  misc_feature (133)..(133): n is a, c, g, or t
cgagtagaaaaaactttttttaggtgggcggtgagattacagggttaataaactgtgacaactttacatttgatttaatgagtaacgaaaactggggtgagattacagggttgacaaaccgaagaaaaaagangtgaaggagataataaagaatctaaagcaaacggtcctaagaatctaaaagaggttactcggacttggtcatcatggctctagtatgaatctaaggtttcaattgaattgattcataggatcacaacaagacaatttgtataactagaaattttggttttattttttaaactactgacacaaatttgttattaacgctaagaaattgttacttggacatatgtgttctctatagggcatggatagatagctcagtttaaaaaacagcaaatatcctttccttgggcaagtgccatttttaggctctcacaagtcagttaatctgttttgcaggatgaacattcgcagccctacttcaagcctccccatctggacaaccccatttgcactcttctgctgtctgaaactacgatggcatttggcaggtcacttgtcactgacagcaacgccaactacaagggacctctcacactctcactaaagcaagggtaagcttaacaattgcattatttatgtagtcatactgtctagtaagatggaacacaaggctcattcatggtcatggaattgcgctccaaaaacctgtatgtaggtccctattggtgatgcgtgggaacagtgccgacatggcgcgccacgtggtgtgcacgtcgtccaaccggcgcgtgagcatcacgtttgcaagggtgaggccatcgacgccggtggatctgagcccactcccgtcccccaccaaggccttgacgccctggcagccgcagccagccacggcctcccaggtgccggcgcccgcgtgcatgacgcagaagcccccggtcagcggcgccatcatcggttatgccccgaccccgcagaccgtgctggcgcccgcggcctggggcatggccatgcgagcgcccgtcatgatggtggccgcagcgcctgcgaggcccatggtgatggcctcgttgggcaccggaggcggcaacatcagcaagcggatgagccgcagcggcaccggtgtgttcctgccgtggacggtcgggccgaagcggtacaacaagcaccttccgccgcgcatccagaagcgccggttctctgcgatgatgtcgcccatcgaggcgcagggctgaggacctgcccgacttcacgtcgccgtcgaacctgtgtttttttttttccttgagggctttcggtccgcctgtaatttagccgggtttgtgacttgtgacaatgtgagtgagtagcggtttagcggagttcagaaccggtagaggagtacgagcgtagggataggtgaaggcagaatcagggcagggttttccttttgttttcatcctgtccccctattttccgttccgagtaaaacttatggatgttgttgtcatacatgcatcagcagctgagtttggattcccccccccccccccccgcccccctatatccaaattatccgtattcgaataaaatgctaatatagatatatgtcttcgtattcgagtttaatatgaatgttaagtcgatgtatatgaatttgtttttagattcgtatttgatagaaccgtgaaatatccgatactatccatatatgtgaagaaaaagtttttgatgaaaccatttaaaacttgtttttataccaagttactaattacaaattattttaaatttaataatgtactaaaaatgacctacactatttaaaatatttaaaaacatacatatagttaataaataattatgttaatcttatataactagtgatacacaatgataaattttattaatgtttagaaagactaattgtaattaaattagattattgagatttttagagtccaaaatacaaatacacaaattatacatgatataaagaaaatatttagagtctaaaatataaatacatttggtatacataatttgtttaaaaatataatattcaactaagcttcatcattcaaatatataactctccactttacactatatgatacgcacattatacgcacatcattcaaaata

SEQ ID NO: 8240 - DNA, 2655 bp, Zea mays
  misc_feature (99)..(99): n is a, c, g, or t
  misc_feature (110)..(110): n is a, c, g, or t
gcacgccgtttaaaaccaagccaacgggtcgagttgaaccaacgcccttacaagagaagaggggttggggaggtagacgagtggcgtagggaactcggncgtggggcggnagagtgttttagtgagagagaggcagggctgtcacgagcgtgggcaggcgatcgcgggagcgatgacgacggcggccggcatgccggggttgccggtgggctcggccgccgcggctggggttcccgcggcgcccgaggtggcggccagggacgcggtgatcggctggttccgcggcgagttcgcggccgcgaacgccatgattgacgcgctgtgcggccacctggcccatatcggcggcggcgggcccgagtacgatcccgtcttcgccgcgatccaccgccgccgcgccaactggttccccgtcctccacatgcagaagttctaccccgtcgcggacgtcgccgccgagctgcgccgagttgcggacgcccgcgccgccgcagggtcctgctgctactccgaggaggccgcgtccacggtgatccacgagcccatggaagaggctgaggctgaggctgaggctgagcccgaacccgagcaggagcacgagcaggatccggcaccggcggccgagctggctgacggcgccgtggagtaccacgagccggacgtggaagttgattcatcgggagattcgtcggagcggaagcccccctccaccgaagatgacaccgtcgcagacggacatcatactgatcaaggatctcaaggggaacacagcctaccagagagctatcccatctgctctgaccacgaggagtgcattgcccgtcctgagaggatcaagatccagaaaggtttcgtggccaaggaatccgtgaaggggcacatggttaatgtcgtgaaaggcttgaagatatatgaagatgcgtttacgacatcagagatcatgaaagttgcagatttcatcaacgaaattcgtcaggctggcagaaatggagaactttcaggtgagactttcatattcttcaacaagcagatcaaaggaaacaagagggagatcatacagcttggtgtaccgttatttcaacctaccacagaggatgctaattgtcacacagaaccaatcccccttgtcctgcaggctgtcattgaccaccttgttctttggcgtttaataccagaaagcaggaaaccaaatagtgtcgtcatcaacttcttcgatgaggatgaacattcgcagccctacttcaagcctccccatcttgacaaccccatttgcactcttctgctgtctgaaaccacgatggcatttggcaggtcacttgtcactgacagcaacggtaactacaaaggacctctcacactttcactaaagcaagggtccttactagtgatgcgtgggaacagtgccgacatggcgcgacatgtggtgtgcccgtcgtccaaccggcgcgtgagcatcacgttcgcaagggtgaggccatcgacgccggtggacatgagcccactcccgtcccccaccaaggccatgacaccctggcagccgcagccggtcacggcctcccaggtgccgtcgcccgtgagcatgacgcagaagcccccggtcagcggtgccataatcggttatgccccgaccccgcaggccgtgctggcgcccgcagcctggggcatggccatgcgcgcgcccgtcatgatggtggctgcagcgcctgcgaggcccatggtgatggcctcatcgggcaccggcggcggcaacatcagcaagcggatgggccgcagcggcaccggcgtgttcctgccttggacggtcggcccgaagcggtacaacaagcaccttccaccgcgcatccagaagcgccggttctcggcgatgatgtcgcccatcgaggcgcagggctgaggacccgcccgacgtcatgtcgccgtcaaaccgaacggccaagatcaagtaggacccggtgcaacgagccaccgtttaattcctagggttcttggagtgttttttttttctctctcgtcgtcgagtcaaaaaaagaaaaaagaaaagaaatggtcaaaacgcgcggacagtgagtttggacgtctgtgtatttcggtgacctgtgttttttttttctctggagggcttttggtccgcatgtaatttagccgggtttgtgacttgtgactttgtgagtgagtagcggagtttagaagcggtagaagaatatgggtctagggataggtgaagtcagaatcaggacaaggtttttcgtttgttttcatccttcttttttcagttttttaagatgatgcttttagttttgctatatcctcgtcttttccttttttttttcgtaccctatttttccgtaccgagaagaatgttgacatgcatatatgcatttcatgctgagtttgaagttctataagcaaaagatgcatcttgtgttgcccacttactggcccgcgagctgggcgccggtacctttaatcttgaggtcttgtttggttatttcgaattgaaacccccccccctcccaatatttttttaaatcgattttggagtttgacgtccattataaatcacatggactaactaatttggctaattgctattttctcatgtgcataaagttccacatacacatccaccccagagttttatttttcccccccccc

SEQ ID NO: 8241 - DNA, 4041 bp, Zea mays
  misc_feature (1406)..(1406): n is a, c, g, or t
  misc_feature (2728)..(2728): n is a, c, g, or t
gctgttagctcacagtaatccactgactctttaatgattagccattgcgtctcggcgcaaacacggtgccggttgaaaccggtaacatatggtcttcggctataaacattgggtccctcgaggccggccgggccccagtattctgctcaagccgagcaccgcagaaaaagaaaaagaaaagccaaaggcaaaggcaaaggaatcccaatcaggcaagcaaaaggaagaaccagctgctgcggccggagatgtcgtcgcagctgatcgaggagcaccggtcgggcgcggaggtgcacgtcgggcacgagctgtgcgagcgcaagtcgcgcgagttcatggtggagctgggcctccccgacgggctcctcccgctgcccagcctggacgaggtgggctacaaccggtcgacggggttcgtgtggctgcggcaggccgccggcctgacccacaccttcggctccatcggcaagcaggtgtggtacgacagggaggtgacggcgttcgtggagcccgggcggatgcacggcctcgccggggtgaagagcaaggagctcctcatctgggtcaccatctccgagatcgtcctcagcccctccggcaccaagatcgtgttccgcacccccgcggggctcggccgcgccttccctgtcaccgccttccagctcgagcccgcggcggcggagggggaccacaaggaggaggccgaggacgccgccgccgccgccgccaactgatctgctctagcttccggcggcggcggccgtgcgtgggctgctcgatccggtagtggcagtggctttgtgagacagtcgagtcgattgtggtttcccctcctccgccatgtgcgtgtagtggatgatgatgcaggaataaacggtgtccctggatccagaactcacggttcgatccatccagtttatctcatgcttgtgtatctctatgtatgcattgcctgtttgttcgctggaatctactacttgcagcggcctcgtctcttcataaaaaaaaaaaaaaaaatgcaccggtgtgtctgctacttagacgttcatgatccgtcaatttggtcgtgttttctgtgaaactggtcgcctgtgagtgtgaggttgagatcgacagctcggcatctcactcgtgttcatcaaatcaaatttagtagtaggttgtgagttactacgagctgatcaaggtggttagcattcatgtgcagtgcagtaccactacaaccacctagatctgggcacttacttgtcgaccggcagttggcatttataaatcctgtctctggtacacgccgttcggcccggctcgaaagcaacggaaaccgctcgcttttacggcacatgctatgctggtgcacagacacatggcattgaagaactccaaattagatttggttcattcatgtnaatttctgtcaagtccaagtgtcctgcttatcattgttctgcattgtatctgagagcgtgtgagttcagacgatactacagcttgtacttggagtgtgagccaatcaaaaatatgttctttatcaaagtcttgacataacaggtcttgaccgtatagaattgtgtacgtatgttcggcggtgtattcatcgtatcacacagatcttagcaatgtgacgatattcccttttgaaactatcctttccaactgagccatctcaagctggtcgcgtaaacggccgtacaaagtactattctgcaccatagattgtagagtgatgtttaaaatagagagtgtgatatatagtggttagagagtcttgctagagataaatagtctaactgttctagacgctttgttagttattttaggattccctcttgtacaactttttttaaaacatgcgaacaattgggagatatctttaaactgagatatctcactattaatagttctagtgagagctagacaaactatgtatacctctaattattgactgtgcatacatcaaattttgatcacgaacccaatgcacaatcatgcaaacatgcctcctctgctagagagcggtgcacatttcttcgtcttgaccttatatcctcgataacaccgtaacaggttgacccgtcaatgagttgtatggtgggtgtgtggggtagtagtagagggttggagatcgctaccaatgatagtggaggtggtagttaggtagagccggtcttgatattttacgggtctaaaacaagttttaaaatacagactcttctaatttttttatatataactgttaataatataaacgctcaagatacatgttacaccaagttctgaggcaaatcgaatgcacccatacacatgctttcgtcacaattcacacatatggcgacattatcaatggagatcatgacacatgtacgattattataagaagcatagtatcagcacataaccaacataactaacagtgtaaccaagatatttattagaaaggcttccatgacaacaaactttttttaggatcttgacctttcgcatgacactaagcgtcaacatcgtcttggttcttttagaaaccaccttcctcaaaaaaagcaacatagtaggcaaggttgagtacttacaagtactcagccatggaagttgtcaccgccatagatctcggccaagatcaccaaagacaattcaaattcgggctctgggctctaaaactcattggtagggttgcaggaaatagaagatctttagggaaactcaccacggtgctgcgagagctcaaaaatgntagattagagctcgtggcgtcgagtggtagcggccagtacgtgtcctgccatgggcggcggaacgttgatcccatacattacaaggaatgtagtgatgcgccaaggctaggagagtatctttgcaatcgagcaacaattctatcgttttttctgttgccaatcatgtctatggtgctcacatgtcgctgccaccagacacgtcgaccgtgtgcattggtatttagaagtgaaagatcctcttctactatgaacaaagttgtgtgaccattttgatgtgcacaagtatattatgctccatagacccattagaaataggccactcttcgcttcctccatttgaagacaatgaaatgacttacaacatcgccatccaccgaattattgcttacctatgcttctatggccatacagtcacatacctagagatgattgagaaaactctctagacattccaccctcaaacacggtgctccaatataagtaccacaataacaaatacatgaagtattgtgatctgattaacatgttacttgttgctgaggctcaaaacgagctcatcaagcaagactattaaagttacatgttggtgttactgtcatgcctagagcactagcttccagtcttagtgggagagaggtcgctctataggaagggtcatgggcgccataatactttagggataagggggattttttaaaaagccaccacaaaatgacagtagaagtagaagtaccaatgaccatggcaaatggaaaaggcaatgacaaagacaacccatagaaggatgatgcaagtacctcaaagcatgctagcgcagattgttttaggtgtgggtcctagtagacactgagactaaagattccctctctaagccacctaatactgttgagtagtctaatcataccgacatggatgctgatgccaccggtcataataatgccctaataggcaatgatgattttatctcgatattgatgatctcatgtagtagatcgagttatcagtgattagccccatacttattcccttagttaatattttaattctagaagaacttttatttggtcataatgtaataaatgcccccaccgagcatacttgatttggataactaagattgattgctatgtaatttcattatgctcatgtattgtttaattatgattgttctattatataatatcatcgtaaatgctaaatttgtatcatatctatttagaacatgatttacacttcccatgatggaggcaatggatgaactatatctggtcgatagcatagccacaaattcaatacttagagagatgagata

SEQ ID NO: 8242 - DNA, 981 bp, Zea mays
tgtggcggccgcttcgagggcccggccgggcccgggagtattctgctcgagcaccgcagaaaaagaaaaagaaaagccaaaggcaaaggaatcccaatcaggcaagcaaaaggaagaaccagctgctgcggagtgcggagatgtcgtcgcagctgatcgaggagcaccggtcgggcgcggaggtgcacgtcgggcacgagctgtgcgagcgcaagtcgcgcgagttcatggtggagctgggcctccccgacgggctcctcccgctgcccaggctcgacgaggtgggctacaaccggtcgacggggttcgtgtggctgcggcaggccgccggcctgacccacaccttcgggtccatcggcaagcaggtgtggtacgacagggaggtgacggcgttcgtggagccggggcggatgcacggcctcgccggggtgaagagcaaggagctcctcatctgggtcaccatctccgagatcgtcctcagcccctccggcaccaagatcgtgttccgcacccccgcggggctcggccgcgccttccctgtcaccgccttccagctcgagcccgcggcggccgagggggaccacaaggaggaggccgaggacgccgccgctgccaagtgatctgctctagcttccggcgccggcggccgtgcgtgggctgctcgatccggtagtggcagtggctttgtgagacagtcgagtcgattgtggtttcccctcctccgccccgcagtgtgcgtgtgcgtgtagtggatgatgatgcaggaataaacggtgtccctggatccagaactcaaggtttgattttggggtgatttggtaactctggtctctctgatctgatccatccagtttatctcatgcttgtgtatctctatgtacgcatgtatcggtaatcagattgcattgcctgtttgttcgttcatgatccgtcaatttggtcagttttctatgaaactggtcgcctgtgaggttgagatcc

SEQ ID NO: 8243 - DNA, 937 bp, Zea mays
cattgggtccctcgaggccggccgggaaaaaaaaaagattctgctcaagccgagcaccgcagaaaaagaaaaagaaaagccaaaggcaaaggcaaaggaatcccaatcaggcaagcaaaaggaagaaccagctgctgcggccggagatgtcgtcgcagctgatcgaggagcaccggtcgggcgcggaggtgcacgtcgggcacgagctgtgcgagcgcaagtcgcgcgagttcatggtggagctgggcctccccgacgggctcctcccgctgcccagcctggacgaggtgggctacaaccggtcgacggggttcgtgtggctgcggcaggccgccggcctgacccacaccttcggctccatcggcaagcaggtgtggtacgacagggaggtgacggcgttcgtggagccggggcggatgcacggcctcgccggggtgaagagcaaggagctcctcatctgggtcaccatctccgagatcgtcctcagcccctccggcaccaagatcgtgttccgcacccccgcggggctcggccgcgccttccctgtcaccgccttccagctcgagcccgcggcggccgagggggaccacaaggaggaggccgaggacgccgccgccgccgccgccaactgatctgctctagcttccggcgccggcgccggcggccgtgcgtgggctgctcgatccggtagtggcagtggctttgtgagacagtcgagtcgattgtggtttcccctccttcgccccgcagtgtgcgtgtgcgtgtagtggatgatgatgcatgaataaacggtgtccctggatccagaactcacggtttgattttggggtgatttggtaactctggtctctctgatccatccagtttatctcatgcttgtgtatctctatgtatgcatgtatcggtaatcagattgcattgcctgtttgttcgctgg

SEQ ID NO: 8244 - DNA, 981 bp, Zea mays
  misc_feature (23)..(23): n is a, c, g, or t
  misc_feature (957)..(957): n is a, c, g, or t
  misc_feature (980)..(980): n is a, c, g, or t
ggtaccctccgattcggccgggnaaaaaaaaaaaaaaaaaagagccggccgccccggcccccagtattctgctcaagccgagcaccgcagaaaaagaaaaagaaaagccaaaggcaaaggaatcccaatcaggcaagcaaaaggaagaaccagctgctgcggccggagatgtcgtcgcagctgatcgaggagcaccggtcgggcgcggaggtgcacgtcgggcacgagctgtgcgagcgcaagtcgcgcgagttcatggtggagctgggcctccccgacgggctcctcccgctgcccagcctggacgaggtgggctacaaccggtcgacggggttcgtgtggctgcggcaggccgccggcctgacccacaccttcggctccatcggcaagcaggtgtggtacgacagggaggtgacggcgttcgtggagcccgggcggatgcacggcctcgccggggtgaagagcaaggagctcctcatctgggtcaccatctccgagatcgtcctcagcccctccggcaccaagatcgtgttccgcacccccgcggggctcgggcgcgccttccctgtcaccgccttccagctcgagcccgagggggaccacaaggccgaggacgccgccgccgccgccgccgccgccaactgatctgctctagctagcttccggcgccggcggccgtgcgtgggctgctcgatccggtagtggcagtggctttgtgagacagtcgagtcgattgtggtttcccctcctccgccccgcagtgtgcgtgtagtggatgatgatgcaggaataaacggtgtccctggatccagaactcacggtttgattttgggatgatttggtaactctggtctctcttctctgatccatccagtttatctcatgcttgtgtactctatgtatgcatgtatcggcaatcagatggcattgcctgtttgttcgctggaataatgcggntctagctaccacaaaaaaaaaana

SEQ ID NO: 8245 - DNA, 904 bp, Zea mays
  misc_feature (27)..(27): n is a, c, g, or t
taccctcgaggccccgcccgggagtanttctgctcaagcacaccgccgacaaagaaaaagaaaagggcaaaggcaaaggaatcccaatcaggcaagcaaaaaggaagaaccaggtgctgcggccggagatgtcgtcgcagctgatcgaggagcaccggtcgggcgcggaggtgcacgtcgggcacgagctgtgcgagcgcaagtcgcgcgagttcatggtggagctgggcctccccgacgggctcctcccgctgcccaggctcgacgaggtgggctacaaccggtcgacggggttcgtgtggctgcggcaggccgccggcctgacccacaccttcgggtccatcggcaagcaggtgtggtacgacagggaggtgacggcgttcgtggagccggggcggatgcacggcctcgccggggtgaagagcaaggagctcctcatctgggtcaccatctccgagatcgtcctcagcccctccggcaccaagatcgtgttccgcacccccggcggggctcggccgcgccttccctgtcaccgccttccagctcgagcccgcggcggcggagggggaccacaaggaggaggccgaggccgcccgccgcgcgccgccgccaactgatctgctctagcttccggcggcggcggccgtgcgtgggctgctcgatccggtagtggcagtggctttgtgagacagtcgagtcgattgtggtttcccctcctccgccatgtgcgtgtagtggatgatgatgcaggaataaacggtgtccctggatccagaactcacggttcgatccatccagtttatctcatgcttgggtatctctatgtatgccattgcctgtttgttcgctggaatctactacttgcagcggcctcgtctcttcgaaaaaaaaaaaaaaagcggcc

SEQ ID NO: 8246 - DNA, 872 bp, Zea mays
attctgctcgagcccgcagaaaaagaaaaagaaaaggcaaaggcaaaggaatcccaatcaggcaagcaaaaggaagaaccagctgctgcggagtgcggagatgtcgtcgcagctgatcgaggagcaccggtcgggcgcggaggtgcacgtcgggcacgagctgtgcgagcgcaagtcgcgcgagttcatggtggagctgggcctccccgacgggctcctcccgctgcccagcctggacgaggtgggctacaaccggtcgacggggttcgtgtggctccggcaggccgccggcctgacccacaccttcggctccatcggcaagcaggtgtggtacgacagggaggtgacggcgttcgtggagccggggcggatgcacggcctcgccggggtgaagagcaaggagctcctcatctgggtcaccatctccgagatcgtcgtcagcccctccggcaccaagatcgtgttccgcacccccgcggggctcggccgcgccttccctgtcaccgccttccagctcgagcccgagggggaccacaaggccgaggacaccgccgccgccgccaactgatctgctctagctagcttccggcgccggcggccgtgcgtgggctgctcgatccggtagtggcagtggctttgtgagacagtcgagtcgattgtggtttccccacctccgccccgcagtgtgcgtgtgcgtgtagtggatgatgatgcaggaataaacggtgtccctggatccagaactcacggtttgattttggggtgatttggtaactctggtctctctgatctgatccatccagtttatctctatgtatgcattgcctgtttgttcgctggaatctactacttgctgcggcctcgtctcttcc

SEQ ID NO: 8247 - DNA, 935 bp, Zea mays
cattgggtaccttgggtacctcggggccggccgggagtattctgctcaagccgagcaccgcagaaaaagaaaaagaaaagccaaaggcaaaggcaaaggaatcccaatcaggcaagcaaaaggaagaaccagctgctgcggccggagatgtcgtcgcagctgatcgaggagcaccggtcgggcgcggaggtgcacgtcgggcacgagctgtgcgagcgcaagtcgcgcgagttcatggtggagctgggcctccccgacgggctcctcccgctgcccagcctggacgaggtgggctacaaccggtcgacggggttcgtgtggctgcggcaggccgccggcctgacccacaccttcggctccatcggcaagcaggtgtggtacgacagggaggtgacggcgttcgtggagcccgggcggatgcacggcctcgccggggtgaagagcaaggagctcctcatctgggtcaccatctccgagatcgtcctcagcccctccggcaccaagatcgtgttccgcacccccgcggggctcgggcgcgccttccctgtcaccgccttccagctcgagcccgcggcggccgagggggaccacaaggaggaggccgagggacgccgccgccgccgccgccaactgatctgctctagcttccggcgccggcgccggcggccgtgcgtgggctgctcgatccggtagtggcagtggctttgtgagacagtcgagtcgattgtggtttcccctccttcgccccgcagtgtgcgtgtgcgtgtagtggatgatgatgcatgaataaacggtgtccctggatccagaactcacggtttgattttggggtgatttggtaaaaaaaaaaaaaaaaaacgcgcccgggtatctcatgcttgtgtatctctatgtatgcatgtatcggtaatcagattgcattgcctgtttgttcg

SEQ ID NO: 8248 - DNA, 2026 bp, Zea mays
ttatgtacagtcctaccagcagtcatgttcacatttaccttgtttcaacctttctcatggggtccctcgagcccggccggaattcactcctttcttcttctcctgcatcaggatcatcatcaggttctccgttccactccatggccttccctgctgtgcccctcctcgccgctctgctcctggtcgccgccacgcggctgtgggactacgtcttcgtgcgcctcgtatggcggccgtacgccatcaccaaggggttcagagagcaagggatccatggaccctcctacaggttcttcaagggctgcaacgaggagatcaggagcatgaaggagaagaccgacggtctcgtgctggacgtcggcgaccacaagtacctcccgcggatcgcgccgcactacctcgaatggagggctcagtacggagaaccatttctatattggtacggggcacaagcccgaatttgcatatttgactacgaactagcaaggcaaatcctttcgagcaagtctgggcatttcgtgaagaacgatgcgcaccctactttgttggctctggtcggcaagggactcgggttcatggaaggctctgactgggtgcgccatcgcagggtgatcaaccctgctttcaccattgacaagcttaagattgtgaccgagacgatgctggacttcgccgatagcatggcaggtgagttggaagctgaagcatcccagaacgagaacggagaaacacaagtggatatatacaaacatttcagcgatctgacagttgacaatatagcctacgccatctttggaagcagctacaagttaggcaaacaagtgttcgaggcacaaactgagctgctggggatcaccatggctactttccttgacgtgcccataccaggatccaaataccttccaacccaagcgaatcggcgaaaatggatgctggagacgaagctcaagagcttactcacgcggatcatacagccacggttagcaagcggtgagcacggaaacgatctgctgggcgtgatgctggactcctgcactgagaccaagcaaggagggaagcagcagcaagtggatcgtctgcgtctcagcttgagcatggaggagatcatacacgagtgcaagctgttcttcttcgctggccacgagaacacagcccttctcctcacgtggtccgtgtatttgctcagcatataccccgagtggcaagaaaggctccggaaggaggtcttgagggagttcgggagggacgctcctaaccccaacgcgctcaacagattgaaagagatgacaatggtgttgttcgagaccttgaggctctactcgcctgctctcttcatgcaaaggaagaccctggccgacatgaccgtggggccaataaaactgcccaaaggcactgcaattgtgatacccattccgatcatgcatcgagacaagcaggcatggggcgacgacgcagacgagttcagtccgatgagatttgcgaatgggatcacgggagcagcgaaagttcctcacggcctgctggcgttctcgatggggccaaggtcttgcatcggccagaacttgtcgatgctggaagccaagtcgacgctggccctgatgctccgcaagttctccttcgctctctcccctgactacgtgcacgcgcccgtggatctcttcactctcaaacctaagtttggccttcccgtcattctgaggccactggataatgttttgatttgagttgggcatatagtacaacaggaagtaacttaggtacatatcaaatttgctagctggtcaaaacgttatatgatgttctcaaccctccgttgttctatatcgttgaaaacaagtattttaatttaggtgcggtttggtttggcgctgcaagcgaaaaaaaaaaaaaaaaaaaaaaaaaaaaaaaaaaaaaaaaaaaaaaaaaaaaaaaaaaaaaaaaaaaaaaaaaaaaatttaaaaggatccaagattaaatacaacaaaaatgcgaacgtaaaaaaaattaatataggggcgcgctaatt

SEQ ID NO: 8249 - DNA, 1741 bp, Zea mays
agtaggagtgtaggactgtaggaggtagaaaaggtagccgcgtctccacgataacgaggaaatcgagcagcggcaccagggcccaggccaatcccaggaaaccggaagctcgaaagctgccaagccctcgccgtcctgccgcccacggcttaccgctgccgcctgccggccaccccacccaacgaaaatccgcatatactgtagtactccgtttcgcccgcgccgcccatccgttcggctgcctcgcacgccccaaaatcccctgctgcgcctccaaagccagcagccggcaggtcccgctacaaaagcaggcggcatgcgcgtgcgcgacaggtagcagctgcctgagccagtgcgcctcggtgagcagacaggacgacataggatagagatggcggccgcggtggagggggtgcggcaccgaacgctggaggcgaatggagtgcgcctgcacgtggcggaggctgggcccgaggaaggcagcgccccagtggtgctgctccttcacggcttcccggacctctggtacggctggcgccaccagatgtccgccctggcggcgcgcggctaccgcgccgtggccccggacctccgcggctacggcgactccgactccccgcctgatgcgtccagctacaccaccttccatgtcgtcggggacctcgtcgcgctcatctccgacctcggccagcggcaggtgttcgtggtggggcacgactggggagccatcgtggcgtggcagctttgtctgcttcggccggacctggtgcgggcgctcgtgaacctaagcgtcgtgtaccacccgcggcggccggagatgagcccgctccaggccatcagagctgcctgcggcgaagaccactacatgtgccgcttccaggaatttggtgttgctgaagctgaatttgctctatatgacatcaagtgggtgtttaagaagacatttggcatgcgcaagccagctcctcttattctgcccaaggacaagagcttctttgactctcttgattcagatggaacttgtccaccatggctatcagaggaagatatttcttactatgcagaaaaatttgcaaaaacaggctttactggaggacttaactactacaggtgcatagacaggagttgggagctttctgcggcatggactggagctccgataaaagttccgtcgaaattcattgttggggaccttgacattacatacaacgccccgggggtaccggactacattcacaagggtggcttcaaggcaagcgtgccaaatctagaggacgtggttgttatggagggagtgagccacttcatcaaccaggagaaacccaacgaggtctctgatcacatctgcgagttctttagcaagttctgatacgtattggaaaaatctcaaggagccgttatatgattctgagctactcgtgtttttatgtcaaaaaatgcggttgcgagtgtcaccatacaaatatacgatctaaataaaattcgtctctggctcacctttctacacagctctaccaagaaacttgctttgcctttgtggtagacaccatatggggtgatccaagaagcaacttccagcggccacggcagcttggagttgcgtgataaaaattccttttgatgtatgacacacgtaagggtgaggctctcatgttattgatctaaaaataataactttcctgttaaaaagaacgtgttcggtgtaaaatatctttttttaccaggaaaaaaaaaaaaaaaa

SEQ ID NO: 8250 - DNA, 892 bp, Zea mays
  misc_feature (880)..(880): n is a, c, g, or t
cattgggtacctcgaggccggcttctacaaacatcccgtcccttcgccggcgggcacgaccatcactccaccatgtccgccgccacctcggcggcagcggccgtctcctcgtcgcgcccgtatcccctcctccaacccgcctccagccccaccctcgtttccttccctcggcgacagcttccatccacctcggttgccctgtccgcgccctcccagctgtcgtcgcggggctcgccgctggcgccggcggccaacccgaagtaccacaacgcgaaggtggacgcgggagacgaggacgcggacggtgaggagctcctgcggcggttccgttggcaggtgtcccgcgcgggtgtcatggaggagatcaggcggcggcgcaggcacgaggacgcccgggacaagcgcaagcgcaaggcgcggtcggcgtcgctgcggtaccgccggaggcgcttcaagggcccatatccttccaacgatgaccaggggctcaaggagcaggacgaggaggacaacgacaactgggagctccctgcaggagagttgcctccttacattacaggcaggtgaaggtggtccgacaaattgaagcgtggttttgtctgacggagaatttcggcggctaaatcttcagttctgtctgttagtcgagtaggtgttgccaaattgtttgcagcccgatcggtggccaaagcatggcaaactgatgtaaatcttggttctggatgttatgcctcggcagcagactctcctggtcctggctgtgctgcgaatgcttcatctgtattgagttcttgtggatggatgtacaatggctggtgtgttctcacgaggattctgatgctttctggtggggagaaatgatttctgatgcagatgcagntgacacttttaa

SEQ ID NO: 8251 - DNA, 801 bp, Zea mays
  misc_feature (800)..(800): n is a, c, g, or t
tggggccccccgagctcggccgggcagctattacccaacgccgccgcccgtccctagcccaagctcccagccgtaacgccaccgctcgtccctaggccctggctagcggctagctcgcgcgtcctgctctgtgctctctcggtctctcccagccccaagctcccagcgccagccgcctgctcgccagaagccacggctccaccgcagattggcctcaccgcggcacgccggcaccggtgacacgccgtgacgccgtgccagccgcccagcctcaacagctcctccaccacacgccgtcgtgacgtgccgtccctccactgctgactgctccacaggccacggctccctctgtccctcgcagtcgcagcaccagcacgacacggcagccgacaggaactctcttcagcggctacggctccattcctgagatgacgcctccggttggaaataatactccctcaagctcaaccataaaattagccaagttgatgtctaccacaagagcgccttctacacacaaaacaaattcggtattcatatacatgctaagtgatccagatgtaagcaagtgattatgaatatatgttttaaactttatattgtgtcatgtgtgctagtagacttatatggcttcttatgttagccaagagtccaagacttatcacttatgtgctacattaaactatgtgtgcttcacatttatatggcttttatctatgtttaattaaaaaaaaaaaaaaaaacgcggccatttggtgttaagttttgaatatatgggttcatggtgtgattttaccganc

SEQ ID NO: 8252 - DNA, 3888 bp, Zea mays
  misc_feature (124)..(124): n is a, c, g, or t
  misc_feature (3294)..(3294): n is a, c, g, or t
gaattgtaccatccttgacgcccttgtgcaaattgttgcaccattttgcaaagctaaaagtctaaaatgaaagtaactgaaacttggaggtatatcgatggttaggtacaatcaaggccgtacntatcaacataagtatgctgccaacatgggagtaatattagtgtactttaattctagaactgcaggcatgaaattctagggagatgccattcacattggcagggagtcttcattctgataaagctgacgattcacccttttgtacttgttacagggtactgagagcagtctggacgattgtgttctccatctcatatgtccttgctgtacgctgtgccaggttatatctgcaaaagcccctatctgcatcccaatattgctaccttcctatgtttggccattgtaaaactcaactgttgctgtacgctgtgccaggaggctagaactttggagatgaataatgtccagtgtggtgtctggcatggccgaggtgataccatttgtttagggagcaacggtgcaggaaacaaggctttcgctgccctgaacaaggcctctctcgtgcctgtaaagtccccggggctgtgtggcatggatagatcgtcaagcgcagctgacgagcagcagccgcttgtcccaccggaccaactggagcaggtttaggtattctctgtcgccacgacctctgcactttcctagaagggcttggacagcgccgacggaaaaaaaaaatcgtcctctgccggattattaggcgcctgcatctgcatccattggtcccgagaactggactttgcagctaccgtacatgggtgatgggcgcagtcgacctgctgctggctgctgctgttgtaaaattcagtgatagattttctcttgcagtcgaattgtttaggtcgaagactgtatcttcataatgtcacgacacgtgctcaggccttttgcctgaatccaactgtaaatttcagatccaatctagcagttcgagttacatagacaggaatgagatggtaatgttcttttcaccggccgtgcttgctccctgtatctttcatacgctgccccttgtcgttcctgttctcaggagcttgattaacactgttttctttacgaaacgtcattttccgtcacagtttgtgcacaagaacgttctagcaggaactgccttcctagaaacatcacagggctaacactctgaactgcactccagcacaagaggcgacctgaaatctgattcacgttcagaaggcatttgctggagatctcagaaacatgtgcctttttttctttggtcagtacaattattgaaacgggttatcctgacaaaagccctgcgaagttgcagaccagcttggagggtgtctgtctctatctgccttttctcaatttcttttttccgctcagtgtggggtggccttttgagttgtttaaacataattctgcgggatgaggaaggtgggccgtgggcgtgggctctggagtctggagtgtgggtagtggtttcccttttgctaaccgaaccatcattggcgtctcacgctagaaaaaatacgtttgcgtgtgcttctctacgtgtgtgtccacggactatcgacatctttagttcacagggggctgcttttttgaattattcttttgtctccagatcaatcattgtgtctactttgtcatgacagcctattttggattttccactctcgcttttccttcacttgactgacaatggtgttttgaagtctgaacatactagcgccactctcaggtacatcgtgagcagttatcttgcgaggtccaaaaaagaaatgaaaatatatagatatcagtgaaacccagttattaacagttatcttgcaaaattcagaacaaaaaaaatgtataaagagcactgtagatcgatattaagattcaccgcgtgatcctcgtttggaacgcagatacaacgtgctggttgctgttaaactggcgcgcggtttgctgcaaacaatatgagacggccatccgcctgcatttttttcgtataatattctgacgacgcacgggacaaggtcttcgccgatgaagcaaaagtgcacctgaacctgattctcttcgtccgttcatgcatggctccaccgcgtgctattctgatgcaaaagtggccaactggccattgaaaacgctcaggtgcatgttgactttaagcccgtacgcattcatgtgaaaccgcgcgcctagaatctttcaaataaaagaaaaaggaaatcatgcgtgtgttcttaagccgcgtttagcgtgtcccgagtgcgtgcgtgcatgcactccacgaggccgccacacatggtcgtgttagttagttgattataggctaatcaatcatgcccagcccagccgtcatgaggtattcccagcttttggtaaattctccccgcgcgccaaattgtcgatctttactggacggacggacggacgtccatggtagccagtagaaattgaaggagagaaagccacgcgtcttgtcaactcttgttcatctatctatctatctatctaccatagtctaatgatcccaagaagctagcgagttccatttcttagcaacgaaggtagctgcgcgcattgttggaagccgcgcgcgcggcgtacataggcctcgctcttggcatcaccagagagcttccaaacaaagcgccttttgaaaatgcgcacacaccactactagtgtctctgaaccgtacgtaccccacgcatattcacggaccaccatatatcatggctaccagcagaaagcgcaggccagtacctaggcctcttaacacttccattattggggctagctagctgctacgtgtaggtgtagtgcagctcccatcggtccgtctctccaatctggataggccagtgcgtcgcctaaccactccactctacatagagtctaccgaaacaagcacgaaaagcaactcacatgaggtctaccgagatataaagaagctcgtgcttttggaggaacttataaagatatgcacacaaggaccagcttctaatcagttaacttcatagatagcccaacctctctttattgtcttcactattaagctttaggctaaactgtcgtgtggctcattaattcccttcggtacgtggcgacgatcccactataaacatggtcgctgtgatcccgtgagactatatgcccctctgagtacaataatattgtgtacaaacactaacttgtaaggggtattcaagccacacgaaatactaagcctataccgagagcaagcacataagcaatagtctagctagcctaagcanttcgttaagcacctacactaatcaacatatgtatcactaagcattattactaggagaatctaaatcgctacatggacgtgaatggcctataaaaattctttcaagaccacaagatactattaaaagttaattagtataagagaaggcgtggaagcaaatatttgctctagctctgtcatcagcacatgggtaaggtcatactcggctactaacaagacacatttaaggatcatagtataggaagctatagtggagaccagccactaggaccaccgcacttgggccccatgcggccatgccccaaaacctcccctaatcttggtctgggtaggggtttagcactagagcaggtctatccccgccgaatatctttccctaggcggtgaagcactgaagcctaaataaataagcatgaggctctgatatcaatcaagatgcctaaggggagggtggattgagataatataaagataattaaaacctatcaaataactcacccacatcccttatgcctacagtgttttctatttttaccataaaagttttgtatcctaagttccaaccctattctagcatgacaactttagaaataaa

SEQ ID NO: 8253 - DNA, 1325 bp, Zea mays
  misc_feature (2)..(2): n is a, c, g, or t
gnaagcttcaagggagggagggagggagggacagggagagccagagaggggggagaggaaatggtcgcggcggcggcggaggtgtcgacggcggcgacggctagcagtagccccccggcggaggagggggagcggcgggacgagagcgagagcgacggggagatggcggggctggcggccgtgctggacttcgacatgctgtgcgcgtccgtggcgctgtcggcggagaggaggaaggccggcgcggcgctggcgggcgcggccggcgactgcggcggtggaggcggaggggtgcagaggatgtgggagggcgacgtcgtgctggattgcctagacgaccggcgaatcgcgctcgagacgtcctgctgcccatgctaccggtttggtaagaacatgcggagagccaatctcggatcttgcttccttcagggaatggtttactgcattctgttggctgctgtcctaatcagcctaattgccttttctgtaacaaggcatcatatatatttatatatgggaatcggctctgtcctcttgatagccatctatactggttatttccggagaagaatcaggaagcaattcaacattcggggtactgagagcagtctggacgattgtgttctccatctcatatgtccttgctgtacgctgtgccaggaggctagaactttggagatgaataatgtccagtgtggtgtctggcatggccgaggtgataccatttgtttagggagcaacggtgcaggaaacaaggctttcgctgccctgaacaaggcctctctcgtgcctataaagtccccggggatgtgtggcatggatagatcgtcaagcgcagccgacgagcagcagccgcttgtcccaccggaccaactggagcaggtttaggtattctctgtcgccacgacctctgcactttcctagaagggcttggacagcgccgacggaaaaaaaatcgttctctgccggattattaggcgcctgcatccattggtcccgagaactggactttgcaactaccgtacatgggtgatgggcgcagtcgacctgctgctgctgctgttgtaaaactcagtgatagattttcacgtgcagtcgaattgtttaggtcgaagactgtatcttcagaatgtcacgacacgtgctcaggccttttgcctgaatccaactgtaaatttcagatccaatctagcagttcgagttacatacccagccatgagatggtaatgttctcttcaccggccgtgcttgctccctgtatctttcatacgctgccccttgtcgttcctgttctcaggagcttgattaacactgttttctttacg

SEQ ID NO: 8254 - DNA, 2229 bp, Zea mays
gatagtacttccagtggcttgttcctgtgaacaagctagatgctactccaaatgatataccagtagggaaagtggtatcttgtgactcgagcaatgatgaggcaatggatgacaatgatggcattatcttggaagatgatgacaactctagggcgctagttgtgtatggacaaaaacaagaaatgtgtctcacggttcttccggttgttccttccgggtcacaccacaagcaatctcgggaccatgatatagatgctcgaagcaaagttaggaagttgctccagttattccaggcgacataccgaaagcttacacaagttgaggaacaaggtaaacgcaaagttggaaggattgacattgaagcagctaaggcactaaagaacgaccctatttataaaaagcttggggctgttgtgggaaattttcccggtgtcgaagttggcgatgaatttcattttagagttgagctgtccataattggtctccatggcccacttcaagcaggtattgccacttctaaggtgaatggtatcaatgttgctataagtatcgttgcctctggtggctatcctgatgaattatcaagctcagatgaactaatatacactggttccggagggaaggctggtgggaataaagaaggagatgatcaaaagcttgagccggggtaatcttgccttgaagaattgcattgaaaccaagaccccggttcgtgtgattcctgggttcaaaggccaaaatagaagtgaaattggtcattctaaaggcaagcaaacttcaatatttatatatgatggattgtacgaagtgttggaatgttggcaagaaggcccaaaaggcgagagggtcttcaagtacaagttacagaggatcgcagggcaacctgaattagccctacatgcagttaaggcaacgaggaagtccaaagttcgtgaaggtctttgtttgcctgatatatctcaaggaagggagcggatacccatatgtgtcatcaacacaattgatgacatgaagccagcaccatttaaatacattaccgaagtcatatatccagattggtatgaaaaagaaccaccaaaaggttgcaactgtacaaacggctgctcggactctattacatgtgcttgtgcagtgaaaaatggaggggaaatcatgttcaatttcaacggtgcgatcgtcgaggccaggcctctcatatatgagtgtggtccatcatgcaggtgcccgccaacatgccacaacagggtgagtcagcatggtgtcaaaattccactagaaatattcaagacaggcaagacaggttggggtgtaagatccctcagttctatatcatcaggcagtttcatatgtgagtataccggtgagctattggaagatgaagaagctgaaaagagagagaatgatgagtatctatttgatattggtcataactaccatgataaagaactttgggaggggctgaagtcagtggttggtctaggatctgctacctcatcttctgagaccatggaaggcttcacaatagatgcatctgagtgtggcaatgtgggaagatttatcaaccatagttgttcaccaaacctctatgcccaaaatgttctctgggaccatgatgatatgaggatgccacatgttatgttttttgctgttgagaatatcccgccactacaggagctgacctaccactataactataagataggggaggtctacataaatggcgaggagaaggttaaacattgctactgtggcgcctcggattgctgtggaaggctctactgaaacattattgactgttgttagctctatgttttgaacacctctgtcctgtctctgcggtacccttctattctcagttcgccttgtcttgtcggcgttctgatgtttacagcaagctgcatttgatcttgctgttttcatttagaaaaaaaaaaacattctgcttcgctctactgtgttttgaattgtgaatgaattttgaatggaaccccgttgtaccatgtgttcatgtggcaaaaatggacgatgatcgtgtcagcatgctggggcgttaattttttttccacagagctgactggtggcattgtaaattggacaatgttattatataattaaaatcttaaaatctggtttaatcttaaaagtataaaaaatactgagctccattggcccttaccttatgagatttggaaatctttgggttcctgacgagtgtaaattctttgtaac

SEQ ID NO: 8255 - DNA, 2458 bp, Zea mays
tttttaatgaaaaagttgtaaaataaaaggaggtcgcagactggcttttcctggtacaaggtcattcacaacttcacaatgctgataggtcacttgcgttcatcgacgatttaggccctgtttggcatagctgctgctggttgaaaaagcagcttatctgagaagctggtgaaaagtagcttctgcttattgtctgcttttagttaattctgaaaagcagctgaactaataagctgctgcagaagctccttgcttggcacaacttctacttaaacctgtgaagaagatgaaaataagctgtgccaaacagggccgtagtcaacttcactatcttcatgtcatgccccccactctctcctccaaaacagtgtttgatttaggttttaaatgtattttgtcagccaaatttgttgttagccatggtaatatatgttaaatcaattctttagctgccttaagaaatgaaatgttttaacaccacttaacatatgctacgtatttcaaccctcaggttgctgaaattctgctagatcaagaatcttttgaggcaaacatccgagattactcaaaattaattgatcttcatgctaaagcaaataatgtggaaagtgcagagagagtacttggtaaaatgaaagagaagggtattgcacctgatgtcatcatatccatcgtattagtccacatgtatagcagggcaggcaagctagagcaggccaaggaggcttttgattttattcgtagggaggattttaaaccagatcggaaactcttcagttcaatgattaaatgctatatcaaccatggagaaccagaacaagcagaaaatctgataaaagttatgagggatacacgtgtcaaacccactagagaaatctacataggtctcttacgatcatatgttcagcgaggcttgatggcatatgcagagagggttcttaagacaatgtcatttgatagagtcgagcctacacaggaactctatacaatatgtatagaagcatatggacgtgttggtgatccaaaagaggcctgtgccatgtttgatcaaatgaggaggaagtttggacacgaagcagatgacagttcaattgctggtgtggtggccgcatacatgaagaataaccaactagaccatgctttgcagtggctgctgagtttagagaaggaaggacttcaacttggtgtcaagacaaatctcatgttactggattggttgtctatgttgcagctagttccggaggctgaacagtttgtgcagaagataaagaatcttggagaagagcccatagaagtccatgtgttccttgccgatatgtatgcgaagtcgtcccaggaagataaagcccgcaggtccctcaagatcttggaagagaagaagaaactattgaagtctgatcagtttgagagggttataagaggccttgtcgatggtgggttttcggaggaggcaaataaattctacaaaatgatgaaatcctgtggctttgaaccatcaaaaacaatcgaggtcgctgttaaggctctcaggattaggggcggttctcatcgcactggtaggtagagcctgtacgccggcagagtggcagtgatctactgggcacgcagtcaggcaaagagggattctggtgtgagaaccttgtggcactgacacggtacaatcaaattgacaaaactcagtgctgaaagatggtttggccaattttttttttctggttgtcaattgtctcgaggcgcgacgttgcttccatagactatgtagttaataggtcctggctaaatgactttgttgtttccagtgatcaggattttcacttgtattagatgaggtttgaagtgattgtaacactgatccatcttccaggttgtgccaaggaaaacatatatccgcgattagtagtggttattactctgttcagacatgcaatgatgtaagttaataaatattccttctggcttccggtcaaaaaaaaaaagataaaagacccacatcaataacttctagactttattgagtctggaaacatactaattatgtgtagatttgcattagatatactcgcaaaattttagttgtttaagagacattttaaaatatattagaggttaaaaatatttaacagaagacttttcaaatcaggtcatgtgtagattcgcattacttgcataatattataaatttaaaagagtttaaggaaagatattagaggtcaaaggcaacggatgattgttcagcatgatatactgtctatttaggattttagggtatgatttattgctcccactatattatgtatatcatactccctccgtttcaatttaaaatatgtttaactttttatcttaagtttaaacgactcatcttattaaaaaaatttgttattattaatttttattgtgatgtcatttagcatataatctactttaagtatggctttgaatttttgaatttcccgca

SEQ ID NO: 8256 - DNA, 781 bp, Zea mays
aaaaaaaaaaacacgcacaccgcgacccagtccagagccagtacgtgcgaagcagcacgcacgctgctggtccgcgtacgcgagacgacggtcaggtcggccggtgcttttcagtttggaataatgacggcgacgacgacgacagccgccggcggcggcaaggtgcagccgcgcggcctgcccgcggcgctgtccctgctgctgctcctggtgttggcagcggggctgggcggtggcgccgaggcgcagcagacgtgcgcggggcagctgcgcgggctggccccctgcttgcgctacagcgtgccacccttgccggggcaggttccgccggcgcccgggccggagtgctgctccgcgctgggggccgtgtccagggactgcgcctgcggaacgttcagcatcatcaacagcctgccggccaagtgcggcctcccgccagtcagctgccagtaatgagctgatgatagccagtgcgatgcactgggcaaaaggcaagggatccaaacacgctgaataataaaaggccaccggcgtcgagtcgactcggtgtcctcattccgtcattcgtagtgaatgctaaagcaaactcttgagggtcgcgtgcccttttgcgatcttgtacgcacacgaccggcctgtggctgtgcaatgtgcaacatcgctttgattcaaagaaccaacaataatacagaacccactctgcacagcagggctcactgaaacaaaaaaaaaaaaaaattatcgatgaaccgcccgcgggggcccgccccgtccccaatcg

SEQ ID NO: 8257 - DNA, 1970 bp, Zea mays
  misc_feature (1314)..(1314): n is a, c, g, or t
agccgtatcactaccaccttcacatatatattttttcaggttagatcaacaaatagcttcacattctgcagcccctgtaggagtcctcatactaaaatttttcagtgaaatttataagtctcacatatgtgcaatgctgcatcagagtaagaatttactgcaaaagtcagttgttcaaggcaaaaatttgacagtcttcatatgtagttttgatcattgtgaagagtatatattgcagtcattgtaccatggcacggtctataatacagacaattatcaaaagtggagagactacaaattaaacccttccaccacatgataaagttagattagtatagccctacaggaggcactatacgggaacataccaaagaactcacataagggcatgatcaaaagatagggcccgctgaggcatttatgcaaacagacctccgtctagcaacgggaactccatagtttcattgctaaaatctggatcatcataccagttattctgcagtccaggtagtaccattgtatcattgcactggaataaatcgatgctattcagtcctatatccccgaaggagacgccttgaagttgatagccggacagttcatcaggtagacaagtcaaatcagtgctgcataatatacttgcctcttctgaagtaagcaaaatggcttggttcctttcctgatcaaagtcacaatctttaacgctggacaacccctccacactggaaatcttcttgtcattgttagttgagctcacaacactgtcactgagttgagcagaaactgactcaactgtacatgtcagtgccggtgataaggacttcatacagccaagaagatctggttttacatctgagaagtctctgacatctccctccacactgcaactcatcgatattacaggtggtggggcataaagatggctaggcgcaattgggtgctctaagtccggtttgggcaggcaagaatagtctcctagaaggtcgcagcgctcatggttatgctttggatactgcatgaactgctttggtggcacaccaccactccaggactgacattccaagatcatggcttccgatagcttcgtgtcctgattcactggcattctttcaaaagagaacaccccacccccacctaaaggtgaaacaccggtgatgttctgatggtcagcagcatcacttgctgaagttccatttttatctggcactttcaagggcactgaagtcttcgtgtcgtccagatgaggatcgagaatgttggtctgagattggaccttctgagaactatgctgaaatccattggtaaggtttcctngctgctcttggaaggaacttcggaggttaagattatctgatggccccttttgattgaaatcttgcctagccgcacccattatcctttcttcgttctgcttttgcaacctactcaagtagaggcgatatttctgcacagaaaaaaatctatcactaagataatcgagacctaattacaagcatcagagaagaaaaaagtaatattagagaaacattcataaattcgaaggcatacaaggatgttaagtaagtattgagttacatgatctctttcaatctttgtttatcttttccatgaaatcttgaatgactttgtatttcagtttttaagttaaggatgaagcacgtgcaaattgcttggaactaaaaacttcgttgatgttgttgttatttttctttcaaaaaaaatgctgtcatatgttaggatccaagtaattgtttcttggaacaagagcatgcaagggatgttttgtttttgtaaatgcgcatgacatacacaaaacactaatgcatgtacttggataggctttttctacctattaatacaatgacatgcaactctgttgtgcgttgtgcggaaaaaagtgcatgttgcaaagaagttttcagctttcaagcatggacaaatttgtttcagcttgaaaattgtaacaatct

SEQ ID NO: 8258 - DNA, 1039 bp, Zea mays
cctcgaggccggccgggccgggtttacatctccccagtgggagagtggacgtcataatttgtggtagagggggtacgcgttcgcgcggcccccgccgtgccacgcccccacccagctcttctcggcggcgccctgacctctcctttttcctcgccttcgatcggcggcccccgccgcgctcgacttcccccccctcgacttccgtcccgccgccgccgccatgaagggacccggcctcttctctgacatcggcaagaaggccaaggatctacttagtaaggactacacctacgaccagaagctgtctatctccaccgccagcgcctctggagtgggcctgacttccacagctgtgaagaaaggaggtctttattctcttgatgtcagttcagtttacaagtacaagaataccaccgttgatgttaaactggacacagaatcaaatatctctactacattgactgtgttggacgctttgccatccacaaagcttgtcacttctgtgaagctgcctgactacaattctggaaaggtggagctgcaatacttccatgagaatgcaacttttgctactgttgttggcacgaagccgactcctgtgattgatctttctgggacagtaggtgctcaaggagttgcatttggtgcagaagctgggtatgacactgctacaggaaaatttaccaagtacactgctgcaattggtgtaaccaagccagactaccatgctgcattcattctggcggacaaaggtgacaccattaaagtgtcaggtgtttatcaccttgatgagaaacagaaggcctcagctgtggctgagctaacccggaggctctcaacaaatcagaacacactcacagtcggtggactgtacacagttgatccccagacagctttgaaggcaagactcaataacactggaacgcttgccgcgcttcttcagcatgagcttaaacccaagtcgctcttgacaatctctggtgaattcgacacaagggccctggacagatccccaaagtttgggttggcgcttgcactg

SEQ ID NO: 8259 - DNA, 1427 bp, Zea mays
gtcgcgcggctcgcgccccgcccgcaggaatccccacagctcacacaggcacacagctcctcttggcggcgcctctgacttcgtcgcccttctcctttttcgtcgcccttctcctttttcgtcgccttcgatcggcggctgcctccttcctccacttccgtcccttcaccgagccgccgccgccactatgaagggacccggcctcttctccgacatcggcaagaaggccaaggatctactcagtaaggactacacttacgaccagaagctgaccatctccaccgccagcgcctctggactgggcctgacttccacagctgtgaagaaaggagggctttattctcttgatgtcagttcagtttacaagtacaagaataccactgttgatgttaaagtggacactgaatcaaatatctctactacattgaccgtgttggacgccttgccatgcacaaagcttgtcacttctgtgaagctgcctgactacaattctggaaaggtggagctgcaatacttccatgagaatgcaacttttgccactgttgttggcacgaagccttctccagtgattgatctttctgggacagtaggtgctcaaggagttgcatttggtgcagaagctgggtatgacactgctacgggaaaatttaccaagtacactgctgcaattggtgtaaccaagccagactaccatgctgcattcattctggcggacaaaggtgacaccattaaagtgtcaggtgtttatcacctggatgagaaacagaaggcctcagctgtggctgagctaacccggaggctttcaacaaatcagaacacactcacagttggtggactgtacacagttgattctcagacagccgtgaaggcaaggctcaacaacaatggaacgcttgccgcgcttcttcagcacgagcttaaacccaagtcactcttgacgatctctggtgaattcgacaccaaggccctggacagaccccccaagtttggcttggcgcttgcactgaagccctgatcagatcatcccacagcgattgctggtgaattttgaattctttggttgtttttcgcaaagctgtagccaataatccgttccacgaaccttttctgttattctggcaaacgtttggagcactgtggcttagatccggatgggtcgtctacaggaattttacctgcctgcttttattgttggaagcatctggccgtcggtagatgtacattgtgcttgcttctttagcacctaggcctctgccactgtgttactgagtagacgctacggtaatcttttgcatgcaggactagcatgataattttgtgcggtgtttgatttaccgctctttacggtttaaaaaaaaaaaaaaaaaaaggcccctagggccaaaaaaaaaaaaaattaggaaaaaaaaaaaaaaaaaaggccccta

SEQ ID NO: 8260 - DNA, 3023 bp, Zea mays
gcagtggaacaacgcagagtacgcggggggacttagatgactccataaaacgctcatccccttactaatctagagggagaaaaaacatagcggcctgcccctggatagaatatatgcaatttttttgtcttgctggatggactagtgtatcaaacttgatgtggtaaaaagtgttgctaagatttctgctacatacattgagacccccccttttttttttttttttgcatgtaattaaacagatataaacaccaaattctttgggttttatcaagattctagcaaggttgttttgtgcaaacatactctaaaataagtaatacaagtcattaattttagcgcttcaaggttttttgcaactacgattgacaaggtaaagcatgggagcgctaaaaaaagattaacctacaaaagatagcggctctcaacctacaccttaaaattcatgtgcacatgccgcctactgaagtaaagagcacctacactcttatatgtccaaatcatcatctggatcttcatccgagtcaggttgctcgtcatctgaatcacggaagtaatgtatttcaccctttgcagttccagatttgggattttttagttcatccacaagggccggtgcagttaaattggggtcacgttgagcctcaggtagggaccggcgaccatcatatatatgaattggttggccatttccttgatgttcgaaaggaagaacaacatttgccctgtcgctacgctccttctctgacagctcaagattgaactgaaccttaggcactagactttggttcacttctatacttacagaaggagccgaatcaaatttgatatcattcccctcaatatacaggttctcgtaaaggtgcttcacccgtccatttcgtcgtttaaggcgaacaataaattttgcttttgaataattttgctcaaggatagacatgtttcccggactctctccacaaacaggatccacaagtgctggctccacacaagcaaccatagtagaaagacattcaaatgctcggggtaccttgggctcatggaggtctgaatgtatcatccaaaagattgatgatacttgttcatggcttcgaaggttactaagaaggcctgaaattgatgacactgaagcatgccttaacatggagctaattgagtcaacagccacagaaaaatacgttttgccttctccttcaaaacctcctccaagttcagtagtggaggacatcaattttgtaacatccttcacacttctataaacagtaatattatctttatttgttgagaactgctttgcactgttcccttgatgctgctgattttgaatcttctgcttccatccaagtgggtcagagtagcaatccaatattctaacacatcggtccaaagcatttgcgtcaaggctgcggcggcgcatgaattccaggtacacctgtgggctccgatcaaacgccacaaccaccaggcccctggcctgcgccttccctgcggcgacctgggaggcgaatgcggccgcgatgtggagcatcgcacccgccgcgagcgggcagcactggagtgatccctccacagccagtgccggcgcgtgctcgccgtcgagccgtccgtcccggaggcacctcacgaccgcctccgccatcctccccgccgccgccggccgccgcttagagcctaaaccctagcccccacaagagcccgagacgggtcgccaaactcccggaaggcctggaggcaagagtaacgcggggcccagctgtcagagaaacacgggaccccttacccgggtccccgtggtgcaagtcggccctcgacccggccgggaaaccttttgccgtcttgcggcggccttctgctccgccgctcgttctcatctcttgcagcggcctggggaaaaagaggaggagagatcggagatgaaggcgtgtgcgaaggctgcgggggagaggctgccgctggtctgtgctccgtcaactaggcagcctctagctcggagctttgttaaggtaagaagattaccctctcaacatgagacgaagtcacaagtatcctgctcagttagggtgtcagaaaacacagctcacagaatagatgccacagcagaaaacattttcccagcaatgaaagatcatgtcttgaaagcaactgatgcaatcaacagaggagaagtgattgcggtgcctactgataccatatacgggtttgcatgtgatgcatgctctgcaggagcagttaatcgtatttatgagatcaaaggacgcatacaaacacggcctctggcaatttgtgttggtgatgtctcagacatatcacggtttgctttagtggaccacttgccacatggcttgcttgatagtctacttcctgggcctgtcactattgttctaaaacgaggtgaaaacagcatattagagagatcacttaatcctggcttggatagcattggagttcgtgtgccggatctggatttcatacgatccattgctcgtggtactggaagtgcacttgcactcaccagcgccaacttaagcggacagcctagtagtgtctgtgtcaaagatttcgagggtttatggccacattgttcatatgtctttgatggtggagtacttccttctgggcgtgctggttcaacaatcgttgatctaataacaccaggagtttacaagatattgagggatggaagctcaaggaaggaaacagcagcagtgctcggcaagttcggctttgttgaagcgttgtaactactcggcactttaagaaagtaagcacgatcaaagagtggctgtcttatccacattatatcttgtttaattagtgatacattagagcttttgttgctgtttgtgcttttcttttacatcttcaaacttattgtattattgcgaatgtgatgttgagtagaataacagagttcacattatttaagctgtgtagagtgtgtgacatgggcttgttttgtagcaaatgaagcagctcagttgtggattttggatgtgttgtgaacgaaaatatgccattttctt

SEQ ID NO: 8261 - DNA, 952 bp, Zea mays
  misc_feature (901)..(902): n is a, c, g, or t
ctcgaggccggccgggccggtcatcgtcccctctcgcgcgtttgtcatttgtcgcgccccacagctccccacagctcacacaggcacacagctcctcttggcggcgcctctgacttctcctttttcgtcgcccttctcctttttcgtcgccttcgatcggcggccgcctccttcctccacttccgtcccttcaccgagccgccgccgccactatgaagggacccggcctcttctccgacatcggcaagaaggccaaggatctactcagtaaggactacacttacgaccagaagctgaccatctccaccgccagcgcctctggactgggcctgacttccacagctgtgaagaaaggagggctttattctcttgatgtcagttcagtttacaagtacaagaataccactgttgatgttaaagtggacactgaatcaaatatctctactacattgaccgtgttggacgccttgccatgcacaaagcttgtcacttctgtgaagctgcctgactacaattatggaaaggtggagctgcaatacttccatgagaatgcaacttttgccactgttgttggcacgaagccttctccagtgattgatctttctgggacagtaggtgctcaaggagttgcatttggtgcagaagctgggtatgacactgctacgggaaaatttaccaagtacactgctgcaattggtgtaaccaagccagactaccatgctgcattcattctggcggacaaaggtgacaccattaaagtgtcaggtgtttatcacctggatgagaaacagaaggcctcagctgtggctgagctaacccggaggctttcaacaaatcagaacacactcacagttggtggactgtacacagttgattctcagacagccgtgaagggcaggcnntcacacatgggacgctttgcgcgcttcttcagcacgagcttaaacccagt

SEQ ID NO: 8262 - DNA, 1755 bp, Zea mays
cgacatgacagcccgagaaaaaagctggagcaaacacagtgaatcgttgctggtggttggcagttacacatcacacactaatagatggaagggggaaagttagggagtatatgtggctacacacttaaatcaaaataaagtgccattttttacggtctgattaatacgacattttttttatttttcagtgcaatgcccccgacctgcagcgcaaagtgtattttcgaatgaataagcacaggacgattatttaaaaacaacctaaacatatattatcatcggcattaaaattgtacaagcttatcttaatctgagaaaacagatacgatttggatatctgaaacagccaagtacatatccaaaattgatttgacacaaaaatttggccgttcagatagactaaaattttcgtaaatttgtgttgtggtcttgtgcagaatgtctgaaacataaggactacgtaacaaagcggcaccattgctgcggcctgcgggtagctggggagcagcagggaccgaagctcggatttggaagggattagtgggctcctgcactctgggaatttagttcaaagtaccagatatgcaatgacgctcgcaggttgtgcaccggcagaccggcctgtccgcgaatagttaactgttttgtaactagatggttatatatatctcagattaagaatcattttaataatccgaatcactttcataatatgttttgttagcgacaaattttattccagattatcgtccaacacccatataaataattgatcagcggaacatattggcttgaaaagggggaaatacttattcaaagaggggtatcaattgcaaatacagggcaaaggctctcagagaaaggccagggttttccacaagccaagaaccagcggacgaggcctccagctttccccccttgctacgctaccaaatcttaccgaatccttctacctcgcactctcgcggaagaaaaacaggaactgcattcttcaacaagacagcaaggtttcacgaggaaacgccaagaaagaggagcctggcgcaaaaggggggaaggaagaaagcacccttccaatagcctttggttcggtgtggttaaagcaagaataatcatcatcgagccatcgattcgtcgtcacggattcaagatgcatatgattcattcaaatagattcacatagcaaaaaatagaaaaaacaaaaaaaatgcaaactgccaagaacaattcttatgattcactggtgtatttgaagcagattgttggaccttcgagaaaatgcgaggatgtatagaacgaacccgcatgtccagaggtccagaggtatgatatcgcatctcttcagaaaaccgaagccaggatccgcaaaacggcgaccaggggcttcagatctttcaaaacgcgaagagtgctcgagaaaaactaaaccaagaaaatagaacaagatttcagagcaaatttgcgaccagagagcgagacaagaagcagaattttcgaggacagaaactgcgaaaggagatgccaaagaaattgttgctgagtaacgaagacggcggcgcacaggtggaacgagtgcgatgcctttgcagccttatataggccttggttagggcatgcgcacggctgaccgggcaaattacaactatgcccattcttgccgcgtgggccaaaaatgacattgttcggcccagcccatctagcagcctaaaactgtttgcctcacactcgaccaaccggcagtgtaggtgagcaact

SEQ ID NO: 8263 - DNA, 2515 bp, Zea mays
ttgggtacctcgaggccggccgggatggaccagaggccctcacgctcacgccttcctagcacgctgccattggtagtactacaaaagcaggcgtcgtttttctttgcctccccccccaccttgtctggctcccttcttcgctctccatgagctgaccaaggctgggcagcaacacggcctcttccctggctcagagattccccccacaagaccacggcatttccccttgctactgagcaaacatcgcagccttttctttttgcgatttttcttcacatttttgtagacaccaacacccatcccttcagtgttctgaatataaatacagtagattcatccaacagaaaacacaaaactctcgatttgttctgatcactcggttccatctcccaaagcgaccccgccgccagtagattcatccggcggcggcaagaacttggttctgctccttccttctgccgtgcagaaacgatcccgccgccttcagtagcggtagaagaagccctatcaagcgagtgaagattcagcagcaggcgaagaggtcgagtctccagcgatggcggcggcgctggagtgctggtcggggcggccgagcaccgacgaggagatggtggagcaggtcctcatgaagccccacggccgttcagacgactccctcccgacctgcgctgactctgcctccgccggcgagccgacgtcggcgcccgcgccgcccaaccccaagaagtggcagcggctgggccgcaactttgccggcgccatcgccgcgttcaagaacacgctgagcctggatggcggcggcctcccccgcgacccctcgcctcgggccgagaagccgccgccgctcctcctccgtggcctcgcgcagctctactcccgcggcgccgccgccaatcagcagctgccggagaagctcgtagctgacctccgccgccacttcgatgctctccccaacagctacgcacaggcagcggttcgcatgaaagatgtcctcttgcatgcccgccttgtagagcaggcgaccggcgaggatcagcctgcggtgaacattgaggaagtccatggcagaggagctggtgatgaaggcactgttttccagctaacatttgcttgcactgccccgctctcgtggcagtcaatgtcaggatcactagacagcccttcgttctgctgcaagaagatccagatctttgagaagagaggtctgacacttggtgtcgtcatgatacttgtgcagactgggaacgagacgctcttcaagaaccgggttgagtctgcgctgaaatcggtagcaaagaagcaaaggaagaacagtggtggtggtgtgaagctgccattcgggctctgcggttgccaggaagaaggatcgagaaacttcgatgaggagtcgatgtttgatccggacgatggccaggtactcgacaatgagcctgcgcgcaggccacagctccccactcgcctaccgcagtcatcagtcttcgtctcggtagatgaatggcagaccatccgctctggtggcgaggagctcggtcgctggatgctgcgttccgaggagatcgagttcatcgattgggttggtgcgaattcgttcaggggtgtctatagaggaaagaaggtttgggtcaacaaattgaggggctgtgacatgggaagtgcttacgaagttgagattcgtcaggacttgctgcagttgatgagttgtggccagaggaacatcctgcaattccatggcatctgtttcaatggaaaccatgggctctgcatagtaaccaggatgatggaagggggatcagttcatgatattcttacgcagagaaacaagaggctgtccctccgggacacggtcaggatcgctcttgatgtcgccgacgctctggctttcatgaacagctacggcattgcgtaccgcgatctcaatgctaggaagatcctgctggataggcaagggaatgcttgcctcggggatatgggcattgttacccccttgtagtaatgttggtgaggtcactgagtatgagacgtctgggtaccgatggctggctccagagatcatcgctggagatcctgaaaccgtctccgagacctggatgagcaacgtctacagctacggaatggtgctctgggagatgatcaccggagaggaggcctactccgcctactctccggtgcaagcggccgtcggaatcgcagcctgcgggctgaggccggagatccccagagagtgtcctccttttctgaggtcactgatgaacaggtgctgggacaattcccctctgaagcgccctcagttctctgagatcatatccatcctacaaaggcagcagaacgttagatagtgttcttttcttttctttttttctcttccccccttccttctatattattatatatgctatatatcagtttggcttggctgtttgcatgcctaatcatgcaggaaactgcatctgagaaaaaatataatataattatatatgtgcagtgcggaggcttttttagtataatatttttttag

SEQ ID NO: 8264 - DNA, 2010 bp, Zea mays
atcaaatctatcactgtcctgtggggccgtcgccggtcgacccccatatagttctccaccaggccgccgcccacggctagacagcctcccattcatcagattcagatcagatcgtagcagccaaggattccgcgctccgggggtgccatgaagctgaagctcctctctccctgccttctcctcctcgccttctttgccaccgcggtaagcacatcatcggtcatctgctgtctgctgctattgcgctgtggcgcctacgaagtcgcctcttgaatcgattattcgctccgtctccgcgcgcgcctttatttgcttgattcatcaggcgtacgcggcgtcggcgtcggcgtcgcgcgcggcggccgtcgtcaggggcgcgggcgccccgtcgcagtcggagttggacgcgcgcccggggaaccagtgcgtgtacacggtgtacgtgcggacggggtccatctggaagggcggcacggactcgaccatcggcgtgacgctgctgggccccgacggcacgggcatccggatccgggacctggcggggtggggcggcctcatgggcgccggccacgactactacgagcgcggcaacctggacatcttcagcggccggggcccctgcatgagccaggcgccctgcgccatgaacctcacctccgacggcaccggcgcgcaccacggctggtactgcaactacctcgaggccacggtcacggggccccacctcgggtgcgcgcagcagctcttcaccgtcgagcagtggctcgccaccgacgcgtcgccctaccgcctgtacgcggtcgtcgacaagtgcaagacgaagcggcaggagccgcgacgctcgccggccggcgaggccgaggccaccgtgaccgcgctctaggtacgaccagtagtaaatcatcgacagaggctagctcctgcctctgctgtgtgtaattactgtatgtgagtgaccgatcccatcggattgcgttcgtcttgtggagacgctgcgtgatcgcgcgattggtttcgctttcgccgccttgtttttgcacgaggaggttctgctagtgcgtacggggagaataaaagcagcattcctgctgtccaaggcctgtcctatattatttctagctgagtttgactcagctggtggggtgtcgacgtgtggtaggttggttatgtgtctgcatcagctcacttgccaccggatggcggtcatttgccacttggcattggtttctccgtgcctagctatcgttaatatgtgattgcgagtgattgcgaaggccgtgtttggttcagtttctgtgcttcggggcaggggtggataacgagtcagctcggctcgttttcgagctggctcgttaagttaacgagccaattcagctcggctcgttaaggtaacgagccacaaagttagtttggctcggctcgtttacgagctcgagctgactcgtttagctcgcgagccagaacagaaaaaattaatatatacataataattatttttagttaattttaaactaatttaacaatagaaaatagtaattatactcatagtttcacaaaccacgtcaatgtaacaccaaattagcacaattcatcattcattaattcacaattcacatacatgttcatcagtttaatccataattatatttgcatagaccaaattaacacataaacatagttcattaatcattagtttaattcataggttatagacatctcacatatatataacatgttcatcaattattctgtaaatgatatgcatatagtttcgttttgctagaatatggtaactcgtttagcttgcgagctggctcgttaacgaaccgaactaggatgtcagctcaactcgtgaaaaaatttaaacgagccgatccaagccgaggcgagttgaccataaaccgagcgagccacgagcattttgtccggcccttcttcgggctcggtcagaccatctcatcatagaccttgtaaaatagatcttctatactgcaattaacgttccacggg

SEQ ID NO: 8265 - DNA, 1012 bp, Zea mays
ccggggatatcaaatctatcactgtcctgtggggccgtcgccggtcgacccccatatagccattgggtgcctcgcggccggccgggagacagcctcccattcatcagattcagatcagatcgtagcagccaaggattccgcgctccgggggtgccatgaagctgaagctcctctctccctgccttctcctcctcgccttctttgccaccgcggcgtacgcggcgtcggcgtcggcgtcgcgcgcggcggccgtcgtcaggggcgcgggcgccccgtcgcagtcggagttggagtcggacccggagaaccagtgcgtgtacacggtgtacgtgcggacggggtccatctggaagggcggcacggactcgaccatcggcgtgacgctgctgggccccgacggcacgggcatccggatccgggacctggcggggtggggcggcctcatgggcgccggccacgactactacgagcgcggcaacctggacatcttcagcggccggggcccctgcatgagccaggcgccctgcgccatgaacctcacctccgacggcaccggcgcgcaccacggctggtactgcaactacctcgaggccacggtcacggggccccacctcgggtgcgcgcagcagctcttcaccgtcgagcagtggctcgccaccgacgcgtcgccctaccgcctgtacgcggtcgtcgacaagtgcaagacgaagcggcaggagccgcgacgctcgccggccggcgaggccgaggccaccgtgaccgcgctctaggtacgaccagtagtaaatcatcgacagaggctagctcctgcctctgctgtgtgtaattactgtatgtgagtgaccgatcccatcggattgcgttcgtcttgtggagacgctgcgtgatcgcgcgattggtttcgctttcgccgccttgtttttgcacgaggaggttctgctagtgcgtacggggagaataaaagcagcattcctgctgtccaaaaaaaaaaaaaaaaaaaaacttagacacg

SEQ ID NO: 8266 - DNA, 1139 bp, Zea mays
cattgggtacctcgaggccggccgggagacagcctccccattcatcagattcagatcagatcgtagcagccaaggattccgcgctccgggggtgccatgaagctgaagctcctctctccctgccttctcctcctcgccttctttgccaccgcggcgtacgcggcgtcggcgtcggcgtcgcgcgcggcggccgtcgtcaggggcgcgggcgccccgtcgcagtcggagttggagtcggacccggagaaccagtgcgtgtacacggtgtacgtgcggacggggtccatctggaagggcggcacggactcgaccatcggcgtgacgctgctgggcgccgacggcacgggcatccggatccgggacctggcggggtggggcggcctcatgggcgccggccacgactactacgagcgcggcaacctggacatcttcagcggccggggcccctgcatgagccaggcgccctgcgccatgaacctcacctccgacggcaccggcgcgcaccacggctggtactgcaactacctcgaggccacggtcacggggccccacctcgggtgcgcgcagcagctcttcactgtcgagcagtggctcgccaccgacgcgtcgccctaccgcctgtacgcggtcgtcgacaagtgcaagacgaagcggcaggagccgcgacgctcgccacctgcagccggcgaggccgaggccaccgtgaccgcgctctaggtaccagtagtaaatctaaatcgacagaggctagctcctgcctctgctgtgtgtaattactgtatgtgagtgaccggattacgttcgtcttgtggagacgctgcgtgatcgcgcgattggtttcgtttcgccgccttgtttttgcacgaggaggttctgctagtgcgtacgggaagaataaaagcggcattcctgctgtccaaggcctgtcctatattatatccctatgacttgctctcagctcagtttgactcagctcagctggtggggtgtcgacgtgtggtaggttggttatgtgtctgcatcagctcacttgccaccggatggcggtcatttgccacttggcattggtttagctagcgttaaaatgtgattgcgaaggccgtgtcggcagataattttttgtgcttcggggctcggtc

SEQ ID NO: 8267 - DNA, 2994 bp, Zea mays
ggctgttgttatacgagttgttgatgatgtagctaatggtattccatctacatacacaaatggtgtatcatcaccaccctccactccatcttgttctcaaaatgaatctttggatccagctgctcacttgataacagggaatgagatcaataatgaagctctgacttctccatcttcggtgcaagatagtcctgaagataaaataatgcaagttgcaaaggctgtgtcttgtggcagtgaagtagttaaggcagatacattgccatatgccatgctgcggccgatagttgttcctagtatatcacgaaggtcatcacgatctgagattaagggtgctcatgatcacaggaggagcccatgtgtaccatcaacaaggagggacatacctattctaagaagacctccatcaccagtagtacttagtgttcctcgcgtacctaggccaccacctccttcacctgctggagagtcaagaaaacgagggttccctatcgttagatcccgcagctcaagtcctcgacattgggggatgagaggtttattttctgaagacaaaatttttcatagggctcagttttgcttggatggtcctgaagttgtatggccttcatggggtaacaaaggtacttctggtacattggtgcaaacaattgaggatactgttttgcaggaccaccttgttaagatttcacagctatcttgtgatcaacatccagatgtggcattgcctgtacagccactagatatgctaaatggttcgtctcacaaggcatccctctctttgatgcacaatgctctacatgaagaaatagatcaattctgtaagcaggttgctgctggtaatctggtgaggaggccctatataaattgggctgtcaaaagagtcacccgttgcctgcaggttctgtggcctcgctcccgtacaaatctatttggctcaaatgccactggtctggctcttccaactagtgatgttgatcttgtggttagtcttcctcctgtccgaaacctggaacctattaaagaagctggaattttggaaggccgtaatggcatcaaggaaacatgtctacagcatgcagcaaggtgccttactaaccaggactgggttagaagtgattcccttaaaacagttgaaaacacagctatacctgtgatcatgcttgtagcggatgtaccctgtgacacgaatatgtccaatgagtattcttcagtactagatggctcacaagactattcagttaacatgcttggagaacaagggagtcctcctcggtctgacacctctagttcagaaggcagcaacatgctgatgtgctcaaaattgaataaggatgattgtgatattgtgcagtcaattcgtcttgatataagtttcaaatcgccatcccatacaggactgcagactactgagttggtacgtgagttgagccagcaatttcctgcagttatacctcttgccttgattctcaagaagtttttggctgaccggagtttggaccacccctattcaggtggtctgagctcttactgtttggtgctgttaattgttcgttttctccagcatgagcatcatcttggtcgacctattaataaaaatctgggcagccttttgatggatttcttgtacttctttgggaacatatttgatccacgccatatgcgcatttctatccaaggaagtggaatttatttgaatcgagaaagagggcaaagcattgacccgattcacatagatgatccacattgccctgctaacaatgtgggcaggaattgtttccgcattcaccaatgtattaaggcatttgctgatgcgtttgctgttcttgagaatgagctactgcagttcagttcagaatgtagcatgcctgtatcttcattcaatatactaaagaaaataatcccaagtattgattctgatgagctgtagctataaaaaagaggtacgattccacagaatacaattgatgacagggtggaatgacctgtgctgccttctagacacactgatgtctatgcagctgctcagaagcctcagtgtggcaagtttgatacctctggaatagaccaaaaaatagaccggcaagatggcaatattcaaacgtgagctcttgtgtgttcatgcaatggcacatgatgccttgctccctgatcgagcttcttgatgttcagatctctgactgaggtaaattggcttactcaagaacaaggtggtgaattggctttctcatgaacaaggcgttgctgcacacagactactgacatggtggctgttcttgcacctttctgaataagcccattcatgtaatgtttggtaaatgcaaaccgcatgattatccgcttgatactgtgattgatagatgcttcacctcgtgccaatattctgtgttccaatgccaagtcacatattctgagcagcaactggagatttgctcatgtaccgattcttcaaggtcctaggatcatttggggtgatgaagattgtgaaatacatgtggaggggtacttatatggagatgcatggtcttagtaattaagcggtcaagaacttatggtcacctgatgaaaacaaggatggttgtgaagagaacggagtagtggcatcagctatcagggaaagggaagtgctattgacatcatggctgacccctttcagattatcgcgctgagatcttcctggcgaggattgggagctacgagccagatatccttgacggaaatgtttgcttggacagcgtaaaccggaaagtaccggcgatgatattgatgatgataatcgcactgctctctattgtcatactgttgtctgcactcttcagcgacatgtcttgtgccttttcaacgtgcgaaatgtgagcaattgctcttgtaaagctgcactatttcactaaaacattattgtttgggttatttagatccatggtattactatttatctatttggaaacttgcattaaaaaaaaaaaaaaaaaaagagggggggcccggtaccca

SEQ ID NO: 8268 - DNA, 2866 bp, Zea mays
  misc_feature (1003)..(1003): n is a, c, g, or t
ctatttttagtctattaatgacaatatggcattagacaaaatgaggtaccatatcaaaggtggtctagatctttcaaaataggactatgaggtgtctactgccttgcttctattgggcttttttgtttaattaggctaggtcaacaaccaaaattgggtcaacgatcgattaattgggtcaatgactgattaatcgggttgacccattacttatgtgattacatgttaatcatatcgattgtctatcgattatttgatgattaataacgatttctagaacaccgaaaattatgcacgaatgaggattcaacctatggttaagttgttggctccaacatctatccaatagagcacacatgtttttgtgttttatactttatactcaaacataaatagaaaccgtagcaacgtacgacgcttggctagttaacgttatacgtgattagttactaatcacgaagatatttattacaaaattgtagtaaatcacttagaaaagagttataataatattattaataaatatagtaattatcttaactcaaaataatcacaagataagttattttacaattggttttagaataatatccctactaacaagtggaggtcaaccttgtctgttggtttcacgttcacatctatctaactaaataaacatatatttttatattttatcctcaaacataatataaattttttttattaaaaaatagggaaaaataaaaccggtgtatatcgggtatagcctgatgtgtcgtacttagcttcagacgcgatccacttatgtaatatatagaaactacagtaataaaaatgcatctaactattatcaaacaatctatctgttttatctaactctccatgtatgtgtggagttgaacgatatcatggtatcttcactatcctctccagccactcattccttacaccttgtcccccgcccggccgccgaaagctcaactattgggaagggtcaagaaaagcgaggaagcaacgagcncaccttctccaactaacataaccagagcattctaccgtccgtcgtagcagcgatgatggctgtgacgtctctgcagttgcgcccaacccctcgtctccttccggcgagaaatagctccacgggcactgggccgcggatggccgccttgagctgcagacacaaccaggtactgacaaaattggctgatattctgctactgtagttgtagctagatctgctttgtatgcctggcaggctgctggtatagtagtgattcggaagcatccgctaagttttgtggccctatagttggagctacggtggttttggtttggttgaggcgaacttgctacatggccattgccagactgcaaggcctgatgctttttttgcagcagctgtgattactctgaaatcacgagcaggggctggtttaactcgtctttgttgtatgcaaagctacgagtatatacacacacacacacacgttgttgagaaatctactcgatcggttacacaaaactgaattcgcaaggaaaattaacatcagctgaaatgtatctcagtaatgttctctgccctatttttaacgcagtccaccaatgtccaaggacgaacagggctcagaagccacgtaacgacgcgcagagacgccctgtcattcgtgtcatccgcgctgctggcagcgttgttcgtggtggccggtgcagcagaagctagaacttcgaggttggagaacaaaaagaaagccctggagaagctccgggagaaggcgttgggccgaaaggaggagaacggagccaccggtggcaagaagatgccgcctccgacgaacttgctaatccgataatccctcgtccggccgtcgtggctaaaggcactttgccgaggggccctttgtgttgatggcgatgctaatgtgagtttgtacgttgttggagtcttgtatgactgccaactggaatctgagttttcagtctacattttcttaagcattgctgtactgtttgttcatcaggttatatgcctgaaaatccaattgttagaactgcatcttatatctaccattaggtttattagaacatcctccgtccttctcgcttgagagcaatcggaccattggtggcttcttcgcaaatcgacatgtggcgatgcatatttttcaaaaaaataaaaaagatctacactctggttctagctcttacagactatatctatcgtccaatctatatcaaccatcgtcaatccttatctactataacgctctagtgcataacctttatcgtcggtaccatatcagctcttcttcaataggcttttagttaacatgaaacatattgttttattgaaactcaaatacatcttattacgtaattaagctaacaaaatttcataatttttagtaataataaaaaattacataactaaagcataataataaaaagtagataatttataaataaaattacataacttaaacataaaaataaaaaatagatagttcataaataaaacctaatttatatattagattataagttttttattttttggacttaaaatggttaaaacaactacgtggcgtggcacatgcgtggatcaattagaaaaatgacacatcattaaagttggtcggtaccaaccagtttaggcctagtttaggtactctagtaataaatgatattggagtggattgaaatgtattgagagagtatttgatttattgtggatttacatcatcttaaatccctccaaaacactctaatctcaaagtatccaaactaggccttagttgtatcgaccagtcggtacagaccgattcaactccaacacaaatggcaccgactggtttagacgatcgtcagcgtcatcggccatctgctc

SEQ ID NO: 8269 - DNA, 811 bp, Zea mays
cctcgaggccggcccgggaacgatatcatggtatcttcactatcctctccagccactcattccttacaccttgtcccactgcctttgtccgaaagctcaactattgggaagggtcaagaaaagcgaggaagcaacgagccaccttctccaactaacataaccagagcattctaccgtccgtcgtagcagcgatgatggctgtgacgtctctgcagttgcgcccaacccctcgtctccttccggcgagaaatagctccacgggcactgggccgcggatggccgccttgagctgcagacacaaccagtccaccaatgtccaaggacgaacagggctcagaagccacgtaacgacgcgcagagacgccctgtcattcgtgtcatccgcgctgctggcagcgttgttcgtggtggccggtgcagcagaagctagaacttcgaggttggagaacaaaaagaaagccctggagaagctccgggagaaggcgttgggccgaaaggaggagaacggagccaccggtggcaagaagatgccgcctccgacgaacttgctaatccgataatccctcgtccggccgtcgtggctaaaggcactttgccgaggggccctttgtgttgatggcgatgctaatgtgagtttgtacgttgttggagtcttgtatgactgccaactggaatctgagttttcagtctacattttcttaagcattgctgtactgtttgttcatcaggttatatgcctgaaaatccaattgttagaactgcatcttatatctaaaaaaaaaaaaaaaaaaacctcgagggggggcccggt

SEQ ID NO: 8270 - DNA, 2791 bp, Zea mays
cctcaaggcccacttgagctctgaacctgatattagtcatgtaccaataaacccacgcgtggggtttgtcatacttgctcagtgatggattgtggaaggtaatgaagaaccaggaagccgtcgatctcgtgaagtcaatcaaggatccacaggcagcagcgaagcgattgaccactgaagcgttggcaaggaagagcaaggatgatatctcttgcattgtcatccgtttccgctgctgagttaccctctctccacggcactgatatccagtcttcgcctcatgatttagattgagacaatttgtctttgccgaattttccgatagaatatgctgtacctatcatagctgtcgacaggcctggaactaattagggtagtgaagacttgagagctggttggtgagtgtgtgcagggtgcctattcgcctgtgcatatgttgactctgcatccgttgatccggacttgggcgactgtcaggaccttagtgcttgtgtgcttgtgatggtaatggacctaatggctaatggtggtaagggaacttgttgataccaaatttggttaatttagttttttttcatggttcgcatttcgtagggtagatgcatctgatttcaaggaaacatattattagttcaaagtgttcttgatgtttcttaccttggtattctattattgatgccttacttgtccgcttaactgtcagttcaattgacatcagttgtggcagttcaattgacatcaatttcatgttcagttgatcttttgaaaaactgcttctgctgctaaaattcaggttgtcctacaaagtgcttatatgtgtttcaactattttaatagagataaagagagggcttttcacaactatttaaaaaatgatacaatagagttttttcacaacaattaattcataatacttttttatagttcataacatttttttcataacttaaagcaactcaagcaatagccccaaaacatggtccctactttttatttgagggtttccctactttaagtcatgttttagattgaactctacgaggagcctcccaaaaaacatattacatacatatgtatttgagaacactatattaaataatactctctccgtcctaaactagtagtagttttaactcttgatttttatatccatattcaaatggatatttagggctccatcagcaaaatatagatccaaaatggatccggcttggtgctaaattggtatctctgagactctacaccctaggggcaatccatgctggccaggccctagggccttagaagcccgagatttacataggaaccctcgacactcccaagatgccccgtggaggatggtcctgggcaacatggccttgacaccaagtgcacctagacctggtcggacgcaacaacaccaggtggttgcgatatcagataagactctcatccttctcatttattgtgaggagtgatgttgtagtcaaaaggtgtcactgtagccacacatgaggcagcaaccgtgcccgtagcactatatagcatgtgcaactataacaactgccaactacatcggacttgatgacgtagtgcattattgtagccatgtctaagaccacatacgtacccaccagtattatgtagtgtgcgtggctacaatggctactaaatacatcatactcgatggtgtgggctcacatacttgccactatggtatatcggagtgtgcgctcacatacttgccactatggtatatcggagtgtgcaccatatacgatacaacaactacaacaagatagtagtagttggatctttgttgggcggcacctgtcatccagacagggatgcactctctcctttcttgtgtttttatttattaccatttattggtgtttgatttgcacaagtacttttcaaattcaaatttaaatttaaattcaaatccaaatttattattttttaaaataacaatagttaaccaaggcgaacaattaacaagtacacgcctatgttaaaagagtaaattgaggcgggcactgtaactagaatacatcggttaattagaattaacggaggcagttgccttaaaatgatcgcctccgtcggttaataagtattaacggaggcggttgccttaaaacaatcgccttcgttaatactaattaaccgaggcggtcaagttacagtattcgtctcggttaacacattatataccgcgggcatgctaaccgtctccgttaatcgatgattaacagaggcctaacgttggaggtggttgcaatgcccgttccctttaattgattttgtccgtttctattaaagtttatgtactaatgactagtgaaatatcatttatgcaacttaacttttatttgttactaatgccaaatgcaaactcctttgtttatatatactgggtaagtcttgtagttatgttgttttgtaggtacctatagcatattggcgaccatgtcatcccgtagatgtcagcaaagtaggtgagccgtcaaaacacgctcttaaacaaggcagctactagttactccgatttattagttatgttcggtttgtattaatgtagggctcttaaataggaaagacatggtacggtaacaccgattattagggtatgtacaatcctgatattgttgtatgatactttaagtataagacacaactaaaacacaatataatacagtaacaaaataaatgctaataaaaaaaaaaaaaaaaccggcaagccatattaaaaaataaatttttaaaaaagtgtttcattctactgggggcggcccttttaaagaaccca

SEQ ID NO: 8271 - DNA, 1565 bp, Zea mays
atttacctattgccattcgtaggatagggccctagcgcgattagaagggacacgagcaaccgatgctgccgcagcctcacactcaaccaatatttctcctgtatacaaagaaaaagaaatcttccatacatcagactttgactcgcttctatctcgcgcaagccgagaagaaaggagcccgtctacgcgagagatgggcggctacgagaacggcgagtcgacggcggccgcggcgcttgctgacggtggtgtgattctgggcgtggacggcggcaccaccaacaccgtttgcgtctgcctgccggctgcaatgacgccgccggagtctccggccaccgtacccgtgcttgcacgcgccgtcgccggctgctcaaaccgcaattccgtcggagaaaatgctgccttggaaactctcgagcaggtcatgacacaggctctagcattggccaacacagatcgttcagctgtccgagcagtttgtttagccgtatcaggagtgaaccatccttcagatcagctgaggatgctggaatggatccgggatctgttcccagacaatgcaaaaaattatgtagaaaatgatgcagtggcggccctggctagtggtacaatgggaaagctgcatggttgtgtgttaattgcgggcactggatgcattgcttatggagttacagaagatggaaaagtagcaagagcagctggtgctgggcctgttttgggcgactggggtagtggatatggcattgctgcacaggccctgacagcagttataaaagcatacgatggtcgtgggccacaaactagacttacaagagatatccttgagaagcttgatctttcttcaccagatgaaatcatagggtggacatatgcggatccatcttgggctcgtattgcagcacttgtaccagttgtggtatcttctgctgaagatggtgatgaagtagctaacaaaatcttgcatgattcagtccaagagttggctgacactgttatagcggttgttcagcgtcttagattgtgtggcgaagatggaaaggacatgtttccacttgttttggttggaggggtccttgaaggaaataaaaagtgggatatcagtggtgaggtcataaaatgtatttccaaggtcttcccgggcactgatcctatttggcctgaggtggaaccagcaatcggtgctgccttgctagcctggagccatcaccacaaagggttgaaattggagaatggaagttgattcccagcatttaagggtgtcaattgtacattgaggagttggcgagccaaaggggtattggtcccaatgatacattcatcggcatgaaggcttttcgttcccagcaaaaagaataaatcgtggatgggtgcaaacatgcggtgtggatagaacatatttctgatgtaagtaggtagtaagaattgttcaaatattcctctgattctaactctcggtgattgttgtatgtgttctgtttgtgtttggaggtagtaacatgtatctgtctaccatggataattgatcgtcaaatgttcagatctttttttgaaaaaaaaaaaaaaaa

SEQ ID NO: 8272 - DNA, 1376 bp, Zea mays
ctcccgcggcctcggctgcaccgctctgcatactctccggtgaatcgctcccagtcccaagtccggatcgcaccgccaagcgttcagccatgagctccgctgcagccgccgccaatgtcgccgtcatcggaggcggaatatccggctccgtgtgcgcgtcgctcctcgccgcgcggggcgtggccgtgacgctcttcgactccggccgcggcgccggcggccgcatggcgcagcggagggaggtgatggaggatggctcggagctgcggttcgaccacggtgcgccctacttcaccgtcaccaacggcgaggttgcccgggtcgttggtgggtgggaggcgcgggggatcgtcgccgagtggaaggcaacgttcgcgtgcttcgatctggccaccggaaaatttacggacttcgagaaggagggaacagctaaaaagtatgtgggagtgccagccatgaactcgatatgcaaatcactctgtctagaggatggtgtggtggccaaatttggtgtcactgtgggcaagatggattggcttcaagatcggagttcgtggtcactagctagcctggatgggaaagatctaggctattttgattatgttgtggcgacagataagaacatagcgtcaccagcattttctgggttgactggaagaccgccacctcttgatttgtcgtcatttccacgcctgcctacagcacttcaagatatcccagttcgtccatgttttgctcttatggtagcattctcggagccattggctacggtacctgttcatggtttctctttcaacaattccaattctctgagctgggccttctgtaacagcagtaagccagggcgtgcttgcgtgcctcctaacagacaatcttgggtgctgcattcgacaactgagtacgcttccaaggtaataaataatattggtccacgcaaaccttcggcggaggcgcttgctaaggtggcagaggaattgttcagagaattccaggcgactggattaagcattccacggccaatttttatgaaagctcacagatggggtgctgctttcccagccattgcaattagtggagatgataagtgcgtttgggacaagagcacgaacttggcgatttgtggagatttctgtacaagcccaagtgtcgaaggagcagtccttagtgctacgagaggggtttccaaaatccttgaatgtttaaggtgcccctcaagtatctaacgttattgttaccatccccagggcccccctctctgtgattggttgtatttatgcctgcattctcttacacaaataaacaattcaagccttatttggaggcacatattgttcgtttatgctaaataagaaataaagtaacagcagaagttgcag

SEQ ID NO: 8273 - DNA, 1159 bp, Zea mays
atatccattccttcttcctcctcctcctctccagggggaaggcaagctcggccagacctccctctccaataagaacaagttgaagaaagatgtccacgtacctggtgtcctgctgcctccggccaccgtcagcgggggcggagatgcccaaggcggcttccgccgcctcctcctcttcattggccccgccgcccgacaccaagagagtcggccgaagagactttgtgctcaggagcagtgagattgccacgctcgccgccatcttccacttcagtggcagcaaaccaagctaccttggcgttcagaagagtcctccgtcccttgctctctgccctgcaaccaataactgtgtttccacatcagaggaaataagcgattcaaatcactatgctcccccatggaactacaatcccaaggatgggcggagcggtaaacccataaccaaagaggaggccatgaaagaactaattgaagtcgtcacgaagacaaagccggacaacttcactcctcgcatagtagagaaaaaagatgattatatccgagttgaatatgagagtcctatatttgggtttgtagatgatgtggagttctggttccctcctggcaacaagaccatggttcagtatcggtcggcgtctcgatcaggatttatcgatttcaatgccaacaagaagagagtaaaggagctgagattggctttggaaaagaagggctgggcttcagaaagcaacttctgaattgaagtgagaagggtggaagaggtgcaggtgcatgctactcagacgagccagcacaactgggaactgggattgggtactgcccacgcaaaggcaaaaaagtctctttgtgatggtccctcgttctcattcaggtcagcgattacctagtttgtgtactaggcagcgtaagctagctgctggtgggtggtggtggccatcatgaggattcaggatgcatgatgatcttccatgggtggtgccgggggcgcactaagggaaaaaaaaaaaggatattacatggacagcaaccaccctggctagctaataccaagaaatcattcatatactcctagtctcctaccaagaaaaaagatatatttattatgcatcttcttgccatccgtgcatcctactacatgcatcggatctgtccttgcgat

SEQ ID NO: 8274 - DNA, 2314 bp, Zea mays
gccgatatccattccttcttcctcctcctcctctccagggggaaggcaagctcggccagacctccctctccaataagaacaagttgaagaaagatgtccacgtacctggtgtcctgctgcctccggccaccgtcagcgggggcggagatgcccaaggcggcttccgccgcctcctcctcttcattggccccgccgcccgacaccaagagagtcggccgaagagactttgtgctcaggagcagtgagattgccacgctcgccgccatcttccacttcagtggcagcaaaccaagctaccttggcgttcagaagagtcctccgtcccttgctctctgccctgcaaccaataactgtgtttccacatcagaggaaataagcgactcaaatcactatgctcccccatggaactacaatcccaaggatgggcggagcggtaaacccataaccaaagaggaggccatgaaagaactaattgaagtcgtcacgaagacaaagccggacaacttcactcctcgcatagtagagaaaaaagatgattatatccgagttgaatatgagagtcctatatttggggtaggcggcggcgggtagcaccttgttttcctttttgtgggcgttactagatgtgcgtaaatgtggtggccatttgatatcatttgtcgatgctgaagtttgtagatgatgtggagttctggttccctcctggcaacaagaccatggttcagtatcggtcggcgtctcgatcaggatttatcgatttcaatgccaacaagaagagagtaaaggtatgcgtgcttgtatcttggtaccggtttagctctgtatactagtggatgacactcgtgattggtttcgtgtgcgtcttaggagctgagattggctttggaaaagaagggctgggcttcagaaagcaacttctgaattgaagtgagaagggtggaagaggtgcaggtgcatgctactcagacgagccagcacaactgggaactgggattgggtactgccccccccacggcagctcggtctccggctcgtggtccctcgttctcattcaggtcagcgattacctagtttgtgtactaggcagcgtaagctagctgctggtgggtggtggtggccatcatgaggattcaggatgcatgatgatcttccatgggtggtgccgggggcgcactaagggaaaaaaaaaaggatattacatggacagcaaccaccctggctagctaataccaagaaatcattcatatactcctagtctcctaccaagaaaaaagatatatttattatgcatcttcttgccatccgtgcatcctactacatgcatcggatctgtccttgcgataatgagatatgcatattcgttcgatatgattgctagatagtcgacccagagatgatttaggtctctctctctctctctctctctctctctctctctctctctctctctctctctctctctctctctctctctctctggcattagttggatgcatggttgacttgtttcatgcatggattctattatagtgcacacatatatattaataaaaaaaggtatctagattatatagacacacacaggaactgtcactcctgatcgagcgagatgtcgatgtcgtgactgaagacccccatggattcaggttctgttcagattggattgctggtgggtgggagtagtggagtggagctgggcatgttggccatcctccggtccatacatgtgtagtcagaaacaaatttgaccctttttggaggtgcgcatgcatgtcgatggattgaagaccctggccggttgaggtcaaatccaaagaaaagatatgatgcaggtcagtcgccaccttccattgtttaccacccaccaaaatgcgtctactctcactctcatcattagctagctacgaaatgatccttctctccctccctctccgtttccaggaaaaaaaaaaaccttctctctctagtctcgactctattaaggtagttggaagttgcagcttagacccatcaaaaccgtctattaatcgatcaagtgctctctacatgttgattcttcaacagttcgacaaggtaaatcacccacatatgtttatattttgagttgggccacccacaaatctatgatcaccaccaaatcgtctagtgataccgatcacaaagagtaataagcataaactctaacttgatctatccaaggctaaatagaacagtggatgcacacttacttttctcggtggattaatgatgtactaacatggtgatgattagatctcaatcacctaactagacaaagactctcccttccctctca

SEQ ID NO: 8275 - DNA, 967 bp, Zea mays
agacccgaccccacccctcctgagggcgagcccgagcgcaaaaccctaaccttgtcttgtgcgcagctccgctattaaagtctgcgtacagtccgccgcggctaggcgaccgcatccgcatctccccaacgtcttctcgccggtcgcgcacgggcaaagcagcgatggctacagcgacggcagttggcggacccgacagggtggagactgcggcgtcgtccgcggcggcagtgctggccgtcgccgttgcctcgcagaggttgctaggtctgctcgctcttgcggttcaaactgtaaatgttggagcagaaatatataataaagatcagcgggcaatatacaagttattatctggaagaatcaaatctgaaaatgtccctgaaaataaggatgggtcagatgacgacgatgatgacgacgacgatgaagacaatgacgatgagggtggtgacgacgacgatgatgctgaggaggaattctctggagaagaagatgggggtgatgacgatgatgaagatgatgatcctgaagctaatggtgaaggaggaagtgacaacgacaatgatgacgacgaagatggtgatgatgatggcgatgaggacgacgaaggtgatgaggacgacgaagacgaggacgatgatgaagatgacgaagaccagccaccttccaagaagaagaaatgatttgctcatccatggatttacctcagcttctccatgctgttagttgtgttgtttagatcatggacagctttgggatcaatgtagcttgttgcttgtcatggtatcgtagtgtaggaaaatttgacatctgatgttaaatcactatcctgctttcccctctgtgcatgtagtcttaaatcttgatttttactctattggagctgcgattgtgtcatgccattcaattttgatcaaacgaagccaatcatgccagcctgcccaaaaaaaaaaaaactcgagcccgg

SEQ ID NO: 8276 - DNA, 1162 bp, Zea mays
aacccgccagaggcccgatcgtcccacactcccaccacgcgacaggaacacaaaaaccctagcacaagcccacacgacgccacccggccccggacggccggccccccccgtcccacgttcccaccgggctccgagcacaaaaccctaaccttctcgctattaaagtcggcgtccagtccgtcggctgctgctacgccaccgaatccgcatctcctcgccggtcgcgcacgggcaaagcagcgatggcagcagcgacggcagttggcggacacgacagggtggaggctgcggcgtcgtccgcgggggctgtgctggccgtcgccgttgcctcgcagaggttgataggcctgctcgctcttgcggttcaaactgtaaattgtgtagcagaaatatataatgaagaccagcaggaaatatacaagttattatatggaagaatcaaatctgaaaatgtccctgaaattaaggctgggtcagatgatgatgatgacgatgaagacgatgaagatgaagatgaagatgaagatgatgatgatgatgatgatgatgatgatgatgatgagggtggtgacgacgacgatgaagacgatgatgatgaagaggggggtgatgaagatgatgatcctgaggctaatggtgaaggggggagtgatgatgacgacgatgataacgatggtgatgatgatggtaacgatgatgacgacgatgaagatgatgacgaagatgaagatgaagaggatgacgacgatgaggaagaacagccaccttccaagaagaagaagtgatttgctctttcatggattcacctcagcttctccatgctgttagttgtgttgtttagatcatggaacagctttgggacaaatgttgcttgtcatggtattatagtgtaggaaaccttgacatctgatgttaaatcgttatcctactttctcctcaaaaaaaaaacttaattgtgtgttttagatttttactttattggagctgtgattgtgtcatgccattcagttttattctgctgaggccagtgtcatgccattcaatttatttcttttactgaggcctgagcactcaggcctggattgtatgtgatgctatgtctgttactgagaaggttgagccaggccagaactgtatttgatgagttgcagattcttgagct

SEQ ID NO: 8277 - DNA, 1039 bp, Zea mays
actgcaaaggctaaggaaaagggtgtctcccttatgtgccaaccgatgttgtcatcgctgataagtttgctcctgatgctaacagcccatttgttccagcatctgcaattcctgatggttggatggggctggatattggcccagattccattgctgcattcaacgcagccctggaaacaacccagactgtcatctggaacgggcccatgggtgtttttgaatatgacaagttcgctataggaactgaggctgtggcaaagaagttggcagaacttagccgcaagggtgtgacaactatcatcggaggtggagactctgtcgccgccgttgagaaggtcggagttgctgacgttatgagccacatttccaccggaggtggtgccagcttggaattgttggaaggaaaggagcttccaggagttactgcattggatgaagcagccactgtgactgtatgaagcaagttttcattttgtttcatcttcttttttggaagttaccgggggagggactcccacctgaataaggtgcgcaaggccaggattgttggctcaaccacagggagcgcacgccaccgcatcatcttcatgtaccattgtatacttgctacattcttgcttgctcctcctcagccgctcgaaatgtaggagatcaatgatttatagagctctggaaatcgtttgaacaaggagtaagcgacccaagtaatatgcttactgagtcatctttcctttgtgacgtaacaaattacataaaaacccttcgaaggtaacctagcctattcaaccattggtaactaggagttttatcctttgtgcaccaggaccagctttgccgagctaagtgtgaattttcttttctgttctttgtcaaagaagcaaactctagcgtcatgcctcgttagaatctagattttacgttatggagttctgctgctgaatctttttctgggccatgacattgtaaaattactgtttggtctctggcacaattttttttcgctttgaaaaaagtcgacgcggccgcgaattccagatct

SEQ ID NO: 8278 - DNA, 621 bp, Zea mays
aaacctgggcgtattcctctctctttcctcatcctcatccgagtggctctctccttgtgctgtggcggcggcggcgcccggctctgctcggacggactccaccgaaggcgctcggctcccctcgggctgcacctgcgacggccggccctctgactgcaccgacggtgcccgccccccctcggcatccaccagcggtgcccggctccaagtccccgccgccactccgaccgtcctctagcagctccgtccggtggtccggccagctgcctagctccctccgaccgtccggccagcaccgcctcctgctcgcggtctcgcccagctcctccgccctccgctgagacgcagatcttggtgcggcagggcaccacagaggctgtgcgtgtgttggtggcctggtgctagcaaccgagttacattgtgaaagatactaccttaaatatatgatgtcgttgatttttttttgaaaactttgacctatcgtcttattcaacaaaaaatttgaaatattatttattttgttataatttgttttatcacttaaggtagtttgagcgtgacttgaaattttagattctcaaaataatatttcgaataagacgagtggtcaaggtttttaaa

SEQ ID NO: 8279 - DNA, 1941 bp, Zea mays
tttccgtattcctctctctttcctcaacctcatccgagtggctctccgtgtgctgtggcggcggcggcgcccggctctgctcggacggactccaccgaaggctcggctcccctcggactccacctgcgacggccggccctctgcctgcaccgacggtgcccggctccctcggcatccaccagcggtgcccgactccaagaaatgtacaagtcacggctgcaggagctgtgccagaagcggcgatgggcgccgccgttgtacgagcctacccgagagggtcctgcccacgcgcccctcttccgcgccactgtcgtcgtgaatggcgagaggttcagttcccgggatgaaggggagaagtcactcaaggaggcgtacaacctcgcggcgatggccgccttcgacaacctcatcgcgctcccggccgcggcccttgcccctgccccggctgctccagcgccgccctcatccgagacccagcttccttacaagagtcagttacaaatttatgctcagaagcgaggcaaactcctgccttcatatcgtcccattcatggaggttctcttcatgcacctctatttaagtcagaagtaaccatagatggtcaaacatttgagagcccagagtactgtcacacaatgaaggaagctgaaacagttgctgcaaaagttgctctgatgtccttacctcaagaagcaaacccaacacagcaattactgcttccatctgtaaactataagaatcttctacaagaactagttcagaaggaaggctttcccttgcctatctataatacagcctcggatgtctcgaactattctgctgccttcgtatcaactgtggaaatccatggtgtaacttttcatggaaagccagggaacaccaaaaagcaagcagagatgaatgctgcaaagtctgcttttgaacatttcaaaaacataaatcatgatgctggatcatctggctctgctaacccacttcctgttgccgctacaaaacagtctgttgatggaaacactctacgtgcaaagctggaagttaacaaatcacaccttgcagagccaagcacagaagttgaagcaatatattcatctacagaagttgacaaactgccacttccagggccaagcatggatatcgaagtaatggactcaactcttgaagttgacaaactgccccttccagagcgaagcatggatgttaaagttgtgaattcgtctctgaaagttgacaaactgcactttgcagagccaatcacagaagctgaagtgatccactcatctctgcaagttgatgaaccgctcattccaaagccaggcatgagctcatctctagagaacacacctgctgtgaatggccactcagcccccatatccccaaccattactcctactctaataagcgtgccaacagcaaccatgcctgtcagcaatgacagatgcggttgctacatgtcaaccaacagaatccaagtctaccctcgccacactgatatggttatcccggaaggcgcggccgtgcttcccatcagcgataatcagtgggtagctgtcagcctaccttattccatggaacaaagggatttctgttgccgtaatccggactgccacttaggaagataaaagcagacaaaaggatggatgctttgtgatgattatatagcttgtgatgctgagcattgcccgtgatgtactaaaatctagtgtaacaagactgccttgcgctggactacgattagtgtccctaatgcggagacttgtgtgactcctattgtatctagattaagctgtacttgtttgactatgtgcggaagtcttgagttacactcctatagtagaggacttgaactctggatggaccatccgcaacatttatcatgatcagacttttttcataatacaaaaaaaaaaaaaaaaaaaagccgccagactagttcctcgtgc

SEQ ID NO: 8280 - DNA, 3043 bp, Zea mays
  misc_feature (2406)..(2406): n is a, c, g, or t
cacccacacaagaaaaccccaccctgcccgagccggggcagagcgcctgtcagctgacaaacaccccaacacacacaacaaaggaactaccccacacgactttgagcttggaggaaggaaacccccttagctccagccaaggaccacaggagagcttcctccctggccagccgaacggccaccaccaagcatggaggagtaattaagaagaaatagaattgacccagtttatgagggaaacaagacctgaaaaccttacaaccacacagtttattaaatgaaaactggcggaaaacctaaacacaacaacctgagcaacccatttacaaaggtgacacacaactgacagagtcccgcgtacatcatcgttgtcgagcttatcacaagatccagtgacaagaagctctgacttaacatcaaccaagcccctaatatgccacccgacctccgtagaaaaaaacgcagcgtgtcatcattgccaagctttgttgcatcccacaatcaaagcaactcggacttctgctgatgtgtgtttcctctgtattaacttgattctcattcattcattcactcatgttatgttcatgtgcagtaaatcatgatgctggatcatctggctctgctaacccacttcctgttgccgctacaaaacagtctgttgatggaaacactctacgtgcaaagctggaagttaacaaatcacaccttgcagagccaagcacagaagttgaagcaatatattcatctacagaagttgacaaactgccacttccagggccaagcatggatatcgaagtaatggactcaactcttgaagttgacaaactgccccttccagagcgaagcatggatgttaaagttgtgaattcgtctctgaaagttgacaaactgcactttgcagagccaatcacagaagctgaagtgatccactcatctctgcaagttgatgaaccgctcattccaaagccaggcatgagctcatctctagagaacacacctgctgtgaatggccactcagcccccatattccccaaccattactcctactctaataagcgtgccaacagcaaccatgcctggcagcaatgacagatgcggttgctacatgtcaaccaacagaatccaagtctaccctcgccacactgatatggttatcccggaaggcgcggccgtgcttcccatcagcgataatcagtgggtagctgtcagcctaccttattccatggaacaaaggtgagacaaaccccagggagacaaaaccatccataaataactaaatatcttatgcaaataatatctctgaaccccacgttataagtttactggatttgggtttcaaaataatatctctgggattgctcacaccgggaaaatgcagggatttctgttgccgtaatccggactgccacttaggaagataaaagcagacaaaaggatggatgctttgtgatgattatatagcttgtgatgctgagcattgcccgtgatgtactaaaatctagtgtaacaagactgccttgcgctggactacgattagtgtccctaatgcggagacttgtgtgactcctattgtatctagattaagctgtacttgtttgactatgtgcggaagtcttgagttacactcctatagtagaggacttgaactctggatggaccatccgcaacatttatcatgatcagacttttttcatacttcctacttgagcttgttgtctttcggaatgcttctgtatgttgatatgcgcccgagtttgagcatctgctggatgcggtcggcatgctgttcgttttgttctgcgaattgcgatttgttcaactcttcccagcacacttcctcagcaagacctctgcgtcgaatgtatagagaggaccgaattggagcgttcacccattcgcgtaaattgtcttgtgaaatgctttccagttgaatgccaaacgtcgtttcgtaccgtgtgcaagtgcaacaaatgctgtttccatctgcctgccctctttcagcgcgtgcccccgaatgttccttccgaaagcaccgcgctcgcctacagatcacgacacctcgcaccgccgctcccacttccggcctcgccggtgcgtgcatgtgcgcgccagggacgccaattgagctcggctccagcacgcaatcggctgcagagtgagctcagagctcaccctctccctctgccgctgctccgctgtaagtcccggcttgctactaagctagctaccagcagcgtctgctgcctcctcctcctgctgctctcagggagctctccgtttagaccagctcgtgtgcttcttgggaagaggtttccgcgttgctgtttctttttcagcctcgcattaggatttccagggaaatcgggggatgccactatagtgtcccgctgtcggctaatttggcgnccagtattttataactaatgggttgttcgcttccagctgtaaacactatagaaacaggtatggattaaagccaatcgaataggctataagatctatagaaacatgtatggattaaagccaatcgaataagctataagatctactgagacatgttgacttcgttaccatgttaatatatcatatttttcgttgacaacacgactgaggccctgtttgaaagcaacccagatttaaaaaaaccaatttttatcttttagataggagaagccagcttcttggtttttaataaactaagaatctaatatctataaactgagtcataaactggtatgtttggaactacatcaatttttataaacagtttgttaaaaactgggtgcttccaaacaatgcctgagtagcaccatcagtctagtttcttttttatccttgctgatgattagtgacgcggtactcgccgtatgctgtcaaattcttctattctttacctgctgggaaatggttctcatttagccgtgtccaatgtacgtatttcactgtagtgatacgtatctgaaaactgcacttctgtggacactgatagagatgctgaaactttgatctgtgaacacattctcagtgtgaaacccttctttac

SEQ ID NO: 8281 - DNA, 1522 bp, Zea mays
cgaaacgtttcacgtgagcaaacctgggcgtattcctctctctttcctcatcctcatccgagtggctctctccttgtgctgtggcggcggcggcgcccggctctgctcggacggactccaccgaaggcgctcggctcccctcgggctccaccccccgcggccggccctctgactgcaccgacggtgcccgccccccctcggcatccaccagcggtgcccggctccaagtccccgccgccactccgaccgtcctctagcagctccgtccggtggtccggccagctgcctagctccctccgaccgtccggccagcaccgcctcctgctcgcggcctcgcccagctcctccgccctccgctgagacgcagatcttggtgcggcagggcaccacagaggctgtgcgtgtgctggtggcctggtgcttgcaaccgagagccagtgtccagcctgccagctcagcccggcgccaaccgcccagcggctggctcgggcagcggccagtggccaacagctgacaaccatacctcgtttcttcggcgtcctccgccgctgcccccaactatgcatcctgttccagtctcctcccagccctttaccgcaactcctgcaaaaaaacttgtttcaaggagcactgctgtgaggaaggccatccattttgtcaacctgcggacagctggaaggtctagtggaaacctggctatgaactccgtaccgaaaccagcacttgggtccgaaacatcttggagggaggattttgctgtgggggataaggatgctgtggtcattgttgatcatgggtcaagacgccaagaatccaatctcatgctaaatgactttgttgagatgttccgggcgaagactagctatagtattgttgaggctgctcatatggagctagcggagcctactataaaggatgcttttggaaaatgtgtgcaacaaggagcatcacgagttattgtcagtccatatttcctttcccctggacgacactggaagcaagacattcctgctttagcagcagaggcatcaaaggagcactcaaatataccctatattgtcactgcccctcttgggctgcatgagcttatggtggatatcatgaatgatcgcatcaagtactgcctgcgacatgttgcgggtgatgtcgatgagtgtacagtgtgtgctggaaccggaaagtgccgcctgtactcctgatggagcatacctgggaggcacatcgatactgttaccatttattatgagatctggagaatacgagatctgaccatattctgagcagatcgtcggaattagacaagtgccaaattagttatgctgtgcatgcttgcgaacatcaatagtgatagagattcattagctaatcttgagtttatttacataacgaacaaactcagtcaagtgctctgatatttccattcacatgtaatctatattcctgctaccttgtagttgaatgaattaacatggatcaaatgataatataatgtgcgcttgtttgatttgccagttttttgttt

SEQ ID NO: 8282 - DNA, 1405 bp, Zea mays
cattgggtacctcgaggccggccgcgaggtacgaggccggccgggacagaccgacaacgcctaggcaagcagcaagcgtacacgtaaacgtacacctacctcggcgagcaaaaggcaaaacgctgatcggagcaaccaacgaagcccgcagccatgccgacggccacggccacggcggctcctcgccacgccgcgctcttcctgctgctgctgctcggcctccacgccacgttcgccgccgccgcgcgcgcgggcgtcgccgtggacgccgagctcacgtccaccaagccgtccccggtcccgaagaagcccagcgtgaagccgcccggccccggcgccgcgagcccgaccttcccgggcttcggcatccccgggatgggcgggttcggcatccccgggatgggcgccggcgggtggggcggcggctacggcgggcccgccggcgggtacgcccgcggcggcgtggtggcgcccaccgtgacgtgctccgagaaggggccctgctacaggaagaaggtcacctgccccaagaagtgcttctcctcgtacagcggcgccggcaagggatacggcggcggcggcggcggcggcagctgcaccgtcgactgcaaggtcaagtgcacggcctactgttgattcgactcgtccgctcttagcggtttgacagctagtggctggcggtggcggcctgctagctgctgttggtgtgatggcgcgtgtgcgtgtcggtgagctgagtaccgcgggtggttaacttgtgttatcatccccaatagtatactagcgtacttctggttctggggactatttatatgtagaccacgatatgcgtaggggcggtttatttctaagataagaatataagatgctctgcttatggtgtttattagtattataatcatctaagttgcgttcctgctttggttaagtgataagacgtgcttgtgaaatccagtatgcataaataaagagctatattgtaagtatcaaacaaacaaaacaatccttttgctatttgtaccgacgtactgtgattagatgtgggccgtggattcggcagttgtgtaaagttagaactctctctagtaggtcctctaaaaatcctcctctaacttaaattttagagtcagcgttctctaaacggtactctaaggcccttctttagcggggctctggttcatctgaaaacagtttcggctctagcttctctgactctttgatttctctataggagccgaagttgttttataattcgtttgtcaaaacagtttctcatatctctcaaggactcccttgatcaattcactcttgccacaggcctccacatcaattactgcaaaagtgtcatggtccctatgcacctagatgatcagctggttataaattgtgtctcttgttttggttg

SEQ ID NO: 8283 - DNA, 1385 bp, Zea mays
  misc_feature (16)..(16): n is a, c, g, or t
cgaggcctggccgggngccccgggctcaaacgtcacaaaagccatctcacagacggacaacgccctaggcaagcagcaagcgcacacgtaaacgtacacctacctcggcgagcaaaagggaaaacgctgatcggagcaacgaagcccgcagccatgccgatggccacggccacggcggctcctcgccacgccgcgctcttcctgctgctgctgctcggcctccacgcaacgttcgccgccgccgcgcgcgcgggcgccgtggacgccgagctcacgtcgaagccgtccccggtccccaagaagcccagcgtgaagccgcccggccccggcgccgcgagcccgaccttcccgggcttcggcatccccgggatgggcgggttcggcatccccgggatgggcgccggcgggtggggcggcggctacggcgggcccgccggcgggtacgcccgcggcggcgtggtggcgcccaccgtgacgtgctccgagaaggggccctgctacaggaagaaggtcacctgccccaagaagtgcttctcctcgtacagcggcgccggcaagggatacggcggcggcggcggcggcggcagctgcaccgtcgactgcaaggtcaagtgcacggcctactgttgattcgactcgtccgctgctggcgcgtagcggtttggcagtgggcggtgctagtggctggcggtggcggcctgctagctgctgttggtgtgatggcgcgtgtgcgtgtcggtgagctgagtaccgggtggttaacttgtgttatcatccccaatagtatactagcgtacttctcgttctggggactatttatacgtagaccacgatatgcgtaggggcggtttatttctaagataagaatataagatgctctgtttatggtgtttattagtgttataatcatcaaagttgtgttcctgctttggttaagtgataagacgtgcttgtgaaatccagtatgcataaataaagagctatattgtaagtataaaaaaaaaaaaaaatgcccccttgctatttgtaccgacgtactgtgattagatgtgggccgtggattcggcagttgtgtaaagttagaactctctctagtaggtcctctaaaaatcctcctctaacttaaattttagagtcagcgttctctaaacggtactctaaggcccttctttagcggggctctggttcatctgaaaacagtttcggctctagcttctctgactctttgatttctctataggagccgaagttgttttataattcgtttgtcaaaacagtttctcatatctctcaaggactcccttgatcaattcactcttgccacaggcctccacatcaattactgcaaaagtgtcatggtccctatgcacctagatgatcagggg

SEQ ID NO: 8284 - DNA, 950 bp, Zea mays
  misc_feature (1)..(1): n is a, c, g, or t
nctaatcgaaaactaaactcacaaggccatctcacagaccgacaacgccctaggcaagcagcaagcgcacacgtaaacgtacacctacctcggcgagcaaaagggaaaacgctgatcggagcaacgaagcccgcagccatgccgacggcgacggccacggcagctcctcgccacgcggcgctcttcctgcccctgctgctgctcctgctcggcctccacgccacgtccgccgccgccgcgcgcgcgggcgtcgccgtggacgccgagctcacgtccaccaagccgtccccggtcccgaagaagcccagcgtgaagccgcccggccccggcgccgcgagcccgaccttcccgggcttcggcatccccgggatgggcgggttcggcatccccgggatgggcgccggcgggtggggcggcggctacggcgggcccgccggcgggtacgcccgcggcggcgtggtggcgcccaccgtgacgtgctccgagaaggggccctgctacaggaagaaggtcacctgccccaagaagtgcttctcctcgtacagcggcgccggcaaggggtacggcggcggcggcggcggcggcagctgcaccgtcgactgcaaggtcaagtgcacggcctactgttgattcgactcgtcccctgctggcgtggcgcttagcggtttgacagctagtggctggcggtggcggcctgctagctgctgttggtgtgatggcgcgtgtgcgtgtcggtgagctgagtaccgcgggtggttaacttgtgttatcatccccaatagtatactagtgtacttctggttctggggactatttatatgtagaccacgatatgtgtaggggcggtttatttctaagataagaatataagatgctctgcttatggtgttttattagtgttaaaatcataaaaaaaaaaaaaatgctttggttaagtaataagacgtgtt

SEQ ID NO: 8285 - DNA, 1071 bp, Zea mays
acccccagcctctccctctcctcacgcgcctcttttaaatgcgcccccaccccgacgccggccccgccctaaactcacaaggccatctcacagaccgacaacgccctaggcaagcagcaagcgcacacgtaaacgtacacctacctcggcgagcaaaagggaaaacgctgatcggagcaacgaagcccgcagccatgccgacggcgacggccacggccacggcagctcctcgccacgcggcgctcttcctgcccctgctgctgctcctgctcggcctccacgccacgtccgccgccgccgcgcgcgcgggcgtcgccgtggacgccgagctcacgtccaccaagccgtccccggtcccgaagaagcccagcgtgaagccgcccggccccggcgccgcgagcccgaccttcccgggcttcggcatccccgggatgggcgggttcggcatccccgggatgggcgccggcgggtggggcggcggctacggcgggcccgccggcgggtacgcccgcggcggcgtggtggcgcccaccgtgacgtgctccgagaaggggccctgctacaggaagaaggtcacctgccccaagaagtgcttctcctcgtacagcggcgccggcaaggggtacggcggcggcggcggcggcggcagctgcaccgtcgactgcaaggtcaagtgcacggcctactgttgattcgactcgtccgctgctggcgcgtagcggtttggcagtgggcggtgctagtggctggcggtggcggcctgctacctgctgttggtgtgatggcgcgtgtgcgtgtcggtgagctgagtaccgggtggttaccttgtgttatcatccccaatagtatactagcgtacttctcgttctggggcctatttatacgtagcccacgatatgcgtaggggcggtttcccccccacataagaatataagatgctctgtttatggtgtttattagtgttataatcatcaaagttgtgttcctgctttggttaagtgataacacgtgcttgtgaaatcccagtatgcataaataaagagctatattgtaagtatcccccccccaaaa

SEQ ID NO: 8286 - DNA, 1879 bp, Zea mays
  misc_feature (8)..(8): n is a, c, g, or t
aaacatgnatactcttaatcccgaaacatacaatcctgttaactaatggggtaaaaatagctaatagctaaactattagttaagtgtttaaatgtctctagctaattttagctgctaactggctctagagttttcaaacacgccctaaaattgtcggccgtgaacaacaataatgttgccgacttgctgtccatttctatcagctgagctgtcgtgttgtaagcttagacacaacataagagaatcgatgctatttgttcttccacactagtctcttctagctacgataaccccataattctccctctcagttcggatggtgacgtggccgccacgtggggtggctgatacttgactgacagtgatgggctgatggcatccatctagcaaactgcaaaccaggtcatctctgaatttccccaacaaagagcgagcataaaccccgctatacccgcttccttctctccaatctccggtgctcgcatcccgctccgcctccatgcgccgcggcagttccacgacgccagtcctctcacctctgtcctgacccaacacccgggcggctggaacccgcaggtgcgcttagtgccgctcgaggaggctcgccgtttgctggattcgttctgtcctttgccggccggcattgtgccctccgcggcggcgacaggggcgtgcgcggtgctgctgtaggggagggtgacggccatctccctggtcggccgcggcccgggctggtggcgtgcgaggaagacggattcacaaagcacggtgctccccaagtctagcagggtgtgttgtatggcttccacgctccagctgttgttttccattgccatcacagctttggcctttttcctccacccatgcgcatcgactgatgagttccaccgtgagctctacggttggtccaatggcatcgctacatggtatggcgcagctgatggcgctggaactgacggtggtgcgtgtggataccagaatgctgtggaccagccacctttctcatccatgattgccgctggctgctcttccatctacgactctggcaagggctgtggctcttgctatcaggctgtatgcaccggcaatgacgcttgctccggtaacccggtgactgtcgtcatcaccgacgagtgccccgattgcccgtgtcctgatgagcaggtccacttcgacatgagcgggacagcgttcggtgccttggcgaagcccgggcaggagagccagctgcgtggcgccggcgccatccaaatccagtatacccgggtgcagtgcgagtggcctggcgtggacgtgaccttctcggtggagccgggctccaacccgaactacctggccgtgctgatcgagtacgaggatagcgacagcgacctcgactccgtggacatgatgcagacgcagggcgggacgacggggcagtgggtgccgatgcagcagtcgtggggcgccgtgtggaagatcaactccggctccgtcctccagggccccttcaacatccgcctcaccttcagctctggcagggcgctcgtcgccagcaacgccatacctgcggggtggaacgccggcgtcgcgtaccggtctggcggcgtggctgtgacgagggccaggcccaggagcggtgcctgccggggctacgaggctgccgggacactggatggtttggtgcatcgtcacctcgtcgtgttgttgttactggtgttattgacgctgtgagccgagatgcgatgcaattttgctggttctgggagcgtgcgagtttgggctacatggactgagtagctctgtgtatttttcttgcatcgcatcgtagtggatggattactgcgtcgtattgtggacatgtctggtggttatcaaatgtccgtccatataatactcc

SEQ ID NO: 8287 - DNA, 716 bp, Zea mays
tttgactgctctatgtgaacttgaagagcctagagaacttctctcactagcaaggtgaactaccattgggcgtccgcagattaactttccattcatcttctcctttgctaactgagcttcctgaatcctctttagtggtgtactgaacaaaggcatagccccggggttcgcctctctttggaccgcgtgtgtgccacagaaaatcctcggctgtaatctttccaaaaggggaaaacatcttgattacatcggactctgacatcctgaagtctaggttccctacatagagcctgcactccagtttatctgcctcaagacctttaatgtccatttctgcttgcagcctgtcccctgctgctgcccacctgcccggtgccccctgctggccgctggcgtgctgtcgtgctgcaccctttactccatcgctgatgcccgcctgccagccccggtggccggtgctccacgacggcagcctccagcgaaaccccaccagcagcccgacgcccccaagtccccacttgccgatccggcctccaggggaccacctcccgcccgccggccgtagatttggtcgctgcgccggtcgattcagccgccgggccggtagatttagctgctccggccgccgatcgccactaggccaccaggttttggacggtctgcaactgcaagacaggcagtcaggcagacgccacggcccacgagcgaggatgact

SEQ ID NO: 8288 - DNA, 1157 bp, Zea mays
ggacccccgggttgcccggaccggtactcattgccatctctacgttctccagcaccgccgttgaacctcctccctattcccgttctctagcaccgccgttgaacctcctcccctctccctcttgcttccctctctcatcctctctgccgcttccccgctctccccaaactactctgtgccccgtcagatcgacctggactttggcgacagctacttctcgacgggcggcacgggcgtgctgctacttctgcttcctctcccacgcttgctgttgagcggttcaagcagagctgatggctacatcagagccagtacaagagagtttggtggtgcactactcacaacctagtaggccccgggtcctccttgctgcttcaggaagtgtagccgctataaaatttgagagcctttgccgtagcttctctgagtgggcggatgtccgagctgtggccaccacgtcatccttgcacttcgttgatagatcatctctaccaagtggcatcgttctttacactgatgacgatgaatggtctacctggaagaagataggagatgaagtcttacacatcgagctgcggaaatgggcagacgttatggtgattgctccattgtcagcaaataccctggctaagatcgccggtgggttatgcgacaacctcttgacctgcatcgtgagagcgtgggactacagcaaaccgctctttgttgccccagccatgaacacgttaatgtggaacaacccattcacggagcggcatcttcacacaatcaaccaactgggcatagccttgatccccccagttaccaaaaggctggcctgtggcgattacgggaatggcgcaatggccgaaacctcacagatccatacttccgtgaggctcgcgtgcaagacgcaaccgcacgatgcgagcagttcactcgcaggtcctgtcagtaataaccggccatctagctgatgcagcggttggccacttgattgtcaagcttaggaatttgttttatctggagtgttgtaccagatttttttcaactagagtttgtgtgtattgaattagggggaaaggttgttgtcacatgataacaataacttccaatgatgactctattcagtttgtaattgtctgtgggagtacaattatgcagctgtattgtctgct

SEQ ID NO: 8289 - DNA, 931 bp, Zea mays
gccaaactaaactgccagacgcacagccgcggagccgccagagacagacgctgccgccgtcggccgtcctccgccctccagttgagcggttcaagcagagctgatggctacatcagagccagtacaagagagtttggtggtgcactactcacaacctagtaggccccgggtcctccttgctgcttcaggaagtgtagccgctataaaatttgagagcctttgccgtagcttctctgagtgggcggatgtccgagctgtggccaccacgtcatccttgcacttcgttgatagatcatctctaccaagtggcatcgttctttacactgatgacgatgaatggtctacctggaagaagataggagatgaagtcttacacattgagctgcggaaatgggcagacgttatggtgatcgctccattgtcagcaaataccctggctaagatcgccggtgggttatgcgacaacctcttgacctgcatcgtgaagagcgtggggactacagcaaaccgctctttgttgccccagccatgaacacgttaatgtggaacaacccattcacggagcggcatcttcacacaatcaaccaactgggcatagccttgatccccccagttaccaaaaggctggcctgtggcgattacgggaacggcgcaatggccgaaacctcgcagatccatacttccgtgaggctcgcgtgcaagacgcaaccacacgatgcaggcagttcactcgcgggtcctgtcagtaataaccggccatctagctgatgcagcggttggccacttgattgtcaagcttaggaatttgttttatctggagtgttgtaacagattttttttccaactagtgtttgtgtgtattgaaattggggggaaaggctgtaacaataacttcctccctgctcagtaatgatgagtctattcagtttgt

SEQ ID NO: 8290 - DNA, 2005 bp, Zea mays
ggacgtgagggccactcgggttgtgatcggttttgatgggcacagaaaacacgcctgtgaaggccgggcatgccgcacccgccgagtgcctgagactccactccccgtctcgcctcctcctctcgatccagccaccaccgccttcacccatcgcctccgccatcgacacatgcctcacccaccgcctcggaagaagaagacgtggatctaaggaagaagacgcggatccaagggttgactgctgaggaagaagacgctactcctcgtcttcgatctgttgagcggttcaagcagagctgatggctacatcagagccagtacaagagagtttggtggtgcactactcacaacctagtaggccccgggtcctccttgctgcttcaggaagtgtagccgctataaaatttgagagcctttgccgtagcttctctgagtgggcggatgtccgagctgtggccaccacgtcatccttgcacttcgttgatagatcatctctaccaagtggcatcgttctttacactgatgacgatgaatggtctacctggaagaagataggagatgaagtcttacacatcgagctgcggaaatgggcagacgttatggtgattgctccattgtcagcaaataccctggctaagatcgccggtgggttatgcgacaacctcttgacctgcatcgtgagagcgtgggactacagcaaaccgctctttgttgccccagccatgaacacgttaatgtggaacaacccattcacggagcggcatcttcacacaatcaaccaactgggcatagccttgatccccccagttaccaaaaggctggcctgtggcgattacgggaacggcgcaatggccgaaacctcgcagatccatacttccgtgaggctcgcgtgcaagacgcaaccgcacgatgcgagcagttcactcgcgggtcctgtcagtaataaccggccatctagctgatgcagcggttggccacttgattgtcaagcttaggaatttgttttatctgcagtgtgcatctggagtgttgtaccagattttttttcaactagagtttgtgtgtattgaattagggggaaaggttgttgtcacatgataacaataacttccaatgatgactctattcagtttgtaattgtctgtgggagtacaattatgcagctgtattgtctgctacaatattgtttgtttgtgtgtgtgggagtggggggtgctgttgccacagagatagattcctccctgcccagtaatggtagtgattattcagtttgtagttgttagtggaagtgtccagcaaacttttctacccttcgatattcctggtacaaatgttgaaacgactgtcccgaccatttgagtgatttgctttccacctgccattgatgtgcgcatgtcgcttcttcattctcggattcttgcctatctgtttttactggtgtagctgtccgaaatctggatgttgtcgatgcatatctttacgaccagttctagtctcacgagcaggacgacaatcttttgcatggagctgtggtgtcagcgagcaagccggcgatgagacatgagtaacatgacggcctacctgcgcgcgtgtttcagggccgaagacgtgtggacaagcgaggtcaggctagcgcgaccagccaccgcaccggctgacacctttcgaagcactttcacgtgtgaaccgaagtcgtcttgtccttcctttctcatttcagtcctcgcctttttcatcttccgtaggggcctttagtcttttgattagagtagaggtcgcgagagagcagagcgtaccgccctgccatagtcgcgaggatcttaatagtcggtcgcgactgttgtcatagtcaacgacggtttaaacttccaggaaaaaacttcgaattgggagggcgatcctcccggtgaactgaccgtaccccaaaccgacacaggtgaacaagtagagtatactagggcgcgtcgagagaaccatgtcgaaggaactcggcaaaatgaccccg

SEQ ID NO: 8291 - DNA, 1454 bp, Zea mays
acggatgatctggtcctgcacgtcaatacagacgatatgtttcccccaaatctaaggcgtcgccagccctggcaaagcgcttgccgctgctcccctcttccgtttccagcgccgccgccctccttccggttcctgttctccagcaccgccgttgaacctcctcccctctccctcgtgcttccctctctcatcctctctgccgcttccccgctctccccaaactactctgtgccccgtcagatcgacctggactttggcggcagctacttctagaacgcggcggcacggcagcaagccagcaaggagaacgcggcggcacgggcgtgctgctacttctgcttcctctccgacgcttgctgttgagcggttcaagcagagctgatggctacatcagagccagtacaagagagtttggtggtgcactactcacaacctagtaggccccgggtcctccttgctgcttcaggaagtgtagccgctataaaatttgagagcctttgccgtagcttctctgagtgggcggatgtccgagctgtggccaccacgccatccttgcacttcgttgatagatcatctctaccaagtggcatcgttctttacactgatgacgatgaatggtctacctggaagaagataggagatgaagtcttacacatcgagctgcggaaatgggcagacgttatggtgatcgctccattgtcagcaaataccctggctaagatcgccggtgggttatgcgacaacctcttgacctgcatcgtgagagcgtgggactacagcaaaccgctctttgttgccccagccatgaacacgttaatgtggaacaacccattcacggagcggcatcttcacacaatcaaccaactgggcatagccttgatccccccagttaccaaaaggctggcctgtggcgattacgggaacggcgcaatggccgaaacctcgcagatccatacttccgtgaggctcgcgtgcaagacgcaaccgcacgatgcgagcagttcactcgcgggtcctgtcagtaataaccggccatctagctgatgcagcagttggccacttgattgtcaagcttaggaatttgttttatatgcagtgtgcatctggagtgttgtaacagattttttttccaactagtgtttgtgtgtattgaaattgggggggaaaggctgttgtcacaggataacaataacttcctccctgctcagtaattatgagtctattcagtttgtaattgtcggtgggagtacaattatgctacaatattgtttgtttgtgtgtgtgtgggagttggggagtgctgctgccacagagatagcttcctccctgcccagccagtaatgatagtgattattcagtttgtagttgtcaaaaaaacaaaaaagcaaacttttctactaccctttgatattcctggtacaaatgttggaacgactgtcctaaccatttgagtg

SEQ ID NO: 8292 - DNA, 3938 bp, Zea mays
gactatgagtgtatttatgacagcagagtagtgtaattagatacatcataaatgcacttatttgatgacatacatactgttacattttcttataaaaatggtcaaacttaacatactttgacttgaatgtctgtagtaattaatttatttgcaaaccgagaggccgtgtgctcagcagagtgaagattgaaatagaaaaatgagatagaggtggtgtagggaggctgctggagataccttagtgtgcaatactactgtgtcctcttctagcctccacacccacccacccacacacgaatttattttttatgtatataggaggtacgtgcaggcgtttaaagattttatatataaaaaaaattgttagcctcacaggtatgattttattcgttagtacaaacattagagttcgcaaagaaagtgtggaagcttaggggtgtttgaatgcactagagataagagttagtgactaaaatttgttaagatatccgaacatgctagctaatagttcaactattatctatttttagtaaattagttaataattaagtagttatttgttagctaactaattccactaataatttttagtcaactaactattagttttagtgcattcaaatacccgcttagttttgttggccatctgtgtatgacgacgatgatgcatggccacgcgtatagtttgccagaggtgatgaatcgggtggacgtacacgacacgaccatgcatggtggcctgcaggactgcacaaagccatatgggcatggcatgcatatggaatggtattaagcacgagaccgcgcgcgagcgatatagaggaggacgacgatattgataaattaattattaaataatataaatataatgtgccacaaccattatatatatatggtcagaaggatatgcagaatgatgcgagcgattgcaggccgaggaggaactgaagcaattaagacggtacttgtgtcattgtgtgtctctccgtctacgacaacgttgcacttcacgcggcgcagccctttctctcgtccaccagcttgcttgctgctgtactgctgcctgctctctatctatctatctctccctctctatatccgtacgtcgtcttgcaaaagtcaaaaacatacaacgacaagcacctgcatatccatccatccatcatatctgaccagagatcgatcgctgaagtcctccgtccgactcctcctcgtcgtcgatctgtgaacaacaagaagatcgggccggccggccaaaagggtcattcgtcgacgacgttcatccatcctatacgtgccggcggccggcggatcgatggctgtgagtggcggcgcgcggcatgcatgcgctcgcgcgtttttccattccatttttttttccgtttcacaataatactagctacctctctctgttccttccttcgatacgaataccatggcatgcatgcatgtgtaaatccgcaggagggtagctggaccccgactgccgagctacctctgcgacaggacccggcggtggacgacgacctgccgcaggtggtggtccaggagaagcagcatggcggcggtgctgccgctcggactgcgatggcgacggcgacggcgacgcgggacgggtcggtgggttggagcggcaagccgtgccgcagagacaggtccgggggatggttcgccggcttcctcatgctcggtaagtcaacgtaacggcagcggccggcccggtagaatagatggcaggttttggggtactgcttcttcttcacgcgcgcgcatgcagttttctcctctgccagttttagattttttttttcgatgcgttatcgtatggcacggcgacgacggccggcgtgcagcgaaccaggcgctggtgacgttcgcggtcaactgcgtggggaccaacctggtgacgttcatgtcggtggtcatgaggctggacaacgccgacgccgccaacaaggccaacaactgggccggcaccacctacgtcttctccatcgtcggggccctcgtcagcgactcctactggggaagatacaaggcctgcaccatcttccagctcatcttcctcgcggtacattctacttccctcgctctgattcgattaatataatccctaactactacgtactgccatccaaacatgggcgggcatggctggctggctgcgcgcaggggctggtggagctggccgtagcctgccacgtgttcctcgacaagtccggccgcggcggcggcggcggcggcgggcggcagcagcactgcaggccgccgacgacggcgcagtccctcgtcttctacgtctccatctaccagatcgcgctcgggaacggcgcgtaccagccggcggtcaccacgttcggcgccgaccagttcgacgagaccgacgcgcgggagcgccggtccaaggccgccttcttcggatacttcttcgtcgccaacaacctcggcggcgtcctcgccgtcaccgcgctcgcctacatggaggacgagggccagtgggtcctggccttctggatcgccaccgccgcggcgctgctcggcttcctcctcttcgccgtcgggaccatcaggtacaggcacttccttcccagcggcaacgctgttgtcagcgtctgccaggtggtcgtcgctgccgtcaggaaccggcgcgtcagagctacggttcgagcgcaggatatgtacgaccccgataccgatggagatcgcggcaagaagggggtcaggaagatggtgcacacaccagagtacaggtaggtactaccacctacattattttgtttgtttgttcatgactgcaggctggccgttccttctttttcttcgtcttcatcgtcaggtgtctggacaaggcagcggtgatcaaagatccagcgtctgcgttccgaccaccggcaggtcaaccacagggccattcctcctccaagcccaacccatggaggctctgcacactgacccaagtggaagaactgaagtgcatcctgaggctagtcccgatctggctctgcagcatcctctactccacctcctactcgcagatgtcgtcggtgttcatcgagcaggcgcaggccatggacgactccctgtcgaagctgacgatccctcccgccggcatggacgtcttcgagatactgggcgtcacggccttcgtgttcatctaccgcttctgcatcgtcagggtcatggccaaaatatcgcacgagccgacggagctccagaggatgggcaccgggctcgtgatctcggccgcggccatggtcgcgtccggcgtggtggagcagcagaggctggcgcgcgccacggccggcgtcgacgcgtccagctctctcagcatcctctggcagatcccgcagtacctgctgatcggagcgtccgaggtgttcatgtacgtcaccatgacagagttcttcaacgaccagctcccggaaggcctgaggagcctcgggagcgccatgagcgtggcctccatgtcggccgggagcttcgcgagcagcctcctcgtcactctggtgatggccatcacctgtagaggcggccggcctggctggatacctcaggatctcaacaagggccatgtggactggttcttctacctcatagcagcccttaacgccgtggacctgctggcgtttgtggtgtttgccaagaggtatagaccggctccggtgatcatacatggagaagatgaaaccggtggtgtcgagaagacccaggatgcggaggaatgcatttgaatgcatatctcaaacattccatgtgtgggcctgttttgatatactccttatacatgtgttattatagcgtggattgatatggaatttaaaactaaattccataccaatccattctaagacacatagaagttagatacataagcattcaaacgaacctttaatctctcacaaaccatattgttggaatattggatttgactgcattcg

SEQ ID NO: 8293 - DNA, 2842 bp, Zea mays
  misc_feature (51)..(51): n is a, c, g, or t
gggtacccgccggggcccgccccgatgtcgtgtcactgagtgccgccaggnagaagaaggcagctgccgccgccgccgccgcgccgtccgccgatgccgagctgcctcctccctggcatcgcgccacgcccaccgccggccgctctccgcagcctcctcctccgccgcagcagaatggcctcctccggtacggcccgcgccttccagctccgcctcaacccactcaccggcgactccgagtggctcgtcgtcgacgaggcggaaacggaagcggaggcgcctgcgcctgcgccgacccaacataagcagctccttgccgccacctcctacctcgacatgctcaacgacgcctcccgcaaccgcgcgtaccgcctcgccatcgacgccacggtaacggaccccacctctcgcgtcctcgacatcggagctgggaccgggttgctgtccatgatggcggcgcgagctttggcagctgctggaggtgaaggtaggggaagcgtgtcagcatgcgagtcctaccttccaatgggcaaactaacacggagggtactcagagccaatgggatggaaaataaggtcaaagtatttcacaagcgatcagatgagctcggagttggagtcgagcttgattctcgacctgatatattggtaagtgaaattcttgattctgagctgctgggtgagggtctcatacctactctacagcatgcgcatgacatgctattggtgaaaaatccaaagacagttccatatcgagctactacttatggagtgttggttgagagcacgtccttgtggaagatgcatgatctgcacagcaatgaagcaaatgctgaagatggtgtgaggcttattcccagtggaacacaaattgttctttctgtgaagtcacagcaacatgcgatgcaatgtgatgcgctggcagatgaaataagattgctgtcagaacccttcaaagtttttgaatttgacttttcggaacgtccagatagtcatcgtgaaacaaagattgagataaaagcaacagctgatgggcatgctcatgctattgtttcatggtgggtgcttcagttggattcttctggatcagtcttttactcaactgctcctagatgggtgagacaatccagtggtgtcgatttaccacaatatgccaatggcacgaaggattggtgtgatcattggaagcagtgtgtttggtttatacaagggacaggggctcctgcaaagaaagatcaaactctttctttgagcgctagccataaccaaactagcatctcatatcagttgaatataaatgatgaaggaagtagaagccccaaaagtaatcgtctaacactgttaccatgatagggtagcactttatggtgataaagtttggagatcagcgttgataagtgtaatcaccacttatgtaagtaatccctctatgtacttggtatagtatgtccttatccaactagtattccatattatgattgctcaccgtaacttctgaagaattataataataataaataattaaacatcccaatattcaaaagcatgtaatctttcaatctgtgaataattaaaagcatgtaaataattaaacagactgtgatgcagtttcctcattttttagaaaacagaactgtattggtcaacactgatttgacactatttggaggtggtctatcctgggcatcttggcaccttaacttttcatgtttaacttttctctgcccagacgagcgaaagatcctctctgatctgcattgtggctgatgacagcgtgttcctagctctcattgtttcttttctgttaccatcttcaaaagtcctcgctatgtttccatgtcttagagacagtggcctcaactatcttcaagctgttgcagatgcaaataatttatccatggaccggattaaagtgattggtaaaaaggcatcgtcccttactacaaatgacttaaatcatgaaaaggttaatatgttagtgggggaacccttttatcatggaagtgaagggatgctgccatggcaaaatctgcgtttctggaatgaaaggactctgcttgatccgttgctctctgaggatgcattcatcatgccttgtaagggaatattaaggttctgtgccatgtcacttccggacttgtggagaagccgtcgtagccttaaagatgttgagggttttgaccactcagttgttaatgatactttaggggcctgtggtgacctgcctggagagcaacaaggcccttgcctaccttattatgtgtggcaatgcggttataccaagaaattaagtgaagtttactctctcatggatttgaacttttctgagcctatccactcttgttttggtgaaacaaaggttgagtttgcccacgatggaacatgccatgggttcgctgtttggatcgactgggtacttgacaaggaaaattccatagtgataagcaccgggccagagagcagatactggaagcaaggggtgcagctgcttagcacgcctgtacaagtgaacccagcgaattcggtgatgcacgtggaggcgaatttcgatgctgacattggggagctcacgtttaaatccaccacgctctcatgatgccaactgtaatgtgtggacaaccaagcctcatgcgtgtgttgttcttaaaagttagcatttgtcgctgcgttttgttcgtcggagctcctgatgtgagtcaagcactcaagctcatgattacgtgtgtgttctgtcatgctagcacaagcaactgcctcctcggtggagctgttttttcatggtcttgtttgttagcccctcccgtcgtgaggaagatgctctaaaaaaaaaaaaaaaaaaaaa

SEQ ID NO: 8294 - DNA, 2045 bp, Zea mays
gcgagctttggcagctgctggaggtgaaggtaggggaagcgtgtcagcatgcgagtcctaccttccaatgggcaaactaacacggagggtactcagagccaatgggatggaaaataaggtcaaagtatttcacaagcgatcagatgagctcggagttggagtcgagcttgattctcgacctgatatattggtaagtgaaattcttgattctgagctgctgggtgagggtctcatacctactctacagcatgcgcatgacatgctattggtgaaaaatccaaagacagttccatatcgagctactacttatggagtgttggttgagagcacgtccttgtggaagatgcatgatctgcacagcaatgaagcaaatgctgaagatggtgtgaggcttattcccagtggaacacaaattgttctttctgtgaagtcacagcaacatgcgatgcaatgtgatgcgctggcagatgaaataagattgctgtcagaacccttcaaagtttttgaatttgacttttcggaacgtccagatagtcatcgtgaaacaaagattgagataaaagcaacagctgatgggcatgctcatgctattgtttcatggtgggtgcttcagttggattcttctggatcagtcttttactcaactgctcctagatgggtgagacaatccagtggtgtcgatttaccacaatatgccaatggcacgaaggattggtgtgatcattggaagcagtgtgtttggtttatacaagggacaggggctcctgcaaagaaagatcaaactctttctttgagcgctagccataaccaaactagcatctcatatcagttgaatagaaatgatgaaggaagtagaagccccaaaagtaatcatctaacactgttaccagaaagggtagcactttatggtgataaagtttggagatcagcgttgataagtgtaatcaggaattatacgagcgaaagatcctctccgatctgcattgtggctgatgacagcgtgttcctagctctcattgtttcttttctgttaccatcttcaaaagtcctcgctatgtttccatgtcttagagacagtggcctcaactatcttcaagctgttgcagatgcaaataatttatccatggaccggattaaagtgattggtaaaaaggcatcgtcccttactacaaatgacttaaatcatgaaaaggttaatatgttagtgggggaacccttttatcatggaagtgaagggatgctgccatggcaaaatctgcgtttctggaatgaaaggactctgcttgatccgttgctctctgaggatgcattcatcatgccttgtaagggaatattaaggttctgtgccatgtcacttccggacttgtggagaagccgtcgtagccttaaagatgttgagggttttgaccactcagttgttaatgatactttaggggcctgtggtgacctgcctggagagcaacaaggcccttgcctaccttattatgtgtggcaatgcggttataccaagaaattaagtgaagtttactctctcatggatttgaacttttctgagcctatccactcttgttttggtgaaacaaaggttgagtttgcccacgatggaacatgccatgggttcgctgtttggatcgactgggtacttgacaaggaaaattccatagtgataagcaccgggccagagagcagatactggaagcaaggggtgcagctgcttagcacgcctgtacaagtgaacccagcgaattcggtgatgcacgtggaggcgaatttcgatgctgtcattggggagctcacgtttaaatccaccacgctctcatgatgccaactgtaatatgtggacaaccaagcctcatgcgtgtgttgttcttaaaagttagcatttgtcgctgcgttttgttcgtctgagcccctcatgtgagtcaagcactcaagctcatggtttcgtgtgtgttctgtcatgctagcacaagcaactgcctcctcggtggagctgttttttcatggtcttgtttgttagcccctcacgtcgtgaggaagatgct

SEQ ID NO: 8295 - DNA, 1534 bp, Zea mays
agcggcgactgggtacctcccgactgttttcgacggctcgtctcccggcgccggctggtttggggtccggaagagtaggcacttacatgggccgcaagatgatcaagtgtgctgcatccaacctactttcagaattgttgctctcgtgtacgtctacgcaaccaggccacgcgtgccccgacgaatatgaaggacatggcgtcgacctcctgaaatctgaagcgtcaatggagtatctatgcaacttaccaccacataggtatgaagctgttttcgcgaaagaaattccggagacgatcactggcgatgcgtttttagagaagtatggagaccacaacgatgcggtaacagaagttgacccaaagcggtcttactgtgtcaaggctcctactagacatcccatatacgagaacttccgagtcgaggccttcaaagcgttgctaacagctgccaaaacagacgagcagctctcagcccttggagagctgatgttccagtgccactacagctacaacgcttgcgggctcggctctgacggcacagacaggctagtgaatctagttcaagaaatccggcacaggaagagctcgcgcgccggagggcccagcctgttcggcgcgaagatcaccggcggagggtccggcggctcggtctgcgtgatggggaagaactgcctgaaaagcagcgaggagatcctcgagatccagaagaggtacaaagcggcgactgggtacctcccgactgttttcgacggctcgtctcccggcgccggcaagtttgggtacctgaagattcggcgccggtccacgtcgccgtctgattgaaggaggaggaggaagagctctgctcggtcggccgtaccctcacggtcgtattgatcgtatcgtatcccacgcactacgcccaagatgccaataaatgggacaaagattgatcggcaataataatactagtagccatagaaaactctagtgataagctgcgaaacaacttgtatgtcgaagaaaatatttgaaaccatggtatctttgtggtcgatatctgaagtgagatgatgtgaatggctattggcggatgttcatgtttgagctgtacggagaagaaaaggccgtatccaacaagagttcatctgcatagttacctcaaacacattatagaatgcactgaatataagagataagcaagctgataaatatatcctaaattgtcatctacaataaattttaggaaatgaaacctctttagagggaattaaacggctttaattagatttaatcaatttgcctcacagtttagtcttcgtcttcatcgatataattagttgtgattatattaaatttaatacctataattgatatttaaacattcaatgtcattctaaattaagcaaacacccacatggtttcaggttacatctcatctctcttgttaaaactgaactactattccattatgagttatgacttttatcagagcatctatttgcctttcatcttcatggtgtgcaagtgcaagtacaagctgcaggcatgca

SEQ ID NO: 8296 - DNA, 1456 bp, Zea mays
ctgatcataatgctcagcatcagcaatcgcaatcagcgcagctacacagccagggcacctgtctacctcaacaaagcaagcccagtcactgcagtattgcatcctatgctgttcaaggaaatggtcagacctacagctccacatacaagaacccttctaactgccctgcaactgtcgtagctcttctgcctcagcctccagctactgcttctatggcgtatcatcccttgggaccacaggtcgttcacaatcatccatttggaaatatggttgaaacggctagtgtggtagggtatcatcgttcgaggactttgagatactccatggtgacatgcaaggcttaactgatactatgtcctttttgaagagtttatcagggcttgttggaaatgacttaagaagccctgagaagcaaactcgagagagggctgctgcttctgtgctctttgactgggaggaggaaatatatgttgcaagagcacctgggcgattagacgttatgggtggtatcgcagattactctggaagtcttgtattgcagatgcccatccgagaggcatgccatgttgctgttcagagaagtgaccctaccaaacagaagcaatggaagcatacacaggctagacaactagcaaatggaggagcagtaccagtgttacaaattgtatcctttggttctgaattaagtaatcgtgcacctacgtttgacatggacctttctgattttatggatggcgacaaaccaatatcatatgataatgtgaaggaatacttttctcgggatccatcccaaaaatgggctgcctatgttgctggaactatttttgtattgatggctgagctaggggtgcgctttaaagacagcatgagcattttggtttcttcatctgtccctgaaggcaaaggtgtctcctcttctgcatctgtggaggttgcttctatgtctgctatcgccgctgcctatggtttaaacattgctccaagggatcttgctttgctctgtcaaaaggttgagaatcgtgttgtcggagctccttgtggagtaatggaccaaatgacatctgcttgtggagaagctaacaaactcctagcaatggtttgccagcctgcagaagtgaaggagttggttaacattccaactcatataagattttggggtcttgactctgggatacgtcatagtgttggtgggactgattatgggtctgtaagagtaggcacttacatgggccgcaagatgatcaagtgtgctgcatccaacctactttcagaattgttgctctcgtgtacgtctacgcaaccaggcgactcaagtcccgacgaatatgaaggacatggcgtcgacctcctgaaatctgaagcgtcaatggagtatctatgcaacttaccaccacatagggtatgaagctgttttcgcgaaagaaattccggagacgatcactggcgatgcgttttt

SEQ ID NO: 8297 - DNA, 3947 bp, Zea mays
  misc_feature (629)..(629): n is a, c, g, or t
ccctagacacggtataagacacgtcgtattaaacagcgttgtacatgcccttagcggtgtgcatccagggggcttttgtggctcagtatgtgatgccttttcgcccctcctgattttctgtaaataaaacgatgctgggagccatcggtgtgattgaactagtgttctgttatgcgtgctccccatcgattcaagatctacagtttttatttactaattactactagtacaagtctttacgtgtgctgtcagtagtaaaacagacaggctcatcgcgaactgaatattccagttgggatttgagaacagttaggtcagcactcagcagcattcggtgcgcaagaaccatctgtacacagcgatgattctgtacacatacaggataaaccaatcgaacagaacaagatctgattgatttccggtcggtcgtaccgtccgatctgccatagcatgatagcaagccgtcgaaatcaaatcggttaagaagctagcctgtcacgagactgttggagaacggcttgggttcggttcggatctgacagcaccggtggtgcctgccctgcctgcctgattgcctccctgtaccggcgcgtgagcgtggtgactgaacctaaacgtcgtcgtgcatnagcttgcattgcatgcccaagtttttgatgcctgctttgcagctcctatctaatcttcaatagatctactaccctcgtaagtcgtaacctaaccaagctgcggacatggttctttccatgcatgagcatgacccaggtcaatgcagacagccatcctcctttgtctgtctcccgagacatttgcttgccacgcacgcacatcaagaaccatgtcaaaggctccgtccagacgcgccacagccaaagccctgttctagtgttctcgtcccagagctcgccttcacttcatctcccgccccgagacagcggcgacatgaagcacacgcgaacaaacacgcagcctctctctgtccagccgcgcgacatgcgcgcaactttccagcggccatgatgcgcgcggcgccagggaccaaacgcaaaacctgacgacggccggtggaggggttttgtcttggtttgtcctcctcctcctcctcctggctagcgctcagcgtcaggcgcaacctaatccagcagggaccagcggcctgaacacggccccaagtttcgcgcgggcggccgtccctaaaggccgacaggggcgccacaggctaagctacccgcctcgcgcgcgctctgtgcaccgagttggcgacagtggcgcagacagcacagctcgacactgccagttttatactccctgcatcctcctgataggcatgagtgagtacagcaccgatcacttgggaagaagaagaggaggaggaggatgtataaatatggcgtgtcgtaggccacatgcatggttcagaccactttgcctgttgtttctagcaagctcctgcgttccgttgcaacatcgtttcatctctagctctcaaccctctctccattctcacactctccacgacctagctctactctacggtcgtctacgcatacaaatatatgaggactaccacttccctgccgtcggctgctgctgccgccaccgtcttgatgcttctgttgctgactgcggccgtggaggtcgaagccatcaggcccctggaagccgtcaagccgcagcagcaagcgaacgttgccattaatgtagtaagcgggccccctgctgccttttcttcgccagcgaagagaagcgtctctgtcgatgggcaggaggtcgtcaaggcaacgttaacggcgcacaaactgcctgggttccatgaggactactatggcgccagcgtccatgaaccgaggcaccattgatctgaggggcaatgcttcgttctccgtcatgcatgccatgtggccttcttcccgtgtggcgctagctgttcggacagacagactattgttccacaccgatcccctttaatttgtgcagagagagagagagagagagagagagagagtaggctaggtactagagcttagtcgatcgatcgtcagcatgcatgcggctgtatgtctgccatagttacctcctgcatagcatagctctcagactgcgagtagcgagctatagtagcatatcgataatcttcttcttctgttcttgttttgttgtcatctcctgcagaaagggccggaaaggtaccagttttgatgcgctaactatatatattgtggcaaagccaaagcaaaaaactctttaccaaaaaaaaaaaaaaaaaaatgagctagctagctataggtttgcgcaccactcgtgatactgcaaagaagaaaacaacggacgtaattaatgtgctcttggtcatgagaacgtatcaatgtccatattgattttgtgcgtacgagcatgaagatggttttaatttatgcacatgcatgacacgttgcctgaacacggaccagagtttcagaaaccctagctgtaatgcaatgcaattggtcggcagttgtaaattggggctagagctagacgacgacgggggtgcaggccaccggcgcgcactgcagtctgcgcagagtgcaggcaaacgacgccgccgttgtatgtgagcagtgcaccaacaaccccaacagatcgagggggcatggggcagctagcctgcagcgcgagtactgtctgtgctctcggctgggcgctgcagcagatgccggatatgctgcagtgttcttcgccggggctgtccggtggatgcgtgactgggacgtggatgggagatggagtagagtatattattcggcggtgtgcatacttccacgtgcccaattatcagctctgcgtactatattgtcagccggcacagctaagtgctgtagagggcccaacgctagggaatgtgtgctgtagagctcccagccagcacgatcgaagcagttgacaaaaaacaatcacttctgtacatacaatcggctgcataattttattttcctactagtaataatgagcgagctatttttattcgtgggctatcgacggtgccgcgttcttgcttgtagttgggcctgcttgtagcctacgtgtcgcctgtgcggcccgtgattctccttggcaacccctgtcggcctgccacggtcccgggcgggccgtggtgcaagtgcaagtgcaatgcaacctccgccagcagattttaggtaccgtttggtttggttacacagtacggtgggactagagacggcaatgcgcacagatttatgtggggattttcttcattaaaggctagtttgacaacctcattttttatgagatttttaatttcctaagaaaaaataaactaatttctcatgaaaaaaattgaaaaactcttgggaaattggggttcctaaatcagccctaaagctagtttgagagccagattattggagagaattggaggggctaaaattccctaactcttcaattttaaatagcaaagagattttagccccctcaatactctgttatatctttgctttcaaactagtctttaggagacggggacaggaaaaattctttctccatgagaatgtaaacggggaaaattcttctctcgttaagtaaatggggatggggacgatgaagcattcctcgtcccgttttcccgcggggacccgttaaaactgtacgtgacaatgtttttgtgtactattaaatgataaaaataaaatgtttacacctgtcaaggatttatcttcgcagggaatgaggaagaaatatcaccgcaaccgttcgtggggaccctacgatacttttttgtagcggggatgagtatggggaagtattcccttactaggaattcaccattaccgtcactagatggaacggaacagctctattcttaatttgttgttgttgtttagtttagttttacataggatatgttagcgccgatctaggcagcaacgatcactaggtggtgtaccgcc

SEQ ID NO: 8298 - DNA, 1859 bp, Zea mays
cattgggaccctcgaggattgcgctgcactgctcccacacgctcggattcctgctcgctttctcctcccacgattccatcgccagccgccccttttcccttcctttttcccttgctcgcccgcccgcccgcccaggactcgtccttcgcgcttcttcgccagctcgtccttcgcgcttcgtagccagccgtcggcgagagagggtgagaggatcctacgtgccttgtacgctcgctcgggagccggccgggatcgcgccgcgccaccgtaccccgccccggacatgtgcgtggaggggctggacgacgcagcagggaggctcggcttcggagaccaggacaccgacaggcgcgccggtgatgcgatggagagagtttgtgagaacacagtggctgttgacttcaagcagactaagctgaacaactttgtgccattcatccggtcaggggaatggtctgatattggaggtcgcgattacatggaagatgcccatgtgtgcatctctgatctggcaaagaattttggctatgactcagtcgaagatgaagtaatttctttctatggggtgtttgatggccataatggcaaagatgctgctcattatgtccgtgataacttgccacgggtcatcgtggaagacgctgattttcctcttgagcttgaaaaggtagtaaagaggtcatttgtgcaaactgatagtaagtttgcagagaaattctctcaccacaggggactttcttctggaacgacagcacttacagcaatgatttttggaaggtcccttctggttgcgaatgccggtgactgcagagcggtgctctcgcggcgtggcactgccattgagatgtccaaggaccacaggccttgctgcatgaatgaaaggaagcgcgtagagtcacttggcggctacgttgacgacggttacctgaacggtcagctggcagtgaccagagcgctcggtgattggcatctggatggcatgaaagaggtgggcgagccaggagggcccctgagcgccgaaccagagctgaagatggtcacgctgaccaaggacgacgagttcctgataatcggcagcgacggcatctgggacttcttctcgagccagaacgccgtggacttcgcgcggcggaggctccaggaccacaacgacctgaggctgtgctgcagggagatcgtggacgaggcggtgcggcggggcgccagcgacaacttgacggctgtgatggtctcgttccacccggacgcccctcccccgagccgagccaacaagaggaccggcagggtcaccaggagcatttcggctgaggggcttcacagcctcagagtgctcctggaaggccagtgacgtcgccgggcggcgcggcgccattgctgcccgttcgtccctgatgctgtgctacgttgctgatgagtgttaactgtaagtagcggtttccggtatcttggtgcttgctcttcttcttccgctgagggcgggcgactattcttgtccttcctccgacaataaaccaacgggcctgagatctcactgtgagacgctgtaaataaggaaatatggaagttggagctcgtcattaaggacgagttagcggtgtgcatccagggggcttttgtggctcagtatgtgatgccttttcgcccctcctgattttctgtaaataaaacgatgctgggagccatcggtgtgattgaactagtgttctgttatgcgtgctccccatcgattcaagatctacagtttttatttactacttgtacaagtctttagtctttacgtgtgctgtcagtagtaaaacagacaggctcatcgcgaactgaatattccagttgggatttgagaacagttaggtcagcac

SEQ ID NO: 8299 - DNA, 2150 bp, Zea mays
gccggccgggcctgggcattcgtgttcaaaccaggaaccaatcggacctccgtaccaaattatttcttggcacctcagatcagcatattccatctccaatcccccgccgcgttcccccgcacgctttgacccataaagtcgatccatctccgagcaccaagttgaacacgcgatcccattcccattctcttgctcaatacaacctccggcttcagcaagccgcagcgccaagcctagaagcggagcgcggaacacacgaggccaggaagaggaggtgctgccgtccccgcgccgccgctgtgggagtgcggggaatggggcggcacggcgtggaccagatcggcgctgtggcagcgttcgtctgggtcaccctccttcccttgctgcttgtgtgcgtcgtgtggccgggcgcccaggccggccatacaagcgagtaccggcgccaactcggctccgccatcgacatgccactcgacgccgatgtcttccgccctccctcgggctacaatgcgcccgagcaggttcacatcacacaaggcaatcatgatggcacagccatgataatctcatgggtgacaacaagtgagcctggctcgagtactgtgatctacgggacttcagaggataacctcaactatactgcaaatgggaagcatactcagtatactttctacaactacacctcaggatacattcatcattgcacaataaaaaagttggagtttgacacaaagtattactatgctgttgggattggacaaactgtgaggaagttttggtttttgacccctccaaaaagcggcccagatgttccatatacactcggtctcataggtgatcttggtcagagctttgattccaatgttacgctcacccattatgagtccaatgcaaaagcacagggagttctttttgttggggacttgtcatatgcagataactacccatatcatgataatgtgagatgggatacgtgggcaagatttgtagaaaggagcgtcgcgtaccagccttggatctggactgctggaaatcatgagatagatttcgctcctgaacttggtgaaacaaagccattcaagccattcagccataggtaccccacaccctacaaggcttctggtagcacggcaccttattggtattccatcaaaagggcctctgcctacattattgtcttggcatcgtactcagcatacggcaaatacactcctcagtacaagtggcttgaagctgaatttcccaaggtcaacaggagtgaaacgccatggttggttgtcctcatgcatgctccatggtacaatagctataactatcactacatggaaggtgaaaccatgagggtgatgtatgagccatggttcgtgaagtacaaagttgacgttgtgtttgcaggacatgtccacgcctacgaacgcacacacaggatatcgaatgtcgcatacaatgttgtgaatggcctgtgcactccaatccctgatcaatcggccccagtttacatcaccatcggtgatggagggaaccaggaaggattggctaccaacatgtcgcagccgcagccgagctactcggccttcagggaggcgagcttcgggcacgccatcctggacatcaagaaccggacacacgcgtactacacgtggcaccgcaaccaggacgggagcgcggtggccgccgactccatgtggtttaccaatcggtactgggaaccgacggacgattcggccgacgatttccagtgaggacgagagctgcagctgggttggttattcgttgcggttcctcacgaccaataagcatcgccctgaatacacgaagcctccgaagctccgatgcaggcctctgccacttcttatagctctccttggtcgttgcccgtcttctcttggagagagaaaaaaacgtgtgaagagtaaaacggagtgtctctactctgattgtgtaaagaactcacgttcacagcatacgttgccggtcgcatgtcgacctcccctctaaattgctaagcagcgtgtactagtcatctaggtgctgctcattggtcaatagtaccgtttcctcttcaccgaaaaaaaccctgcctccttgcaaaaataataaaatgaaataaaataatgccctgctttcgcagcaaaaaaaaacacccccac

SEQ ID NO: 8300 - DNA, 1549 bp, Zea mays
  misc_feature (56)..(56): n is a, c, g, or t
cattgggtacctcgaggccggccgggctcccacctgaccctcccgtcccgcattcngggacgaagccaacgacgagctcagcagcgccgacgccgcaacgacaaccagagcaccccgcactgtggagaattcatgtaaattagattaaaggtagcaatgtggcgccgctgttgctgcaattgccaagtggatgaacccgcccggcgggaaaatgggcatgtcaaggccacaatcaacaacattgatggggcaataatggggttgaaagattctactactggaaaagtcgagccgcaggatgctgctccccgaattgatatccctgttctatccttggatgaactgatagaaaaaactgatgactttggttcaacggctttgataggtgaaggttcttatgggagagtgtactatgcgattcttgataatggaacaaaaatggcagtaaagaaacttgattctactgaaaatgaacccactgctgaattcttgacccaggtttcattggtttcaagattgaaacatgaaaactttgttgacatgttggggtactgtatggagcgtaatcttcgcatagtagcctatgaattcgccaccatgggttctctgcatgatgtactacatggaagaaaaggagttcaaggtgctcaacctggcctggcgcttgattggatgcagcgagtgcaaattgctgttgatgcggcaaaaggacttgaatatcttcatgagaaagttcagccttccattgtccatagggatattagatcaagtaatatcctcttgtttgaagatttcaaggcaaagatagcagactttaatctctcaaatcaggctccagatatggctgcccggttgcattcaactcgtgtcttgggaacctttggatatcatgctccagagtatgcaatgaccggtcaactaacccagaaaagtgatgtatatagcttcggagtagttcttttggagcttttgacaggtagaaagccagtagaccatacaatgcctagagggcagcagagcctagtaacttgggctaccccaaggttaactgaagacaaggtgaagcagtgtgtagatccacggttgatgggggaatatccggcgaaaggactcgctaagcttgctgctgtagcagctttgtgtgtgcaatatgaagctgaattccgcccaaatatgagcattgtggtcaaggctctgtctccactactcgtaacaaagcagactccaccacctgttgttgacagttgacgtacaaaattaacctaagttgcaaatatgagcggcaacagttgggacactacggacatttgatcggttcacctcagtcacagatttcaaacactaactgcatggagagggcatctttagtactgcattaacaactttgcatctgcggttctacagcatgcgcatgtcaacaatgttccttttcatctctcagtaaatgccagtatcaaggagactagtgaaatattcagtgatcaacattgagactgtttttttttttttgcaaagatgcggaatggtaaaagacccttcttttggtgtc

SEQ ID NO: 8301 - DNA, 602 bp, Zea mays
cattgggtccctcgaggccgccagccgggcccttttgtccctctgtaactggttcgcagtttccgcacccagcacccgtcccgtggacactccactgcatccaccacaccaccagatctgctgccgtccgcgcagaggacgagagcaacttcatcgcgatgggggcggtggtgacggcggtgatcgcgatcgccgcggtggtgctcggctggatcaccatcgagatggcatgcaagccctgcctcgagaccggccgacgcgccatggaccgcgcgctcgaccccaaccacgacccggactcccccaccaacgccgccggcgcctccgccaacgagccgctcctcgccgacctctccgcctccaccgcgccacccgcaaaggccatctgaatctcatcacctcccagagcgagccagaggcggaccacccttttcccctcgccttgtaatcttgcttctttctatgtcattttgtgcttatgagtttgctattaatattaatggtgttttggttatgaaacgaccactgctagcaatatataaactacttattcagacatccaaaaaaaaaaaaaaaaaagcggcctagattctgatggggat

SEQ ID NO: 8302 - DNA, 995 bp, Zea mays
tgcagcatgacatatagttcatataaaagaaacacatgaagctagggtggaagggggtttctggttacaatgaataatgtttttagatcattatctatattttgtatcgacagataaggttttaggtcaaagcaagtgttttattgctgaagaacacaattaaaatagcaacattgactgctgacgtaacagtaccgaacattcgtattttttgcggaaatgtattgcgcaggtccttgtaaatggttgacatatccagaaagcatatgagtactcatgcaattaactgagataatggaaagaggagtacggaagtactcacttgaacatggaatttgatgtatacttgtatgattgtactgtcgaagttaatgctctggataacagcccactgcacagaagctcttcccatctgaacaaaccacatagattatgaagtggtcgagcaacctgcaagatcacaattaaatgtatgcattgtcatttgcgtacaacatttaataaaatgctgatgtatatatgtaaggtaatcggtatgacgatgtgcaatgcagtctaaaaatgttgcagtagtgtatacatccaccaagcaatggaaaacttttacgtactaatattattcattcattgtaaataagaggctgtatgcaaacgcacgctatggaaaattttaattttccgtgcacagcaattaaagtttcacatctaacatcgctgcagcatcatatatagctggtataaaaagaatacatgaaggtgccttacacggagtaaaaaaatgtataaacagatcaagctagatttgatatacgaagtaaaaaaatgggttgaaaattttagtatgtacgcaagagggtttgtgtttacgatgaataagattttttgggtcattaccgataatttacatctacagataagattttagttcgaagcaagtgttttatttccgaaggacagatatgtctcgaatcaaacacttgttatatcagggcgac

SEQ ID NO: 8303 - DNA, 3661 bp, Zea mays
atatatatatatatatatatatatatatatatatatatatatatatatatatatatatatgatgcaggcatcagagcagcggatgagtgagagagcggagctgctcaaggcgcaagtacgtcaggcgttcgatgctgccagcatggatgttgcaggtctgatcacgtacgtcgacaccctcgaacgcctcggcttagacaaccacttccgcgacctcatcggagctgccctggaacgaatcggagctgaggagctgccggagcacggcggcggcctgcacatcgtcgcgcttcggtttcgcctgctccggcagcatgggatatgggtatctacaggtgtcttcgtcgcgttcagagatgcccccggacaccttctgttagctactgtatacatgtgatatagctagtaataatcacgtgtgtgttttgaattaataatatacacgcacgtacgcatgcagatgtgttcgacgcgttcagagaggacgcgggcggtttctgctcgagcctctgcagtgacgaccctaggggtctcctgagcttgtacaatgcggctcacatggcagtacccggcgaggtggtcctcgacgacgccatcgccttcgcgaggggccgcctcctggacatcatcagcaaaggcgaggtcaggtcaccggtgtcagagcagatcacacgagccctcgacatccccctcccacgatttacgaggcggctggaaaccatgcactatattgccgagtatgagcatgaagaggcacacgacggcctgctgcttgagctcgctaggctcaactttgtccttgtgagagcgcttcacctcagggagctgaaggacctgtcactgtaagtcttctttcatgtatacaaacatgtatatctgatctgcatgcatattgaaaagattcatgatcagcaattttgtttggaacgcatgcagatggtggagggagctctacaacactgtgaagctcccgtacgctcgggaccgtatggtggagatctacttttggacctgtggtatgcttcatgaggaggagtactccctggcacggatgttcttcgccaagacgttcgggatggtgtcactgatggacgacactttcgatgtccatgctactctagacgagtgtcacaagctcaaagaagctatgcagaggtagtctgcccttattttatgttagccgccagtgcaaatttagctccggctcagcgtcttccttcttcttgagagatgttttttgctaattaaacatcatcatcactcctaatataatgcatatacttattactgatggaccctggcccatgcatgcagatgggatgaaagtgaggtctccattctacccgagtatctacgcttgctgtatatcaaaacacttagcaacttcaaagagtttgaggagatcttggaaccgaacaagaagtaccgcatggcttacacaaaagaggcagtatgttcatatattattaattagatgcataataatatgtgtattcaactgtatacttcttaacatggaataagatagatatatatatatatatatatatatatatatatatatatatatatatatatatatatatatatatatatatatatatatatatacatagtttcaactaattgaataattaatgtgcatgatgcagtacaagttgtgctccaaaaactacctaaaggaagccatctggtctaaccagaaataccagccaagcttcaaggagcatgaggagctatcaatcatgacctcaggcttgccgatgctcacgatcctaacactaatgggcttcggtgacgaggcaaccccggaggcgttcgaatgggtaagcagtgttcctgaaatggtccgcgctggttcgcaggtcactcgcttcctcaacgatttgtcttcttacaaggtatactatatacccataagtataagcataagcatgcatatagacaggccttgcatgatttgattcaacatagaacatgcaaatacatactctggtatatatatactcaccatatatctatacaaacaaacatgcaaatgcagttgggaaagaacaagaaagatatgcctggctctgtggagacctacatggtagagaatggcttaacaggagatgaggctgcagcggcaatcgcggcacttctagagaacaggtggagaatactaaaccaaacaaggatggagatagatcacacgctactgccagcggcgcaggtggtgctcaacatggcgagggcaaatgagatcatttacctccacggcagggacgcctacaccttcggtgctgacctcaaggaccttgtcaccacactcttcctcaagcaagtgctccctctctagacaatactctgatcacacaactagattggctataacgattctcgtgttgtattacgctttgtgtttcattatgcacgctatatatatgatcaatgtacctgtttctatcatattgatggtaatataatattctaaatggatatagttaacttactgtgctcaatgtatccttgccattatgcatatcatcatattaatattgttggcgactcgtctgaccccctcgtccctagcgtcgcatcgctcggtgctggcgcggtgctgggttacccggggcgagtccgcctgggccggttactcactcgtgggtccctgagtaccctgggattcgttccgacacatctatataagcattttatgatatctttatgttcatggctagtatatttaatgtaatgatgttttacaccacgttctggatctgtatatatataccagccatttaatttggtacctgcaactttctaatttatgttttacatcatgctaatgatctatctggctgccattttatagatgtatacatatctttcttaccctatatatcttcagcagcttaccatctcatctcctatcgtatctactagtttaaacttcactttgtaaatagtaaaaacagtgttttgtacgaccatatatatgaccatatatatacacacatgagacagccttatgttttatataaagctataggctacgcgcacaatgtgtaccatattatttgcacgtgaacactttcagaaataaaatagaatacgtgtaacataccacgcccctgtgtgcacactcgtcttgatttgtcagatcatgatgagttgtcgtgaagataactcagttttaataccagtgttaactcagttttaatacatgtgatttggcatcgagcactattcacataaataatgctctctctgataccatgtgacatgcatgcttgctctaatatgtagtaagacgcgtgcatggcgacccaatcactctcgatctcttccctgtcgccccctttgcagcctccctccttggctcgtaggtgtggcctgtagctcatgtcctttttttttgcccctggcaatggcagcgcagcaccccagcatgtggtgagccatctctaggcatgactaactgtctttgttgccgctgccacgccactctcgacaaaagggcacgaaaaaggtgtttatatgtgatcgtggcccaggaggagtgttagataaataagggattggcctatttaatatttattttatagtgaattaaatgcaaaagccttacacaatggtcactaggtaaaatagggaattttcgacagctaaagccgtc

SEQ ID NO: 8304 - DNA, 2134 bp, Zea mays
agggttttgttacggtgagtgataagtgtgtctgtcgatctgtcggtgcattgcattgcattacattacagcaagctaggttggcctttaaatagagatccatatacaccgtctcctatacccacgcgccccccgacgcgtgggtcttcttcttgtcagtaggtgtggcctgcacagctagcgccactgcccactgtaccgccattattttgttagcatggccccgagtaacatcgtcgttcagagcagcagcactccgccggttgccggcggcgacgaggagttcgcgccgtctgtatggggagatttcttcgtcacctatgcccctcccgtctcacaggcatcagagcagcggatgagtgagagagcggagctgctcaaggcgcaagtatgtcaggcgttcgatgctgccagcatggatgttgcaggtctggtcacgtacgtcgacaccctcgaacgcctcggcttagacaaccacttccgcgacctcatcggagctgccctggaacgaatcggagctgaggagctgccggagcacggcggcggcctgcacatcgtcgcgcttcggtttcgcctgctccggcagcatgggatatgggtatctacagatgtgttcgacgcgttcagagaggacgcgggcggtttctgctcgagcctctgcagtgacgaccctaggggtctcctgagcttgtacaatgcggctcacatggcagtacccggcgaggtggtcctcgacgacgccatcgccttcgcgaggggccgcctcctggacatcatcagcaaaggcgaggtcaggtcaccggtgtcagagcagatcacacgagccctcgacatccccctcccacgatttacgaggcggctggaaaccatgcactatattgccgagtatgagcatgaagaggcacacgacggcctgctgcttgagctcgctaggctcaactttgtccttgtgagagcgcttcacctcagggagctgaaggacctgtcactatggtggagggagctctacaacactgtgaagctcccgtacgctcgggaccgtatggtggagatctacttttggacctgtggtatgcttcatgaggaggagtactccctggcacggatgttcttcgccaagacgttcgggatggtgtcactgatggacgacactttcgatgtccatgctactctagacgagtgtcacaagctcaaagaagctatgcagagatgggatgaaagtgaggtctccattctacccgagtatctacgcttgctgtatatcaaaacacttagcaacttcaaagagtttgaggagatcttggaaccgaacaagaagtaccgcatggcttacacaaaagaggcatacaagttgtgctccaaaaactacctaaaggaagccatctggtctaaccagaaataccagccaagcttcaaggagcatgaggagctatcaatcatgacctcaggcttgccgatgctcacgatcctaacactaatgggcttcggtgacgaggcaaccccggaggcgttcgaatgggtaagcagtgttcctgaaatggtccgcgctggttcgcaggtcactcgcttcctcaacgatttgtcttcttacaagttgggaaagaacaagaaagatatgcctggctctgtggagacctacatggtagagaatggcttaacaggagatgaggctgcagcggcaatcgcggcacttctagagaacaggtggagaatactaaaccaaacaaggatggagatagatcacacgctactgccagcggcgcaggtggtgctcaacatggcgagggcaaatgagatcatttacctccacggcagagacgcctacaccttcggtgctgacctcaaggaccttgtcaccacactcttcctcaagcaagtgctccctctctagacaatactctgatcacacaaccagattggctataacgattctcgtgttgtattacgctttgtgtttcattatgcacgctatatatatgatcaatgtacctgtttctatcatattgatggtaatataatattctaaatggatatagttaacttaaaaaaaaaaaaaaaactcggccctatccagcgactaataaaaagaaacagaggaagtattctaaatggatatagttaacttactgtgctc

SEQ ID NO: 8305 - DNA, 1633 bp, Zea mays
  misc_feature (814)..(814): n is a, c, g, or t
  misc_feature (1260)..(1260): n is a, c, g, or t
ccgggccgggacattaaagtagaagcacatttgcatgttgttctttcctcaaatcatgacaactttgggacgtggctcgatggggaaccatattccttatagtttctcttgtgtttgtcatggttattcaatcaacttcatttcccacaagagatgatgtgcgttgtgatgtgctacaacaacgatgtgcacctaacaattgcaatatccaactatgtcgagtgtggtatggagaaagacaattcaaatctgctttttgcaagaggactcctccttttcctgaccagtgttgctgccaaatgcgtggccaaccaccaaactcctatgtccaagtcccttgaagcttaggggttctacttgaataataatatttcaccattactttttttcttattttagtgatatcaataaataaagatgcatttggctaacttgctcttgtatgtgatgtgatccatttacatgaaggaaatgcaacaaagatgttctaaccatatagccattacaacatatgtggtggtgtgtgtcgctatctagcaccgacaacacactacagggtattacgtggactgcttttgatggttagcaacgtcgacagtagctcaatggatgtaaaccctagaatttagttttaaaactctagtcacttgaggaataataaaggagccattttaattatgtatctagtaaacgagcatatttctaccaagtaaaaacatggaaattatgcagcatgctagaactcctttacttgggcatcaaactcaaacttaggcttaaaacaaagttagtttcaaaattcaattttgagctngaaaaaatatgggagaaaaagagttaagaagaaaggaataataataataataataataataatatggcaaacagagaaagtattattcatgttgaaattatgtttggaaatttgaaagtgcaaaacaggactttgaaattggtagggacacttcaaattagaaataggaaagaaaatagaaaagaaaaaaaaagaaaaattccctgcgcttgggccagcatttgaccactttggcccatttccgattatcaccccgcgcggcccgctacccagccttcccccacggcgctgacgactgggccctctgggaagtctccatcgttgggcggtggttggcttgggccaatgacgtgtgggacctggctgtcatcactcaccttccgtgttcgtcgtgaatcttaacaaacctaagccaaccttgtgattccgccggtggtgtggggggnctgtcgtcggttccttgatggacgctggggatcagatctcccgttgccactttgggattgtgatcaaggtcgttcatccggagtccaacggaggtgagcagatcgcgcacatttgaaatctacgccacagatctgtgatcctgcggtcctggtgccataccggttcgaatatatttcgatctaatctggaccacacgagttacatcttatggctgatatcccacgtcaccccttcgacccgcgcacaaattgcaaactagcccctgtgttctaacagaattaacccgcagtccgaactataggaagatcatcactgacaggtcctgaaatttataaaactgaccctggggaattccagaatagtgacccggtc

SEQ ID NO: 8306 - DNA, 1302 bp, Zea mays
aaacccccttccccaaactaccttcgctgctctccttgatccgcaattttctcccacatctctcttctgcccacttgcctccatcttggcctccccctccactccccacccccgaacatccggcgccgtccacacccttgcaccccgactcccctcgtccttcgcggccacgatggcggcgtccatggcatcgccttaggggcgatcgatctgggagaaagtgctggagcacgtggcgtcgtaccaccagcaacaacggaggcagaagctacgcaagagcctcacctacaccggcagtgagttctcgttcgctgtccggggtcgtggggacgaccccgcctccacgtccgttggggcacagaacgaggacatgcctcttgagcacgtctttaaaatcattagatccgatggcaaaagtgtgtgtttatggttcctgagtcagatgatctttcttcagttttagaacacacctctccatctttcggtgctaggtggatcaccttaacacatattcggacatagaactggattgtgcatattttgtaaagtgtatgttctacattttgtaattcgtattattcattttttcctttagtttttctctttctacaactcctgtctctttacaatcaaatttcagatgtgatagatattagtatgaaagataaaaactagaatgctatgcctgtcagaggagctttcttcagtttcaggtactgctctgctttattagccatccagccgatggataatttctatacgcgtatcgcccctgcactttcaaacacttatgttcattgtttccaatcacatattttttcttcttctcttagatttactatgtggttgtggtctcagtttggcttgtaggttaatttgtatactcatgtcattttagtttttccgggtattttatgttcatttaagtatgtcttaatttagttactttcaattcttgatgctaataatatggatagattgcgacactactttctggcttgagcagaaatgagtttgttgtatatagcagaatatagttgtcgtagctggcaacaatgaccgctctttggatgatctgaaaactattctgtagtcaggtagttaaatatagctgaatatccattattatgttttattaatcttatttgttttttctgtcaaaagaacacacctctccatctttcggtgcttggtggatcaccgtctaaacgatccaccaccagaaccgcccaaccccaagatagctccatctcagtcgttgtacccgttcaatggcgagctggtggcagcgatgtaggagat

SEQ ID NO: 8307 - DNA, 1954 bp, Zea mays
  misc_feature (985)..(985): n is a, c, g, or t
  misc_feature (1449)..(1449): n is a, c, g, or t
cccccgcggccggccgccccccccacgaaacccccttccccaaactaccttcgctgctctccttgatccgcaattttctcccacatctctcttctgcccacttgcctccatcttggcctccccctccactccccacccccgaacatccggcgccgtccacacccttgcaccccgactcccctcgtccttcgcggccacgatggcggcgtccatggcatcgccttaggggcgatcgatctgggagaaagtgctggagcacgtggcgtcgtaccaccagcaacaacggaggcagaagctacgcaagagcctcacctacaccggcagtgagttctcgttcgctgtccggggtcgtggggacgaccccgcctccacgtccgttggggcacagaacgaggacatgcctcttgagcacgtctttaaaatcattaggtaacttccagatctgcctagccccttgacgtttaacttgatgcccaatcggtagtttgttcattcagaccagcaaacacaactcatttgtttcttgtgaggctaggccaaagtttgtgcgaccgttgatgtgaatttcctctgggcccaactttggtatacataaattccattattgcctttaattttttttgtattctggtagatttgggcatgctaagagctaaggttgtttcatcttgcaacacattgacgtgctctatagctataaatgatatcaagttatttcatcttgcaacagatccgatggcaaaagtgtgtgtttatggttcctgagtcagatgatctttcttcagttttaggtacttttatgctttaatatagctcatgcaatatgatttattttaacacatatttggaatagaactggattgtgcatattttgtaaagtgtatgttctacattttgtaattcgtattattcattttttcctttagtttttctctttctacaactcctatatctttacgctcacggttcactaggtggactagtnactatgtcgtatgataagatagagctagaatgctatgtctgtcaaaggagctttcttcagtttcaggtactgctctgctttattagccatccagccgatggataatttctatacgtgtatcgccctgcactttcaaacacttatgttcattgtttccaatcacatattttttcttcttctcttagatttactatgtggttgtggtctcagtttggcttgtaggttaatttgtatactcatgtcattttagtttttctgcgtattttatgttgatttactatgtcttaatttagctcactttcaatcctggatgctaataatatggagagattgcgaccctactttctggcttgagcagaaatgagtttgttgcatatagcagaatatagtttttgtagctggcaacaatgaccgctctttggatgatctaaaaactattctgtagtcaggtagttaaatatagnctgaatatacattattatgttttattaatcttatttgttttttctgtcaaaagaacacacctctccatctttcggtgctaggtggatcaccgtctaaacaatccaccaccagaaccgccctaccccaagataggtatgtgcaggttcaactactcatttagatattggtacaacctgtaatagactttggtacaataggatttggttctgctattcactttgtttttagttccaaacaaccaaaaaattgcatgtcctttaggaaaaatatcacaggaatattagtaatataacactgataataaaaaatgctttgattctatatatttttcatgttataaggttgaaaacattccgtctcacggatcaaaatgggtacaaggggacgtactgcatttacaaatatatttaaccataataaaacatctttggaaaatgaatatcattttaagtccaaaaaatgtttttgttgaatgttcattaagctagagtgaagagtaaactt

SEQ ID NO: 8308 - DNA, 3554 bp, Zea mays
  misc_feature (612)..(612): n is a, c, g, or t
aattcggcacgaggcgcaaaaaggcagcaaggtttaggagatctcacccagctactaacaaaggaacaagctgacctgggggtaatctcggtgcgggcgccgttgctgtcgctcggtacaacatccatcatcagaaaggcctaccaggacccagaactttgtcaaaaatttgaatgtcgtggctgggtgaagcttacacaacctttcaatcctcatgagtttctccgcagtatggtcgcccagttctacgcaaacagttgcctgcaaaatggaatcgttataaatgtcgatgaactgaagaggattgaggaaatggcgacaacgggaggcggactcattggggcatttatggataaagtaaatgagaacagatacctaatcgtcctggaaaatctgtccacaattggagattgggacaccatcggaacttacctgccagacaggaagaatggcagtcgggtcattgtatccacacagcagtgtgaaattgcaagcttgtgcattgggcattcataccaagtagcagaggtgaagcagtactcagcagagcactctgtatgtgtcttcttcgaggagggattgcaaggtaatggtgataaaagcatggaatcntgatagagtagtagacaacaaccatgaaatgtcaatgcaggatgaaataacccacggtactggcttttctgtccgacagaattccaacatctaaacggaaggatgcctctgattgggtgaagaattttcaacttgttgaacgcaagtcagaaatgaaccaactcggtaactatattgctaaggcacgtgtctatggtttgcaaatactgtctgtgtgggggatagctggtgttgggaaatcagccctcgttaggaacatgtactttgacagaattcatcgaaatgaccaattatttgagaagtacggttgggttgatgtaacccacccattcaatttaagggacttctcccggagtttgcttttggatttccattcagaacctgttcaagccatgggaatcaaagaccctactcaagagtgtcataagattctagaagataaccggtgccttgttgttattgatgatttgcagtccattgaagaatgggacttaatacaagctgccttggtgtctagaccttctagaagtattatcattgtcattacaactgaagcaagtatcgccacatattgtgcagataatgaaggggtcgtatttaatgtcaaaggtctagaagacaaagcagccctcaagcttttcaaaaagcaggtacataggcaaaaaccatcatctcctataaaggactccatagatgaagagctacaagaacttattttgaagtgtggtggtcttccaaaagttatagttgccgtagctaactttttggcacctaaaacagtctcatggatggacagtgcaagttctatgaatctcaaatttatgcaagagctggagagcagcccagagtttgcttgcctgcagccactctttggttggctgcactcctactttcgaacatgcccggattttctcaagccatgtatcttctatctgtcaatttttcctcgagatcacagtatccggagaaggcgattggtgagacggtggattgcagagggctatgccagggacacggacaaaatttctgcagaggaaagaggggagcagttcttctgcaggctcctcgatctgagcataataatgcagaaaccatattcagtcaccaccggattcagagacagcagaatgactttgtgtcaagtcaacagttttgtccgagagtatatcatctctcgtcaaatggaagagaaccttgtatttgaactgggaggcagttgcaccctaacctctcagcgcatggggcgtcacctcatcatactgaaaagctgggacagagacagaattgtgtttgagagcattgacttctcaaggctacgatctttgacagtgtttggagaatggaagccattcttcatatctgataggatgaggttgcttcgggttctggatcttgaggatgcatctgatttaaaagatgaagacctcaaacaaatgatgaagctgctttgtcgcctcaagtatctttccctacgaggatgcactgggatctatagcctgccgaattcattaggttgcttgaggcagcttgagactctggatgtcagacatacagccatagcaaccatgccaaggactatcaccaagctaaagaagttgcagtacctccgcgctagtaccaccaaaccaactaaggaacaaccaacacccgatactgctgttacacccaaaccaacaaagaaacaaccaaatccacacacctcggtatcatggacgtcatccttgttccacagacatcgacaactagagggtgttgtggttcctactgggctagagaaattgacggcattgctcaccatcggtgttgttaatgtcaattctgctcgggggaggtccatcttgaaagaggtcaggaagctcacccaattgcgcaagcttggagtgtctggaataagtaggaacaacagcaaagatttctgtttggccatctcaagtcgtgcgcatttagactccttatcagttaagctcaagaaggacaatcaggactgcttgtgtgtcaccccagatggctaccttccccccaagaacctacagagctttaaattgtatggccttgcagacagttttccaaaatggatcaatcaacttgaaaatctcaggaagttagttttggagatgactatattaacgcaagatactatcaagggactcaaggatcttaaagtatgtattctgcgtctaattaccaagcagcttcctgatggtaagctcaatttttgtgtcatgttgcatgggcagcaattacgttgctatgaaacagtgaagatactcgagatctcttgcagctccagcttagatgtggcttttggatcacaatcactgcaaaatcttgagctgctgaaagtttcctgctgtagtggttcagggtcggtaatgaagctctctgggctagaaaaactgtctgaatctgaactcaaggaagtccagattaagggttccgatgatttcatagtaaaaacagatgtggaggaacaacttgccaggcacccaaagaaacctgttttgaaggttgaaaaggtactgtcgtccactggggattttgagctctagagtgtcagtttcctatcgttacgatatcaaggattagtgactggtgctgtttgcttcctcttatttcttcagtgctattcgatccaatctaaccgattagaaagatcagttatgcagccatcgtgccaataataaactgtgaaacctgaaagcttccttcttggccacatattgatcagtctatttttcttgtgcctgtggtttatttattcctactgcatagtcccagtctggatttgttctaaaagatatggatggtgtgcaaatgtgtttatgtatatagagaatgttggaccagtgaattgctattgtacttttctgttgctctcatgtattgtagtttcgtggtgtatcttgctacatccatgttctcttgtggttgtttgtgtgtcc

SEQ ID NO: 8309 - DNA, 713 bp, Zea mays
tttttttttttttttttttcttccctccttcttttcttggcatctggaatactccacatgcattgtaatatattattattagtaaagccacacatcttattcagtttatgtgcgtataaagcatacggatcgatgcatgcgtacgctgcattaggctaattaacgatcatgggcagcagcactgcgggagatgaagaccaggcggtttatagcagaaggcagttgcagcattgaagccattggattcgcagataccctggcacttcttttggaaacaaatgcctcccttaaccgcgatgcacgtcgtcgtcctcagttgctgcgcgagctctagggatccctcgtgctgatggccatcgtcgcccttcacatgcacttggaaggatggggacattgaagccatgatgaaaagaagaaccagcagagaagcgattatcaagtcggtgatgttggtcggacttttcttgaagagtagtgccatgaggaaacgagtattcttgctacttctatttcctttctgcgacgaccatcgatgggcactacctgggcttacagtgatatgtttttatgtaggctggggcttaggtatgcttcttctaagcatttatggatttttgcatgcaaaggttgtggtgtaatatggtcttattagatggcaaaataattagcagtggaagcacaaccattgccaatgtgttgcctgtctttgaatc

SEQ ID NO: 8310 - DNA, 1113 bp, Zea mays
aatcttatttcactgccagccctctgaaaaaaaaattaaaaaatgaggtcccagttccacccacctagagagccaaaagagccggcggtggccggcagccaaaacccacgttggattttgccgccgccgcctggagctaggggacaaggcaacgccggccggtgcaacatttatgcgtgtaccaggcagaccagcccggcagccacgcgtacacttctgccgcaaagctaaacgcgccactccgcggcaagctgctctgctgctcccaccagccaccgcaccgagtgccaatggcgactgcagcgagttcgacgccggcggcgcggcagcctactctggtctgcgcgtcactgaccgcgcgggtgccccgggagatggcagcggaggttgccgccgctgcggcgctcggtgccgacgtggcggagctccaggtcggctgcctcgacagcttcgagccatgcagggacctgcccgtgcttctcgcccagccccgctcgctccccgtcatcgtcacctacaggtttgcatcttcttctcggggacaccttcttggcgcattctgtgagcatttggttctggctggtttcagtacaattgaaaggggaatttgtttttttttctttgtagttttcagactgtgtttctattgtaccatcagcggaacaatatgtatttgctcagttaatctcgtatgaaaagaaatgtatttcttggttttgattgtgcaggccgaattgggagggaggccagtacgcaggcgaagatgagccacggtttgaggcgcttctactggcaatggagctgggagctgaatatgtcgatgtcgagttcaaggttggctccgtcctcactccttttaattaaatttcagactgtcacaattcaaaaggctagtttgcagggcaaagaatttgtccttattcatttgattttaggaccatttcgtgaggcttggcgaattcatagctttatgtgtgcagtactactgaattggatatctgagagttcagagttggagtacatttcgatgcagtttccttcttgtgcttaattacatgtttttgggacaagtgaatcacttttcaattgtcactattaccatgctgctctgca

SEQ ID NO: 8311 - DNA, 803 bp, Zea mays
  misc_feature (39)..(39): n is a, c, g, or t
  misc_feature (53)..(53): n is a, c, g, or t
agataccgagccgccgccggtaccgcgggcgcgagaagncggcgccggggtgnagtagtagtagtacatcccccccccatatgccccatgacgcagtagcccacgaacagcgcggcgaagcagccggccatgagccccgtgaagaaggtggcggcgtgcgagtccctgcgctgcgccggcctcaggtacttcatggccttgcgccggttgtcgccggcgaagtgccggacgaagatgtcctcgacctcgtccatcagcttcagcgcctcatcagagctgttgaagtaggaggtctcgaccaccttgagatatatggacaggacctccttcccggtgatcttctcgaacttcttcagaatcttcacgaatgccatcatgttcaggctccggtaggtggcgaggtagcccagccccttgtagagctcgacgaaggcgcgcttgatcatcttctccgcgtgccggagcttggtcttgctgacgctctgcttcccgtccgggatgcatttcttggaggaggaggagaagtggctaatggcgagctcgtcccacaggatgtccgtcagcgcggagatcgtcctggagggggtggtcagtgggatggtgatcttcaggctcttcctcccgcacccgctcaagggcggtctcaccgcgaaggttccggagccttctagatcctgctgctgctgctggtcctcctgagccgtgacgccggggccgtcggtcggcagcggcgtggcttgttcttcttgctcgctcagctgcagcgcgtccgtgtctgatgctgacgtcatcgcataccttgt

SEQ ID NO: 8312 - DNA, 733 bp, Zea mays
ttgggtacctcgaggccggccgggaactcacaccaccgcaccgcacaccgcagcccaagttctcctctgcatctgaaatatcttgccacctgacgcgacagcgacaagatccaagaactcgcgcgtcgccggcacggaccaagaactcgctcgcgcgcacggacagggccggaacccagggatcgagactgaacagcagtccgagacgccatgaacgtggaggaggaggtcgggaggctcaaggaggagatccataggctcggccagcagcagcccgatggctcttacaaggtcaagtttggcgtcctcttcaacgacgaccggtgtgcaaatatctttgaagcactagttggcaccttgagggccgccaagaagaggaagatcttgacctacgaaggcgagctgcttctgcaaggtgtccatgacaacgtggagataaccctgttgcccccacctgcagttgctgccgcttgaagcgaagagcaccaccaagttctcgattccatacaactcgtatgcttgtattctgccgtgcctatattagattctctcgaaccatttggtgttccttgaaaactgctatcgtgtgatgtatgaaattgtggtgctcaagaaattgccttgcttgcatatggttgtgttgcttaataaattcaatgctggtatagcattcgtgtcaagagacatgaaaaaaaaagccccccgttaacggccgcgggttattgacgtcttc

SEQ ID NO: 8313 - DNA, 594 bp, Zea mays
acaaccacacgcgcaccgcacaccgcagcccaagttctcctctgcatctgaaatatcttgccacctgacgcgacagaccaagatccaagaactcgctcgcgcgcacggacagggccggaacccagggatcgagactgaacagcagtccgagacgccatgaacgtggaggaggaggtcgggaggctcaaggaggagatccataggctcggccagcagcagcccgatggctcttacaaggtcaagtttggcgtcctcttcaacgacgaccggtgtgcaaatatctttgaagcactagttggcaccttgagggccgccaagaagaggaagatcttgacctacgaaggcgagctgcttctgcaaggtgtccatgacaacgtggagataaccctgttgcccccacctgcagttgctgccgcttgaagcgaagagcaccaccaagttctcgattccatacaactcgtatgcttgtattctgccgtgcctatattagattctctcgaaccatttggtgttccttggaaaactgctatcgtgtgatatatgaaattgtggtgctcaagaaaaaaaaaaaaaaaaaaggcccctagggccaaa

SEQ ID NO: 8314 - DNA, 647 bp, Zea mays
tcccagatcagacggttcacgtacgacggttggcaacaatcacaaccaccgcaccgcacaccgcagcccaagttctcctctgcatctgaaatatcttgccacctgacgcgacagcgacaagatccaagaactcgctcgcgcgcacggacagggccggaacccagggatcgagactgaacagcagtccgagacgccatgaacgtggaggaggaggtcgggaggctcaaggaggagatccataggctcggccagcagcagcccgatggctcttacaaggtcaagtttggcgtcctcttcaacgacgaccggtgtgcaaatatctttgaagcactagttggcaccttgagggccgccaagaagaggaagatcttgacctacgaaggcgagctgcttctgcaaggtgtccatgacaacgtggagataaccctgttgcccccacctgcagttgctgccgcttgaagcgaagagcaccaccaagttctcgattccatacaactcgtatgcttgtattctgccgtgcctatattagattctctcgaaccatttggtgttccttgaaaactgctatcgtgtgatatatgaaattgtggtgctcaagaaaaaaaaaaaaaaagaaaaaaaaaaaaaaaaaaaacggccggccccta

SEQ ID NO: 8315 - DNA, 2797 bp, Zea mays
  misc_feature (790)..(796): n is a, c, g, or t
tggcgcgctgggggactgggatggggaacacacggtggggaatgggcagtgggacgacgcaagagagtgtggatgacaacgctaaattattaatagagtagtataaatacaactctcggctgattggcaagcaactcaccggctgagtcagcttcaatctcacctgtgacctgtacactcccagatcagacggttcacgtaccacgcgcggcaacccgctcgaccaccgcaccgcacaccgcagcccaagttctcctctgcatctgaaatatcttgccacctgacgcgacagcgacaagatccaagaactcgctcgcgcgcacggacagggccggaacccagggatcgagactgaacagcagtccgagacgccatgaacgtggaggaggaggtcgggaggctcaaggaggagatccataggctcggccagcagcagcccgatggctcttacaaggtaccccttccatgctctaaactctcccctccggcctccggagccgccgcagatctgagccatccgcgtcgccgcatttccttttcctgtgctgtgctgccatctccaggatggcccgcgccagaattcctccccttctctcgatgcttagtgtgcaatgtgcagtatgatctgcacagaccagtctccggcatgaagctgcgatgggcgatcgagtcgagaagccgttgccgactcgacggactttgagagatcatcttgtggctgccgctgatgggtagtatttagcagggtctttctgaaatgggaagacatttattctagcagcctggtggnnnnnnnatgctcgaaacgatatctgcggtgcagatcccctaagctgtgcgcctctcgcagttacttagtcagccagtggacattgctgtgaggattggcgccgaaccgatgatattgcaactgaaagatgaccctttcagtcgtttgcattgtaggtagcattttgtgtcggttgtggtgggatgaccaccataagcttatgatttcgtagattatcccctattctatggaaccgatcgaatgcgaaaatcttttaaaaaagcatgaataaatggaaactctgtttaaattgacctacttgccccagttaaatgttggcctgtgtccatatatgtcatattcgtaatgaagatgtccaatgtcgttgtgggaagaagagtgcaaacagatcaacgacatcgagttctttcataccgcagatgtttgtgtcgttgaccactatggatcctgtttattcgagaatacagaatactctccaaactcagtagagttatcccatcttggttattttggttactggtctaatttttttcttgcttcaagtaccatggaattaatattccttatgtttaatcgtgtcttaccttctattgattttctgtgtatttttcctagttattggtttccatgtttgttgtgtcttaatcatgttgaggctccaaagtgcatatgatagcttagaagggcttgtcgctgtgattctccttcgattcatcttgaatgaattcaaggtctattatttttactatttaagatttggcttgttcttttcatgttttgtacgacaaatttgaacttcgcaaatccgaatcttggctcatttattagtccatcgccctatgtgatctttagcccctgattctagccaaaagtcgtcaacaatgaaaaggatgcaatggatacataaacagatgtagttcctgttcctggaaccatcactgtactgtgagcttttgtatcttaaatcgtgacactactttcatgggaggttgctagcctgctatgacctgcttagtgcagaccttgctttgctaaaagagtctcaccattcttagctgcacgtctgtatcctatagacaccactttctttaaagagtctacaagtgatgttgtaaatgttataacactatatcatatgatgttacagtgtaaaattatagtatacatgttatggattttattgtttctgcgctagacggctcaaggaggagatccataggctcggccagcagcagcccgatggctcttacaaggtcaagtttggcgttctcttcaacgacgatcggtgtgcaaatatctttgaagcactagttggcaccttgagggccgccaagaagaggaagatcttgacctacgaaggcgagctgcttctgcaaggtgtccatgacaacgtggagataaccctgttgcccccacctgcagttgctgccgcttgaagcgaagagcaacaccaagttctcgattccatacaactcgtatgcttgtattctgccgtgcctatattagattctctcgaaccatttggtgttccttgaaaactgctatcgtgtgatgtatgaaattgtggtgctcaagaaattgccttgcttgcatatggttgtgttgcttaataaattcaatgctggtatagcattcgtgtcatgagacatgaaaacagcagactggagttaatggccgcgggttattgacgtcttcaaaaaaaaatgattttcttcccaacaaaggctagtttggaaaccttaatttttcaattgatttctatttttccatgggaaaatgaactaatttccctaggaaaaataaaaatcccatgaaaaattggggttcccaaactagccctaagtttctttttagttccgtcactcttcccattttcctttatattttttttatggatcctcgtcgacatttacttccctcaccagcacctgttgtcaccctgatcaatacaggccaagttaacaagcagatttttaaaaaggggattttaaatccgtgcccgtagtt

SEQ ID NO: 8316 - DNA, 856 bp, Zea mays
  misc_feature (824)..(829): n is a, c, g, or t
  misc_feature (831)..(838): n is a, c, g, or t
ttgggaccctcgaccccgaggccggcccgcaccggctgagtcagcttcaatctcacctgtgacctgtacactcccagatcagacggttcacgtacgacggttggcaacactcacaaccaccgcaccgcacaccgcagcccaagttctcctctgcatctgaaatatcttgccacctgacgcgacagcgacaagatccaagaactcgctcgcgcgcacggacagggccggaacccagggatcgagactgaacagcagtccgagacgccatgaacgtggaggaggaggtcgggaggctcaaggaggagatccataggctcggccagcagcagcccgatggctcttacaaggtcaagtttggcgtcctcttcaacgacgaccggtgtgcaaatatctttgaagcactagttggcaccttgagggccgccaagaagaggaagatcttgacctacgaaggcgagctgcttctgcaaggtgtccatgacaacgtggagataaccctgttgcccccacctgcagttgctgccgcttgaagcgaagagcaccaccaagttctcgattccatacaactcgtatgcttgtattctgccgtgcctatattagattctctcgaaccatttggtgttccttgaaaactgctatcgtgtgatatatgaaattgtggtgctcaagaaattgccttgcttgcatatggttgtgttgcttaataaattcaatgctggtatagcattcgtgtcatgagacatgaaaacagcagactggagttaatggccgcgggttattgacgtcttccaaaaaaaaaaaaaaaaaagcgaaaaaagaccttnnnnnntnnnnnnnnaaaaaaaaaaggccccta

SEQ ID NO: 8317 - DNA, 1169 bp, Zea mays
gcacgagaccattacctagaacatccgccgcccgggatggaagggagacaggcgaatagaggacagctgagctgcagcatcccgtccaacagcaggaccagcgagggtgtacctccgcctcgcgagtcgggaccatgtggacgggcagcccgctgctccgggacgttggcgccgccgtgctcacgggagtgggcgcggctgccgtgctccgcttctgggaagagatcgccaaccgcgccctgctggaccagaaactctgcaggaaactggtgcacataactgtaggattagtgtttttccttatgtggcctttgttcagctcagatgatgtgtttgctccatctctcgctccgcttatcatcatcatcaacatcatgaaagtgacagtgattggacttggtttcgtgaaagctgaaggtgtggttaactccatgactaggcatggagaccgcagagaacttctcaagggcccgctgtattatgcctgtgctataactctgacaacaatagttttctggaggacatctcccatctcaatcgcggtgatctgcaatttgtgtgccggagacggtgttgctgacatagctgggagacgattcgggcatgttaagctccctcacaaccctgaaaaatcatatgccgggagcatcgcaatgttcttggcaggtttcatcgcatcagtactgttcatgtgctacttcaacattttcgggtttgttgagaagagctggaccatggttgctgcctttggtgtgatatccctggctgcagcagttgtggagtcactcccgatcagcacacgccttgacgacaatctgacggtttctgtcgcatcagtgctagttggcgcccttgttttctattccattggagccagaaacctgtgctgcatgagcagcgaagtcaggagaagtatcccagcaaccgttggaatggtgtttgcaggcagcagctgaaacatgtagccacagtccaggagcagagttgagcagaaagtgcagagaaaggagttcttcaatcctgatgtgtgtgtatcttgtactgtaaccattttcctgtctaagcagacattcttgtaactttattaagaaagaggtaaagcgagaataagttcattagggaaaacagaggatgtgctctcataagcaaatgcaaaaaaaaaagcggcc

SEQ ID NO: 8318 - DNA, 1763 bp, Zea mays
ccggccgggagcgattgggggtcccgaggccggccgggaccttccaccctcccccactttctcctccctcaccgagtcacaaagccaaaccctaattcacggccgccggagatgggacaaggttctcccggcgggatgggcaagcagcccggccttccgggcgaccgcaagcagggagacggcaagaaagagaagaaatatgaaccacccgctgccccttcccgtgtcggccggaagcagaagcggcagaagggctccgaggcggcggcgcggctccccgccgtggcgccgctctcaaagtgccgccttcgcctactcaagctcgaacgcgtcaaggactaccttctcatggaagaggagttcgttgccagccaggagcgcctgcgccccagcgaggataagacggaggaggaccgatccaaggtcgacgacctccgcggcactcccatgaacgtcggatcgctggaggagatcatcgacgagacccatgccatcgtctcctcgtccgtcggtcccgagtactacgtcgggatactttccttcgttgataaggaccagctcgagcctggatgtgccattctgatgcacaacaaggttctgtcagtggttggtattttgcaagacgaagttgatcctatggtttctgtgatgaaagttgaaaaggcacctttggagtcttatgctgacattggtggcttggatgctcaaattcaagaaatcaaagaagcagttgaacttcccttaacacatcctgagctatatgaggacattgggatcaggcctccgaagggagttatactatatggggaacctggaacagggaaaactctactcgcaaaggctgttgccaattctacttcagcaacgttcttgcgtgttgttgggagtgaattgatccaaaagtaccttggtgatggtcccaagcttgttagagaattgttcagggtggctgatgatctttctccttcaattgtctttattgatgagattgatgctgttgggacaaagaggtacgatgctcattctggtggcgagcgtgagattcagagaaccatgttggagttgttaaatcagctggatggttttgattcaagaggagatgttaaagttattctagcaacaaatcgtattgagagtcttgatccagccttgcttcgcccaggtcgaattgacagaaagattgaattccctttacctgatgtcaagactaggcggcgcatcttccagatacacacatcgaaaatgacactggctgatgatgtaaacctagaagagtttattatgtcaaaagatgagttttcaggtgctgacatcaaggccatttgtactgaagctggcttgcttgctttgagagagcggcggatgaaggtgacgcatgcagacttcaagaaggccaaagaaaaggttatgttcaagaagaaagaaggcgtgccggagggcttatatatgtgagactcatcagcagcgctattagtcttagtgagagaactggcgtttgtaatctgcttaaatggtccgaaaatgtttgcttacagcatttattttggttggaaacacacaactcaaacaaatagttatcctattatgagtacttggatatatgaaatggcagcgacgagtcaagatgatgttgaatgttggttgtctgtgcaggcgtggacatgtatgactagcatcctaggtttcaatcctaggttaatatgataattttatttttttatataaattgaagtctattaatggaaaaactcgagacctcgtgc

SEQ ID NO: 8319 - DNA, 1307 bp, Zea mays
ggacgtaggggtacctcgaggccggccagggattaatgggtggcttgtggctaaaactgttttttagaaccatccatgatggccaataatagctaccatttgggtccccgaggccggccgggaccccgcatctcctagccccagctagtagatcattggacacatatcgaaacagctctctagctagcgcgctcgtcgtctaacctggcttccggcatggcttccaagcagatcggagtcttgacctgcttcattgccatcaccgctctcgccttccgtccctgcgcatccgccgtgcccatggacggcggctggtcgaacggcggcgccacctggtacggccccgccaagggcgctggatccgacggtggtgcgtgtgggtaccagggtgccgtcgaccaacctccgttctcgtcaatgatcaccgccggcagccaatccatcttccaggacggcaagggctgcggcacctgctaccaggtgaagtgcaccggacacgagtcgtgctccggcagcccggtgacagtggtcatcaccgacctgtgccccgacgctacgtgccaggtggagcccgtccacttcgacctgagcgggacggcgttcggtgccatggcgaagcccggccaggccgacatgctccgaaacgccggccgcctacaagtccagtacactcgggtggcgtgcaactggaacggcttggacatcgccttcagggtggacgccggctcaaacgccaactacctggccatggccatcgagtacgagtccggggacggggacctgcgcgccgtggagctgaagcagagcggcgcggcggcgtgggcgcccatgcaacgctcctggggcgctgtgtggcagtacaagtccggctccaccaatctgcaggcccccctgtctgtccgcctcacctcgggctccggcagggtcctcgtcgccagcaacgtcatccccgccggatggcagcccggcagaacctaccgctccgtcgtcaacttcggaggaaaccatgcataacgagtggtattaagatgtcgatcgtctgcagatgtctccatccaacaataagatgcatgcatatatgatctgtgtggccagctagctgctagaccatctcactccctgagtctgctgatgctcagccaataatgaatcattccatctcgatcggaaattcaacatatataataatgcaagcaccggaaataaaattctactgtgttctgtgaaaaaaaaaaaaaaaaaaaaagcccaacaaaaatatacgcatgtcagtgctgtttgccaaaaaaaaaaaaaaaaaagcggcc

SEQ ID NO: 8320 - DNA, 1076 bp, Zea mays
cattgggaccctcgaggccggccgggaccccgcatctcctagccccagctagtagatcattggacacatatcgaaacagctctctagctagcgcgctcgtcgtctaacctggcttccggcatggcttccaagcagatcggagtcttgacctgcttcattgccatcaccgctctcgccttccgtccctgcgcatccgccgtgcccatggacggcggctggtcgaacggcggcgccacctggtacggccccgccaagggcgctggatccgacggtggtgcgtgtgggtaccagggtgccgtcgaccaacctccgttctcgtcaatgatcaccgccggcagccaatccatcttccaggacggcaagggctgcggcacctgctaccaggtgaagtgcaccggacacgagtcgtgctccggcagcccggtgacagtggtcatcaccgacctgtgccccgacgctacgtgccaggtggagcccgtccacttcgacctgagcgggacggcgttcggtgccatggcgaagcccggccaggccgacatgctccgaaacgccggccgcctacaagtccagtaacactcgggtggcgtgcaactggaacggcttggacatcgccttcagggtggacgccggctcaaacgccaactacctggccatggccatcgagtacaggtcccggggacggggacctggcgcgccgtggagctgaagaaagcgcgcccggccggcgtgggcgcccatgcaacgctccctggggcgcctgtgtggcagtacaagtccggctccaccaatctgcaggcccccctgtctgtccgcctcactcggggctccgggcagggttctcgtcgccagcaacgtcatccccgccggatggcagcccggcagaacctaccgctccgtggtcaacttcggaggaaaccatgcataacgagtgatattaaggatgtcgtgtgcaaatgtctccatccaccaataagatgcatgcatatatgatttgtgtggccagctacctggtagatcatctcccttcctgagtgtgctgatgctcagccaataatgaaccattccattttggtcgg

SEQ ID NO: 8321 - DNA, 1195 bp, Zea mays
  misc_feature (1144)..(1146): n is a, c, g, or t
  misc_feature (1148)..(1151): n is a, c, g, or t
  misc_feature (1173)..(1173): n is a, c, g, or t
tcgaggccggccgggcattggggccccgtggccggcgggaccccgcatcccctatccccagctagatattggacacatatcgaaacagctctagctagcgcgctcgtcgtctaacctggcttctggcatggcttccaagcagatcggagtcttgacctgcttcattgccatcaccgctctcgccttccgtccctgcgcatccgccgtgcccatggacggcggctggtcgaacggcggcgccacctggtacggccccgccaagggcgctggatccgacggtggtgcgtgtgggtaccagggtgccgtcgaccaacctccgttctcgtcaatgatcaccgccggcagccaatccatcttccaggacggcaagggctgcggcacctgctaccaggtgaagtgcaccggccacgagtcgtgctccggcagcccggtgacagtggtcatcaccgacctgtgccccggcgctgcgtgccaggtggagcccgtgcactttgacctgagcgggacggcgttcggtgccatggcgaagcccggccaggccgaccagctccggaacgccggccgcctacaagtccagtacactcgggtggcgtgcaactggaacggcttggacatcgccttcagggtggacgccggctcaaacgccaactacctggccatggccatcgagtacgagtccggggacggggacctgcgcgccgtggagctgaagcagagcggcgcggcggcgtgggcgcccatgcaacgctcctggggcgctgtgtggcagtacaagtccggctccaccaatctgcaggcccccctgtctgtccgcctcacctcgggctccggcagggtcctcgtcgccagcaacgtcatccccgccggatggcagcccggcagaacctaccgctccgtcgtcaacttcggaggaaaccatgcataacgagtgatattaaggatgtcgtgtgcagatgtctccatccaacaataagatgcatgcatatatgatctgtgtggccagctagctgctagaccaccatctcactccctgagtctgctgatgctcagccaataaagaatcattccatctcgatcgggaattcaacatatataataatgcaagcaccggaaataaaaatccaacgggggctctgggaccccnnnannnnaaaaaaaaaaaaaaaaaaaagnactctgcgttgttaccactgct

SEQ ID NO: 8322 - DNA, 1147 bp, Zea mays
  misc_feature (1048)..(1051): n is a, c, g, or t
  misc_feature (1115)..(1115): n is a, c, g, or t
ccggccgggaccccgcatctcctagccccagctagtagatcattggacacatatcgaaacagctctctagctagcgcgctcgtcgtctaacctggcttccggcatggcttccaagcagatcggagtcttgacctgcttcattgccatcaccgctctcgccttccgtcgaccaacctccgttctcgtcaatgatcaccgccggcagccaatccatcttccaggacggcaagggctgcggcacctgctaccaggtgaagtgcaccggacacgagtcgtgctccggcagcccggtgacagtggtcatcaccgacctgtgccccggcgctgcgtgccaggcggagcccgtccacttcgacctgagcgggacggcgttcggtgccatggcgaagcccggccaggccgaccagctccggaacgccggccgcctgcaagtccagtacattcgggtggcgtgcaactggaacggcttggacatcgccttcagggtggacgccggctcaaacgccaactacctggccatggccatcgagtacgagtccggggacggggacctgcgcgccgtggaactgaagcagagcggcgcggcagcagtggtaacaacgcagagtacgcggggggcgctgtgtggcagtacaagtccggctccaccaatctgcaggcccccctgtctgtccgcctcacctcgggctccggcagggtcctcgtcgccagcaacgtcatccccgccggatggcagcccggcagaacctaccgctccgtcgtcaacttcggaggaaaccatgcataacgagtgatattaaggatgtcgtgtgcagatgtctccatccaacaataagatgcatgcatatatgatctgtgtggccagctagctgctagaccaccatctcactccctgagtctgctgatgctcagccaataaagaatcattccatctagaaaaaaaaaaaaaaaaagaaaaaaaaaaaagtactctgcgttgttacaaaaaaaaaaaaaaaaaaaaaaaaaaaaaaaaaaaaaaaaaaaaaaaaaaaaaaaaaaaaaaaannnnttttgggttgttaccactggtttaagggggagattttgaaaatatcaataaaactgggggccgnttaagaatgtttctaaagggcctattttttct

SEQ ID NO: 8323 - DNA, 2125 bp, Zea mays
atattgtccgatccttagagaagtcgtgacaggtgaccaacacttcttatttaaaaaaaatggacctacataatcctcatcattgcttggaatgcacttgaaaaaaaagtttcgtgggctgggagtgatttgcgggccagagacggcctcccggcccaccctgagcctcccggcccgtctaaacggagggaacgcgaggccgtccgggagaaatcgtcggggttggggtttgggtgcttctctacggccgccgccagcaccgagttccggacctccgccgcctcgtctccgctccctcgcactcgcactcgcagctccggctgctattctgcagaagtcggtagattggttttcctcatgggtcgcaccatcaagaaggccaagaaggctcaatccaagaagtccaagaagaaaactgaatcgtcctcgtcgtccaaccctgcgattgcctctggtccggctaaggtctggcaaccgggtgtagatacactggaagatggggaggagctgcagtttgatcctcaggcttacaattatctccgaggttttggcattggctggtcttgcttgagttttgatgttgtgcgtgatcaacttggactcgtccgttcagagttccctcatacattctatggtgttgctggaacgcaggctgagaaagcttcatggaactatattggcgttttcaagctttctaacataagtggcaagaagcgggaacctataccagcttcagcagttgaagctgacactgatgtggatagtgacagcagcagcgatgaagaagatgaagagattaatgaggatacaaaacccatcctacatctaaaaaaggtggctcatgcggggtgtgtaaatcggatacgctcaatgactcaaaaaccacatataagtgctacgtggggagatactggtcatgttcaggtgtgggacttgagctcattccttaattctttagctgagtcagggacagctgcacccaaagaagacgacataatccacaaacacttacccctgaaagtatttagtggtcataaagatgagggatatgccattgattggagtccacttgttactggaagacttgtttctggcgactgcaataagtgcattcacctatgggagccgacttcaaacaactggaacgtagatgcaaacccatttgttggacactctgcaagtgttgaagatctacagtggagtcccacggaagccgacatatttgcctcatgttctgtggatggtacgatatcaatatgggatatacgtacagggaagaaaccttgtatttctgtcaaagctcatgaagccgatgtgaatgttatctcatggaacaagcttgctagctgcatgatagcttctgggtgcgatgatggcagtttctcagttcgtgatcttagatcaattgaggaggactcgttggtggcacattttgagtaccacaagaaagcaattacatctatcgagtggagtccacatgaagcatcatcattagctgtaacatctgaagatcatcaactaacaatctgggacctttcactggaaagagatgcggaggaggaggctgagttcagagcaaagatgaaggagcaggcaaacgcacctgaagatttgcccccacaacttctctttgctcatcagggccagagagacttgaaagaactgcactggcacccacagataccgtcgatgatcatatcaacggcaattgatggcttcaacgtgttgatgcctagcaacattgatacaaccattcctggcagcactgatgcagcaatgccatctgctgagccacagcactagccaacattgatacaagcattcctggcagccctgatgcaatgccatctgctgagccatagcactgatgtaggcgtttcttgtagcatggctcccagcttagaattccaggtctacgcagtggtgtatccgagtgcggttggcatttgtgttgagagtgctatgatgctatgtttgtgtttgagcatgatgggaaaggtttggttggctggcattccatgatatatgataagatttattaatatgtgcattctatgatatatgataagatttattaatatgttggcattctattaaaaaaaaaaaaaaaaaaccccccgccggg

SEQ ID NO: 8324 - DNA, 1894 bp, Zea mays
tgcaggttggaattctctagaaaaaggtgctctagaaaaaaaatcagacaatggatttgtgtgtccgtcatccgtttcaaatgtaggtcgggacatcttttctcattatctaaaaaatatttttagaaaacattctaatcttgtttttaggggaaaaaaatggtgcgactataattcctcattatgggctggaatgctctagaaaaaggtttcttgagccgggagtggtttgcaggccagaaacgtcctcccggcccacctgagccttctggcccgtcttaatggaggaaacgcgaagctttctgccgaaacagtggggtttgggcgcttgtccacggccgccgccaacaacgagttcctgacctccgccgtctcttccccgctccctcgcgctcgcaagtcgcagctccggccgccctattttgcagaattcggtagatttgtttccttcatgggtcgcaccatcaagaaggcctgcctagccattcccaagcggtctaagaaggtaccttacctgatagatagtgataggattattgctggagctctgattgctgctgtttcatgtttttcctgatctcttcagcatgttctttggctcaattcattcttctgtatttctgtgctgcagaaaactgaagcgtcttcatcgtccaatcatgcggttgcctctggtccggctaaggtctggcaaccgggtgtagatgcactggaagatggggaggagcttcagtttgatcctgaggcttataattatctccgaggttttggcattggctggtcttgcttgaggcggagaaagcttcattgaattatatcggtgttttcaagctttctaacataaatgggaaaaagcgggaacctataccagcttcagcagttgatggtgacactgatgtggatagtgacagcagcagtgatgaagaagatgaagaaattaacgaggatacaaagcccatcctacatctaaaaaaggtggctcatgcggggtgtgtaaatcggatacgctcaatgactcaaaagccacatatatgtgctacttggggagatacccgtcatgttcaggtgtgggacttgagctccttccttaattctttagcagagtcaggggcatctgcacccaaagaagacgatataatccacaaacacttacccatgaaagtttttagtggccataaagatgagggatatgccattgattggagtccacttgttactggaagacttgtttctggtgactgcaataagtgcattcacctatgggaaccgacttcaaataactggaacgtagatgcaaacccatttgttggacacactgctagtgttgaagatctacagtggagtcccacggaagccgacatatttgcctcgtgttctgtggatggtacgatatcaatatgggatgtacgtacagggaagaaaccttctatttctgtcaaagctcataaagcagatgtgaatgttatctcatggaacaggcttgctagctgcatgatagcttctgggtgcgacgatggcagtttctcagttcatgatcttagatcaattcaggactcgttggtagcacattttgagtaccacaagaaagcaattacatccatcgagtggagcccacacgaagcatcatcattagctgtaacatctgaagaccaccagctcacaatctgggacctttcattggaacgggacaccgaggaggaggctgagttcagagcgaagatgaaagagcaggcaaacgcccctgacgatttgccgcctcagcttctctttgctcatcagggtcagagagacttgaaagaagtgcactggcacccacagataccgtcgatgatcatatcgacggcaatcgatgtttaaacacaataaagttggaactggaggggggaaaggagtt

SEQ ID NO: 8325 - DNA, 949 bp, Zea mays
  misc_feature (845)..(845): n is a, c, g, or t
  misc_feature (860)..(860): n is a, c, g, or t
tgggtacctcgaggccggccgggcaaacagtggggtttgggcgcttgtccacggccgccgccaacaacgagttcctgacctccgccgtctcttccccgctccctcgcgctcgcaagtcgcagctccggccgccctattttgcagaattcggtagatttgtttccttcatgggtcgcaccatcaagaaggccaggaaagcgaaacccaagaagtctaagaagaaaactgaagcgtcttcatcgtccaatcatgcggttgcctctggtccggctaaggtctggcaaccgggtgtagatgcactggaagatggggaggagcttcagtttgatcctgaggcttataattatctccgaggttttggcattggctggtcttgcttgagttttgatgttgtgcgcgatcaacttggactcgtccgatcagagttccctcatacattatatggtgttgctgggacgcaggcggagaaagcttcattgaattatatcggtgttttcaagctttctaacataaatgggaaaaagcgggaacctataccagcttcagcagttgatggtgacactgatgtggatagtgacagcagcagtgatgaagaagatgaagaaattaacgaggatacaaagcccatcctacatctaaaaaaggtggctcatgcggggtgtgtaaatcgaatacgctcaatgactcaaaagccacatatatgtgctacttggggagatactggtcatgttcaggtgtgggacttgagctccttccttaattctttagcagagtcagggacatctgcacccaaagacagacgatatgatccacagacgatataatccacaaacctttacccatgnaaagtttttagtggncataaagatgagggatatgccattgattggagtccacttgttactggaagcactgttttctggtgactgcaataagtgcattcacctat

SEQ ID NO: 8326 - DNA, 631 bp, Zea mays
aatgccattcgagcagcatcgtcacccagagccaagctgcaagcagctagtagcggccggcagcatcgcgtagtagagtgtgctcagagcagcgcgcgcatgggacccttgggccccaccgtgagcttcagtatcatggtcatggccaagctcagcggcgccgcccagcagcagccggaggatgagagggagaggaaggagggcggcagtgggtgcggcttccggatgccgctgcactacccgcgctacaagaaggcggactacgaggccatgcccgagtggcgcgtcgactgcctgctccgcgagtacggcctccccgccgacggcgacctcgacagcaagcgccgcttcgccatgggcgccttcctctggcccgaccagcactgatctgatacaaccaaacaagctagcgcgctagcccagagcgcggcgtgccggccgtgaatagtctcgtcatgttcagagcatcagctgtagcgatcgagacctaaatcatcatcgtgcatatgctctcttctctcttgctatttataagttaccatctgcttgtagttgtatagtatagctaattattagctatggaataattaagagatgtttatgggaaaaaaaaaaaaaaaaagctatgatc

SEQ ID NO: 8327 - DNA, 4355 bp, Zea mays
gtttgaaagtaatggctcgcaggagttggaaccatctcgaattccggcgagcaattctgggaattccgaatcgaaactagggaaacgattttgagatttggaaagggatcaacgagagggttccgaccatatatattgctaggggttggaagatattttatttttcataataatcccgtttttaaaattacaataattccaaaaaaggatgaaatcgttttcaatgtccgaaaaatatctctgaggctccaaaaattctagaaaaaattctagacatgatttggaacccaatgaactcaaaagatatttagaacttttgagaaatgttttaagtacctcaaataaatagattttggttctcggaaaatagaaaaatattcagcaaaatatgaaaattcaccggaaacttctacaaggcatattaacatgtttcacacactttttacacttagaaactctgtgcagcagtatgaatgcagcaaacaaagaaccactagggctcactttactgtataacaaaataaatcttcattgttttagtaaaggaaaaagaaaaatgaagaaaggatcgagtaacacctgaattttgagtatagagataaaatatacctcaaattcaggatgtgtcacttattagccatcagttggtcgtgttcatccttacgtgtcgacccaaccattaataccgtgtgggtggtctttgcttttccgacagagttttagattctagagtgtgcctgtggagatatttcttcttttcgttaacagtcatagtagaaaaaaaaactcatgctggagtgaagcttgaaacggcgccaaatatccgtgaagggttggcacttctaaatttgctacaatataaattatacgagtatataattctagaacatcagatggagacagcaactgatatgttgtacgaaggaaacgggactgatcggtaagttgaactgattctggtaataagctgctctgttcagacttcagactgtggttcccctcttgggcatgtacgtacactgttacccttttgtgaacgtacggtactatgacgtgaaaaggatcgttttcgatgtgccaatgtaaaagcttctcccttgaagatatgatgatgtgtatccttttaaaattgatttggattgtagagatatgaccatttcggctagacaacaaaatcgaaatgaggagatacatagcaacgaaacgggtttgccgaaaggaggttcgccgtttggacggacgcccctggtttggcgtcgcccacagaccagaccacagcagtagcagcggcttgcccccagatacctcgcgctaccacagcacgtcacatcctttgtggaacagaaacgcttgcaacgcaagccattatggaatgcacgccgaactcatgcacccgcagcatcatcctagctaaccacatccccagaatactctgtttgattttttttaattccttttcctttttcacatgaatttagaggcacccacagattttatttcctttttttcatttccctgaagaatactggatctgtaaactttcactaacccagatagtacgaccgtcccttccgtgagaaaatacccaaccgtcgtaccaacatcctcctctgtcggcgatgaaagctaaaaccgccgcctctcacacactacacgaacacgactctcctataaaaagcacccgaggcgccgcgccgccagaccaggccactcaacagcatcactcaaagccaagcaacagcagcagcttccctagcaacaccttgcccctgagctcatgggatccctgggccccacagtgagcttgagcatcatggccaggccaggcggccagcagccggcggagatggagaggaagaaggacagcggtgtcttcttcggtgggggctgcggcttccggatgccgctgcactacccgcgctacaagaaggcggactacgagagcatgccggagtggcgcgtcgactgcctgctccgcgagtacggccttcccgccgacggcgacgtcgacagcaagcgccgcttcgccatgggcgccttcctctggcccgaccagtactgatccaaccaaacaaagctcagcgctagctagctgcgtgccggccgtgatctcgtcatatttagaggatcagctgcatcagttatagcgagacctaattgatcatctccatcgatcgtatacatgttaccatcgttctgcttgtagttgtagcggccggacatgctgcattctagtatatagctggatcgcgcgctgtatagtgtagtatgtctatgaaataaaagaaatgttgtttattttatcacaaaaaaaaaaaaaaaagcccccatctgttgtgttctgtccctctgttacttgtcacaagtcactactgttccatctccaaaacgctgatatgcatgcttcacaaacgtatcggggttccggaaagaattcaggcggataacctgggctagttaaaaccggccatggtttgcagatcctctcgtccggcagcacccacagactcgcgctcacgaagatagcctgcaaacccgcgctgaagtctctagcagcataacaagtgttgtgagttgtgacgcaaatccatgcaagcacctagtgcatgcccgccttatctagtctagtaaccgtagcacctcaaatctattctctaaaactatttgttttcaaacaaagtctttagaaagtgagacaaatattctcatgcataaaagtttaacccttttgctagtgtattcattcttagagcatgacttttgtttgttaaggtttggaaggatttgttttcatattctattgttatgaggatctcatttttcttttcttagaaatgactcaattattaatttttaagttgatattttatttatgtaagtattatttccaaaattattataaatttttctgaaatttcaaactacgtgtttatctctacaaagaaaataagagagaaaagataaggatttagaaaaaggaaagaaaaagaaaattccccctccctagctggcccgtggccgatttcggcccaagcagcccgtcagattgtgcccgctctttttttccttttcccctttctctgacaaccgagccccacccatcagtcgccctgtgcttcttccccggttgcccacgcttacctcgctcgacaccgcaccgtggcgccctcgccacggccgctcccatcgattcgttgctaattggggcaggcggagatctgcccttccctttcctctatgatccgatgctcttccccttcccttccgacttccgaggcgcatttctttcctctttcgagcgctatggatggaaggtcgtccggagcatcaatttaccggatgcgcagtgatttggagctcgatccttccccctttctcttctataaataccactcgagcctttgctatctatcgcacgcccgcacactccctcacgtgctccccagccctatgtccacagccgccattgcaactgcatcaccgcctctcgtggtcaggcgcctccggtgcctctccgaccacgctgagtccgccaccgaagtcttcggagcccgccattgcctacccaagctccctatgcctcgattccgcctcgagacgacgccccgacctcattggagttcagcagaccgtcattcccgtggcccgagtgctcccgtcatccccaacgaccagtgaacgcagctcgaggatccccatcacccacgcatccttgttcttcacttggattcgccactacgccgccataccacgcccccgaccttgtcggagttctcaaccgccgtcgcccacgcatccgaggtagacgaagcccgcctctctttcctgtccgtgcggctcgcggctcacgaagccatgcgcaagccaagccgcgtgatcgagtccgtcggatttagattgcgtgattaagatttagccgagtcggacaagttcttttcatcttagccctcggatcctgatcggacggtccgagatcgccaataccccttcacccgagctgccgaaggtttcttttaaaataacctcggatttttccgttttcgcgaataggtccttccacctgttaagatcctcaccgagaggtccctggtttttctataatgactattttatcctcaaagaagccctagttaggtccttgcagctttatttcttcatataatgactattttatcctcaaagaaattggttcttgttttatttactttctaaagtattgattaattactctaggacagttttatagaagttttataacctccaaaacgtgagttaattctaaattttttttgcatgtgtgctattagaagacactctcgtggtagaaaatcaggttcaattcgaagaggaatctc

SEQ ID NO: 8328 - DNA, 1663 bp, Zea mays
  misc_feature (1517)..(1517): n is a, c, g, or t
cgcttgcaacgcaagcaagccattgtgcgactgatcacgccgaagtcatgcagcctcctcagctcgctcgtccacgtgacgtcgtcgtcgtcccccaaaacactctacttaatttgagcaaacacgtactcaaccgtcgtaccaccaacatgctgctctctctcgccttccagaccagaccacgcctactacgcggcgtacacaaccggcctcgtatcgtataaagctaggcacctccacgccatgccattcgagcagcatcgtcaccaagagccaagcagctagctagtagcggccggcagcatcgcgtagtagagtgtgctagctcagagcagcgcgcagcttccaccctgcgcgcgcatatatgggacccttgggccccaccgtgagcttcagcatcatggtcatggccaagctcagcggcgccgcccagcagcagcccgaggatgagagggagaggaaggagggcgtcaggtgcggcggcgtcggcgggtgcggcttccggatgccgctgcactacccgcgctacaagaaggcggactacgaggccatgcccgagtggcgcgtcgactgcctgctccgcgagtacggcctccccgccgacggcgacctcgacagcaagcgccgcttcgccatgggcgccttcctctggcccgaccagtactgatctgatacaaccaaacaagctagctagctagcccaagcccagagcgcggcgtgccggccgtgaatagtctcgtcatgttcagagcatcagctgtagcgatcgagacctaaatcatcatcgtgcatatgccatatgctctcttgttatttataagttaccatctgcttgtagttgtatagtatagctaattattagctatggaataattaagagatgtttatgggatgatgaggtgtgttgtcgccgccctgtgcgaggctcacaaactctcagttgtgttggagccaagctggcatgcagaaatgtctcccggcctctaccctctttgtgcaactgttcaaacaggaaaaaacggtccagcagacgaccatacgtatgattaaaatagaaggagcgttaaaaccggccacggttttgcagattaactaaaagcaagtttaagccaacagttggccgcaagaatctttatagcctgactcttccaaacaagtgttttaatccacaaaacttgatcaaaagatgtgaattagggtttggaaactcatctagggtaaccataacaaacactttgacaaaaccccagcgatccactccttccttaccttctccaactcacagcaattctcactacactacaactctcatgttgtttcaatctaaacaaaatggatagatgttagctatcacaattagcgaatgtacccagaaattgatgacaaaactgagagaatagatgattcgtaactagttttgcaagagaaatgggcatggctgatgatagcggcaagccctagtcgctcactcttttcttattcttcttcttcttctctcaccctattttcttctttcnatgtatagacagaggaccgctagggttgtgcagggatggcacacatgcagaggtttagtttgtgtttggttggacgtataaggagggatggaagggagtgaccacattttctatagtgtttgaatgagaatcacgcggggacgagg

SEQ ID NO: 8329 - DNA, 753 bp, Zea mays
attgggtagcgcccggccgggccggcactcccacaagaaacacagaaacgacatatattattaagcatgggttccctaggctcaagcaccattagcagcatgaacatggcgaagcaggcagccaccaccgttggtgctaagaacggcgctgttgctgtcgccgatcagcagaaagtagagggccccaggacgataatgaactgcagtagctacaccttccacatgccgctgcactacccgcggtacaagaaggctgactacgagagcatgccggagtggcgcgtcgactgcctgctccgcgagtacggcctccccgtcgacggcgaactcgacagcaagcgaaagttcgccatgggcgccttcctctggcccgaccagtactgaaggaacccgtggcccgagctgaggctgctgagcctgagctaacaagagatgaagcaactgcagtagccggagctaacaagagatgatgcgccactgctgctgcctccggcgaccagagttacatccctgacgtaggcaagtgtgaggagtgtggagaagaatcatatatttatgtgtagtgttgatacattatgattctacgtactcgcctcgatcttgcttctgcttttctctacaataatatataatccattcatgcaaccaggatcgataattgcatgccgttgtaccaatatatgaactaataataatactaataataatatcggttcgcaacgaacaaataaaaaaaaaaggcccctagcgggc

SEQ ID NO: 8330 - DNA, 8097 bp, Zea mays
ctaatctaattggttgaggtactgtttggaacttaagtatttaactaatctgatttaggcgtcgttcgtttcggccggaacggcctattcctagcctctttccgtgcgggatgaatcaacccggcttagaatccggcccagtctgttagagtcgttcgttttaatctggactagaaacagacccacctgatttgaattcctttcgttcaattctttgtctggaacgagtcctggtgagctacctcccggattggttcctggactaatgaccaggaattagtgacaacacatgtatcacttctcctgtgctgctttcgatcccgtattatcaaccgatggtttttgttttggtcccgactaaaaaatatgaaaaccatccctacttgtgagcatgacccaaaaaatctgtactttctcctttcatcaatccaaccagttgcggaaacgcgtgacgtcactgattacacgaacggggaaaatcgtagggttatctgggccaaacattcctgaggttagcagttcacccgtcatgtctctaggactgcagcagcagcaccctggtttccaacaacttaacagccacgtgtcgcctcctagaccgtccgatcggtgtcgttccagaacaatccgcctccgaatcaacggcgggctctgacaggtgacagccgctcgcgccgtgagccgcttacccccattgggtacctcgaggccggccgggctgacctttttctctctccccgtctgcctcgccctccacaccaggccacgccacacacaggatagcgagcgggagcgacggcggcggcggaggagctagggttttgatccggcctcgccggctaggctgcgccgccccgacgccgaagccatggacagggagcttctagagacgtttgacgcggccaagaaggcggccgacgcggcggcaggggacggcaactcgccggaggctggccgctgcctcgacgcgctgcggcggctgcgcgacattcgcgtcaacaccgacatcctcgtctcgacgcaggttggcaaacgccttcgaccccttactaagcatcctcactcaggcattcaagcagttgctgcagacctttttgggtactggaaaaaggttgtccttgaagagtcaggaaagaaaaatggcggctcagagaatgaaagatcaagtgactcttcaggaaaggttgagaaggtgaggcccgtgaagattgaaaagaactctgcatcagcaagcatgaagcttgagaaaagagatgtggatgttaggggtcagaagcctaacaatgtcaaagttgagaagactactagtaatggttccaaagctcaatctgtgaaggtggaaagggtatccaaagaagtcataaggactcctgacgcgaagaggccagcatccgtccccaatggccacccaaagcttacatctcttgtcaaatgcaatgatcctacccgagataaaatccgggaactacttgctgaagcctttgtaagggtttccagagagactagtgatgatgacagagacgaagtgagaaacatcttggatgaagtcgaggcatgcgacccatacagggttgccgtgacagtagagtctgcactattcgagaggcttggaccttccactgggactcacagggcgaaatacaggtcaatcatgttcaacctgagggctgaaaacaataccgatttccggaggagggtcctcatcggtctagtggcgccggagaggcttccagacataccccctgatgagatggctagcgacgcaaggaagcaagagaacatgcagatcaaggagaaggctctgttcgactgcgagcgtggagcggcaccaaaggcgacgacggaccagttcaagtgtgccagatgtgggcagcggaagacgacttactaccagctgcagactcggagtgctgatgaaccgatgacgacgttcgtcacatgcgtgaactgcaacaatcactggaagttctgctgagtgttcagccttgctaaagtgtttacttagttgtgctgagcacactatcctgctgtgatgtgtgtgctctgttagttgtgactggaagttcgacagggcaggctgaacaactcaccttttttccccttttttaccccccgtaaactaggagcagttatcctcttcctctgtcaggcagcctcctgattcattcagattgtactagtcgaacgcgtgaatgttgttgacttgatcgcatcgtcaccagatgtgaatgttcttgggtggagttagaatagaatggtgccaagtcagacgatgctgatggattagtggtgctgtgtgctcaaaaaatgtttccattgtctggatgaagatcgagatctatatcagatgatgcgctgtcccatttcggactatctgctctaggattgtttgcctgcaaaaaaaaagggttgactcactggtttgcgcaccacggtggatcaagaactcgggagaggggtcaagctaggccaacatgccctaaaactttgcagtgccttctagtctaggccagcacgaggcttcgtcaggcaaaggacgtcgccacgtcggaaacgttgcatgctaacgtgttcactgccgtctgcctaacctgccttgtaggtaacgaagacccaaacctgctagggtcgctcttgatgtaatctgatggaccgtactaaggttttgtcgacagaatatatagggcggataattttttttccccacacaacggtacgtgtaatataattgtcggctactcgtcatatataggaagtctcagttaatgaatccattagcaaattgatggcgacgtttgttttgttggcaggggacccgaccttgaccttgttaatgattttagccggactttcgaatttgcaaccctcctcaccccgtttccaaaagtccgcgccgggtcccatcggtggcaaagcatggtaacgctaggccggccaggccagccgccgacgccacaaactcggcgaagacgacgacgacggctccagcgtggtctgccgatgcggtgcgcgcggacgacatactcacgtaccaccaggccacgccgtctgccgagagcgacagggaggacgcccacccaagtgggggaaggtggcagcacagcacagcgctgatctctcgccctcataccaaaaaatacacggggaactgtttgttcattggctgttgttactttggtctatgcatttgcgcttcagacagtagaaaggaaactaatcttgcactaaaggaaatcacaaggaaggaaaccaatcaatcataatttttccaataacctttcgatccatgataaatgctgatacgatacacatgtgtattaacagtaacatatgcacgcatgtttcctgcctgacactgtcatcgtcctccgcagccactactccgctccccgatgcagggccacatgctccaggcgttgtgcatccccgccgtgattgtctttgcgagcgccctggtgctggtggccgcggtgttgtgcgccgtcgcggtgcgggcgctgcggcgggcggcggcgcgggagatggcgctgaacgtcgaccttggcccggcagcaaggaggcgctgcggcaggcagagcgcaagagcatgaataagagcaatgcctttgccagcgctagccacgacatccggtccgcgctgtccgccatcgccgggctcgtggacatgtcccgtcaggaggcgcagtcgctccccgccgtcatggaaaacctcgatcagatgggtgtctgcaccaacaagttgttcggttagtccaccaccatagactcttattatggagttaattaataatttccatcaagctttgctcgtcgtcatctagctagtaaagtaggaatattgctgtgactaatatgatgtttctagtgttacatatggtctaccagttaatactaagaaaaaatgtaggatctgtcatctaccgtattttctcagctacaataggaaggattaatgttgctaatatagttcatcaattaaaacattctatagtaggaaaggtgccagctacagattatctaaccaaacagggctagctgttgtatattatttgcagaaagaacaaaattagtaggttatgttgatggatatgctcgatttgttttccgcagatatcctgaactcaattctagacacaagcaaggtggagtcggggaagatgcagctagaggaagccgagttcagcatggcagacgtcctgcaggagtcggtggacatggcctacgtgacaggcgtccggcggggagtcgaggtggtctgggacccctgcgacttctcagtcctgagatgcgcggctgtcctcggggacagcaagcgcctcaagcagatcctagacaacctactcggcaacgccctcaagttcaccgatgaaggtcacgtcgtccttcggagctgggcgacccgaccgatcaccgggagcaatgtcagagctccgtcaaggtttgtgcacccacggcacggcggcggcggcttcttgggatgcttgttcagggcaaggaagcgtcctggtgaccaggatcatgtgcagaatgaccccaatttggttgagttttactttgaagtggtcgacactggcattgggatcccccaggagaagaagatgtccgtgttcgagaactatgttcaggtgaacaatggccaaggcggcacgggcttggggctcggaatcgtgcaatcctttgtaagttaccactcaaatatatgtactatgagtatgtacatatatgtatctcctgttcattttttcgatgatctatgttgatcttgatcgcaggtacgtctgatgggaggagagattagcatcaaggacaaagagcccggagaaaggggaacatgcttcgcgttcaacgtgctcctgaggataagcgaggtgcaacagcctcaagacatagaagaaggaccgtcggttccattaggcaccctgaaccgctccatttccatagcctcagcgtttcaagaagccagcaacttcaagggcgtgcactgcgttctctacgttcatgggtatgaaaccaggaggatcctgcagacgtggatggagagcatcgaggtcaaggtctggctggttccgcaagccgagttcatcggttccaccttggagaaggtgcagagcaatagcacggccaccgctaccgcggaatgcggcagcgccgaccggtgcttcagctccaaggagatggtgaacctgttgaggaacaactctagtcctaggagagccatcctcggggggattccttccggtatccttgttgtcatcgacgtgtccggtggtgaaacggaagaaatttgccaggagatggccaagcttgccaggatcaagcatcaagccccatgcaaagttgttctgctcgaggatatcaagaccccttccaatgatctgaggaggctcaaggacatgggctgcgatctcgttctgcgaaagccagtgcacgggtctcgccagttcactctccttatgaccctgagagacctccaagttttagatgcacaggcacagtcttcccatcttggccctgagattgctgggaacagccagcaacaagatttgccggatgttgttgttccttgcgtggaagacactgccgcatcaactgaagcttcatgcttggctcagaagcctggagatgataagccgctagccgggatgcgaatcttgctggctgaagacaatctagtgctgcaatcaatccaaaggaaaatcatgaaccagcttggagcatttgtcacggtagctcaaaatggagctatggctgtgaacttgctcagagaagctcttgagcaagccaatgcttcagaagaggatatagtgtccttgccctaccatgtcatcttcatggattgccaggtttgttcaaccaaaacttttttacctctgcatgtgcaaagctccgtctgatgattgcctgacacctgtagtattccttgtttgtttttagatgcccggtatggatggctatgaagcgacgaaactcatccgcgaggaagaacaacgctacggaattcatgctccgatcatcgctttgaccgcgcacgacatggaggaggatctgcaggcggccatcgatgctgggatggatcttcacctggcaaaaccaatatcgcggaagaagatagtggacgctgttcgcagtttctgcaaatgtgagaattgacaaagcgtttctgcgtcgggtgaagaactctcaggaaaccagtggtttcattgactaggatggcgatgatcagagctcacaacatccatctggtcattatatagttagctctggttcaggaagctctcttgttttctgttgtctgtggcctgcggggctgtcactttggcctgcactgaagtgtatcagatatctgttttatataaacatctcttcaagtttctggtctcgtatgtatttgcgcttcaggaaatgctggccagttgatctgagtgcctacattcttatgataatatatgctctggtattatctacagttcagtacttcggcacttgaaaatgacgccgattgatcttgagtgccacctatagcttacattcttctgtctatgtacattgttcgagataggttttatttataacctaattgacattattctgcacagctttgtatgccacagttctttgctcgagttaccttgaatgtatgcacagacgaccttcctgggccctgtccatagagtgactctgaattccgttttctcagcagacaagcttcaggccagctgaacacagtacagtttggctgcagatgggcattacaaaaatctctattattaaaaccccatggggtttgagctcctccccacgtttcacggagatttgcccttagctggtgccgacgcgtggctatgggaaaaagccaacactgccgctgacagtacagagaacagcgtacatagcacagttctctgtcctcgtcttttttcagtttctctttcttcgtcccgtcaggaatgccctccttcctctgagatctcggagtcgccctcctcttgcccaagcccagaccgatcgaggaccagccctgcatccagatctatgttttttgtgcccctccacgtgatccctgctggcggaggtagcaccgtgtgggagaatgacgcccccccacttcggcaatatggtcgcacggtcgcacccgtggtggcctggccacatctacaaagtcaggctcaccgtctcatcgatgacgatgaggtacaccgcggctaccgcgacgggttcatcctggtcgtcttcttcggcgacaagagcacgggtggttcgagcccggcgagctcgtccccttcgaggaccgcttcaccgagaaggcagcccacgccgaggccgtcgacaaggtagccccccccccccccgccgcatcgcgttggcgctgctctgccagtgtagcaaccctaacgcctcccgcccccaccccagcgacgtcattttcttccttgtcaatctcccggcattcgacaccaacgttgactaccaccgccaccagacccaggccgcgcggcaacgatttgtgcgcagaaggagctcgactaagtgcttaacgctgccatggctgatggctcaacgggacgcggcggaaaaggctgcacacaccgtgccagggatggagatgaccacgttgttctcagcgtaccgtcgcgcagtgttttcgcccatagaccacctacgcccaagcgttgggacttcggggtggatcccgagcttccgcttgctacggactagagagccacggcggcagagcgagctcaacaaggtatcaacactaattggtatagcagtaatttgttcatgtttgcataacatcatccctactaagttttgctaatgactttcctgaacactttttattcaactgtaagaaacaaaggcatatgagctacatgcatcctgtatgagtaccatgtttcattagatgaagcagtattcctttaacttttagctaaagtatatgtgttctgtttaccatgttttgttctctcaaaccaggatgttagcattcagactattccagtcagaaagttatttcatgcattaccgaatgaaaccatgaattctgtagtatttagtgggtatataatgtattattgaattgattttgaagac

SEQ ID NO: 8331 - DNA, 2039 bp, Zea mays
gcctggccgggaaaaaaaaaaaaaaaaaaaaaaaaaaaaaaaaaaaaaaaaaaaaaaagtactctcgacgcctgccttgtttctctttcctcctgcctcctgcaagccacgcgacgccacacacaggatagcagggacggcggcgcggagctagggttttgatccgccacgccggctaggctgcaccatcccgacgaagccatggagagggagctactggagacgttcgatgcggccaagaaggcggccgacgctacggcaggacagggcgactcgccggaggctggccgctgcctcgacgcgctgcaccggctgcgcgacatacgcgtcaacaccgacatcctcgtctccacgcaggttggcaaacgtcttcgacctcttactaagcaccctcactcgggcattcaggcagtcgcatcagacctttttgggtactggaaaaaggttgtccttgaagagacaggaaagaaaaatgggagctcagagaatgaaaaatcaatggactcttcaggaaaggttgagaaggtgaggcccatgaaggttgaaaagaattctgcatcagcaagcatgaaggttgagaaaagagatgtggatgataggggtcagaagcctgacaatgtcaaagttgagaagaccgctagtaatggttccagaactcaatctgtgaaggtagaaagggtatccaaagaagtcaacagaactgatgcaaagaagccagcatctgtccccaatggtcccccaaagcttacatctcttgtcaaatgcaatgatcctacccgagataaaatccgggaactccttgctgaagcctttgcaaaggttcccagagagactagtaatgatgaccgagatgaagtgagaaacatcttggatgaagttgatgcatgcgacccattcagagttgctgtgacagtagagtctgcactatttgagaggtttgggcgttccactggggcccacaaggcaaaatacaggtcaatcatgttcaacctgagggctgaaaacaacactgattttcggagaagggttctcattggtcaagtgaccccagagaggcttccagacatatcccctgatgagatggctagtgatgcaaggaagcaagagaatttgcagatcaaggagaaggctctgtttgactgtgagcggggagcagcaccaaaggcaacaacggatcagttcaaatgtggcagatgtggacagcggaagacaacttactatcagctgcagactcggagtgctgatgaaccaatgacgacattcgtcacatgtgtgaactgcaacaatcactggaagttctgctgaatggcagcctgctaaaatgtttgtttagttgcgctgagcacccagctgtaatttgtgctctgttagttagctctgcgactcaaagttcaacagggcaggcggaactcagttttttttcctaaactaggagccgttatactcttcctctgttagtcgctctttgtgattctgattcattcagattgtactacttgaacgcataaatgttgtaaacttgatcatatcatcaccagctgtaccttaagttttggatggctatgtggttcattgtaaatgtgattgtttggttgttttacagttgtgttcatgtttgctactctgatggtgttttgctctcctgtggcttcctcgggctcggatggtgatttatatcagatgatgctgtggtgccctgccccatttctatgcatcatgaagcttgatgctcatgtttgctactctgctctgggattgtttgcttgcataaaaaaaaatgtgctgcgttagactaatctgctctgagattatttgcttgcacaaaaaattgcgttgggtcggactactctgctctaggattgttttcttgcaaaaaaaaaagtgttgggttggaacgataatatacgtagtcggaagaagtcagcatcctcttcatttggtaccggtttctactatttttatatcatgtgtttggttgcccgtatatgaagactcttcatatgaattgactatggctcgtcccgtgtttgatccgctgt

SEQ ID NO: 8332 - DNA, 494 bp, Zea mays
gttaagaatttaaactctcttaatctcatccaatctatatatggattgggataaaaaccaataggccgttttgtggtgggtgatccatatcaccaaagatagggtcacgtgctcttatcattacagtgaacatgcatgatacatatgcatgcgatgaaacgaaacggattcagcgacggattagattaatccgttgctgctcttgggtggtacgaagagggtcgcagatcgtgcacatgcatgctccatcctcgcacttgccgtctatgcccttgattttggcgcatatcaccgggcacgcgtcgccaggggtgcaccgcatgccgctgtggctgaggttaattctgatacaacctgctgtggcgcttgtcaccaggagaaagatggtcaggagcatcagggtagggttagcgtccgccatggctagctagctcactcgtatcaccaacaggacaagaagttgtggtggtggttgtgccgattatgaagggggc

SEQ ID NO: 8333 - DNA, 7309 bp, Zea mays
  misc_feature (88)..(88): n is a, c, g, or t
  misc_feature (4327)..(4327): n is a, c, g, or t
  misc_feature (7234)..(7234): n is a, c, g, or t
gataccgtcttagtagaatagacttcatgatgatgtgctttcagtttctggcctattggccttctgagaatctcattgatgaactatngcagtttgtgaacttcactggtattatgtcaacaagtaaggatatgtcaaagaaggaggctgcatttgcccttgcagctcttatggaaataccttctcagtataaagcaacgcaaggcctccgacctccagagtaccagttcttactcagttatttgtggtcctgaattagtttcttggcattactgccatttcttttttccatttgctgatcttgtatgtattgtcttatctgaactaatctcacagaaagcaagcacaaaggattggctctcctaggattcttcctcctccaaataaagttcttgaaaatgataatgccgccgccgctgcttcgcaccctcctcaaactgcaagctcgaaatcaactggtattggcaaaagtgctgctgacgagcaggtactttgggccagttactcttcattacatttctcaagagtgatggcacattcaagtattaaactgtatctttgccacctacaggtatgccccatatgtctaaccaatccaaaggacatggcttttcagtgtggtcatctggtaagttttcctacacgcataagatctccatacactgagtttttttttccaaagtttgaaagtgtgaaatggtaaatgatcgcctaatatgataatatctattgttaatgaactctcccaaacgaactaattacctgaaatttgagtactatgattaacctttaagctttaaagttaaggaaaatcaatcgattcctttgtttggatgagttattgacaaacttcccctggcttttcagtgtggtcatctgacatgtaaggactgtggcccaacactatcaacgtgcccattgtgccgcgctctaatcaccatgcgtgtgaggctctactcctaagtcggttggtgtctggagggatgggaccaaacagaaaggagcaagaactttggggcgcaaggactgcgctacgatcttgagatatggtccatatggatgtcatgataacgatgcatgtacagaaaccttgtccgtgcctattcagtaatgtcgttgatgagtatcttccatcaatcacatgtaaaatttctaatgttatcttgtattagtagcaggggattgcttgttgagtggaataccaccagttgttcagcaacagatagtaaactccatgtgcatttggaagtcacttttgtgatttgtgtccaaccattggttcctgatagacagtttacccaaaaccgggttctttctgtctttcaccgaactgttggtctggaatttggagccacaaattcaatcgcggcaatatatatttaggcccagttcggttgcctgggaaggcttccaggccaggaaacagtggaccactcaatccagcccaagatttgatctagatggtaagggatcgggattcctaccgggctatggaggaaggggaactttaaaccgggccgtttttgtttttatttcgggttgaaacgaaaatctcagggctggattccaaactggataatttttccagccggtaagaggcatagagcggccggatgaggccgaaatggacgagaccttatgtgttgacgccaaacaggttacatgggtagtgtatcactggtcttgcattgtttgttttcaaacgagcaagcaagcaagccagagtgtgtaagcagggtttaaatgtaagcgtgtaagtaagcgccttctggtctctcggtccccctgtgaatgtaatcgtactttgatagggttatttatgaagttgcatgagatgatggtgtaagggttcaaatgctaaatacgatataatacggttggatcatatgatctaactgactagaagacttgattgcacgattgcacctaaggtctgcttgcagtctacacctctacacgaagcataagagacagtagtgttatgagaaattgatgtattaacttgttgagggtcaaaatgttcctttaggtatcctttagcgttcttgtgatcaaaaagagatatatgaattgtaatgatacttctaaactttgaaattcgtaatgattcccagacactgttaggttaacaggccgtgtaacattttgggccaggacatataataaaactcagtagattgaagggtaacaaagaagggaaacagaaccattctcccccgcatacctctgcctgcgccctgcgagtcttccctcgcttccattcctcattctgttctccgagagatctcgttctccgatgatcgccggttcttcgccgccggtcatcacatcccacctcggcagttcccagttcccaccaccagatcgccacgatgcaaccggagccacctacgccatccggaggcacgacgcccctccgcccgcgcgccgacatcacgaagggcctccctcgccacgacgccgtgctgtactgcccgtcgtgctgggcctaccgccaacccccggcgtcctgggtccgccgcgagccgcggtcctggatgagcactacgccgggtacggctaacgacgtagtaagaatccacctcgaccgcgtgcgccgccacatcgccggcctcggtctcacgatcgccgccgcgaggtccttctccaccacggcctgccccaggcgcttctacctacacctccgccttcgccgcgggcacgaggcgggaacggagccgcaggcgcacgtcgtcgagctcacctcgcacgaccgcctctgtgacgcctgcagccggtcccaggccgacccggaccgatggcccgccgtcgtgcaggtgcgccagcgcgcgtcaacgtcgtcgtcgtgccgccgcacgctcaaccacgtcatgtcgctgctcgtctgctaccgcggcaacgactcgctcctccgcgtggactgggacgcgggcgccggggtcctcgacgtgcacgtcgtgtcgcgcgcccacgccgcccgcttcgtccgcttcgtctcgaccgtcgcgcccgcccgcgtcgtcggcacggcgcggaggctcgtctcgcgcgacggcgagggcagcccctacagattgcacttcatctccgtggacatctgcccggtctgcgaggatgacctcgtcctcctgcacgcggaggcgtcccgcgccctcggccgcctggggcccctcgtcctgtgcatcaaggtcaccagctcgctcgcgctgctcgacaccggcaacatgcgcgtcgtggtggtaggcgtcgaggcgtgcgagcggttcaggatccagcccttgctcgaccgcggccgcctcgtcgagtacgtcgtgcttggcgtgcaacacgacccgtccggccacgtcgcggcgctcggtgcgagcttcatgatgtcgtgggcgcaggtcgtccgctcgtcggacgtgggcaagaaggacgccgccgtcatcaccgtgaagacgcacctcggctacgacctggagcctgggtgccacgcgctcggctacgacctctccggagacgacgtcttcggccatggcttggagaagtatgggaagagacacacgttgccagctgcggtgcttactcggaggtactacgacgatgacgaggactgggaggagagcgcaggcgggatgcaggacggcagggagggacgtcgcggcggcggcgggattgaagaggttaccacgggtattggatgcatggacctgaacccggccgacgacaagaacaccacagtaccatgacaccattccatcggctatgagtagcgagtaagcgacaagtgtttcatgtagtaccaccaacattaatccacggctgttgttgactcttattctaatgaatcataagccatgcattagatgactctagtcataccttagtctaaaaatctatcactggagttatacatgtagcagtgctcatgagtagatagcgagttgcaattttgttgcttctgataattcatcaattcttggctacagtagttcagtgtatgcctgctctcatttttatctgttatctcatatgcgtgtcttttgaatgcttgtccagttcagagatgctgtaagcatctttctcagatgattacatttttagagggtaagttacctctaagagtcaaattttcattatggtatttagagaagggaaacattttgaccaaggatgatttgatttaggggtcgtttggatctgttaattttgaaggaattagtatgctatttagtttggaatttgatattccattactttccaaagtttagatacaaatctatccccaatttatagtatgtggatggaaaatgattttatatatcactagtctatgttcctagantaacttataacatgctcttcagttcgccctcctatagttgaaatgtagcatatagatatgtcttccatatgaataacagtaatatacaaatatattctgtataaaatcataatagcttgattgatctatgtctaaattacgattattagaatagaatttaattctaaggatccaaacggatacatagttgcaataagggctagtttgggaactaaaataccagaggtgattggaggagctaaaatcctcttcttattcaaaattgaatgagaagggcattttggctcccttcaattcccaccggttttgtggctcgcaaactagccctaagtattgttttttagctccgaggagatcgttaagcagcaatgtttttatcatttttcagcatttaacctccaactagtgttgctaactcgtttggttctttggctggcgagtttctcttcagtgctaataagacagattttaattggcatcacagttttgtgctgggaaatttggttatatagaaatggtgtcgtattcgaagggaccgcgctactcacgttgttggtggttattttcagagggacatattaatagagttcttcaacaagtttgggtggtgttctaaaaatcggattgattgctgatttttatgtttttgcttagtatggtgtctcaacgagttgtgccaccgtgtggtggaacatgctgtaagtttcatggattttgtgatatactcaattactcattccattaatgaatgttagagggcagaatatttatattccttaatctaaaaagtaaaaataggttgcgaccaacttgttttacaataactcaaacttttacatgtgtattttatctgccatggagggggaaaatgctccctcagaacttgaacaactgacttaagccttctgcttttgcgcatgattcatctttctcgtaactttactagtagcaaatctattctagattcctcaaacttaagcaaggcatgcacttacacgtgtatgaaaaaaagaatacattggaagactaaaagatgagacaaatttattatatttaatgaagtctatatttcatactcctaattgatattcaaatgttcgatgtgacatgaactaaactttagtttagggtaatcaaacacccccttagttcagcatacatttagttttaggaggaacgaggtaatagtctgaaactgcacagtgatgcactgctgctagtagtctagcacccgtgcttgttccagatttcagatactacctaatacagatcattctaggtttttttttcagcagttttctaaggaagctaagtatatttgaccacatacaccagcaccacagtggattccacgagcttctgtgctctgcgcatttgcaaccaccagtccgaagacgctatcgccgagctgggatcagcaagttcggcaaaagaattgtacaagcccatgggtccttttctccctccctatatgtttcttagaaatcacaacagattagcgagtgcagctattaattttgccattagacaagtgctggagccttgaggtcgtaagggtgggttagagctaacccaagctagcccaactaatacatgaataatgaaacactccatgaattagtagcccttcctattgtaggagaatggaactcttgattgatattgcatagaggtggtggttacatatatatagacacaaaaccctaaccccttaatggactgacagcccaacagcggtgccggcccacacacccagtctaacacctatacctaccatgaattagtagctacttatgtaaaactccagcagtctataaccccatcttgtaaattctatatacaaaagaatgcaacactgctaactagaaatcatcatcaggcgccttgttgagttctaatctgcatgtagacccgttggttcctctgaaagaagctggtgatctgttgcagcacagggaccaaaccgactggcagagtagctgaagccgtgacgtgggcatgattcaggaccctgtcatgcctggtgctctcctcgtctcttcttttcctcagcttctccaggtccaccacacggttgtcatggctgtagcgaggactctccatggtgctcagcccgagctcttcctccagatccttgcgctttctgtcgtagtctttggaggcgtggtcggctctccgcctctgccgccgctcgtcttcctggctcttcttgaatctacgcacgaccttagagaactggtcgatcgctttcagcacatcagtcctggagaccatctcgatcgcttggaaccagtcgtttgagacgacgaatacgggtggcgcgccaagcctgcccggggagaaaggaggagccccgtctgctgtaacctcctcctgcgactcagggagccatttcttcagccattcgttcagcgcctcggcacaggacctttgcgagatcatccacttgttgaagcaacggtaccatttcgtcagctcccgttccaaatcccgtgaggcctctgacacaacgccggattcacttacagtcatcgccttcatccagtgaatcctactgtcctgtatggctaatagctgcttctcatggcattccataatatctttccacaaactcctgaatctgtgagaaatcatatggatcagatagattcaatcttctgaagacaaagacgattcaaatagggagtactcattcatacctctggatgagatcaaccagttgagggtaaagctcttcgtctcgaatctcctgtatttttaacgagaaggcgtttgcggttctaatgttgatgctgatcttggactccacaagtcttgcggacaaacgggtggagtcgattgtacttgattcagcgcctcgttcgtccatggatttcagccttctgtaatacttctcatacttcatcngtagcttctcctcatcctagaacaaccacctaacgatgttcaacagatattggcaataaatcagacaaaatatga

SEQ ID NO: 8334 - DNA, 1864 bp, Zea mays
gcacgaggctgactgttttgccatgtgaggagaccgcggtgggttgctttgatgcttgtcgttccccgcccgtgaggggcacttccgctgccgtcgtgcggcgcgcctgcaactgcaacgctaccacctcgactcgcccctgctagcagcatccgggaagctgccctgccactgccaggctgccacaccgaggtgctcccttgactccctctcctctcctcttctcgcgcacgtggtctgtgcccgtacgcggcggcgctgccgctcaccagaccggccgccgccacgtctgcttccgcgcctccccgcctcctcaccgtccgcccccttttacctgcctgatcattttattataaatgtggggcgagagaactcatcataagcactggcatcaaggtcatggtacctcggggaattccaacaacaaaaagcatgataagcggcagccaaaatttataccagacaattatagctccgtcgatgaggttactactgctctgcgagaagctggcctcgaatcgtcaaatctaatcctcggtattgatttcaccaaaagcaatgagtggtcaggcaggcattcctttagaagaaaatctctgcatgccattaatggcaccccaaatccatatgaacaagctatctctataatcgggcgaacgctgtcaccttttgacgatgataacttgataccatgttttggatttggcgatgcttctacacatgatcattctgtgttcagtttctacccagagaaccgaccctgtcgtggctttgaggaggttcttgtaaggtatcgacagattgtaccacatttgaacctttcaggaccaacttcttttgcacctcttatttatgcagcgatttctgttgttgaaaacagtaattggcagtaccatgtcctcgtgatcatagctgatggacaggtgactgccgcgaatataaatgatggaagattaagtccacaggaacaagcaactatacaagcaattgtcgatgctagctactatcctctttcaatagtaatggttggggtgggtgatggaccatgggatgcgatgcagcattttgatgactgtatccctgaaagagcttttgacaattttcagtttgtgaacttcactggtattatgtcaacaagtaaggatatgtcaaagaaggaggctgcatttgcccttgcagctcttatggaaataccttctcagtataaagcaacgcaaggcctccgacctccagaaaagcaagcacaaaggattggctctcctaggattcttcctcctccaaataaagttcttgaaaatgataatgccgccgccgctgcttcgcaccctcctcaaactgcaagctcgaaatcaactggtattggcaaaagtgctgctgacgagcaggtatgccccatatgtctaaccaatccaaaggacatggcttttcagtgtggtcatctgacatgtaaggaatgtggcccaacactatcaacgtgcccattgtgccgcgctctaatcaccatgcgtgtgaggctctactcctaagtcggttggtgtctggagggatgggaccaaacagaaaggagcaagaactttggggcgcaaggactgcgctacgatcttgagatatggtccatatggatgtcatgataacgatgcatgtacagaaaccttgtccgtgcctattcagtaatgtcgttgatgagtatcttccatcaatcacatgtaaaatttctaatgttatcttgtattagtagcaggggattgcttgttgagtggaataccaccagttgttcagcaacagatagtaaactccatgtgcatttggaagtcacttttgtgatttgtgtccaaaaaaaaaaaaaaaaaagccaaaaaaaaaa

SEQ ID NO: 8335 - DNA, 804 bp, Zea mays
  misc_feature (19)..(19): n is a, c, g, or t
acatgaaaaacaagagtanccggttctcatgaaagaatttaagtacatactttagaagttaggatagaaatatttgatgctgcaataatgttcatttgtcatttggctgtaaacggctctaatgtctgaacacgcccctgtccccgctaacatatgtactatgccataatttactgttgcccccgttgcttgaatcatgtacagtctgatcctgggctcaagagttcttcagaccccactccatcatgtgaccgaaagataatatcgagtgggcgaaaggccttcacaggatctatcgtcgagcacgacgatgacgatctttcaaccattcaaccttctgcgggcaattcgttggcaaaacctggtacttctgcgtcttcaaggcccatgtcaagattcaagatgcagaaaggagggcggtgagtctcgataccacggggcgatgtatcttcggtggttgattagatgcatctggaacaatcatgttaagtggtagttttgtgcgagctgagcacctggaagctagacattttgttgtggagcggcgattgccctcttggggcctgttgttgtggagtgcaccttcaccagtgagactgtttggcggggatacatgggatgttcagttagattcagtttaattagtggctggtggtgcagtatctctttcagaaacctatatatatatgccgccatgccggttgtaaatctttcagcaacaaaaaaaagtgtcgaaagattaattctcggatttatggaaaaccatgctgcttaagactgaaaaaaaaaaaaaaaaaagcggcc

SEQ ID NO: 8336 - DNA, 1844 bp, Zea mays
ctgctcatatttcccctgctcctcatcgtgccaagacgcggatcgagtgccgctgatatgtgggctcgggctcgcacgacacgacggaggcatccagcaagcgaagcgactcctgcgagccgacgacgcgtactcgcaggccgcacccgtgcacgcctctgacgctgacgcctcaacagcccgcagcgctcggcgtgcgcgaggccgcccgctgccgccgcccaggaaaaaatgaacggcggtctttgccaactcccaggctacttatttactgcgtcacataaaggtcacgacgcaaccgcaactccctgctgcttctttgggggtgccggtgcgatgttccacgccacgctgcgccctgctcgcccgcctagcgctatatagcccgtgcccgtgtccgtgtccgtgtcgtgcagcggattgcggagtggcattgggttggcagcacgcccctgcacacggtgacacgggccacggcgcggcgcggcgcggcacggggagcgagcgccgagcgagagcaagcaaccgctgtccgccgggccggccacggcgctgccccctgcttcgcgccttcgccggtgcgctcacgcctcacgcaggtgcatgcatcgacctacggtatcctagtctgggatcagaaaagaacacagcaacaacaaagaagaaaggcgcgagcgatggacggtgacgccggaccagagcaacacgggtgcgtgcactacaggaggggatgcaagataagggcgccgtgctgcggcgaggtatttggttgcaggcactgccacaacgaagccaaggactcgctggaggtcagcgtccacgaccgccacgtgcttccccgtcacgacatcaagctggttatctgctctctctgcaacaaagaacaggatgtaagttccctgacgaagcagggacagtgttcttcggccactgttggtgttacctgccacacaccacatgaaaaaaaaacccatctcgtctgtcgacaggtgcagcaagactgtgcgaactgcggagcatgtctcggcaaatacttctgcgcgaaatgcaacctcttcgacgacgatgtgtcgaagaaccaatttcactgcgatgggtgcggcatatgcaggactggtggcgctgagaatttctatcactgtggcagatgtggatgctgctacaccactccgctgaaggattctcaccgctgcgtggacggagctatgcatcacaactgccctgtctgcatggagtatctattcgactcgatgaaagctatcagcgtgctccactgcggacacaccatccacctggaatgcctttacgagatgagagcgcaccagcagttttcatgcccggtgtgcctgaggtctgcctgcaacatgtccgacatctggcaaaagctggatcagcaggttgcagcgtccccgatgccagcgatctaccagaagaagatggtatggatcctttgcaacgactgtggcgtgacgtccaacgtgcagttccacatcttggcgcacaagtgccctggatgcagctcttacaacacccggcagacgaggggcgatccagccgcatgctctagagtctgagagcaaataaaactgcagtactgcactgcacataaactcgtggggttgtgcggtcgatcgataggtagcttgcagggaggaaattaaagactaccattgcgcatggacacgattggtgccggcagttgagtacgtgtattaggcctgtcatatgtagatgtatcatatgcaatgccttcacaaagaagaatttggcgcagcggacagggtttttttttgttgctaaaaaaaaaaacaaaaaaaaaaaaaaaattaaaaaaaaaaaaaaaa

SEQ ID NO: 8337 - DNA, 2216 bp, Zea mays
gttgtgattatttttgagaatttcagtttcgccctattcacccccctctaggcgactttcacttagttcatgctacagctgctgctgatggaagggaaggagtgctcgatcgttagaaaggtttgtttagctagttccggccttccgggcatcttctaattagtgcctgctgtgatgctgaatactatatgtgtaaccatagcttaaccttagtggtgggctcatctgctaccagctcaacgaccatccatggagttgccatcgaaattccacgcgctctggtagtagtctggtctggtctggtccaccataacctacacccacacggccacacaaggatcggaggctggactggacggactccgctgcatacatataagctcgttgagagccgccatggacgagtgaccaaacgataattcactctcgcactagtcccaactcccatccatatcccatcatccagcatccaagcaggacgagaagaggcccggtcgaatcgaagatggcttgcgtggcggaccgtcaggccgcggtgagggaggtggcgcaggtgtacgagctcatcaagctccagcagcccctcctcctcctccattcctcctcgtcgcatctggcgcagagcctcctcggcaaggcgctgcgagccctcaacgtcgccctctccgtcatgaaccagcagcagcctccccctcctcctcctgcagtggcaccagtgaccgttgtcgtcgtcaaagctgagcctcacctgtcgccgcccagcccggcgtctgccgattccgaagccacggcaccgccggccagaagaggcgccaaaagaacaaggtgcgcgcatgctctactgctcgatcgtcgttcatcgttgggcttcagttctagactagatttgtgcagtagtattcgttcagcgtctccgttcgttgactgttacttccaataactgaatctgcgtgctgcatacatgcagacgatcagcggcgccagtgggagggaagaagaactcgtcgtcatgggcgaccttaaccgccgtgccctacgacgacggctacgagtggaggaaatacggcgagaagaagatcaacgggacgctcttcaccaggagttacttcaggtgcacctacaaggacgacgccggctgcctcgccaccaagcacgtccagcagatggacagcgacgacaacagcagcccgcccatgttccacgtcacttaccacaacgaccacacctgcagcagcgccaaagctgcagccaaagccaacacaggcagcagcagcaacaacaacagccacctcgctgcattgctggcagactgctgcgacggcagcggctgcaacaagggactgacgaccaccaccatcaatgggcatgctgctgctgctgccgccgccatgaacatgaacatgaagcaagaaccgtcgctgctgccgccgccgcctcctctggccgaacctccttccgcctgctttccttatgaccaaatgccacagcagtgccatcagctgctatttcctgtaagcatggagcagcagttccccggcaatggcgaagaaatcccgtcggctgctggttcgtgcatctccggcgagaccagctgggatgggtattattattctggggacatggcggcagctgaagacgaccgtttccacgatctcgagcgtttcctcctgggcgatagcttcatggactaccagtactagctagctcgatcgatctgaaacagaattgttaacagggggtttatgaaagtagaagaatggttttggtcttctttttttttttttttggattcttagggcagcagtgccaataataaagtgttctgtaggggaaaaaaataggcgtgcatgagatgtaaaaacaaacgatcgttttattgttatataaaaatgtccggcactttccaaaaaaaaaaaaaaaaacctaaggtttcaagtgggataacaaaatttcaagtaattaagtttcctgtgcaatcgtcgtatcaattttcaagttccaaatcattttatgttcagagatataaaaaaagaaaaaagttatatctaatatatatgaaggatttaaaaatgatagaattttctcatttccatatcttctatgaactgcgataatcggactgtgataatcaagataatcagttctaaggataatataaagtcgacaaggcacataaagatgcgtttaaaatctatcaagaaattgagaaactccgg

SEQ ID NO: 8338 - DNA, 1685 bp, Zea mays
ttcgtatccctgttgaatttgtcaaagattgaaatgagttccgtctttatttttgccttttcacttcctgtatatacatgcattgctcctcttacagccacagctatactatccattttcctgaagtgttctgtgtctttgcgcaaaacagtgatctgtattttctctgtcggttcaggatgtgatgacgaaggtcatatcgttttcccaacaaggaccacgagctatctgtgttctctctgcaaatggtgtgatatccaccgttacactctgtcagcctgattcctctggtggcacgttaacttacgaggttagccatgcatgacaaaagttcttactgcacgcgtggtttcatatgcatgtctgtgtggggatgcagatgaaggaatctgagtggtcctgcttaataaccccatatgtctgatgccctgctttggttgtagggacgctttgagttgctgtccctgtctgggtccttcatgccaaccgaaaacggcgggacacgaagtcgatcaggtgggatgagcgtgtctctcgcgagtccagacggtcgtgttgtcggtggcggggttgccggcctgctggtggcagcgagtcctgttcaggtatgcatttgcttccgtgtttttgagatctgaatgcctgcctactagaagcctcagttgtgcagctgaactagtgaaactgcatgccccgcaccatttttattttttttgcatctgtatccttctaacggctgtagtttgctgcatataagctcacagtgtaactgatagtggagagtccccatttggcagattgtggttgggagcttcctgccaagctaccagatggagcagaagaacaagaagccacgggtggacgcggcacctgctgccgccgtcccgcagacgcctcccgcagtcccgatctcgagcacagacacccgcagcagcgagcaagggcagcagagctccgcgtcccagagaggggtgaacatgacggtcccgggaggaacctacggcgcggaccagagctgggtgttgtcccctgctccgcagcagccgatggccgaggtgtccaggacgccgtcgtctggggacctgaagatgaccacgtccggatcatgagcactctgaaacccagccggagctagccacccacgcactgactgggagccaaggtccccgctggaagatggaaggatggggtcatggattggttcatttgttcctgactcttgctgcaaatctcgcactagggcggtctagtctagttgttgctgtatgatgagcgcgccaggcaggaggaggggagtctaacaactgcacttgctgccattgtcggggagtgcgtgtgtgtagtgcagcagctattaacaccacagtttgagtgtgctagcggcgtgtgtttttatttaggcgacattgtcgattaaattcttgtgtcgggattattacctttaccttacgtgctggtttagtttggcaccctgtatctgtatctgtattggatcatgcccacccttggcttaaatcagcattagaaaattctccatgtttcctgttattctgtcactagtcgggaaatggatgaattccgtggtgcgatcgatctctctttccgaatcatgtgtgtaggtatgatggattgtgtggccaggtcatgcctacttttgtaactgttgccgtactccaaaagcacac

SEQ ID NO: 8339 - DNA, 1829 bp, Zea mays
ctcttctgctgcctctcgcctcgcgacctccgcttcgtcctcctcccgcagctgctcctgtttttgtttttgtcgatttttgtcgctggagcgaggattttttgaggaatatttcgggattttggggctatttttcggggacttttttttgggggggagggaggattttcgttattttctttttatttttgggaggcgccgcccggaactaaaggagggagatggggagagcgtgcgtgagctccaatggcgactgctcgtgtcgggaggcttagtaggacgactacgagcaggcgggcgcgtgcggggtgctgcgtgcatggaggccaagccgggggaagccagtgttgggcatgcgcctgcgcctatggcggcggcagcaccggttatggcggcgccaccactagaggagactgtgagcttccagcagccgctgccggcgccggccgcggcggcggagaggggcagctcgagcgccgtcctggtgccgcctcttgctacggcggcgggaggcggcgcgatggcgctcgtgccggtgctgatgaaggtgccgaagaagcgagggaggccgcgcaagtacgggccggacgggagcctgatccgcccgctcaacgccacgccgatctcggcgtccgcgcccttgccggccgccgtggcgcctgggcactacacgccggcctccgcggtgggcgccgccatgaagcgtggcaggggacggccccttgacttcgccgccgccgccgccaagcagcaccagcagcatcaccaccagctctaccagcatcagcagcagcagttcggcttccacttcgactccattggtgatatgggggcatgttcagctggtgcaaatttcactccacacataattacagtcgctcctggtgaggatgtgatgacgaaggtcatatcgttttcccaacaaggaccacgagctatctgtgttctctctgcaaatggtgtgatatccaccgttacactctgtcagcctgattcctctggtggcacgttaacttacgagggacgctttgagttgctgtccctgtctgggtccttcatgccaaccgaaaacggcgggacacgaagtcgatcaggtgggatgagcgtgtctctcgcgagtccagacggtcgtgttgtcggtggcggggttgccggcctgctggtggcagcgagtcctgttcagattgtggttgggagcttcctgccaagctaccagatggagcagaagaacaagaagccacgggtggacgcggcacctgctgccgccgtcccgcagacgcctcccgcagtcccgatctcgagcacagacacccgcagcagcgagcaagggcagcagagctccgcgtcccagagaggggtgaacatgacggtcccgggaggaacctacggcgcggaccagagctgggtgttgtcccctgctccgcagcagccgatgggccgaggtgtccaggacgccgtcgtctggggacctgaagatgaccacgtccggatcatgagcactctgaaacccagccggagctagccacccacgcactgactgggagccaaggtccccgctggaagatggaaggatggggtcatggattggttcatttgttcctgactcttgctgcaaatctcgcactagggcggtctagtctagttgttgctgtatgatgagcgcgccaggcaggaggaggggagtctaacaactgcacttgctgccattgtcggggagtgcgtgtgtgtagtgcagcagctattaacaccacagtttgagtgtgctagcggcgtgtgtttttatttaggctacattgtcgattaaattcttgtgtcgggattattacctt

SEQ ID NO: 8340 - DNA, 2533 bp, Zea mays
gattgaccttttgaactcttggatccaaatcatagcattacaatcagttgaaagcaacatcttctttgatcagatgttcctctcaatgtgatcagtagagtacaaactaaaggaaatgaagcaatggatgtttctgaacacattgtggtatctcagaaatcaaacagagcttggtcagcaagcagttgtttctagaccaagaacatcaatccatcatcatcttggtcattaaactttctctattcaacaaaaagtgttccagatcaattatgcttgtagcagtatactaacagactaacttgacccacagattattcaggtgaggcaacacataacataacaagcctcttctatgtgggttaacttaaaactgataaccgtatgatcagatatccaaccaccttgtggaagcagcaacggagagcaagacagcaccactggcatgtcacggccctacttcttgttcgagatgacattctcgacgtaccatttgtaggtttccacgaggccttccttgagggcgatcttgggcttccaccccatcccctgtatcttggagctatccatgagcttcctgggtgtgccgtccggcttgctggagtcccacaccaggttcccctggaagccgaccacctccttgactagttcggcgagctccttgatggtgacctcactcccactccccacattgacatgctccatgccggagtagtgatccatcaggaagatgacggcgtcggcgagatcatcgacgtgcaggaactcgcgcagaggcgagcctgatccccagacgacgacctcgggggcgttagtagccttggcctcgtggaagcgacggatgagcgcgggcaggacgtgcgagttctccgggtggaagttgtcgtgcgggccatacaggttggtgggcatggcagagacggcgtcgaggccgtgctggatgcggtaggcctggcacatcttgatgccggcgatcttggcgacggcgtaccactcgttggtgggctcgagcgggccggagaggagcgcgccctccgtgatgggctgcggcgcgaacttggggtagatgcaggaggagccgaggaagaggagcttgcggacggagccgcagcgcagcgcggcgtcgacgacgttggtctggatctggaggttggcggcgatgaagtcggcggggaaggtggagttggcgtggattccgccgaccttggcggcggcgaggaccacgtagcgcgggcgttctgcggcgaagaaggcctcgacgtccgcctggcgagtcaggtcgagctcggcgtgggtgcggacgacgacggaggtgaagcctagcgagaggaggcggcgcacgatggcggagccgacgaggccccggtggccggcgacgaagaccttggcgtccttgtcggcgaggaaggacgggtgcggatctgcgaggggggagaggggtcggaggtaagcccagcacgagaaatcgagcttgcggagggtgagggagaggacgccatttacctgcggcagtgacggtgcccatgtcgacggagggtccggagggagcggcggccggagatgatcgggttcggatgagaattgcagtcgccgctgcctcgctggacggggaattgggattttggagggccgttattaaagatgggttcgtgggccgggttacgtacatcgaactgctcgagagtcgagagtccacacctcaaagccgttgacccgttttccccataaattcgccctttttcctttttaagtttcgtccattcccagtttccaaaagccatgccatcaaaacgtcttacaatttagaacgaaatgactcagcatgattagcactataaagaggtataataaatttgaacttgaaaattttagatataattagagtaagatagaaataatatatgtatgatttttttataattttgtaaatatgtttgtttttcaaattttaccctgcaaacagcaaaatcccatattttacaggatgaagacaactttagagacagagtagtccaattctcacgttttaactagatcctagaacaagcatcccgtcaagaacaagcatcccgtcaagcgactactacgcgagaagagatcatatcaggattgcgtgaggaagcgctcagttaaaggagggcacgtgaggcgtcgcgggatccaaagaatgagaagcgtgcaggtcagcaggctgttctacttgcacgcattccttcgtcgtcaacagtaggttcctggcttgcttcacgtgttcgttaccaggatacaaacatggctccatgcgggcctaaatcagtgcgcgcacaagcccatctgacacaatattgggccataaaaggccagtgcaaagtccgatatatgtccagcccgcatcccacagccacgcgacccaaacatgatgccggcattggccagcaccactggaggccagcactgtggttgggtcggatcgaagttcaggccggacgcttttcgtctggacaattcacacatttccttattattaaaccagcaaggaatccggctcccaggatcg

SEQ ID NO: 8341 - DNA, 1614 bp, Zea mays
ttttttttttttttttttttttttttttttttttttttttttttttttttttttttttttgaaagcaacatcttctttgatcagatgttcctctcaatgtgatcagtagagtacaaactaaaggaaatgaagcaatggatgtttctgaactctttgtggtttctcagaaatcaaacagagcttggtcagcaagcagttgtttctagaccaagaacatcaatccatcatcatcttggtcattaaacttcctctattcaacaaaaagtgttccagatcaattatgcttgtagcagtatactaacttgacccacagattattcaggtgaggcaacacataacataacaagcctcttctatgtgggttaacttaaaactgataaccgtatgatcagatatccaaccaccttgtggaagcagcaacggagagcaagacagcaccactggcatgtcacggccctacttcttgttcgagatgacattctcgacgtaccatttgtaggtttccacgaggccttccttgagggcgatcttgggcttccaccccatcccctgtatcttggagctatccatgagcttcctgggtgtgccgtccggcttgctggagtcccacaccaggttcccctggaagccgaccacctccttgactagttcggcgagctccttgatggtgacctcactcccactccccacattgacatgctccatgccggagtagtgatccatcaggaagatgacggcgtcggcgagatcatcgacgtgcaggaactcgcgcagaggcgagcctgatccccagacgacgacctcgggggcgttagtagccttggcctcgtggaagcgacggatgagcgcgggcaggacgtgcgagttctccgggtggaagttgtcgtgcgggccatacaggttggtgggcatggcggagacggcgtcgaggccgtgctggatgcggtaggcctggcacatcttgatgccggcgatcttggcgacggcgtaccactcgttggtgggctcgagcgggccggagaggagcgcgccctccgtgatgggctgcggcgcgaacttggggtagatgcaggaggagccgaggaagaggagcttgcggacggagccgcagcgcagcgcggcgtcgacgacgttggtctggatctggaggttggcggcgatgaagtcggcggggaaggtggagttggcgtggattccgccgaccttggcggcggcgaggaccacgtagcgcgggcgttctgcggcgaagaaggcctcgacgtccgcctggcgagtcaggtcgagctcggcgtgggtgcggacgacgacggaggtgaagcctagcgagaggaggcggcgcacgatggcggagccgacgaggccccggtggccggcgacgaagaccttggcgtccttgtcggcgaggaaggacgggtgcggatctgcggcagtgacggtgcccatgtcgacggagggtccggagggagcggcggccggagatgatcgggttcggatgagaattgcagtcgccgctgcctcgctggacggggaagcgggatttgggagcgccgttgccggcgcggggttcgtgggccgggttacgtacatcgaactgctcgagagtcgagagtccac

SEQ ID NO: 8342 - DNA, 3566 bp, Zea mays
gctgactaactattagctctagggtttatcccttatgccttagcctcttcatgtatcatgcgcttgaatgtttgcatgccttcaacaaaatcttgagtacagtatacattttttagatgatggaataaaaaagcatttcatctagaatgtgtcgttgccgacagttatatattatagacgctcaaatcaataaatatacaggcaaccaagtctaagtaaacaacacaaaatagacgatgcttatattatatatggagccagatatatatcgttcatgatgtgaggatagaagatgcatgaagagcattcttatcctatatatgttactaaactttctggccatatttggcgaatatatataggggctagctgcaataaacaatataaaatttctagatcttttttttaaaaaaaaaagctattctatcttcttttgtacgtgttgcatgttagatagttctattctacgctaaattcgaggctcatatctagccagaaactaaggaaattcaacgaagccagagtagggaaatctgagagggacgtgtacgtacgtacatgttcagctgacaagtcgaagctatcctgaagcaagcaccacccgttgataaacgcgtgcattgttcatgcactttgctgcggccctgccgactttgccatcgttttttggctccatacgtgtgcactcatgcttcgaataatccgcagaaaatgcagcatggcaggactgatggagaaaaaaagtgaatcacggcgtgtgcctatatatatctgcatgcaatgcagcgcattccacacccatctcagcaatagagctcgatcggcgatctgtagtagcagcactagcactagctacgtagtacattgcatcgtcgtctctttgctagtagtagctatctcctggccgccatggcgtcttcctcggtctcatcctgcctgctgcttctcctgtgcttggcggcggtggcgtccgcgcagctctcgccgacgttctacgactcgtcgtgccccaacgcgctgtccaccatcaagagcgccgtgaacgccgccgtgcagaaggagaaccgcatgggggcctccttgctcaggctgcacttccatgactgctttgtccaggcaagctcagctcattcattcattcattccctagcttcgatcgcttccttatgcagtttatctgtacacggccatcacttactaactgcatgcacttcactcactgtgtttaagagcgctcctgtttgcatgagcaggaagaattttttacacccccgatgtgacaggtagttcctattaattaaattaatgttctcgatgacatcaggggtgcgacgcgtcggtgctgcttgccgacaacgccgccacgggcttcaccggcgagcagggtgctgcgcccaacgccgggtcgctgaggggcttcgacgtcatcgccaacatcaaggcacaggtggaggcagtctgcaagcagaccgtctcctgcgccgacatcctcgccgtcgccgcccgtgattccgtcgtcgcggtaagcaaagaaagaccacgactgcatgcgtagagaggggcttggtaatgatccacaccatgcatgcagctgctgcatcaaatcgatttctgacgcatatgctgacgtgcagttgggcgggccgtcatggacggttcctctggggcggagggactcgacgacggcgagcctgtccctgggcgaacagcgacctgccgcctcccttcttcaacctcggccagctcataacagcgttcggcaacaagggtttcaccgcgaccgagatggccacgctctccggcgcgcacaccatcgggcaggcgcagtgcaagaacttcagggaccacatctacaacgacaccaacatcaaccagggcttcgcgagctcgctcaaggccaactgcccccggcccaccggctccggcgacggcaacctggcgccgctcgacaccaccacgccgtacagcttcgacaacgcctactacagcaacctgctgagccagaaggggctcctgcactcggaccaggagctcttcaacggcggcagcaccgacaacaccgtcaggaacttcgcgtccaactcggccgccttcagcagcgccttcgccgcggccatggtgaagatgggcaacctcagcccgctcaccggatctcagggccagatcaggcttacctgctccacagtgaactaagattaataataatcaccatacgcaaaaaagagtggtatattcacatgcgaataataaggctaagccaccatgtgactagctagtggtatattcaacgaatcgtttgaaagggacgagtgcgactttaattttagatactagctgcaaaagcggcatatatgtatcagcccgatcaattgctcaaagaaaagatgcacgtcatacatttcagagctaggctttatgcaaaggactccccggcttaactgtgtgcttctctatgcttgtctgcttattaaatatcccacctgtccaacagttatttcgtggtactgtcatcagtgtgtttaataccatgttactaactaaatatgaaatttgaaggatagtagtagatttggcactaaaagatattccctcctgttcgttttagacatcgttctgtcgttttcccctcttttctaagtagaagccgtccgcacggtttcggacgtacgtgtttgccccgcgtggccgcctgggaatcggccattagggcgcaatttctacgaagctaagtcaaaaaaaatacaaaagacagatttttcacgaagaatataacttttcacgactctctatacatattgtctattagttatatttattatttagagtcttagatttgtatgatacaatcttttagttatctcttctaattagaactggagggagaacctttaactttatggcaagttgatctcggttagctgagatcacatctaataattactaacgaccacttctagcttttgcgccacacaaacaaatctgtttcaatgaaatgattgatcaaacgttagctagttcatcaatctagcatagtgttttcttcaaatcaaagtgctttcatgaatcccacaaaaaaccatttgattttataagtatatattctaaaagaaaaatatgagcgaaggcacataaattaaataccgtgaaaatgctgacaacgtcaagtgtgccatacctgtgtgtaggcctagctatatggtgcctaactgcatagctactagccctttaacaaaaacaaatttaagttgctcaagtgtctcaatgtcatttccttttgaattatatcatccttactgtcatgaaccatcttcctcgccaacaatacggtgtgacatatggtcttgttggtcatgctaatatatttgtagttaggtacgctaggaacttcaacatgtactaccgatttgagctgccttaactcctcggtccactaccggaatcgtgttctttgccgagtgtctaagacacttggtaaagaccattttacacacaataaatcctttgtcgagtgttacagtcggcaaagaatattcagcaaacattttatcgacaaagggttctttgcc

SEQ ID NO: 8343 - DNA, 1337 bp, Zea mays
ttgggtcattgggtacctgccggccgggccgggaccccatctcagcaatagagctcgatcggcgatctgtagtagcagcactagcactagctacgtagtacattgcatcgtcgtctctttgctagtagtagctatctcctggccgccatggcgtcttcctcggtctcatcctgcctgctgcttctcctgtgcttggcggcggtggcgtccgcgcagctctcgccgacgttctacgactcgtcgtgccccaacgcgctgtccaccatcaagagcgccgtgaacgccgccgtgcagaaggagaaccgcatgggggcctccttgctcaggctgcacttccatgactgctttgtccaggggtgcgacgcgtcggtgctgcttgccgacaacgccgccacgggcttcaccggcgagcagggtgctgcgcccaacgccgggtcgctgaggggcttcgacgtcatcgccaacatcaaggcacaggtggaggcagtctgcaagcagaccgtctcctgcgccgacatcctcgccgtcgccgcccgtgattccgtcgtcgcgttgggcgggccgtcatggacggttcctctggggcggagggactcgacgacggcgagcctgtccctggcgaacagcgacctgccgcctcccttcttcaacctcggccagctcataacagcgttcggcaacaagggtttcaccgcgaccgagatggccacgctctccggcgcgcacaccatcgggcaggcgcagtgcaagaacttcagggaccacatctacaacgacaccaacatcaaccagggcttcgcgagctcgctcaaggccaactgcccccggcccaccggctccggcgacggcaacctggcgccgctcgacaccaccacgccgtacagcttcgacaacgcctactacagcaacctgctgagccagaaggggctcctgcactcggaccaggagctcttcaacggcggcagcaccgacaacaccgtcaggaacttcgcgtccaactcggccgccttcagcagcgccttcgccgcggccatggtgaagatgggcaacctcagcccgctcaccggatctcagggccagatcaggcttacctgctccacagtgaactaagattaataataatcaccatacgcaaaaaagagtggtatattcacatgcgaataataaggctaagccaccatgtgactagctagtggtatattcaacgaatcgtttgaaagggacgagtgcgactttaattttagatactagctgcaaaagcggcatatatgtatcagcccgatcaattgctcaaagaaaagatgcacgtcatacatttcaaaaaaaaaaaaaaaaaa

SEQ ID NO: 8344 - DNA, 1381 bp, Zea mays
cctcgaggccggccgggccgggacacacaccatatcacaagcaagcgccaaccatcgagcagaaagaagatcgtcgagatcgagcataagccatggcggcctctgtttctgcctcttgccttattggcctgtcgtcgttggcggtggtgctggtggcgctggcgtcggcggcgtcggcgcagctgtcgtcgacgttctacgacaggtcatgccccaacgcgctgtccaccatcaggagcggcgtgaactccgcggtgaggcaggagcctcgcgtgggggcgtcgctgctcaggctccatttccacgactgctttgtccggggctgcgacgcgtcccttctgctgaacgacacgtcaggggagcagagccagggcccgaatctaactctgaacccgaggggcttcgttgtcgtgaacagcatcaaggcgcaggtggagtccgtgtgcccggggatcgtctcctgcgccgacatcctcgccgtggccgcccgcgacggagtcgtagcgctcggcgggccttcgtggacagttctgctagggcgaagggactctaccgcttcattcccagggcagacaagcgacctcccacctccgacgtctagcctccgacagcttttgtctgcgtataacaagaagaatctcaacccaaccgacatggttgcactctcaggagctcacacgatcggacaggcgcagtgctcgagcttcaacgaccacatctacaacgacaccaacatcaactccgccttcgcggcgtcgctcagggccaactgccccagggcaggcagcaccgcccttgcgccgctggacaccacgacgcccaacgcgttcgacaacgcctactacaccaacctgctgtcccagaaggggctcctgcactcggaccaggagctcttcaacagcggcagcaccgacagcacggtcaggagcttcgcgtcccagcacgtcggccttcaacagcgccttcgccacggccatggtcaagatgggcaacctcagcccccagaccggaacccaggggcagatcaggcgcagctgctggaaggtcaactcgtaaactactagctacgtactacgcccaatgcaatgcgttatggcaggcagatcagagccaattagtaataaggcctcagctcgctctctacctgtacgtgtgtgtgtgactggtgttggtcgagtaagtgtacgtactacatggatggagcagagagagagagagatatatcgatttggccaccttattattgcatgcatatgtgtactgtattagcacgacactattagacacatttattaatggtacccatgctatgcttgtaaacgtacccagccattgacctagatatgacactataggtctaatcgtattgcggctaacacca

SEQ ID NO: 8345 - DNA, 2062 bp, Zea mays
ccacgcgtccgcacaatctgaaactgtgtggcgccaggcagataaatatggggttccaagaatatgtttcgtgaacaaaatggaccgccttggagctaacttctttagaactagagacatgatcgttgcaaatttgggtccctcgccgccggccgggcagttgccgattggttcggaggacaatttccaaggagttgttgatctagtcataatgaaagctattgtatggacaggggaggagctgggtgcaaaatttgaatacaaagacatacctgctgatctccaagagatggctcaagactatcgtgttcaaatgctggaaactattattgaattggatgatgaagttatggagaaatatcttgaaggaactgaaccagacgaggaaactgttaagaaactaatcagaaagggaacaatttctgccagctttgtaccagttttatgtggttcagcattcaaaaacaagggtgtccaaccattgcttgatgctgttgtcgattacttgccatctccacttgatctaccttcaatgaagggtactgacccagaagaccctgaaataatatttgaaaggcaaccaagtgacgatgagccattttctgggttagctttcaagatcatgactgatccatttgtggggtcactaacatttgttcgcatatactccgggaagctgatagctggttcatatgttctcaatgcaaataaagataagaaagaaagaattggaagacttcttgagatgcacgctaacagtaaggaagatataccagttgctgtgacaggtgacatagtagcgcttgctggtctgaaagacacaattactggtgaaacactctgtgacccagacaagcctgtagtgcttgaacgtatggaatttcctgatcctgtcattaaggttgctattgaacccaagaccaaagctgatgccgacaaaatggctactgggttaatcaagcttgctcaagaagacccgtcattccacttctctagagacgaggaaaccaaccagactgttattgaaggaatgggagaattgcatcttgatatcattgtagacagactaaagagggagttcaaggttgaagcaaacgttggagctccacaagtcaactaccgtgaaagtatttccaaagttgcggaaatacaatatgtccacaaaaagcaatctggtggatctgggcagtttgcagacattattgtgcgttttgaacctttggaagctggaagtgggtatgagttcaagagtgaaatcaagggaggggcagtgcccaaagaatatgtaccaggggtgatgaaaggattggaagaaagcttacccaatggtgtcctcgccggttacccagttgtggacttccgggctgtgctggttgatggctcatatcacgatgtcgattcaagtgtcttagcattccaaattgcagccagaggagcattccgtgagggaatgaggaaagctggtccaaggcttctagagcctataatgaaagttgaagtgataactcctgaagagcatctgggtgatgttattggtgatttgaactctagaagaggacaggtcaacagcttcggggataagcctggtggactcaaggtggttgattcttttgtgccacttgctgagatgttccaatacgtcagcaccctccggggcatgaccaaggggcgagcgtcctacacgatgcagctcgccaagtttgacgtcgtcccacagcacatccagaaccagatctccgtggcaaaaacagaggaagctgctgcttagttttggttttccgtagatatatccatacagcaacaggagagcaggttgataggaaggacatcaaggtgtatgtagctttgtagtgtaaatctcttaaggcttgttcggatgattggaggggattgatatggattgagagagattttaatttactatggattgaaacttcctcaattcatatggattggactagaaccgaacatggtctaagggagcattatttgccattgattttgcacctgataataatggcctttgttgagttttcacgaaaaaaaaaaaaaaaaagcggcc

SEQ ID NO: 8346 - DNA, 2610 bp, Zea mays
  misc_feature (2238)..(2238): n is a, c, g, or t
ggaatgggagaactgcatcttgatatcattgtagacagactaaagagggagttcaaggttagtattctgactacctgcgtttatgcagctgcatgcgtcatgtgtttctttaattctattctgtatagatttttttttacttggtcgttagctgttgttaactcagagttttgtagctgtcacattacctttacttctgttgttgcatactctgtgcaggttgaagcaaacgttggagctccacaagtcaactaccgtgaaagtatttccaaagttgcagaaatacaatatgtccacaaaaagcagtctggtggatccgggcagttcgcagacattcttgtgcggtttgaacctctggaagctggaagtgggtacgagttcaagagtgaaatcaagggaggggcagtgcccaaagaatatgtaccaggagtgatgaaagggttggaagagagcttacccaacggtgtcctggccggttacccagttgtggacttccgggccgtgctggttgatggctcgtatcatgatgtcgactcaagcgtcttagcgttccaaatcgcagccagaggagccttccgtgaggggatgaggaaagccggtccaaggcttctcgagcctataatgagagttgaagtgataactcctgaagagcacctgggcgatgttatcggtgatctgaactctagaagaggacaggttaacagcttcggggataagcctggtgggctcaaggtacgaaacagaacagtacatcctcccctttttttgtagactagtttaaccatagcctactctttgcaacgtgaccttaaacaatgcgatcgatcgcgattcacaggtggtcgatgcttttgtgccactcgcggtgacgttccagtacgtcagcaccctccggggcatgaccaaggggcgagcgtcctacacgatgcagctggccaagtttgacgtcgtcccgcagcacatccagaaccagctctccacggcaaaagcagaggaagctgctgcttagtttttcgtttccccgtagatatatccatacagtacagcgtccgcagagcaggttgataggaagcgcgtcaaggtgtatccgtgtatgtagctttgtagcgtcttgaacttgaaccccgtcacggggcattatttgccattgattttggacctgtagtggacagtgaaattatatggcttcgttttcttgctcctgttgagaagctgtccatcgttctcacctctagttcggccctcttcctttttgtttgttacaaattctataaaatttctacggaattaaagcattgtagtgagattttagaggatttttaacgtgaggttcaacctcttgtaaaattttctaatggaattgaaggagacatgcaactctatttctataattttctcattcctatgttttactaatcctcctccattctaaaggaggcctaaatatgtttgtgatctgtgatgggctctacaggacactgtctagccatagccaggcagccttccagttctagggagatgaaacaggccaaaagcgaccggatggacgcgacggcacgcgcgccgcgcgaaatggcgatcacaactttttggcaaggccggggagatgtcgcagctggcggctggcctgcgcttgcgtagcgtggtggtgcgcggcggcatgattgcgtccgtgcagcccccacgccggaacggtgagcgcgcccgtcctttgctgccgccgcactgccgcctgcctgcggggaccgggatgtatcctgcgccgctgcgcgcccgagccgcgagggagagcggcagggccggtccccgggcctgctcctacaagccagccgtgaacggacagcggcctccgcgtacgatccaatgattgttgctgtagagttctggtagtgtacagtagccgggctcgcgcgcgcgtcgccgtcgaccaggcgccgggagatctcggaccgctgcctgccacggtgccacccagcgccaggggaggggccaagctagggcggtgcactgtacgcgccgggcacgagacggtgctcaccagtcgccacgccacgcacgcttcctcgcgagcaggacagtggtgtggtggagcggtggagcctagcgagaccggcgcgcgcgcgcggtcaacggcgtgctccaactgccgactcgttcattcggtcgatcttgcctgcgtggggtcctgtacggatgaaggcgttcgtacgggcccatgccgtgcggtggttggcgcgncgttttcagcgtccgaggacgctggatcatgccacgcgttctagcgtactactccctccgtcccacaaaagaagtcgtcttgggcattggcatttgtcccttgaagattgtcgttctggtgtctagacaacgagatcagagcagacatgggagcagggagcgattggcgcagcccacgcctcgagctacatgattttgtggcacatgaatctttgtatttaataggggtattgttgtaatctctcacttgacttgtttttcacctgctaggctagaacgactttctttatgggacggagggagtagtaggcagtatagatggccaataagcacgaggcccgcgaggccggcacgaagcctgctgtttgggtc

SEQ ID NO: 8347 - DNA, 1934 bp, Zea mays
  misc_feature (1785)..(1785): n is a, c, g, or t
  misc_feature (1851)..(1851): n is a, c, g, or t
ttctgcaatgaaaaaattgggtccatggccttgttcagtgaatgtgccgccgctacatgagtttgcatgatgtgaatttgctgcaagtacagaaatatcggtgcagagggtgtcaatatagaatataccatgcttggcatgccgcttggtactagatatctattggcacttgtcatatcaatgctaaacctttctgccatatacatcaatgagactgaccaaatgaacctctgaaaattgcatgccagttgttttttaattacatttcttattgctaaatacactattcttatatcactttgttgatttaacaagttagatattaacttgctttcttttgtatccagatcgccaagtgcctttacatgattaccgcaatattggtattatggcccatatagatgcaggaaagacaacaactactgagcgcattctgtattacactggaaggaactacaagattggcgaggttcatgagggaacagctacaatggactggatggaacaagaacaagagagaggaataaccattacatctgcagcaacgactgccttctggaacaaacacagaatcaacattattgatactcctggtcacgtcgacttcactcttgaggttgaacgtgctctcagggtgctggacggtgctatatgtctctttgacagtgttgctggggtagaaccacaatctgaaactgtgtggcgccaggcagataaatatggggttccaagaatatgtttcgtgaacaaaatggaccgccttggagctaacttctttagaactagagacatgatcgttgcaaatttgggtgccaaaccattggtgattcagttgccgattggttcggaggacaatttccaaggagttgttgatctagtcataatgaaagctattgtatggacaggggaggagctgggtgcaaaatttgaatacaaagacatacctgctgatctccaagagatggctcaagactatcgtgttcaaatgctggaaactattattgaattggatgatgaagttatggagaaatatcttgaaggaactgaaccagacgaggaaactgttaagaaactaatcagaaagggaacaatttctgccagctttgtcccagttttatgtggttcagcattcaaaaacaagggtgtccaaccattgcttgatgctgttgtcgattacttgccatctccacttgatctaccttcaatgaagggtactgacccagaagaccctgaaataatatttgaaaggcaaccaagtgacgatgagccattttctgggttagctttcaagatcatgactgatccgttcgtggggtcactaacattcgttcgcatatactccgggaagctggtagctggttcatatgttctcaatgcaaataaagacaagaaagagagaattggaaggcttcttgagatgcacgctaacagtaaggaagatataccagttgctgtgacaggtgacatagtagcgcttgctggtctgaaagacacaattactgggtgaaacactctgtgacccagacaagcctgtagtgcttgaacgtatggaatttcctgaccctgtcattaaggttgctattgaacccaagaccaaagccgatgctgacaaaatggctactggcttaatcaagcttgcccaagaagacccgtcattccacttctctagagacgaggaaacgaaccagactgttatcgaaggaatgggagaactgcatcttgatatcattgtagacagactaaagagggagttcaaggttgaagcaaacgttggagctccacaangtcaactaccgtgaaagtatttccaaagttgcagaaatacaatacgtccacaaaaagcagtctggntggatccgggcagttcgcagacattcttgtgcggtttgaacctctggaagctggaagtgggtaccttgcccggcggccgctcg

SEQ ID NO: 8348 - DNA, 1457 bp, Zea mays
  misc_feature (1439)..(1440): n is a, c, g, or t
  misc_feature (1457)..(1457): n is a, c, g, or t
gcacgagaccattacctagaacatcctaatcaaaagcggatgcgctcgggcgacgctcctctctctctttctctttctctcgctacatattcttcctctctctatctttgttctcctccgcccagctttcggacgcgacactcatcgcacattcccgtcaggccggtatccgcctcgggcttcgccgaaatcctacgctacctctctgatctctctccccccggccccgagcgcaccagattcacaccgcgcccgcataggtgcgtgtgcctgcggaagctggttgctgctcgcgctactagctgtttcgcgcggtgatcaacaatccggccgcgggagcggagctaggaggccgagagacacaatgaacatgttcgatgggatggagagtgctgggtacggcggcggcgctgggccgatgggcggggtggtgctgtcgcgggaccccaagccgcggctgcggtggacgcccgacctgcacgagcgcttcgtcgaggccggattgtgctgtgcgcggcaaacagaggcgacgcccaagtccgtgctgcggctgatgggaatgaaagggctcaccttgtaccacttgaagagtcacctccagaaatacaggcttggaaagcagaccaagaaagacacgggtttggacgccggcagaggggcattcgcggcgcagggcatcaatttctccacaccagtacctcctcctagcattccatctacggccagtgacaatacgggagaaacgccacttgcagatgcgctgaagtaccagattgaagtccaaaggaaattgcacgagcagctcgaggttcagaagaagctgcagatgcggatcgaggcgcaaggcaaatacttgcagacgatactcgagaaggcccagagcaacctctcgtaccacgcgactggagccgcaaacctagaagcaaccaggtcgcagctgacggacttcaacctcgcgctctcaggcttcatggacaacgtgacccaggcgtgcgagcagaacaacggcgagctggtgaaagccatgtccgaggacggtctcagagcgaacaatctagactttcagccgtaccatggagttcatgacggggacgatgtcaagtgcgctacggacgaagggttgctacttctggacctgaacatcagaggcgggtacggtcatcggatttcgacggatctgaagatgaatcaacacatgcggtgaaaagttcagtagaaagaaaggcgaggacagtagtttaatcttgggtaacccatcaatctaagagaagaggtgcccttgtgtttgtgagaaattctttcggccatcttgattcctaacgatgcttctttatggtgatggtcagcgtattgcttatgtaaaatttggtgagaggctccgaataagggtaactaatcttatacaagatctttacaaaaacaaaaattaataaaaaaannccaaaaaaaaaaaaaan

SEQ ID NO: 8349 - DNA, 3263 bp, Zea mays
attgataatgtttcttcgacatcagctcaatttatttaagcagtgtatttataatagtattatatatttatatagtcgtcaatataatattagtgtatggtgatattttgtcacacattttgcataccatagtaatatttgtcgttccgtatctatattgttttatactaattttttactctcgtggtaacgcatgggtacagacctagtgaactataatgtatagctgaagttggttgcagtttgaaacaatgccacatttaaaaaaccatagacactggtctatatctatgtgaacatattgaccagactcgtacagggcgcgagcaattcactagtaccatttcaaccaccgtcaaccagcaggcgctccactccttgtcctcccattggcgcctcgtagactgctgctctggtaattggatcttggatccatctccatgggtgcctccagtacttgcccttgccaccacttcagctcgtcttccatcctcaccaagcgggccatcgccttcgtgctctacgccctcgtccccctcgccctcatccactacctcctatctcttcctccccgtctcccctctcctcccaccaccggcgccgccacctccccgtcacggccgcagcaggcggaggaggctccggcagcgcggtgcgattactcggacggggagtgggtgcgggccgcggcaggtcctcggtacaacgggtcgagctgcggcgagacgatcaaggccggccagaactgcgaggcgcacgggcggccggacacggggtacatctactggcggtggcgcccgcgcgggtgcgcgctgccgccgttcgacccggaggagttcctgagcgcggtgcgcggtcgccacgtggccttcgttggcgactcgctcgcgcggaaccagtgcgagtccctggtgtgcctgctcgcctccgcgttcccggcccagctggtgcgcggcgctggcggcggcgacggggacggggacggcgacgagctccgcaagttccggcgctgggcgttcccgtcgcacaacgcgacggtgtcggtgttctggtcgccgttcctagtgaacggcacggagaggcccaagtcgccggcggcggcgggagggctggaccacaaccggatctacttcgaccagcccgacgagcggtgggcggcggcggtcccggggttcgacgtggtggtgctgtcggcggggcagtggtacctgaactcggccatgttctacgaccgtggcgccgtcatcggctgccatcgatgcccggagcccaaccgcaccgagacgggcttcttcggcgtgttccgcctcgccgtccgcaacgcgctccgcgaggtcatagcccgcgtcgccgccacgtcctcgcccgcgcgcccccggctggctgtggtgacgacgttctcgcccgcgcacttccagggggattgggacagcccgaccgcgtgcgtgcgcactcagccgtacgcgcgcggggagcgggagatggagtacatggatctggagatgctgcgcgccggggtcgaggaggtcgccgcggccggcgcggacgcgagggtgcgcggggccggcctggcggtggaggcgctgcaggtgacgcggctggcggcgatgcgcccggacgggcacccgggcctgtacacccgggcgttcccgttcgccgagggtgcgaaggatcggatgcccaacgactgtgtgcactggtgcctgcccgggcccatcgacacgtggaacgagatcctgctgcagctcgtcaagggatgggccgtcggcgtcggcgccatcgccgacacctcgtcgccatcgccatgaactgggccgttcgaagctaccgagtggccgtttggatgggcgattttggtccaaatccttgcgatggatttcgaattatttactcactcaagcgctttagattttgtagagttggccttttgttcaagcgctcagtcaggtatctttcgcttgtattttaatgataccagaactggaatcaacttaattagtcagcttagtcagacatgacaatggcctgaaacatggccagaacctgcggcgtaacgtgcggatcgctatgaggcacacggtactgaccttttcatcgatgaccgaccgacgctcactccacaaatgacccttttgcccagttattagggggctgttcaatcttgagccccggcaatgctatcattttttttgtggatcttttgcagagcctgaacagaagcagtcagttttatgctcagcccacactagtctaaaacacactggctgtcagcaataatcactcatcatcaccacaaattaaaaagggccagtgattcgtgatgggctgtcacagcgaaaaatctgcaggacgagagtttgcaaaaagcaattatcaggccgccagagttgcgcaaggcaccacaccaaatggccatagaatgtgacttggcccttggggattccatatatagaattgagtcgcctgccaaggattccaaaaacgactgcaaaagaaggcatcaagacatggatgagtcatgtaaacaaatcagctgagcgaaggaacgaagagagcacaagtggttctcagggcacatgaacacaactgacaattcactacatggaggacagatgataccctgtatgtgaagagtctacaatggagggatagggcatcaaatacattatcggataaaagattaaagaaatgactaaacaaaatactgcatgtgtgttagtccagccttcttccaaatgtagctccttgataaggcaaattgtccgattgttacgtccttgttaagtatgattgtccatccatgatctagatatggtacaaaatacaacaggacctgaaagatagccgtgcattagattaacccggaaaatcactccgacagaactgcctgatagaattttgctcgaaagtgccctgcctgacagaactgcttgatagaatttggatttagggtgttacttgacaatttagtattaatacttcaaatttgtttcttgatatcagaagattgtaattatattataaacctaggggaatcaagtgacacataagttattaggactatgcttgctttatcagtcaatattttgacaccttttgatgcagaggtcaactaggccaagagttactacaaacatgcttgggtccaattttctacctcaataatcactgaaaaagtatgtaactacaaggtatggaactgcagcttgctttggtgattccccttttctttttttcatagacaatccattaaacaattttgg

SEQ ID NO: 8350 - DNA, 1505 bp, Zea mays
ttttttttttttttttcttttttttgacttaataaagggcatttgacgtactcttgcaatagcaaagggtttttaacaataaatctgtggccatcggcagatagctgctagccaccatcatcaacgacgactgctgtctgtgagcttgaactctagctgtagtacctaccatcttgagttgatatgctacattactctcactctcaccgctgcatgcaaaccaccactttaatactccatctacccatcttggtctcgcgttacgatttattgaccgacgctttcctgctattgacagttgctattgaagcacgccttccacatggcgctgcctctgcgccgctacaatttccttacgccgaaccgcctgtctctgctctggaacgagaccagcgcttggaggtaatcggcctctccgaagtcgggccacagcgtgtccgtgaagaagagctccgcgtacgccgactgccacagcaggaagttgctcagccgcagttcgccgctggttctgatgaccaggtcgggataagggagctcgttgccgttggcgtggctcgtctcgagctcaccggcgaacagcgactcgtcgatgtcctccggctcgagcagcttgtcgcgcaccttctgggctagggtccggcacgcctgcactatgtccctccgcccgctgtagctgattgccagtgtcaggtcgagctgcgagttgttccgcgtggcctcctcggcttctctcgcggtcctctgaagagaaaccggcagccttgaggagtcgccgattacgcgtagccgaattccttctctgtaaaatgtaaagagcaaaaagctatcctagttgtgaggtatcctgccagctccgtagtgtgtgtgtgtcctaatgcatctgcatcttatctggaataatgccagtacatggtgtgaggctattaactgacggcgcaaatgcatacctcaaaaattcagctacgctttcgcggatcgctcgctcaaactgccccatcaagaattccacctccacctgtgaattggcaaaacgagccgtcaagctcgatcgtcggtgacaaaagaaggcggcggcaagcgtaccttgggccggctccagttctcgtgggagaaggcgaaggcggtgagcgtgcggacgccccaggcgcgggagagccgcaccacctcctccagcgcgcggcgcccggcctcgtgcccggccgcggacggcagcccgcgcgcgcgcgcccaccgcgagttcccgtccatcaccacagccacgtgccgcggcagcgactccgcacgcagcccgcccggtaggagcgcagcgtcggccaccggtgccggggtcgcgccggctcgcgggcatggcgataggagcagcgtccggcgggaaggggcgagtggctgatttgtggcagccggggaacgggagaacagcatgagctcttcacttctccagcaccacagctcgaaaatcaaccgcggcagtgctgctatacccagtgcgccgagccgaacgactt

SEQ ID NO: 8351 - DNA, 3045 bp, Zea mays
  misc_feature (3005)..(3005): n is a, c, g, or t
taactaaggtctgaagctgcccagatattaggctggaaagggtatactgcatcataaaaccagacctctttctcttcctactttcgtataagcttatcacacttattttacctgtgagccatggagtgaatcaggagaagctacttttttcagctcctagccctcaatttcattctagagaatcacgttacagaaccagcgtagaattacttctctggaaaaaagtgtttggcagagcttcttgtggattcagcctggaagttgctctaggagctctgcgcctctgccaagcattttgaaattacatgttgtgtgatgctctaatttttttctagagtacttgtaattttctagccatggaagtctgtttgatacttttgcttaaacaattactggcctagcacaattagcctaatctttgacagtttgacttaactatactgaatttatgatgcagttatactataaaaccaaacttgtttgcgcctttggaatgtgcacacccatgggaatttttcttgatggtccactgctgacatgcacagacatctcttctacctctgccaattcaaaggccatgctgttataccagcggtagctgcaacgattcatctagttgtggcaaattttggcacgtccccaacactcgagagatcaagaaagcaaaggcatgccaaccttcaaaatgcattgagaattttggaccttgtaccatccaagcatcatcatgaccaagaggaagttccgtcacatcaccgccttatcaatggctgtatgggtgacatctcggcagtccaatcaagactgcacactatgcgtaagggtaaagagagttttgctaactcaagctcaaatcaagcacagcctaaacacaataacattgtctcaaataatacctcagtttgccccttcataactagactcacaaaggaggacatgtttatgcaaattgtggagttacataggagtggacaaatcagttcagatgcatccattttggtatctgcactgagttactgtgctgctgagaaaattcttaccgcaggtgtacagttccatgctcaactagtgaaagtaggatatgtctcatctatatccactggcaacttgctgatcagtttttattcacgatgcagccaattggaaattgctcatcgggttttccaaaatatgacagcaaaaagtactgtgacatggacagcattaatttctggctatgcccaggataatcaggtcgaaccatgtctccatttatttgcactgatgaggcactctgtgtgcaagccaaatgacgtcacatttgcaactatcttcagtgtctgcactaatcatgcatttcttgtacttggtaaaagtgtgcaagccctacagatgagaatgggttttgattcgtatgtgcatgtgtccaatgcattgatatcaatgtatgcaaagtgcgggagtattggtgaagcacgagctgtatttgagagcattagatgcaaagacctggtctcttggaactccttgatctttggatattcacagcatggccttgctgagcattgcctatacttgctaagagaaatggaagggcatataacaccggatgcaatctccttcctaggtgtgctctcatcatgccggcatgcatgccttgtggcagagggccgacggtgcttcagggcaatgattgaacatggagtagtaccagagatagatcactactcatgtatggtggatctttttggccgtgcagggctgcttgatgaagcatgggatctgatccagacgatgcccatgcctccaaatggtgttgtatggggctcccttctagcttcctgtagggtgcatggaagcacttggatcggcatacaagctgcagagcaccgtctaaagctggaaccaagttgtgctgcaactcatgttcagctagcgaatttgtatgggagcattgggtgctgggatgatgtggcaagagtgaggaaggtgatgaaggagagagggctgaaaacaaacatcgggtgcagttggatagaagttggcaataaagtttatacatttacagcagaaaacagatcaaagaaccaggtaaacaatgtcctggttgttcttgattgcttgcagtcacatatggatcacgagtatgatatactactgatcgagggtctggattgggatgatcctgagcatatcaagttgagtttaaacaatatataaatttgaagatcattgcccgccatgttcagcttcatttgaagaggcactcaataggaatcccccgcggccgttcacacctcaaatatcttcaatctcgatgtaacatgtaagtttaacacctgtgtttgagcatttgaaaagatttggtttgctcagtttactttcatctgagctactgctgatatccatattcattttgtactaaatatatttttcacaattgaaacctctgtatacaagaatgcatgttcaatctcttgagtaatgtgcagttctgcatggaagatgatgggcaataaactgggttactttgatgcaatgggttgtgcgatgctttgcaagggagcatcttttattgtctaggtggttaggatgcttgctattcaattcttacctaagagacctgtctatgagttctggcaaggcgatggcattatgttttttccttgtgcatatgttttttcttgtgcatttgtttcgtccagcagcgtatatattttattgtgaatagttattccacatcaaggatccagtagtgtccttcatcgaatttatacttgctaatctgctatccatacttctaagatgttatcatttaactctgagtatttcacttgattagctaatggtgtaatggaccgggcattgcaacgagcacacaagacatttagtggttctctctcaaacagctattagtgtggcttacttaattttttattgcacacaagaatgcatgctcggctctcctcaccaggcaagaataggcaaagcaagcacagctacctgtttggttctgttttgtcctntctataagatcaaaaaccattgctttggttgaacaccacc

SEQ ID NO: 8352 - DNA, 1652 bp, Zea mays
ccgaaaaagaaaaaaaaaaggggttgcaattttgctgggagcctgggacgctgagtcagacccccaccgatggcgtccgaatcctccccgcccccggcgggggcgccaccgcctggtctgggagacaagctagcggtgttctgggacgagggcatgctggcccacgacgccggccgcggcgtgttcgactcgggccgcgaccccggattcctggatgtgctcgaccaacacccggagaacgccgaccgcgtccgcaacatggtctccatcctccgccgcgggcccatcgcgcacttcctctcctggcactcgggccgccctgcccacgcctccgagctcctctccttccactcctcagaatacatagaggagctcgtccagacgaacgccaccggagccaagaagaagctctgtgagggcacgttcttgaacccgggctcctggggtgcggcgcttctagcggccgggaccacgctctcctccgcgaagcacatactagacgggcaggggaacctggcctacgcgttggttcgcccccctggccaccacgcgcagcccgaccacgccgatggctactgctttctgaacaatgccggacttgctgtgcaactggctctggattccgggcgcgcaaaggtcgccgttgtggatattgatgtgcactacgggaatggcaccgcggagggcttctatcggacagacaccgtgttgacgatgtctcttcacatgatgcatggttcttgggggccatcgcatccgcagagtggctccgtcgatgagattggtgagggcaaggggcttgggtacaatctcaatatacctttgcctaatggaagtggagatgctgggtatgaatatgcgatgaacgagttggttgttccatcgattgataagtttcagcctcaactgttgtttcttgtggtcggccaagattccagtgcgtttgatcccaatggaagacagtgcttgaccatggaaggctacaggaaaattggacaaataatgaggcgcctggctgatcgccattgcaatgggcaaatactggttgtccaggaagggggttaccacatcacttattcggcatattgtctgcatgctacactggaaggagttttggatctggaagccccgctgcttgatgacccaatcgcttattatccggaggatgataaatacactatgaaagtcgttgacatgataaagagctactggaaggaatcggttcctttcctaaaggaaatttagaggaaataatgttcgcgccctcaatgttcaaattgcaggaaactccacattcctggacatcttcaattgaattgggaagaacattgcacgtctacgttttcaggccgtttaagattatctgattgacagtttcacgcctaacattgtacaggatagattaagaacattgtttgctgctgctcttgaatttctgcaatcaggatctcgtcagcctatttttgataaacagtcgatctttttttttccctgagatgcttttggcggcagtagaaggtaggcggtgcttgagagtgacagagggccatgtaaccaggggataaatcttgattgactagtccaagcaaagggtgatgctcgctaccagaacttgaatgtgtttttttttttcaacaaaaaaaaaaaaaaaa

SEQ ID NO: 8353 - DNA, 1631 bp, Zea mays
  misc_feature (1456)..(1563): n is a, c, g, or t
cattgggtacctcgggggtcacaattcacaactcccaacccaatccagcccagcaatcaacaattcccccggtcgttttcacttgacatcccccgtcccatagatcgccggcgatggctccggccgttgccgcggcggcgtcggcggcgatgaggcaggcactgcgggaccggcagatcctcgatgccgtgggcactggcgctgcggcgctctcgctggcaggctcctccttcatcgtgatctgctacctcctcttccgcgagctccgcaagttctccttcaagctcgtcttctacctagccgtctcggatatgttttgcagcttattcactatattgggggggccatcgaatgcattttactgctttgcacatgactacagtgctcatttcttctgtgtggcttcttttctatggacaaccaccatatcattcactctgcatcgcacagttgtaaaacacaaaactgatgttgaagaatttggatctattttccacttatatgtgtggggaacttcactatctaccactgtattacgttcgataggaagtgactacggaagaccaggcacctggtgctggattcagcagggaagcatggcaaaggtcctacatttaataaccttttatcttccactttggggtgccattttgtacaatgggtttacatactatgaagtaaaccgcatgctgaataatgcaacgcagatggctgctggcataagtgatcaatcaaatcagtctgacattagggcaggcaggaaggcatttaaccgatggggttattaccctctaattctaatcggttcatgggcgtttgcaactatcaatcgtctttatgactttgccaatccagggcacaggatagtctggctctcgtttcttgatgttgggttcgctggacttatgggcctattcaattccattgcttatgggctaaactcttctgtgcgccgagctattgcagagagaatcgacacgttcctacctgagagaataaaaaggagcctccctgctttgtcaaggctgaggagtcaacaggaaaatgaactcacttctcttatcgttgagggtaactgatatgtaatggaatttccatgcacacgaagccttttttttgtttatctgttcgttcttcaatctccaacaagggaatgcaacatcactgtaagagcagtgggttagtaacacgtcgaattggttccgctgtgtccattgttgatcgtcttaacacgagacctggggtttggggttcaccgctcccgctccggccggagtacataggagggctagagtaggaacagtcggtagatagactgatgttcatctgtagctaggtaagcagagtttgtttgttcagatgtacgagtataaccacctgtgtataatgcacattctagcgccacatggttgcaaattttcagttcccccccccccgaaaaaaaaaaaaaaaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctggggggggggcggcgggacccatttccccccaaaggggggggttttaaattttccggggcccgg

SEQ ID NO: 8354 - DNA, 1899 bp, Zea mays
gagttctcgatcgcgccattcaatcggataaagctgtgttgagttgcagaaaatcagtctttgatcgtctgtgttttcctgattaaagcagcgctttgttgctttagatagaggtagagccatgtgcggcgcttttcaggctggttttttttcgaaaaccggttttccccactccacaccaccaccaccaccattgacgacttgactacaaagcccagatccattcctcggggtcgggcggccgccaatcccgccgcataccgctggccgagtcctcgtcggcgccggacggggtgaagtgaaggccgactgggagaattttgtggatcttatctggtctccatcatggaacaagacggcacgacgaacctggctgtcactgaggctgtgcgctcggtgcagctgctcaagatcgacggctactgcgccaccgctaccatgaaatcatcggagttcatcaaattccgatggcacatcgatggccacgagtgggaggtccgtttctatcctgattactggtacttcttcgaggacgaggactgcttcagcacttatggcgacgacgatcactccgagtgggtaggtctgaagctcatccttgtcagtgaaccccagagggacgacgacaaggtgagggtgaacctgagctgccggcttgtatgccccagccccaccagccagcggcggcatctcggtacctgctggtccgaagagaagagggtgtcccatgtgtttgccagcaactcgaaatgctcgcctgaacttctcctcatcctgaagcacgagctaccatcgtcaggttatctcgtggacgattcactgaccgtggaatgcacggtcaccgtgctacgcgacttggacgccgccacggataaggcgctgtcgtccctgccagtgccgccaccctcggacctacaccagcacctcggcgacctcctgcagagcgaggacggagcggacgtcacgttccgtgtctccggggagtccttcgccgcccacagggccatactcgccgcaaggtcccctgtttttaaggccgagttcttcggaggcatggaggaacgcagctccgcttctgtggaggtcaaaggcatggaggctgctgtgttcaggtccatgcttcgcttcatctataccgacacggctccagagctcgacggtgcccaggaccaggagcctgaggcggcggtggccatggctcagcacctactggtagctgctgacaggtatgggctgaacagactgaagctcatgtgcgaatgcaagctctctggcggcatcgacatcggcacagcggccgcgacgttggctctcgccgagcagcacaactgctcgctgctcaaagccaagtgccttgagttcgtcaccaggtcgcctgagactctcgatgctatcctggcgactgacggctacgagcatctggtggcaagctgcccctcggtgctggctgaactgctgagggctgcgcgtggaaggaagatctgagctggacgatgatttcatattatggtttgcctaagatgtgtgcgaactaaaaaccatgcatgatgaactagtagtgcttgcagttgatttcctgcccctcctttcagtttgacctgcgcttgtcatgcatgtattgtatgcacatacatgagacgggcagctagcattttctgtggttcgatctcgtctcggctttgtgcctgccatttgggggcttaattgtaccggttgccgtttctcgttcttcgcaaaaaaaaaaaaaaaacgcagccacacgcatgacatgagcagactgctgctgcttcagtcgcaactagtacacaagattcagaaaactcatctttagagcagtcagtttctgggggaacagggcaacaggcaactccaaaactcgatcacagttgtcaactgcag

SEQ ID NO: 8355 - DNA, 4984 bp, Zea mays
gtttgtgtgaccttacccattagacttgtgtagatgagctcttaataggtcgacaacttagttgcttcagttaagatatttagtaaatttcctgtaatagatagaggggtgtagccatgactagatcgaatagaattaattttgcatatattttggttagccaacataattaattttagaaaggactatttactttctgtattctgccatctcgactctacatgcttattttggaatgacgtagacggtatcaaatagagataaacacatatatttgtattagacctaattacgttccaccttagacattttttataaaggctagctcaaagactccagtgtctagggtataattagttctagactagctagaagatatgtattggtagaaggggatctctatcagtgtggtgtcaatgaagttctcctaaagtgcattacgagaaggccaatagtataatcattgacatccacgagggtaaggcgataaccactcatcgtctcgtatgatggtcgaaaagccctttcagcaaggatttttctagatgatggtctttagggacataaatgaactggtaagaaaatgctaaggatatcaattcaatgcaaagcagattcacatattaatccaagtgctagaatccatctctttatagtataatggtctaggtctagaacatggacattatgaaattctatggtctatctatggtgtaacagattattggctcatcgctcaggatgcctccagtggagcgtgaaaaatatgtaacgaaaaactgtagatgatgctatttaatattgtttgtatagttaagtttgaaatagataattagacagaattactggagatagtctcatgcttatgcgtagacagattcgcacacggcccgccggtccggggaacgtaggagggtgggtcttctcttcccccttcgcttcctcgtgcagctccgaccacggtgagcgtagccacgccgctcccgcttgcccgcttccgatccccgcgccgcccccacaaaattccaggccggcacgcctcctcgtccacttgtgcaccgtggctaccgtttccctttcctggatctgaatttcgtcccgcgtagcgcagatgccgctaggacgggaggattaatctcgtggcccatgagcttaccggggaggaaggccccagcgggggcctccggagtccggcggtggctcgtcaccgtcgtcgtgtcggtgctggcgctggtgctgaccctcgttgtgatatcgctgtcccagggctcgtccctgcctcggacgtcgctgcacggttacctccccatcggagctactgacctggggaagcgttcgtcgtcggagcatgctgatgaaaacaggagtggcgctgcaattggggaggaattgtcgcagggtgagcgggagtccttagtggagcagaatggtcagggtggcgacgtgaattcaagccaaacgtctgcagcttcaggaaagatggatgacaacgagccggatccagcttcttccagtgataccacaacgattccggacgaggatacatctaatgaatctcaaaaggctgagcaaggtgagctgttagttcgtttccctgagatttctgcacagcatatttaccagcatgaatgggatgtcattcgtcattgtactgtagtgatttattagattcatcattgtatcagggtagctgagagagcaggagttgatatttgctttctgactgtgcagataattgtgatctatatcgtggagagtgggttactgattcttctgggccactatacacaaacaactcctgccctatcatcacacagatgcagaattgccagggaaatgggcgaccggacaaggactatgaaaattggagatggaagccagaacagtgtaacctcccacgcttcgatgcaaggaagttcttggagttgatgagaggcaagacacttgcgttcgttggggattcagttgctcggaatcagatggagtccctcctttgcattctgtggcaagtgagatgcctcctgctacgttcagaatcttacatttgcattatagtgtaattaagataaaaccattacctgccaaatacttttatgtgactagttttctaacttatcccctgtcaaacaattggtatgcaagtacgcacaaactcctaggcatttttacaggtgatgatgtaccctaggtcaaccatcatcgttttatttcatttgagaccttgtctcaaaaaaaatagattactgataagaaaaggaatggaaagtaattggatccttccatccatactcttacagagttacaggtaggatactatgagttaggtttgcttaaaagtctgtaattcatcaggatataaggctcctatttcagttcttttaggagttccagagactaatgctaagattagtagccttttcattttatgatcatgtttgacattaatctctactgaacacttcttaacaaggttttacccctagaatacgataaatgtaatatgaagggcaacttcaaacagttttgcatttctacattcaatgtatttgtagcacttgttgtcaggcaacatatatctgcttcgttgtcttaaagcatctgtttctcctttttacaggtagatgtcccacaaaaccgaggcaacaaaaggatgcacaagtggcgcttccggtcaactaaaacaactatcgcccgcgtctggtcttcttggttagtgcacaggtcaactgaagctgtggggattgctcctaagggtattgataaagtttttctggatattcctgatgagaccttcatggagttcctcccaaggtttgatgtactcgtcctttcctctggccactggtttgctaaacgatcagcctatatcctgaacgagaatgttgttggagggcagctttggtggcctcgtaaagcaggaaaaatgcaggtcaacaatgtggatgcctttggtatctctgtcgagacttgcctaactgctgtggtgaataacccaaattttacaggcctagcaattgtgcgcacatggtcacctgatcattatgaaggcggagcatggaacaccggtggatcatgcaccggaaaggtcaagcccttgaatgaagtggtgaggaacggatttaccgatgcgatgcatgaaaagcaggttgcaggcttcaggaaggcagtgaagaatgcaggggaacacggttctaggttgaaattgatggatatcactgaaccctttgccttcagggctgacggtcatcctggcccgtacagaagtcctgacccaaacaagaagacacagagagggccagatggaaaacctccacctcaggattgtttgcactggtgcatgccaggaccagtagacacatggaatgagatgttgctagaaaccattcgaagagagttcgagacagatagaacctgaggatagaaagtgctggctacttcgccatcatgtattcatgttatacattctgcgctgcgaactccatagggatgtatcgctgcacttagtagcatgttgtgtttaccatagataggaaggaacaaagcttcggatacgtaagattcactgtattttctctgacacgattcttggacatcattttcttgccaaattttgtgggcctgaatcccaaaaagtgtcaactgatatttgcattctgtccttgtactagtcaacctggtttggtgtaatagaataaaatgtaacaaccggaaagatgagaattgtttgccgaaaaatcgtctgtagctgttttttttgtgtgtttttgtacaaaaaaggtgtactgctcttcttgtgccatacatgcagatattctagaaattgcagatgcggtttatgttttggggcgtggtatatatggtgtctggttctgccagtacgcatgatcttgatacgttagtatttcaaagaaaaagctagtgtattatttaggtggagattggtgcttttggctgcagaaactctgtattgtctggaaaggtgttagcaggacggagctggctaaaagatcaactgcctttttactcgctgtggaaaaagaaagcggaagcattaatgttagtgatgcggtaatacccacacctaagcttgtattactgggaccttggctttatcttttggtctcaagtcagataggacacgagatggtgggtttctttgttccgtgggtttctggtttgctctgttaagaaaaggtgaaaatctgttaagaatagtatctgatgtaacaaatgggttgatgtaagctgaatgttaccggtttatggcattaggcttgttggccttgatgcttggggaatgaaaagtccttgaactctaaaaaataacaaaagctacggcaatttccaatcctctgaaattgcagccaggctaacgtaccatcacgcgccagttaagacgacatgccaacgagactgcatcttgaaggaagagtgcagtagtgcttgacatgaaggccctttaaatgtgtttcactctgagatacatggtagtatctgccatatagatagtagggtacttgatttactaacaggcaattacgcctcctgtccaatggccagcaacaagtttacaagtcgtgaaaatcgcatacagaaatcttctgaaaaacatagcagcaagatattaaaaaaactgacgaagttcttcaatcagactaggcttaaggatgccacctgttggcatttccaaactctcttctgttcatggataaagaaccctctcccaacagaatgccatagcataacactccacgtcaggttattccttcatgacgctgtagatcttctcgtagccattgtcacctggtgagatgccatgagaaacactcattgtcagtctccggagcgctgctgcgcatccgagtatgacttttggagcattaagggtctgtttgattcgtgactaacagcgtcacactttacctaaagttagtcgtttgaattgaaaaactaaccttaggcaaaaaaaaaagttagacgaaat

SEQ ID NO: 8356 - DNA, 1948 bp, Zea mays
  misc_feature (1)..(1): n is a, c, g, or t
ntcatgctcacgcgtagacagattcgcacacgacgcacgaaaccagtgaccggaggagggtgggtcttctcttcccccttcgcttcctcgtgcagctccgaccacggtgagcgtagccacgccgctcccgcttgcccgcttccgatccccgcgccgcccccacaaaattccaggccggcacgcctcctcgtccacttgtgcaccgtggctaccgtttccctttcctggatctgaatttcgtcccgcgtagcgcagatgccgctaggacgggaggattaatctcgtggcccatgagcttaccggggaggaaggccccagcgggggcctccggagtccggcggtggctcgtcaccgtcgtcgtgtcggtgctggcgctggtgctgaccctcgttgtgatatcgctgtcccagggctcgtccctgcctcggacgtcgctgcacggttacctccccatcggagctactgacctggggaagcgttcgtcgtcggagcatgctgatgaaaacaggagtggcgctgcaattggggaggaattgtcgcagggtgagcgggagtccttagtggagcagaatggtcagggtggcgacgtgaattcaagccaaacgtctgcagcttcaggaaagatggatgacaacgagccggatccagcttcttccagtgataccacaacgattccggacgaggatacatctaatgaatctcaaaaggctgagcaagataattgtgatctatatcgtgggagagtgggttactgattcttctgggccactatacacaaacaactcctgccctatcatcacacagatgcagaattgccagggaaatgggcgaccggacaaggactatgaaaattggagatggaagccagaacagtgtaacctcccacgcttcgatgcaaggaagttcttggagttgatgagaggcaagacacttgcgttctagatgtcccacaaaaccgaggcaacaaaaggatgcacaagtggctcttcaaatcaactaaaacaactatcgcccgcgtctggtcttcttggttagtgcacaggtcaactgaagctgtggggattgctcctaagggtattgataaagtttttctggatattcctgatgagaccttcatggagttcctcccaaggtttgatgtactcgtcctttcctctggccactggtttgctaaacgatcagcctatatcctgaacgagaatgttgttggagggcagctttggtggcctcgtaaagcaggaaaaatgcaggtcaacaatgtggatgcctttggtatctctgtcgagacttgcctaactgctgtggtgaataacccaaattttacaggcctagcaattgtgcgcacatggtcacctgatcattatgaaggcggagcatggaacaccggtggatcatgcaccggaaaggtcaagcccttgaatgaagtggtgaggaacggatttaccgatgcgatgcatgaaaagcaggttgcaggcttcaggaaggcagtgaagaatgcaggggaacacggttctaggttgaaattgatggatatcactgaaccctttgccttcagggctgacggtcatcctggcccgtacagaagtcctgacccaaacaagaagacacagagagggccagatggaaaacctccacctcaggattgtttgcactggtgcatgccaggaccagtagacacatggaatgagatgttgctagaaaccattcgaagagagttcgagacagatagaacctgaggatagaaagtgctggctacttcgccatcatgtattcatgttatacattctgcgctgcgaactccatagggatgtatcgctgcacttagtagcatgttgtgtttaccatagataggaaggaacaaagcttcggatacgtaagattcactgtattttctctgacacgattcttggacatcattttcttgccaaattttgtgggcctgaatccc

SEQ ID NO: 8357 - DNA, 1889 bp, Zea mays
acccccgaggtttttcccccaaaattccaggccggcacgcctcctcgtccacttgtgcaccgtggcgtccctcgcccccgcccgggtctgaatttcgtcccgcgtagcgcagatgccgctaggacgggaggattaatctcgtggcccatgagcttaccggggaggaaggccccagcgggggcctccggagtccggcggtggctcgtcaccgtcgtcgtgtcggtgctggcgctggtgctgaccctcgttgtgatatcgctgtcccagggctcgtccctgcctcggacgtcgctgcacggttacctccccatcggagctactgacctggggaagcgttcgtcgtcggagcatgctgatgaaaacaggagtggcgctgcaattggggaggaattgtcgcagggtgagcgggagtccttagtggagcagaatggtcagggtggcgacgtgaattcaagccaaacgtctgcagcttcaggaaagatggatgacaacgagccggatccagcttcttccagtgataccacaacgattccggacgaggatacatctaatgaatctcaaaaggctgagcaagataattgtgatctatatcgtggagagtgggttactgattcttctgggccactatacacaaacaactcctgccctatcatcacacagatgcagaattgccagggaaatgggcgaccggacaaggactatgaaaattggagatggaagccagaacagtgtaacctcccacgcttcgatgcaaggaagttcttggagttgatgagaggcaagacacttgcgttcgttggggattcagttgctcggaatcagatggagtccctcctttgcattctgtggcaagtagatgtcccacaaaaccgaggcaacaaaaggatgcacaagtggctcttcaaatcaactaaaacaactatcgcccgcgtctggtcttcttggttagtgcacaggtcaactgaagctgtggggattgctcctaagggtattgataaagtttttctggatattcctgatgagaccttcatggagttcctcccaaggtttgatgtactcgtcctttcctctggccactggtttgctaaacgatcagcctatatcctgaacgagaatgttgttggagggcagctttggtggcctcgtaaagcaggaaaaatgcaggtcaacaatgtggatgcctttggtatctctgtcgagacttgcctaactgctgtggtgaataacccaaattttacaggcctagcaattgtgcgcacatggtcacctgatcattatgaaggcggagcatggaacaccggtggatcatgcaccggaaaggtcaagcccttgaatgaagtggtgaggaacggatttaccgatgcgatgcatgaaaagcaggttgcaggcttcaggaaggcagtgaagaatgcaggggaacacggttctaggttgaaattgatggatatcactgaaccctttgccttcagggctgacggtcatcctggcccgtacagaagtcctgacccaaacaagaagacacagagagggccagatggaaaacctccacctcaggattgtttgcactggtgcatgccaggaccagtagacacatggaatgagatgttgctagaaaccattcgaagagagttcgagacagatagaacctgaggatagaaagtgctggctacttcgccatcatgtattcatgttatacattctgcgctgcgaactccatagggatgtatcgctgcacttagtagcatgttgtgtttaccatagataggaaggaacaaagcttcggatacgtaagattcactgtattttctctgacacgattcttggacatcattttcttgccaaattttgtgggcctgaatcccaaaaagtgtcgactgatatttgcattc

SEQ ID NO: 8358 - DNA, 909 bp, Zea mays
  misc_feature (896)..(896): n is a, c, g, or t
agcagtggtaacaacgcagagtccttttttttttttttttttttttttttttttggaaggaaacattatattcaaaggggatattggaattacaatcgaccctaaggagaactttaattatttagttaccactacatctatcacacttatctcgtaatatacacagaatcaaagcacacattctcaaaattaaaccacatggtgagcccagcatcagcccacgccggcacactagtagaactattagcacactcaaacagaaggaccgtcgagggttcgcttcgctactagctagctgcaggatctagccagcgggcgagcggaacaatcctctgagcttttcctccacgcgagccgcagcgcgcccgaggcggtcggagccgctgagcgtgaggaaggcgagcgccgcgccgaccgtgaacagcccaaatccgagcaggacatgctccgggttgtccgcgaggttggccacggtcccgtggagcaccacggagcccccgcaggcgaagaagaaggccgaagcctggacgcgccggtccctaggctccagcagatcctgcaggatgacggcgacgcttctttcctctaggccctgggctccggctccggcggcggcggcgacgggttcttcctcgtcgcggatcgcaggcgtcggcgtcggcgactccgtgtccgtgtccgtggccatcgatcgatctacctcggcggcggcgggttcgtcgtcgcggatcgcaagcgtggtctccgtgtccgtggccatcgatggatcgatgtagctcggcggcggggttgggttgtctcgagtcctcgatcgcctctggtggagcggtggatctttggctgcggggtctagggtttcggctcctcccgcacacaatcattccccggccggaccncgaggggtaccca

SEQ ID NO: 8359 - DNA, 3442 bp, Zea mays
tgcgtccagtgccagatctgaattttgcttcatcctggtctccaggaagccaagcaccagccaccaggtaagcctcgttcggttagattagaccatggtttaatctggattggatccaatcgagcccacaattcatgacaaaaaaatctagaattattttatttcccctctccagttaaacccactatggttcgcacttcgcaggccagggttttggatctggccgaccgacagactcaagttgttcctgttcgttctataaaggtaggaatatgttatatttcactcgagattggtcactgtaataatacaattcactagctaaaaatatgtttgtagatatttaaaatgaaaatattttgaagcatttttaaggcttaagaactcggaaaataaatttatcttgcagcatcaactcatgaacaatatgtattgattattgtatttctagaattcgtatcgacttatttttaggctacatatttcttaaatgtttaaattatatcttgtttctggtgtcatattaaatatcaattatattttttgtttgatttaaaaaattttatagacttagcttattagtccctctcttggatcaatcctggatccgccactgagtgtgggttatcatctttttgttgtttttaagctgtatgttgtttaagcagaggctagctagaagacgtttcaagggtgtgtatcacctccatgtaatgcacttgaaagttgaaactatctatgaatataatcttccttcatacaaaaaaagaatgaatgaatgaagaacgctatcctttaacttgaagcgcctacaaaattaagaacgagttggcgaacttcgaagcctagctagatcgactacgattcgtcttgagtcggacggagtcggtagtagaatcaacttgaaactcccggatcggttgcgcccgttctcggactcgtctccgtattcgcgccatgcatcgcacgctccccccgctactacaccctccctccgggctccggccgtccctgccggcgtcatctcagacgccgccggccggcccgctgtgcccggtcacacacacgctagctagctcccctaaggcctcaacaaaataagggcttggtggtctggaagacatgaaatcacccaccaccggctaccgaaagctttcgactttccacctttaatttcagtcgcctgaaagcacgaagaatagagaggtgaggaggtaaggaactcacacagtagcagcctagcaggtagccaattgcagatcgaggaaggacctagcgagatgggcaacggcggcagagccgcatgcagcttccactctccgctagcttccactctcctcccccagccagccctccgctaccttttacctccgttatgaaacaggtctaccttatattatcttagtaattcagatctctgtcagctcaggacaaattcagatctgatcaaaaattaatggaggaaatgagttcatcatgcatgcatggaaggtcttatgaaaggaaacattatattcaaaggggatattggaattacaatcgaccctaaggagaactttaattatttagttaccactacatctatcacacttatctcgtaatatacacagaatcaaagcacacattctcaaaattaaaccacatggtgagcccagcatcagcccacgccggcacactagtagaactattagcacactcaaacagaaggaccgtcgagggttcgcttcgctactagctagctgcaggatctagccagcgggcgagcggaacaatcctctgagcttttcctccacgcgagccgcagcgcgcccgaggcggtcggagccgctgagcgtgaggaaggcgagcgccgcgccgaccgtgaacagcccgaatccgagcaggacatgctccgggttgtccgcgaggttggccacggtcccgtggagcaccacggagcctccgcaggcgaagaagaaggccgaagcctggacgcgccggtccctgggctggagcagctcctgcaggatgacggcgacgcttctttcctctaggacctgggctccggctccggctccggcggcggcggcgggttcttcctcgtcgcggatcgcaagagtcggcaccggcgtcggcgtcggcgactccgtgtccgtggccatcgatcgatctacctcggcggcggcgggttcgtcgtcgcggatcgcaagcgtggtctccgtgtccggggccatcgatggatcgatgtagctcggcggcggggttgggttgtctcgagtcctctcctcgatcgcctctggtggagcggtgggatctttggctgcggggtctagggtttgggctcctcccgcacacaatcattcactcccggccggcccggccgcgccgcaccctttgtatagccggaggcccggagtctgtctgagacgttcggtttgggtctggacgcctggcaggggatatgctccggccgcgcgtcgtgattcgtgaagcggctgcggctcgcggctcgcggcactggcagtagacagtaggcagtaggcttggagtcttggctggcacggcatgttcgcgggcttgggcttccctacagttggcgcaatttttttcatgggcctgagattatatgacgcgggtctccaccttcttttgtttgagtttcgaaatgttcacgggccgggcttttctaggtgggcggcgggtgcgctgttcctttcagcttcgaaagcctctccctcccatctctgtagcctcgtcacttccgcacctattttttctcaaaaaaaaaaaagaaaaaaaaaaggaagacgcagcagcgcttccgcacctaccgttgacgaacaagcagatctgcatcttgtgccagcatagcatgccaaggcgagatctctacgcttccccttcttcatcctccctctttggtttccctgatgaatgaactactatctgtctatctatatggatcctacgggacatccatccatcagtctacatattttcatctatagcccgatgccaagcagaataagcagcaccgcgtgcaccacaggggcagatatatagacggcatagaatagcgctggcatgtcatgcacccaagacgtacacaccaatttgcatagctttggcaaactgatgaaggccggcgaaatagaaggtaggtagtagcaaagcgtgtaaaatagctagtggtgaagtttcctaagttccaggtgatgaaaaaaaatctcccagaaaagaaaaccaatgcaagagaggtatggaagagaaaaagacgacgctgcaatcacacctacggtctgaaaagcaacgacgagcaaaaaaaaacaagaagaagaacgaggcacgtacatgtggctgcctgccgagcatgagcaagattgatgacggcggaggccgccggcggctgcacggcggcaagcatggtagcgcgacccggccgcgcgccgtgtttagtctactc

SEQ ID NO: 8360 - DNA, 3883 bp, Zea mays
ctatcttcacttgaaagcaaactttcgtgtgccgacaaagccttgatgctgcagaggagaggcagcgtttgctcgtgagagtgtgagacggtggtggtggggctccgagggaggacagaatccaatccaaggcgcaagcaggcgagaagggtgagaaaacagcaagagaacaacagcaatgcaatacaatgcacgagaaatcaatgcgatggcggacagccctttgcttctctctcgtcttccttttccacctttttttttcgttacatcaaaagaaaatgtttctttctctctctcaagaaaaaaaaactctatccttttgagagggttgtagttgagctgtttcgcttttgccccgcctactgctgctgaaagattctccctctcttccaggtcaaagaagtgaaagcaaaagcagcaaacaattggggtggtgagtggtgacatggaggatgcaaaagaagatgctgccatggtgccatggccaggcctggccctggcccccagctgcctcacgcgccatattcccttgccttgcccgccgattcgaccccgggcgtatccatccatccatacatatgccgctgcccgctgcaggtggagacggaatatctccgagcggtgctctggtggagtcacacgaaaggaaccgaccggccgcctatctataagagcccccgcgccgcccgcgccggcatctggcattcgatcgatcaccttgctgctgctgctgctgctgtcgctggttggccaggagcacaccagctgcttgctgtgtcgccgtcgtagaagcagccgcgcgctgtcgtcgtcgtctcgtccgcgacgcgaccactccggcggctgctgctgcctctcatgctggccacgccaccgacgcttttgtgataccatacgaagcgccgcggcgggcacgttggagatgtcgtcgctgggtgggcaacagcagcacgggcgcggcgacgaggccagggcgcggctcaggtggacgcgccagctgcacggccgcttcgtgctcgccgtggcccagcctcggcggcgcggacaaggcgacgcccaagtccgtgatgagggcgatggccgtgtcggggctcacgctgtaccacctcaagagccacctccagaggtaccggctggcggtgagccaaggcaccgcgtccccggtgggcgagggcgacaacggaggtggcgccaacgagcggtcgtcctcctcggagagccagctggacgagtacgacgacggttccgtggccgacctgcatggtgattcttccgggagcatggcggcgcgggtgcagagagaggcgaaaaggaagcggcatgagcagatgcagatcgaggtgcagcggcacctccagctgaggatcgaggcgcaggggaggtacatgcagtccgtgctgcgccgggcgcaggaggccctcgccgaccacatactgggctcgccggccaccggcgcggaggcagagctctcggagctggcctccgcggtggagaccgggaccgggtgcctgtcctccacttcctgctgctccacctcgccttccccgatgcgccaccgctccgccgacagctgcgtgacgtcctcctcctcctcctcctcctcggaggccgagagccaggcccccgccggcgccaacacgtgcgctggtacgcgcgactgctccgtcgagcggccggtgcagggcgaggagagtacattcctgcagaggcacgaggacgaggacgaggcagaggaagccgacgttggagctgcagctgcagctgaggacgaggacggcacttcgtcagagattgatctcaacaggtaggcgacgaagatcctgatcagaagcatctgtgctgcatgtgcccagcatcggatgattggcggggtggccttcaaggttgggacttgcttgggagggggcaggcttttgagcaacgtctgctgctgaaacagctggctacatacactgcaagtctgcagcgaccacactgctcttcattccataatatatgatatacataatattccaatttatgcaaatggttcttctgcttcatgaaaaaaaaaaaaaaaaaaatcatggcttgaactagaggcaggcccagctgcagatgatgcatgccgtatgcttgaggtgcaatgcaatgcaaggatgtatgcatagtacagaactgtagtagcagaggcggatctacgaccggggctgcctgggctgcagccccggtcgcggcccaatacaagcaaataggcccagtacaagtcgcgtctccgcctccagcttccagccgccagccgcgtacctgtgtcagcgcgtcgtgtaatcgcatccagccgccagcccgccagcggagcagctcagcaacgccgaggagatgagcaggaagcgcccaagctgaacagcacggagacaagcggagcagcgctgcgtccagtggcagatctggatttcgcttcgtcctggtctccaggaagccaagcaccggccaccaggtaagcctcgttcggttatattagaccatggtttaatctggattagatccaattgagcccacaattcatgccaaaaaaatctagaattattttattttccccctcttcagttaaacccgctatggttcgcacttcgcagcccagggttttggatctggccgaccgacagactcaagatgttcctgttcgctctataaaggtaggaatatattatatttcactcgagatcagtcactgtaataatacaattcactagctaaaaatatgtttgtagatatttaagatgaaaatattttgaagcatttttaaggcttaagaactcggaaaataaatttatctcgcaacatcaactcatgaatagtatgtattgattattgtatttctaaaattcgtatcgacttatttttaggctatatatttcttaaatatttaaattatatcttgtttctggtgtcatattaaatattaattatatttttttgtttgatttaaaaaattttatagccttagcttattagcccccgtcttggatcaatcctggatccgccactgtgtagtagctattgttagtgagattatatgccatcagcgaggcaatgccgtgagaactggaaaaaaggtttagaatgtaacttaagatcattataattacaaacctggtatgggcactgagcagcaagttctgttacagcatttcggggataaaccagggttaaacttccccggcgaaatccggtaaaattttcgttatctcagtacgggaaaaaaatcaggaaaactcggtaaaattcgttggtaattttaaaaaatgaaaaaacagtggaaaatatgataaaaactacgtttttccgagcattctgaagttggcgtcgttaaaaatttaaacatatttcataggtaaaaaaattaaaaacacttgacccgttaagaaaccgcgcattccgagtggatttcgccgcatcccgaacgcctgaggtgagatttgttactgatttgatgtttttttttgttgatttcgcaagcggatgtaatgtgtagagaatttatagcgtctattcatgtactgatgaatttcttttaactgttcctgcatatggtttagggtttgtgttagtgcatagatgtgtcatttgcataattattcatcagcacgccagccacgataagacagcgcggacaaccaatcaagcggttagtttcaaaaccccatcccggttgaaaaatacaaaatttggtgaaattcgccaaaaaatcctgttttcgatgacctccaaaaaaaaggaaaggttaaccctgggataaaccaagctatcacatcgggagcaacagccaaaagaaaaagaaaaaaggcatcagtgcagtttttcttatagtgaaaaaaaggtgtgaaaatttggcatgatatgc

SEQ ID NO: 8361 - DNA, 994 bp, Zea mays
ggaccctcgaggccggccgagatataggctttggaagggggcgcccggccggaatttcgggaatcgatttgtagtggggcatgtaagcttgtgggagaggaaagcagcaggagacgaaggtagacaaggaaaagtatgtcaaagaaaatgagagaacaaccttcttagcttctcctccagtctctctccaccaccgctctatctcctcggtaggaagaagagcaagcaagagaggagcaagctagctagcggtacaagggagagtgagcggcgaaggggacggacgaattgaagaacacctgccagtccgatcgagctggtggtgccgccaggataaatcgggaggtatatgatggcgtcgaattcaccgtcggcggcgttctttggtgttagggatggggaccagcaagaccaccagattaagccgctgatatcaccgcagcagcagcagcagctggcagcggcactgcccagcgtggcgtccggccaaggcgcgccgacggcggcggcgcagccaccgcccaagaagaagaggactatgcccggtaattcacgcaagtccacccccttctgactccggtcgtccatgcacactgcgtacaggtctgctgcctgccagagatctcgctcgctcgtctggatcgattggagttttatgagttggatgcttgcagcaagagcatatatcttctctcacatagtcacatgcctgcactcggtttctctttccatttcttcgtggtttcttgtctgagtattgtagttcttggtttgtgatcaccgctatatatcttcactgcgccactgcctaaaaaaaaaaatccttgcctggttttccaacgcagaccgatgtgtgcaaactacagtttttttttggttctgggtttctggatttcatgaaaataaaaataggaattctccagttcttagttttctctctctttcctccctatctagttcgaggtggatcccatccctaccttcttctctgcag

SEQ ID NO: 8362 - DNA, 1366 bp, Zea mays
cagaacttctcagagcattgaaatccgatgacaaaagcacgcccacgagcaacatgaaaaggacgccatcatggcctctcgttgctttctgcatctcccgagcttttagcgccttttacactaatcaatctagtctgaatctaatccatgcccccgattcgctaatgcttcgttgcaatgcatgcagagactgacacgaatgcgactgaggccgtccagttcgcgccgccgcctccgccaccgccgccgcctccgccaccgccgccgccgcagttacaggtaccggtgctttcgcaagattcggtgagcgctgctgccaacgttggcgccagcagcagcagcagcagcgtcgcggggacgtcgcagagcctgctcggcggtatgttcgcgccgtcgtcgatggcgtcagcgccgcagtacgcggacctcggcggccggccggagcgcgcccatcccgccaagcccccgccgctgtgcctcgccacggacgcatcgtcgtcgatcttctcggcggcgccggcggtgaccgccgagcgccagcagttcgcgccgccgcctccgtccccgtccccgtccgcacacatgtcggccaccgcgctgctgcagaaggccgcgcagatgggcgccacctcgtcgagctcctcgttcctgcgcgggctgggcctggacgtctcctcgtcgtcgccgggcgcctcgtcgtcaggccagcagcaccagcaccaggaggccatgcgggtgtcactcccggacgcctcgctgcagcaatggccgccgcggctggagctggagccggcgccaatgctgtcggccgggctcggccttgggctgccgtacgactccaccggggctcaggtgagcctgccggagctcatgatgggccagtcgtctctgttcagcgggaagcccggcgacgctggacttcctggggctcgggatgagcccgtcgggcgcgtcggcaggacgaggcctccccgcgttcgtccagcccatcggcggcatggccgggaccggggccggcgcagccgagacgttcggcgccgggcgtggcgcgcaggcaacgccgtgggagaggaatccgagtagctcgccgatcctgtaactaaaaacttggatagcaatgcaagtagtttggattgaaccccaggcgctgtgattttgggcaaaaggaagaggaaacagtagacgccaggttcgattagcagctacgtagtcttatgttgcactgccggttcttgctgttcttttgtttctcttagctcggtacgaagaaactcactcactctcctacaagaatgctgctttgcacttgcttcctcccgagtcccgtcgcttgccgttgtctcttcccgattgcttccttgcgctt

SEQ ID NO: 8363 - DNA, 4490 bp, Zea mays
cttgacactaggtgctatcaccctcagccggcgggcgcgtgggcttgagggtctgttaatactgaggtatctatttgggctcccttctgatcctagtggttccttggaatcatctggtgagagtccaagtgagattgagttattcatgaagacatatgaagagaagatatgccagggcattgaaaattcagcgactgctgttggaaagactcttttacgcaagctactgaattcgatcaaattactacgctcaattcttgagaattctggtcaatccgcagatacagttcagatggttcttgaagaaggcactgactcactgtctgaaattgctcgctctgttgttatgacagctcatcttatgccatccctagccaatgtgtcagtaaatgatgaatctccttttctcttctctaatatgtggaaggttattgttgattcagaagagcctcttgactgccaagagggtgaatttgcaaagaggctagtttgggagttgcctgattcttctcttgatagacaactagcacctggccaatctgccaggaggaaattagcactgggagagagtgcaagtaggcgtgtaagggataatcaactgcctgaacccactgggcagttctcacgaggtttaaatacatccaatgcttcttcgggacatacacgcagagacactttccgtcagcggaaacctaacacaagtagaccaccttcaatgcatcttcggggctatgttgcaagagagagaaacatagatggtgcaagtagtgcgtcaaatattgtgaactctaccccacgaggaacacttagtggaaggcctccatccattcatgttgatgaatttatggcaaggcagagagaacgtcaaaatcatgcgccagccccaactggagatgcacctcaagctaaaagtcagacaacaagtttagatgacagtcttcgtactaagccagagaacttgcgtcaacccaagactgatctcgatgatgatcaagaaattgaaattgtctttgatgaggaatcaggttcggatgataaacttcctttccctcaaccagatgatagtctccaatctccacctgtcattattggggaaaattctcctggtcctgttattgacgagacagaaaatcaggagaatgaaagagttccctttttccagagggccacatctatcccgaaggacgatgaaaatcttggcattggcatttcttcccagactgcaatgctctcagaagctaacagttctttggaactgaaacattcagtttctagcccagggaagaattcttttcgtgatcatgctgaagagtctaattatgattctattggtgtatctgggagaccatctttacaagcagatcatcaacaattatctcgtagacatgaaaagagaagtccacgaaaattttctgagacttctctgtcaaatggattccatgggcgtgagcatagacattccaataaccatccacctctgccaccaatgccacctccaatttcatccgtgtccatgcaaaatactgattcagttaataggcagtcatcttcgttcagtgctcgagatcgaccaacacctaatccttctggttatcctacacaatcttttgactctagtatgcctagtgctttcacaggccttcagggtcaaactcaatacatgcttgcaggcgctggcagttcatcagcgaatgagttacccaatgtggaggccaagcttctatggaacacatttccagcaaataggatccctctggagaccttcagctcaggtttacctgctcggccgatgccaccccttacaccttattcagctgttgctactcagcacgctacgatgaactctggctctcctgcaaacctgtatagccagggcagtgttgtccagccttctccaactgcttctattattagtgattcaaatttggccatgaactccgcatctggcagcatgctgcccgcgaccctgcccccgtccttcccatcccaatttctgatgagcaggccttcaatgcctactccgttttttggcacgcctcttcaacaagttcaattctcatcgggtcttccacaaaatatttctaaccctcagccacctgtctcaatacaaccacggccacccccacccccaccacccccgcagcagccacatccttctcagacactccaacaacttggtgctatccaattaccacaccaagatcagcagcactcatatccccatagtgctatcttgccacaagttacgttgcagtttcctaaccagctacccattcctcaagtacaattgtatcatcaaagccagcaggaatctgggcaaacactgaggcaagttggtgaacaatcacaacttcagaaccagggtatgcaagcagatagtttctctcaacagcagcaagactcagggatcaacttaaaccagttcttttcatctccagaagccattcagagtctacttagtgatcgtgagaagctctgccaacttttagagcagaatccaaaacttatgcaaatgctccaggatcgcattggccagttgtagtcgcactggaggtgctattgtgaaagtgaaatctgatgctggtcgatcgctaggttcctagagtatggtgttgttttgttttcggctatggctgtagctagatgaaagcaactgccagcttgctagtcgccgaaatgtattcctatgtacattatatgtaactttgttctgtaatgtgaaaatttgtaatgttagtgcgtatctaatttatagttttaagtttacctttagtggttagatcgtgtgacatgcgcagcgacgggaaaacgacgccgccttttgtctgcaaaggcatttgacgctaactacctgtagagttctgaatatcctgttgcactcttgtgtgtatctggttgctttaatgctcgaaaatgaatatcctaaggttttgcattcgtatgcaatcataagcaatcctacgcttccgttcctattttgaacagcatggggttttatatgatatataaataaaaatcaatattggagggaagaaagtaaaagaccgatacacctttttaggctgtcacctctcaaggctttgttcggttacacatggggatgttcggttacacatcggaatgttcagttacatggggatataaaggatcaagagattaattctatttctgtacaattttgattaataagcgatttgatcacctttaatccatcactaaccaaacaagcccatatgatatatgaggaccagaggtttgaaatagatgacttaaatctacttctaatactatgggttctaatttttatatactaaaaaacgtatactgtaaaataatctatatagatatgcaaataaaattttactaagctattttgctataaaaagttatgtaatctagattttaattctatcaattaatctagcaagctaaactacaaatataagcaatataaattaaatgcagaagctttaaacaagatagagacgtcttgtttttaccaagttattaagaagctcacattttttcctagttcttggagtcctttgtacctatgttatttttttctagtttttgttagagtccctcgtaaaagcatctccaaccatgcatcaaattgatgccccatattaaaatatagggtttaatctagaaaaaacagttctaactgtgcctcattttataaaaaatatcaaaaaaattatagtacacctcttgaaatgccacaaatatattacaccttattgaattgtcatatttgtcgtagtggacctagctaacgaggccacaacaaccacgtcttccctcgtggcccatggccttcctccaatcctaaagcgccacatgtctttgttactcatatgaggctttattgttggagcttaactatttattgctgccctaaatcctctaaagcatgatggttttaaatttatagggcatttttatagggcaccctcttggagatgctctaaggatacctttgtgagggctaagctctgattgcaagggttaagcttctgattgggtaacttttggatagttctcgggtcttcaagcgcatatgattctatgagataggttctcctagaccctttttgctatttttactatcaagtcttggtatatggtgccaaccacaccataaacttggttgtattcatgtgctctaatgttacattatggacttgatcctccccctaaatccttaattcacattttccttttcttgtactatctctcaaaatagaattctccattcaataccactcaattttttgtaaaatttatggttttagtatttgttatggactgagcttgtttttacctttcaaattctctttcgcatcagacacaaaagaaaggcattactaccataaagcagggtcaaattttgtgatcccttatatgtataatatagttgatcataaaagttgactctcatattatatagaaagctcccctaactgtatgcatatcgtagcaccccg

SEQ ID NO: 8364 - DNA, 2583 bp, Zea mays
actcgctcaaaccctagccccaccgcgcgaatggccgatgtgcttgacccggcctccgacgcgccgcgcgcgcgccgtccgccgccacctcccccggatagcccggaggaccgctcgccgcagctgcccccgcctccacccgggggccccccggcggcgagccggaagcggagtcgctctccgccgccgccgccgccgcctccgctgggttcgtcccggccccaaaggtatcgggaccaccgcagcggcggagggcggggcgggagcagccccagcccgccgccgtaccggggcagccgccgccactcgccgtccaggagatccccgtcgccgccattcaagcggtcgcggagggacgacgggtacgaccgccgcgggggccgcgggagcccgccgcgttacgggtacgatgataggaggcgaggttatgaccatgagcgaggtggcggcagaggtgggtatgaagatgacaggaaccagggcagatatctgaaccgtgctccagattggcctgattcggggtacggagcggccaatgatggtccaggggtcacccaaagggaaggtttgatgacatacaaacagttcatgcaagttcttgaggatgatatttcaccaagtgaagctgaacgcaggtaccaagagtatagaactgagtatatcactactcagaaacgtgcttattttgatctccacaagaatgaagattggttaaaagacaagtaccacccaactaacttgttgtctgttatcgaaaggaggaatgaacgttgcaaggttatagcaaaggatttctttcttgatttgcagaatggaactctggacctaggccctggaataactgccggtgcagcaagtaaactaggtggtagtgatggaaattctgaggatgacatggacaatgacaagagaagaaagcatggcaaagattcctcaaaagcaactgattctctttctggtgcccccaaggctcatccagttagttctgaatcacgtcgagtccaagctgacatagagcaaactctagctctcgtgcgtaagcttgatgctgagaagggcattgatggcaatgtactgtcaagtggtgatcatgacaagtcagatgtagacaaatcacacataggatctatggggcctatagttataatcagaggtttaacgactgtcaaaggcctggaaggcgttgagctcctagacactattcttacctatttgtggcgtattcatggtgttgattactatggcacatcagagtcgcatgaggccaagggccttcgtcacgtgagagtagacagtaagacttctagcacatctgatgtcagttctgctgattgggagaagaagctggatactttctggcaggaaagactgaatggtcaggaccagctggtcatacttactgccaaggacaaaattgatgcagcagctgctgaagttttagaacctcttgtcaggaaaatcagggatgaaaagtatggatggaaatatggctgtggagccaagggctgtacaaagctttttcatgctcctgagtttgttcacaagcatttgaagctcaagcatccagaccttgtattagagtcaacgtcaaaagttcgagaggatctttattttcaaaattacatgaatgatcctaacgcaccaggtggaaccccagtgatgcaacagtctgcaccagacagaggaagacggagacctagcatggacagtcgtctgaaatttgaccgtggcagtaacagagaccatgataaagctgatagagatggagtcaggtatggtagaggtgaccactctccaagccgtgatgggcctgatgatcagatgtttgatggtttccgcggacggccctcgaatgctccttttgttgctgaattcccagctccaccgatattgatgccagtacctggtgctggtcccttgggcccatttgttcctgcacctccagagatagcgatgcatatgctgagagagcaagggccacctcctccttttgaaccaaatggcgcaccacatggcaatgctggaatgcttgggccaatgatgggtggcccagcaccgattatagctatgcctccaaatttccgccatgatcctcgccgcctgagaagttataacgacctcgatgctcctgatgaggaagtcactgtccttgactacagaagcttgtagggtccagcacctccagatacccgtagtcaagtttcccgttcccccattggtgaattgggcttttttctctttatgaaggcaaaagatggaaggttatgttcaattaaaccaatttttgggtcacctgtagtctgttagattctgttgtaacttgaatactctgtggatgcactgcggttgctacagttcttgtccaacttttttttgacacagtgctgtaataaataggcgtctgtttggaccctgaaaaaaaaaattgtagtgagagatacgtacttcgccaccttgttgcagtctgcaatgccccttgaacatttgctgcaatccgtgacttcgtcagaagtcagaacgaagacttggtactgggtgttgaacggtttacaaacaataaggtcaaaattcttatcaactcgc

SEQ ID NO: 8365 - DNA, 1800 bp, Zea mays
  misc_feature (1618)..(1619): n is a, c, g, or t
  misc_feature (1634)..(1634): n is a, c, g, or t
  misc_feature (1637)..(1637): n is a, c, g, or t
  misc_feature (1641)..(1641): n is a, c, g, or t
  misc_feature (1653)..(1654): n is a, c, g, or t
  misc_feature (1656)..(1656): n is a, c, g, or t
  misc_feature (1660)..(1660): n is a, c, g, or t
  misc_feature (1662)..(1662): n is a, c, g, or t
  misc_feature (1686)..(1686): n is a, c, g, or t
  misc_feature (1698)..(1698): n is a, c, g, or t
  misc_feature (1700)..(1700): n is a, c, g, or t
  misc_feature (1711)..(1711): n is a, c, g, or t
  misc_feature (1717)..(1717): n is a, c, g, or t
  misc_feature (1719)..(1719): n is a, c, g, or t
  misc_feature (1726)..(1726): n is a, c, g, or t
  misc_feature (1731)..(1731): n is a, c, g, or t
  misc_feature (1737)..(1737): n is a, c, g, or t
  misc_feature (1739)..(1739): n is a, c, g, or t
  misc_feature (1741)..(1741): n is a, c, g, or t
  misc_feature (1743)..(1744): n is a, c, g, or t
  misc_feature (1752)..(1753): n is a, c, g, or t
  misc_feature (1757)..(1760): n is a, c, g, or t
  misc_feature (1767)..(1768): n is a, c, g, or t
  misc_feature (1770)..(1770): n is a, c, g, or t
  misc_feature (1779)..(1779): n is a, c, g, or t
  misc_feature (1784)..(1784): n is a, c, g, or t
  misc_feature (1787)..(1787): n is a, c, g, or t
  misc_feature (1796)..(1796): n is a, c, g, or t
aggcaaaaacgaagattggctgaaagacaagtaccacccaactaacctattatctgttatcgaaaggaggaatgaacgttgcaaggttatagcaaaggatttctttcttgatttgcagaatggaactctggacctaggccctggaataactgggggtgcagcaagtaaaccaggtggtagtgatggaaattctgatgatgatacggacaatgacaagagaagaaagcatggcaaagattcctcaaagggaactgattctatttctggtgccctcaaggctcatccagttagttctgaatcacgccgagtccaagctgacatagagcaaactctagctcttgtgcgtaagcttgattctgagaagggcattgaggaaaatgtactgtcaagtggtgatcatgacaagtcagatgtagacaaatcacacataggatctatggggcctataattataatcagaggtttaacgactgtcaaaggcctggagggtgttgagctcctagacactattcttacctatttatggcgtattcatggtgttgattactatggcacgtcagagtcgcatgaggccaagggccttcgtcacgtgagagtagacagtaagacttctagcacatctgatgtcacccacgcgtacggggagaagaagctggatactttctggcaggaaagactgaatggtcaagacccactggtcatacttactgctaaggacaaaattgatgcagcagctgctgaagttttagaacctctcgtcaggaaaatcagggatgaaaaatatggatggaaatatggctgtggagccaagggctgtacaaaactttttcatgctcctgagtttgtccacaagcatttgaggctcaaacatccagaccttgtattggagtctacgtcaaaagttcgagaggatctttatttccaaaactacatgaaggaccctaatgcaccaggtggaaccccagtgatgcaactgtctgcaccagacagaggaagacggagacctagcatggacagtcgtctgaaatttgaccgtggcagtaacaaagaacatgataaagctgagagagatggaggcagatatggtagagacgatcactctccaagccgtgatgggcctgatgatcagatgtttgatggtttccgtggacggccctctaatgctccttttgttgctgaattcccccctccaccgatattgatgccagtacctggtgctggtcccctaggaccatttgttcctgcacctccagagatagcgatgcatatgctgagagagcaagggccacctcctccgtttgaaccaaatggcgcaccacatggcagcacaggaatgctcgggccaatgctgggtggttcagcaccgattatagctatgcctccgaatttccgccatgaccctcgccgtctgagaagttataacgacctcgatgcccctgatgaggaagttactgtccttgactacagaagcttgtagggtccagcatccattggagatttgggctgtttcctctttatatgaaggggaaaaaaggaaggttatggacaagtaaatgaattttttgggcgcctgtgtatcctgtagatttgttgaacttgaatagccgaatttctattnntttcgcgttcgtccnacntatncgggaatgcgcnngntgtncnttgtggccacttttttgacccacntgtgttaaaaancntggtccccccnttttgnanaatatangggtngggggncntnannaaaataannattnnnncccgggnnancatttttangggcnccngggggttcntttt

SEQ ID NO: 8366 - DNA, 2151 bp, Zea mays
gggtatctcgtttgttatcccgtacccactctggcctactcaatccaccaaaagtgcagggccccaaacggccaaacacaaaagcgagagcaaagcaagcttcggcctcacctccagcggcaggtggtgctgcggagcttctcctcgccctagatcccgcgcacccaacgccagatcagagatcagggcgcgccggccgtctccattgcccggcggatcctgcgatgcgagctggaccgagagggaggagcgagggagcgcgcgggtagagaaggcggggcggggggaggaaggaaggaaggagcgccggccggagcagacgtcccctcggggccctcggtcggatgagatcgacgatgaaggcgcagcacgccaacgggcgggggagcaggagccccttcctgacgtcctacgcgctcacgctcgccttcatcaccttcgtctccgtgctctactttaaggacttctcctccacgctgcaccgccccttcctccaccgcccccgccgccacgccgccccagacaaaagccaggcggggcgccgcgcggcggcggagcggctgccgttcgcggtgggcgcggcgccggcggggtgtgacgtcgggcgaggggagtgggtgtacgacgacgcggcgcggccgtggtaccaggaggaggagtgcccctacatccagccgcagctcacgtgccaggcgcacggccgccccgaccgggcgtaccagcactggcggtggcagccgcgcgggtgctcgctgcccagcttcaatgcaactctaatgctagagatgttgcggggtaaacgaatgttgtttgttggagattctctgaaccgtgggcaatatgtatctttggtttgcctcctgcaccgaatcatccctgagagctccaagtcaatggagacagttgattcccttacagttttcaaagcaaaggactacaatgccaccattgagttctattgggctccctttctggccgagtcgaattcggatgatgctgttgtgcaccggatcgcggatcggattgtaagagggacatccattgagaagcatgccaagttttggaagggggctgacatcttggtattcaacacctacctatggtggatgactggacaaaagatgaagattttgcggaactccttcgaagataaaagcaaggatatcatagaaatggaaacggaggaagcctatgagatggtacttaatgctgtgctgaaatgggtggagagcaacatgaaccccaggacatcaagaacattctttgtcactatgtcacccacccacacaaggagcagagactggggcgatgatactgacgggaactgctacaaccagacagcccccatcgaggacctgtcctactgggggccagacaccagcaagggcctgatgcgcgtgatcggagaagtgttcagcgcgtctaagtccaggatccccgtgggggttgtgaacatcacccagctctccgagtacaggaaggacgcgcacacccagatatacaagaagcagtggaacccgctgaccccggagcaggtcgcggaccctaagagctacgcggactgcacgcactggtgcctgccggggctccaggacacgtggaacgagctgctctactccaagctctttttcccctgagttaaagggtttgagttgcgaggtgcacggtgaagttggggtctctctctggcattattggcacgctgcacaatactagttagcttggcataggcccagcagtctgaagatggatgctctgcctctgctgcggtagtttctcgggggcaaaccttccacgcggcatggcatggtattgttgatgtacgattcattcgttggaaaacctggacgtgagtgctggaattgcaccatctggccttttctgtacatgcctgatgtaacggtggtgttgtgtttccccaccaccacctctcttttcacgatgatgacgcagtgcatgtataattgtatgggttaatgacgcagtgcatgccttgcggagtgggccggtagacaaacatttcggcggctggtcacttggtcagtgacccgttgatattattattattattggatctaatgcaacaaccagttctggtgttggtgtccaaaaagaaaaaaaaaaaaaaaaaaaaaaaaaaaaaaaaaaaaa

SEQ ID NO: 8367 - DNA, 2056 bp, Zea mays
gagcaagcaagcttcggcctcacctccagcggcaggtggtgctgcggagcttctcctcgccctagatcccgcgcacccaacgccagatcagagatcagggcgcgccggccgtctccattgccgggcggatcctgcgatgcgagctggaccgagagggaggagcgagggagcgcgcgggtagagaaggcggggcggggggaggaaggaaggaaggaaggagcgccggccggagcagacgtcccctcggggccctcggtcggatgagatcgacgatgaaggcgcagcacgccaacgggcgggggagcaggagccccttcctgacgtcctacgcgctcacgctcgccttcatcaccttcgtctccgtgctctactttaaggacttctcctccacgctgcaccgccccttcctccaccgcccccgccgccacgccgccccagacaaaagccaggcggggcgccgcgcggcggcggagcggctgccgttcgcggtgggcgcggcgccggcggggtgtgacgtccggcgaggggagtgggtgtacgacgacgcggcgcggccgtggtaccaggaggaggagtgcccctacatccagccgcagctcacgtgccaggcgcacggccgccccgaccgggcgtaccagcactggcggtggcagccgcgcgggtgctcgctgcccagcttcaatgcaactctaatgctagagatgttgcggggtaaacgaatgttgtttgttggagattctctgaaccgtgggcaatatgtatctttggtttgcctcctgcaccgaatcatccctgagagctccaagtcaatggagacagttgattcccttacagttttcaaagcaaaggactacaatgccaccattgagttctactgggctccctttctggccgagtcgaattcggatgatgctgttgtgcaccggatcgcggatcggatcgtaagagggacatccattgagaagcatgccaagttttggaagggggctgacatcttggtattcaacacctacctatggtggatgactggacaaaagatgaagattttgcggaactccttcgaagataaaagcaaggatatcatagagatggaaacggaggaagcctatgagatggtacttaatgctgtgctgaaatgggtggagagcaacatgaaccccaggacatcaagaacattctttgtcactatgtcacccacccacacaaggagcagagactggggcgatgatactgacgggaactgctacaaccagacagcccccatcgaggacctgtcctactgggggccagacaccagcaagggcctgatgcgcgtgatcggagaagtgttcagcgcgtctaagtccaggatccccgtgggggttgtgaacatcacccagctctccgagtacaggaaggacgcgcacacccagatatacaagaagcagtggaacccgctgaccccggagcaggtcgcggaccctaagagctacgcggactgcacgcactggtgcctgccggggctccaggacacgtggaacgagctgctctactccaagctctttttcccctgagttaaaggtttgagttgcgaggtgcacggtgaagttggggtctctctctggcattggcacgctgcacaatactagttagcttggcattggcccagcagtctgaagatggatgctctgctgcggtatggcatggcatggtattgttgatgtacgattcattcgttggaaaacctggacgtgagtgctggaattgcaccatctggccttttctgtacatgcctgatgtaacggtggtgttgtgtttccccaccaccacctctcttttcacgatgatgacacagtgcatgaatagttgtatggggtaatgtgataatacatactgtaattctctggttccttcccttcttctctgttggcccccccttttgttgggcctacgctagcatcaaatctgtctgataggctgggccttgcggagtgggccggtagacaaacatttcggcggctggtcacttggtcagtgacccgttgatattattattattattggatctaattgcaac

SEQ ID NO: 8368 - DNA, 2677 bp, Zea mays
gcaggagacagaggggctccccccccacccccgagcccaaacgcagctagctccccattccacccaagctcccgcagccagatgctctcccccgctcgagccccaccgccgccgcccgtccccgccgccgggtagaccgcccgatccgacggcgcccgccgcacccatgggccgcggcggcgcgcgcgcggcccccgccgccgcggtgccgccctggcacgcgctcccggacgaggtctgggagcacgccttctccttcctccccgcggactcggaccggggcgccgccgcgtgcgcctgccacgcctggctccgcttcgagcgccgctcgcgccgccgccttgccgtcgccaactgctacgccgcgtccccgcgcgacgccgtcgagcgcttccccgccgtccgcgccgtcgaggtcaagggcaagccccacttcgccgacttcggcctcgttccgcccgcctggggcgccgacgccgcgccctgggtcgccgccgccgccgccggctggccgctgctcgaggagattagctttaagcgcatggtcgtcaccgacgactgcctcgagatgatcgcggcctccttcaggaacttccaggtgctgcgcctcgtctcctgcgagggcttcagtacagccggcctcgctgccattgccgctgcttgcagaaatctaagagaacttgaccttcaggagaatgagattgaggattgctctattcattggctcagtctatttccagtatctttcacttctttggtaactctaaatttttcatgcctagagggggatgtcaatatcactgtacttgaacaattagtaaccagatgcagcaacctcaagactctcaagctcaacaatgctatacctcttgacaagcttgctaacctccttcgcaaggctcctcagattgtagaactcggaacaggaagattctctgcagattaccatccggatctcttttcgaagcttgaagcagcatttgctggctgtaaaagcttaagaaggctctctggggcttgggatgccgttccagaatacctgccagcattttattgtgtatgcgaaggcctcacatcactaaatctgagctatgctactgtacgaggccctgaactgattaaattcattagcagatgcaaaaatttgcaactcttatgggtgatggacttgattgaagaccatggtcttgctgttgtggcatcgtcttgtaacaaactgcaggagttgcgggttttcccttctgctcctttcgaagcagctgagcaggtctctttgactgaaagaggtcttgttgatgtatctgccagttgcccaatgctggagtcagtcctctacttttgcagacggatgaccaacgaggcccttattaccatcgcgaagaaccggcccaacttcacttgcttccgcctatgcatcattgagcctcacacaccagattacattacacaccagcctcttgatgcaggttttagtgccattgtggaatcatgcaagggcctcaggcggctttctgtttcaggccttctcacggacagtgtatttaaatccatcggggcacatgctgaccgtcttgagatgctctcgattgccttcgccgggaacagtgatttgggcctccattacatcctatcgggctgcaagagcttgaagaagctagagattagggactgcccatttggtgacaagcccttgctggcaaacgctgccaagctggagacaatgcgatccctttggatgtcgacgtgctcaatgaccttgggcgcatgccggcagcttgcgcgcaagatgccccgtcttagtgtggaggtcatgaatgatcctcgacggggattccccttggactctctaacagatgagagccctgttgagacgttgtatgtctaccggacaatttcaggtccaaggtccgacacaccagcttgtgtccagattctctaaggggcagctgtggtctacaaaggtactatggaagcatccattttcaatcacatcatgtaccttcaacaccttactagcataacctggatcgtctccttgaagtagcaaggctggtgacctcggtaatcctgtcataatctctgcttagctgtacaactgtttctgggagtttagggtgagagactcagggtccctttcaggtgttaataactgtagggaggacactcgatgagttacaggaactactagatagcgtcttgaggaaacttgggtttgttttcttagcgtgcctagttcttttcatgtataaaaaaatatgggatcattccaatgctgccacaatgtactgtactattggaacaattgtacttggagcctctacttttttgagttttgaccccctccccaccccccccccactgattatgggttgctgttgctcccgcctgtgatttgtgaatgctatataattcaagcttgtacgtggctctgccttcatgtagcgcctccctcgttttggagaacggtaacttcactggttgtagtctctacccttatcaaggcttaggcatctgaactgctggaagtctatgcccccttgaccctggatgatctgaaggtatagtttgcttctggttctggccttctactttgacttcgaatcacttgaattgtaagaggtgttctccagcggtaccgggctctaccactagggattagggaaggcataacctatgt

SEQ ID NO: 8369 - DNA, 1656 bp, Zea mays
atgttaatttctggctgtgcgctgtgtcgcattttgttgcaataatttgactactttctttgggtgatgtcctactacttgatgtcatgttggtagataatgtttggtagctgtcgatgacctgaatcaggtcgattatgtttactttccttgtatgtcggtgcttgattgcttttgcgaccgaaacgtacggttgtatttctgttatgcaaataatagaaatggaggttcttcgtttaaaaaaaaataattagtaccgaaagatagagttttgcatttgcttctataataattttcaaaaaaatataaatattataaaaagtttttaaaattctaattaaatttgagaagctttaactgtagatgaagacgtgtataagaatgtcttgcactgtttataaattagggtttgaaatagaagttgagatagaaagtgaaacgggtgttcgagatagtcttataacttcaattatgacagcggccgccggccagcctgtgtctctctgagtggctcaccgcactgcgccccgtttcagagtggtagcagtgctgcgactgcgtgcacagggtatatagatagataggagtacactgcgtaggagacagcaagagggcgaggctgtgtgtgagagagggagaggcagagaacattcggcagtgtgagaatcggaatcggagtcggagatggcttggaatggccgcttcggcaacgacgaggaggggagcggccttgagctcagccttagcctcccgggctacttctccggatcaccaacccaagctgcagcaggtttcgaggacaaagcagacggcggctctgctgctgctgctgctgctgcgcgagcaaagggaagcaatggcttcaaggccaggccggcggcagctgctccggtcgtgggatggccgccagtgcgcgcgttccggcggaacctcgcctcggcgtcctccaagccgtcccgcgatccgccaccaagccacagaggaaacgagtccgcgagcgtcggcgccggcggcaaggccgtcgagggcggcaacaagggcctgttcgtcaaggtcaacatggacggcgtgcccatcggccggaagctcgacctgggcggccacgccggctacgacacgctaaccgccgccgtcgaccacctcttccgcggcctcctctccgctcaaacgtcgggaccaggcggcgagcggcaggcggtcgcggggatcctgaacggtggcggcgagtacacgctggtgtacgaggacgacgagggagaccagatgctggtcggggacgtgccgtggcagatgttcgccgccaccgccaggcgtctgcgcgtgctgcggagctccgatctcaacccctcgtcgctaagggcagctaccaggaagagagctgcagcttagtgcttcgctggcgtaccctggagtctcaactctgaacattttgcggccttttcggagggccaccaatgtaaaattgaagcggtttttcgtggattttagttaccattaccatcatgtatgtgatcaagtagggaagcaggaatctagaggtgatgagcggtgttggtagaatcacgtaatttagtgctaggaccagcagtgtctcaacttttctgaaagtctaacaaggtgtcttggcgctggagtgtatgaaaaaaaaaaaaaaaa

SEQ ID NO: 8370 - DNA, 1831 bp, Zea mays
ggatttaaggagccaatcatcctctcttatcatggatgcatggttgaggattcgttgtaacctaccgaacacagctgacgagatgacccatatgcagtgatagcatacatcacaacggcaccagtactgcggtgtttattatatattagcccagtcggctgttctcccttgtcatgcatccccaattaacataaactagctagctaggaacgtggccaaaatgcattgctacatataaacatgcgcacgcggctgggccggagacaaatcatacgtgtagtgatagccatgaggtctcttctccacaccaccaatagcagtagcccgccccctggcagcagcaggaagcagcagcactgcggcagcagatgcttcgtcgtgtcccttctcctggtcctgctagctcttgtagcctcggacgtgtatctcagcttcccaaaccgacgacgggttcttccattgttcccccagcagcttttgtctcgcagacagcagcgaggcggcgagggcggctgtgacattttcaggggcgagtgggtgccggacccggacgcgccctactacaccaacgacacctgcaaggtgatccacgaacactacgactgcatggggtacggcaagccggacctgggctttgtcaactggaggtggcagcctgacggctgcgaccttccccgcttcaacccatggcgcttcctccacatgatgaggggcaagacccttgccttcgttggcgactccctcggcaggaaccacaaggactcgctcatctgcctcttgaccacggtgagtcgtcgtcgttcatctcgatcggccatccgccatccatgcggcgcgctatagatcgctagctagctgcttgcttattagacgatcatgcgtgatgcgtgcatatgcatgtccatgggatgcaggtcgcggagcctacgacgagctggccgagcagcaagcacaccgtgtactactacgccgactacaacttcaccgtggcccacttctgggcgccgtaccttgtccggcacgagcagatcgacgaggacggcccagcgcacacgggcgtctggaacctctacctggacgagccagacggcgtgtgggcggcgcacgtcgcggagttcgactacgccgtcgtgtccgcgtccagcggggccgaccgcccctccatgctgtacgaggccggccggctcgtcggctgccactactgccggctgcccaacgtcaccgacctcacgctgcgctacgcgctgcgcatggccacgcgggccgcgctgcgggcgctgtccggcgccgacggccgcttccgcggcacggccctgctgcgcaccgtggacccgtcgcagtacgagggcggtgagtggaacaaggacggcaactgcgtccggacggcgccgttccgtcgcggccagaacgcggtccagggcctcgagcgtgagttccgcacgctgcagctggaggagttcgcgtcggcggagaaggcggcgacggacggtggcggtaaggtgaggatgctgctgatggacaccacggaagccatgatactgcgtgcggacgcgcacccgagcaagtaccgggggtggacgccggagaagcacttcaccctgcacaacgactgcgtgcactggtgcctgcccggggccattgatacgtggaacgacatgctgcttcatatgttgaaatgatcatcagtaatttgaattaataatgccaaaccagtgtggctgtgtagtgtgtacaatacggtgctccctctgttgacaagtatatgatgactttgacgttttttcttcaaaaaataagaacaaccaaatgtgtatatacatacaaaaaacta

SEQ ID NO: 8371 - DNA, 1398 bp, Zea mays
ggtcaaatcatacgtgtagtgatagccatgaggtctcttctccacaccaccaatagcagtagcccgccccctggcagcagcaggaagcagcagcactgcggcagcagatgcttcgtcgtatcccttctcctggtcctgctagctcttgtagcctcggacgtgtatctcagcttcccaaaccgacgacgggttcttccattgttcccccagcagcttttgtctcgcagacagcagcgaggcggcgagggcggctgtgacattttcaggggcgagtgggtgccggacccggacgcgccctactacaccaacgacacctgcaaggtgatccacgagcactacgactgtatggggtacggcaagccggacctgggctttgtcaactggaggtggcagcctgacggctgcgaccttccccgcttcaacccatggcgcttcctccacatgatgaggggcaagacccttgccttcgttggcgactccctcggcaggaaccacaaggactcgctcatctgcctcttgaccacagtcgcggagcctacgacgagctggccgagcagcaagcacaccgtgtactactacgccgactacaacttcaccgtggcccacttctgggcgccgtaccttgtccggcacgagcagatcgacgaggacgggccagcgcacacgggcgtctggaacctctacctggacgagccggacggcgtgtgggcggcgcacgtcgcggagttcgactacgccgtcgtgtccgcgtccagctggttctaccgcccctccatgctgtacgaggccggccggctcgtcggctgccactactgccggctgcccaacgtcaccgacctcacgctgcgctacgcgctgcgcatggccacgcgggccgcgctgcgggcgctgtccggcgccgacggccgcttccgcggcacggccctgctgcgcaccgtggacccgtcgcagtacgagggcggggagtggaacgaggacggcaactgcatccggacggcgccgttccggcgtggccagaacgcggtccagggcctcgagcgtgagttccgcacgctgcagctggaggagttcgcgtcggtggcgaaggcggcgacggacagtggcggtaaggtgaggatgctgctgatggacaccacggaagccatgatactgcgtgcggacgcgcacccgagcaagtaccgggggtggacgccggagaagcacttcaccctgcacaacgactgcgtgcactggtgcctgcccggggccattgatgcgtggaacgacatgctgcttcatatgttgaaatgatcatcagtaattttaattaataatgccaaaccagtgtggctgtgtagtgtgtacaatatggtgctccctccgttgacaagtatatcatgactttgacgttttttcttc

SEQ ID NO: 8372 - DNA, 2099 bp, Zea mays
ggatttcacgccgtaagtacttttttttacccggcccctattctccatcggataactatttcccgcatcataatctcgctgccccttccccgccccccaccccgcgtctgcccctgccctgttacctcgcgcggttagctgcgccagcgaggctcgtatcgccctcctcctcgcgccgcttacttctattctattttgcccggtcccataaattcgaatccaaacgcgcgaccgtcgccgctgcggccgtgggaaaggaaacacagaaaaaggacaacgccgtcgtctcttcctcgcaccagcttcccgctagggtttcccctcttctcggtggaggcgccgcgcctccgggacctggatcctatcaggtccacgctgatgccagcgaggtgcagccgtctttgattcccctcctgcaactgcatcctcatgccgaccatcacgcactacgtgctggatcccttcctcgagacagggtcgcctgcgcaggccgagaaagccacgcccaagccgccgccctcgcctccagacaaggccacacctgtaccggtggctcctattagggcacagacgtcgccggcatcactctatgccacgcctgagagcaccaccttgcccgactcaccttcctcgttccccgggacctggtcgccgtacattatcaaccataagaggcggggggcctcccttgccaagaccgttcctcagggtgatgttggaagtcagggcagccagccaaagctcccagtgatactgcctgctctgcctaaagggggtgaacccactgcagtggaggagcctgagtttgcgtttcagcaatcagggaatgaccaagctgaaggtgacagtggtgtggacgaggcccccatcaatggaaaaaatgaaatgctgctgaagggcaagggatctgtgacggccaaaaatgagcacgagcagcctgagtttgagtttcaccgtggaaatcttgaagcactagtgaggcctgttaatgttggaaggcctttgattggcggagcacccaaaaatgatgagagtgacaccttccttgaacttcaggattccatgagtgtggctagcaatactgaaactgatgatgctggtacccaagagtggtggtggaaaccgagttcccctcttgggatctctgttggcacaccctgtgctgaattctatgatgcatttgaagaaatatcaagtgatggtggaactaggtcttcacgggccatggatgatgacctccgtgaaatgaggttaagcctgttgaccgaaattgagaggaggaagcaagcagaagaagcacttgagatatggcagaaagaatggaagaagctgagtcaccacctatcacatgttgccttgtcacttccatctccaagtatagctgaggatactgatgattcaagcatcgatcctggagctgagttgtgccagcaaataactgtttcacaacttgtagccgctgctatttcccaggattttgctcgtgctgaagttgaatcagagatggaaaccgtgattgccgcaaagaacttcgagattgcaaggctgtcggatagggtccagtacctgcccgcgccgccccgcgaaatgtcccaaagaaaccaagaagctatcgagacgtcaaggcaacaacgcaaggagcgtaagaagcgacagaagtggttctggggttcagttgggcttgcagtcacccttggtgccacggccattgcctggtcttatctaccttcatcgcagccccgagctagtgcagattcaaatagtaccgccagtgactagagctaggatgaagatatctcatttcagaagcctaacaaacctctaactatactcctagaggagaaaaaaaaacgttgtataagttctcttttggtgatcgtccatgatcgctacaatcttcatttgctgctttgtatgtaaaaatgttgggtgggccatctccgttcaggattggctccattccaatcaccgtaaatctctgcatagatgattcatggttgagcaaataatacaaagggatgtggatatggttagtaatccatgcccaccgaccccactccaggagttgattttgcaaaaaaaaaaaaaaaaaagcggcc

SEQ ID NO: 8373 - DNA, 2077 bp, Zea mays
gccggccgggtcgggaaaaactggccccagtcttttccctgtttcctcgtccggagcgaggcgaggggtgacgcaaccgagcgccgccaaccgcgaccgccttcctcacctgtgtcacctccgccgccatcctcacttcgatcgcctccgccgtcatcctcagcttgtcctgtcgcactgcttgtgccgcaccagcttgttgccttccgcgcccggctgcgccagccaggctcgtccggccctcgcgccgcttacttctattttgcccggccccatagaattcgaaccgcaaatgagacaggcgctactgcagccgtgggaaaggaaacgcaaaacaacgccaacgccgtcttctcttcctggaggcgggcctgggaaggaggtggagcgcagctggctccgctagggtttcccctgttctcggtggaggcgccgcgcctccgggacacgggctgcgtcaggtgactgctgcaggctcgttgatgcaagggaggtcaagccgtctgtgattctcttcctgaagttctatcccgatgccgtccatcacgcactacgtgctggatcgcctcctagagacacggtcgcctgttcatgtccagaaggtggttcccaagcctccgcccccgcctcctgacaaggccacaccggtgccagtgtctactgccaggacacggtcgtcgctggcatcactctatgccacgcctgagaacaccaccctgccggacttgccttcctcgttcccgggaacctggtcgccatacctcatcaaccataagaggcggggagcctcccttgccaggaccttctctcagggtgatgctgggagggaggtcagccagccaaacctccctgtgatgctgcctgctttgccgagagggtgtgaacccactcaagtccaggagcccgagtttgtgtttcagcaagcaggcaatggtcaagctgaaggtgaaagtgctgtagaagaggctttgaatggcaaaagtgtaatgctacagaaaggcaaggggtctgttatagctgaaatagagcaggagcagcctgagtttgagttttgtcaaagtcttgaagcattagtgaagcctgttaatgttagaaggcctttgaatggtgaggcacccaaaatttgtgagagtgacacctttgaatggcggaagcctagttcacctcttggaacctctgttggtacaccaggtgcagaattctacgatgcatttgaagaaatatccagtgacggtggaactcggtcatcgcgaggcatggatgatgacctccgtgaaatgaggttaagtctgttgatggaaattgagaggaggacacaaacagaagaagcacttgagatctggcaacaggaatggaagaacctgagtcaccacctatctcttgttgccttatcactaccatctccaagtatagctgaggattctgattgtttaaaggtggatcctggagctgagttgtgccagcaaataactgtttcacaacttgtggctgctgctattgctcggggttttgctcgtgctgaagttgaatcagagatggaaactatgattgcgacaaagaactttgagattggaaggctgtcggatagggtccagtactatgaagctgcaaacagggaaatgtctcaaagaaaccaagaagctatcgagatgtcaaggcaacaacgcaaggggcgtaagaagcgacagaagtggttctgggcttcagttgggcttgcagtcacccttggcgccacagccattgcctggtcttacgtaactccgtcgcagccccaggccagtgcagatccaagtagtgctgccagccagtaagctactaagtaagctaggatgaagacatactcctcgttccagaagcctaacaaagatctagctatactcctatagagggaaaaaaatgctgtataagttttctctttggtgatcggccgtgatcgccgccgcaatcttgatctgtcgcttcgtttgtagaagcgttgtatggcccatctcgtagatggttgagcaaataacacaatggatgtgggcgtgtggctatggttagtgaaccatgcccgtagcccactcaagcggagttt

SEQ ID NO: 8374 - DNA, 1491 bp, Zea mays
gcacgagaccattacctagaacatcctaatcaaaaactggaccatcatctatcgtcaatcgtcgcgactcgcgacgaggcgcgccttctccctccgcttccgctccgtttggtttccaccctttccgcgtactccacgtcgccttctcccatctcctctttcctacccaccgccgccgctccagggccccgaaatgtcggacgaaggcggcaccggcgagccgctcagcgacagccagaagcgggagatcgccgtctggttcctctccaacgcacccgccggcgagatccactacgtcgccaaagatgtgcgcgcgctgctaggggacgacgcggtgtacgaggccgccgccgcggaggccttcccggagtacaacaaggcccgcctcgtgtccctcgagctccccgaccgcagtggcgacataatcatcacaacttatggggagattgacaagaacaattatctggaccccaggactgcgcaagttgctactatagatcatatgaaacagacttgtacgaaactgaggcccgctgaagatgaggagcttccatcggcttacattgaagagtttaggtgtgctttagatgttgaattgtcaaaatatgttgctgaagcttatcccaaagggacctgtgccgtttattgtactagtggaaaggatatagagggaccaggagcagatttcagtttcgcagcagttatttctgctactaagcgtagcccacagaacttttgcaatggcagttggcgttcaatttggactatggaattcaattatgagttgcagtttgttgatattaaaggaaatatacaggtagatgctcactattttgaagagggaaatgtccagctggatactaacattgatcgcaaggactccaccataatgcagtcacctgacgactgtgcagtttcaataactagcatcattcgacatcacgagtctgaatatttgtcatctctcgaggaatcatacttaaatttgtctgatgcaactttcaaggatcttcggagaaaacttccagtgacccgtactcttttcccatggcataacacactggcagtcagtcttacgagagaccttgccaatcaattagcgcttggaaaatgaagtctttgcatgccatgtcaccggatggcttcaaatgtttttttaatatccatgtgctgttctgtagtaatcagcattcttcatctctgagcttcccaatcccattgtaaatcaagaacacgtttttttttttgtggagatgtaaaagatttcgccttccctagggtttctttggatgccgttaggaaccaaacagcctcttactgacgggtgtgaatcatatgtttcttcatcaatgctccaatctgatggattattgtaggtgttctgtatgaggttaaaaacaaggcccattcaaaaggaatgtgtgagaaactatgctttggataaaaaaaaaaaaaaaaaaaaaaaaaaactcgagggggggcccggtaccc

SEQ ID NO: 8375 - DNA, 2190 bp, Zea mays
tttttccctctcctctctcctccgctcctccgctcctccgctccggtctccgccctccctcacctctccgtcccaaaaagggcaacgaaatccagacaccgctccccatctccccttccttcctttcctactcccacactcccccaccctccactagtactagtactagtaccacaaccaccccaccgggaaaaaacccaacaaggggtagggccgccgccgccgccagcgccgccgtgcagatcgcggccggatctacggcgctggggcacgggggtccccggatcgacgacgcctccgccgagggttcggatggctatgcgaaaagaaaaccctgtgcttaatgcttgtcaagcatccaatggccggatcacgcgagctcaagctgctgcaaatcgtcgaagctttggagctttcccttctgttccattgcctgcaaaaaccgaacgaaaacagactgcacaagggaaggcaaaacgaggttcttcatatgacaacaccagtgcaagcgttgcactttcaggcccccagcctaaaaggcgcacagtactcagggatgtgaccaatttgagcaatgctaactctaacaaaagttttgctgctgcaccgaagcttcagacaaagccctctctaaggactggaagaaccgtgagcaaaagcaagccgtgcgcaaaaaagattcctaaaaaaccaccaccagctggtaatggaagtgcattgactaatgttttgaacattgctgaagaaacacaagcggagaagattttggcagagagagtggaacccgttctgttgcttgagaacagggggccactgtcattgcagaatgttgaaaggaacagggacagtgcttgtcatgaggtattctttgaggaaagaaacctcagggataaatgtgaaccttctgtgtcaaagaatggggactcttatgtgttagacattgtagatatcgacaaagataatggcaatcctcaaatgtgtgcttcctacgttgtggagatatactcaaacctaatggcttcagagcttatgagaagaccaagtccaaattacatggagggtttgcaacgggacatcacaaagggcatgagagaaatactcattgattggcttgtggaggtttctgaagaatacaagcttgttccagacacgctgtacctaactgtataccttattgaccggtttctttctcggaactacattgaaagacagagactacaacttgtgggaataacaagcatgcttgttgcctcgaaatatgaagagatatgtgctcctcgagtagaagagttctgtttcataaccgacaatacatacacaaaagcagaggtgctgaaaatggagagccagctgctgaatgacctgggatttaacctttctgttccaacaacaaaaacatttctcaggagattccttagagcggcacaagcatctcgtaaaactccttctatgactttaggatttctggccaattatctcgcggagttgactttgaccgaatatgagttcttgaaatttcttccgtcgttggtggcagcatcggccgtgtttcttgctagatggacgcttgaccaatccgatctcccatggaaccagactctagagcactacacgtcttacaaatgctctgacattcaattgtgtgtctgtgctctacgggaactccagcataacaccagtaactgccctcttaacgccatccgcgagaagtacaggcatcaaaagtttgaatgcgtagcgaacctaacttcaccggagttccctcggtcgttcttcagctgacacgccaatggcaccgattgatgagcaacgttagcagcagccgtagcgcaggttgcgttaacattattgtagcatccccttttaccccccaatgtctgatttggatgtgtgttgttatcgagctgctgtgtcccggcctggcctttttcgagtcgcaagtgagatgaagaaggacagagagatggctccttggcttttcttttgtttgtttgacgtaaaaggttcacccggttgtaaacaacactgtgtgtagggctctttgcttgggctgttgttaattaactgtaaggggagatggtccggctggcttgtatgacgacaaacgacgggatgatgtttttgttgacacaattcgttcattggtagcttcggaatggaaattagtttattgccaaaaattactccggg

SEQ ID NO: 8376 - DNA, 6018 bp, Zea mays
  misc_feature (41)..(41): n is a, c, g, or t
  misc_feature (4773)..(4773): n is a, c, g, or t
tgcagcattggctggagagtggagaccaccaccaccacagnggctgtccactagcagtctaccactaactggttttctcaaatctcttcgctctcagatagatgatctaaaatttcaggggaggttaacgatggatggagtctaccatctcgagttcacgccctctgctcctttcgcgttgcttgacgtgggtgagcccgtgttcctagcgacccccccccctctggccacaagaggcctttcttccccgtgggagcgccccaggtttttcctggtttcggatggtccgtttggggtgaaggttttcgtgaaggaatttcccgagacacggtgacgctggctggacctgggccgtaacgctcgcttgtcacctacctatactgcatacgtgtagatagatatggacgcaaggcgagcctcgaagccttcgttttcagctccttgtccttttcacagatgctgctcgtggctccctcatggaacatggatccgtgctgcctggtgaaacgtgaacacatgcatgggagcctttggagacctcttctcgccaacttttcagatttttggcaccaaaaaaaacctttttaaattgtttcgaggatctttgccaccgccaacgaccatatagttttttccccctgcgtgatccacttccactgtctgaattgctttccagtttttttactagtgtaaaagctttacgatcctgagcttttcagattacggtgattcctaaaaggccagatggcaccaaccgtccctatcgtttcttgttcagaaaaggcagtttgcaaaaactgtgccttgcctagctgttctagccactagattaccgcgccgccatgcatgttttgtaacgctgatcgccgctgcataccgctcgtcgtctccaggatatagcgggaaggagatgagaggtgaggagcacagggcagcgctgagacagaagagactcaagaaggccaagtgcttcaagtggagaccaagcaagggcgacatggatagcaaagtggaggcggggggagcggggtctggtcaggtctgcgatgacgcagtgctctgctcgctgtctacggccagcttcagtggcctggttagctggcagagagtgaggacccttgggaaggtatctttcctgccttgttcgatcggttgctttctgctcatcatgcatgcccatctttgagttctttttttttttttgtatttcgaaggtggctgaggggtgtgatgctgccgatcctccggttccaagaaaattaagatcaggtactggttaaccgcactatttatccattcttccgcatggcctgaggcccagagcaaaggggtttcggcttcctcgtccattgttatttttaattacagtttgctcgacaaataataccattaattttaagctgaatttttttgtgagctaaaattgaaattaacaatatggtttaacgctgggttgaagaaacttgttaattttgttattgttagacagggaacagttgctagttgtcacctaaaaccttggtgtttatctgtttatgtgtttgtgggtacttgaatttcttttcaagtgttctgttgtatccacacatggcatcatgtaactaattaatactaataagcagttgattgtgagttgcgacgttggcatattggcatgagtaatttaatctgaggtttttaagctaagatgataattcagctcttggcatcctactttcagccataaacaagcgagctggtcgatttgcttctgcgccatcacgccatgtcaaaaagaggcgtcatctttcggctatcagtgctcaaatttcttctgtaggccaggaaacaagatccaatgggagctcggtaaatattttttccctgctgctacaatttcctcatcatctcttgacgcgagactgagaactggtagtgagatgcacatcctgtttacagttatttacagaacaagaggaagcaattgctgatgttctgctgtccctatcccaagtaccctctcacagcgaggtcacagccgacaaggctgtagcagatagttcaaacacgaatgacgcttcaacttctttttcaaaaggtttgccccgcactctttgagtcttttctgattatcatactaaaaggcaagcattatgactttagaatatgttcatagtctgttgtgtgatctcctatgcaggacctactaaggaggatgaccaaacagccgagctgccaagcgctgctaacgagctggctagccaatgcgcctgcataaataaagcggtggagcaaagcaacatcgttccaaatgcagatccagtggctgctgctgcaaatcaatccagcaacagtatcccacttctgtcagcgaatgagcaaatgcaggacctttctatggaaactgctgtgaatttgccaagcccatctaaagacacctccattaacaggtagagaactgctcgcggcagccggcagccctttggtcgctaatcttgttcttaaacttcattctcatgcttatttctgtttgtagcgctcaaaagcaccatgaactgcagtttgatgatagcaaatgtcaccctgcacagaagccagaggctcctctttggctggtactacacttttatctgtctgaaagtacaggtgttactacaccttcgtttggtcctaatgcttcatggttccctcaaatatgtttttttttctacaggtaaattctgatcaatctgagggtgtgctgctacatgagagggagaaggccaagaacaacagtgcacaaggtactcctacagatccagaacgcgccatgacagctgaagttcattatactaaatacttgttcttgctacctatctgctaatatgtttctacttctatcagaaattgtgcctctggtccagactctgttgccttgtaccccagctgggtacttagtaaagtaagtttttgttcaaactagttgtgtattttgttttcttatgaagacattgttagttgggttgttaagaagatggtaaatgcatgtctgttttcagaccctcttcaagcaaactggcagctcccgccaatacaatttctgaatccgctaacttcaccacgcctggaaatcagaacaaggcatgttctatctactccactcttaacattcaacaagtggaataggaatgtcctctggttcatcgttaaaataataaaattcatcttatcgaagacggctgtgctgcggatgttttccctggccaagctcctgagaaaactctgaacgtttatttgacactgttatctgcagccccccgtgctcagaaacgtcggcgcgccgaaggcatggaagaggagcatcacccacgtgtacgtgagccacgtgatccagatgcacgtgaacaaggagaaggccgccgcgtcgtcgtcgttacaaagccaagcgaggcctgaggagaggctcctcgcccgctgccccaggcctccgaacggctcgtccaccacctcgcacaaggccgccgccgctcgggacgagaggttgtacacggtgcacttcgacgtgcgcgtcccggctcaccagccgcccgctggcatctgcgatgcgggcgccggccggcagaagattgtgagcgccacagacactagagcttgacagctaccgtggcggcgctgctgctgcttgaacgctggctggctgccggtaactgagctccactgaagtcttgcctaaccgaagccgttgctgtttcaggtcagcggtagttcctggcaaaaccttccggccacatcggcggccgccgcggcagcggcgcagcatgtccggtacctacaccctcagatggctcggccaccggcgacgccgcgtgacgcgacgccgtactcgttcccgcacttcccttacagcagggggagtctgccacccgccgcggcgcttcagcaggttaggttcttcctgacactactgcaccatattacttctggtttcttgttgtgttacatacttgcattgtatcacggttcaaatggcgtctgatctgatcgatcgctgtcttgtctcgtctctgggatgtgttcgcagatgccacagtatgtgtgcggcccggccggcacgaggcgccctgcgagctcgtcggcgatgatgatgaagcagctacaacaacccatgccgacgcagcagcagcaccagcagatgtggcagtaccatgtctcgcagtaccagccgaggccggacgctacgctttctccggcggcagcgtggcacggcatttcgtcgtcgctgcggccgatgggcatgcttgctcccccggagatgccgtcgccgccacggccgccgcagatggagctcttctgcgcgccgtaccaaggtggcaggcagccgcagcagctgaggttgatgtagcctggcctcccttctgctgctgatcagctgattgatactactattcagacgcactaatttatagtggataatatacaacatcttagcagtaaaaaagtgggatgttgcaaaaaagaaaaagaaagtgagatgcataaggttgtgttttatttatacactcaggaaatagggttatgcatggtaccagaggggactaaactgcaggccactggtatttagagtgagagcccttttggcaatgcctacggctctaactctggctcatcttcaatctctatcaaacggttataaaaaaatagcttcttatcgaaagccctctaaaagagagagagcacaaaaaatatggctcctaacggatccttctacattttactcacacatcctttaagataaacacaagaaaactgttttancaaatgaattgcaaagcagctctgactttttagagaaaccaaagagccaggtgagtcagtgctgaaactgtttttagaggaaccctgtttttagaggaaccggagccctaccaaaggtcccttattctagatcgggcctataaatcagtgacccaaatgcaagtgaattgcaggtgaattaactgtagatgatcttgttgtgtctgaagagggagggctcaattgtaattaacatgtttagactttagagtgactccaaaagactgctataaaattgttccccaaaacttaatattaggggctgatgtaaaaaacgtttcctaaaaaaatctaaatccacaacagactactaataaattaaccctaaattttttgaaacaacctaagcgcgagtcagagaagacacatgaattgggctggcattgacgacattctcgccactgcagatgctaatttgttagcttgtgcagcttctcacaatacacatgctgaaacaaacagtgacggaattgccatgtctaaatttgttgctggtagaaggcaaggtaaatgccagattccaccgtggtaaaggcaaactggccatgtgagtctaaccttgtgcgtgatgcaggacgcctccgagaggcaatgtacagatgttgctcgggccaaaggcagcctatcgtttgctctgaccttgccaattgaaaccatattgtacagatgttcccaaacacaagaactgtacaaatgttgtgaagggacatatttcaaacttgtagtaacaagaattgagagtgctcacacttggtactccaattgaaagtgtgtttaaacttaaactataattgaagtgctttcaaaatgaaacactcaaactatcatacaaagataggattaaaagataggattaatatgatttagtctcttttaggccctgttcaatttcacgggataaactttagtttcctgttaaactttagccatatgaattgaagtgctaaagtttagctccttgtgtgtttggactactctaataaagtttagcacattagaaaaagacacacatgcccctaatgcggaaagagaatgtggttggagggtatggggtagaaaatgaggttctctggcccacgtttagccccttttagcaccccttgagcagattatgagataataggtgctaaattttatcacaccaccattagctctcctatttagatcaccaaatggctaaaaatagctaaaaagttgataaagttt

SEQ ID NO: 8377 - DNA, 2522 bp, Zea mays
agggaaggaggtagaagcaagtgcaggcagagcagagagggtccgcagctttccggtcgcgccggcccacgccaagcggagcggccaacaaaaagggcgaggcgggccacgtcgcacggctagcaccgcatcgcagtccgcggcggcagcagcagcagcagctcctcctgctcctgctcgtcgctgtagtcgcctcgcatttaccactcactcactcgctcgctctgcccttcaccccctcgccttcctcctccttccatctcgatctcgtactctccttcgctcgcatcgcatcgcatcgcaccgacggacgcagagcagggtcgcccgccgccccaccacccgcgcgcggctcttggcgccgcatgccgctctcgccctcccgcgccgccggcggcttgctccgccgctgcccgcgcgctgccgtcctccccgccgccgccgccgccgcggcaacggctcgactcgaggcgatgcagatcggaggatatagcgggaaggagatgagaggtggggagcacagggcagcgctgagacagaagagactcaagaaggccaagtgcttcaagtggagaccaagcaagggcgacatggatagcaaagtggaggcggggggagcggggtctggtcaggtctgcgatgacgcagtgctctgctcgctgtctacggccagcttcagtggcctggttagctggcagagagtgaggacccttgggaaggtggctgaggggtgtgatgctgccgatcctccggttccaagaaaattaagatcagccataaacaagcgagctggtcgatttgcttctgcgccatcacgccatgtcaaaaagaggcgtcatctttcggctatcagtgctcaaatttcttctgtaggccaggaaacaagatccaatgggagctcgttatttacagaacaagaggaagcaattgctgatgttctgctgtccctgtcccaagtaccctctcacagcgtggtcacagccgacaaggctgtagcagatagttcaaacacgaatgacgcttcaacttctttttcaaaaggacctactatggaggatgaccaaacagcacgtgcgccaagcgctgctaacgaactggctagccaatgcgcctgcataaataaagcggtggaacaaagcaacatcgttccaaatgcagatcaagtggctgctgctgcaaatcaatccagcaacagtatcccacttctgtcagcgaatgagcaaatgcaggacctttctatggaaactgctgtgaatttgccaagcccatctaaagacacctccattaacagcgctcaaaagcaccatgaactgcagtttgatgatagcaaatgtcaccctgcacagaagccagaggctcctctttggctggtaaattctgatcaatctgagggtgtgctgctacatgagagggagaaggccaagaacaacagtgcacaagaaattgtgcctctggtccagactctgttgccttgtaccccagctgggtacttagtaaaaccctcttcaagcaaactggcagctcccgccaatacaatttctgaatccgctaacttcaccacgcctggaaatcagaacaagcaccctgtgctcagaaacgtcggcgcgccgaaggcatggaagaggagcatcacccacgtgtacgtgagccacgtgatccagatgcacgtgaacaaggagaaggccgccgcgtcgtcgtcgttacaaagccaagcgaggcctgaggagaggctcctcgcccgctgccccaggcctccgaacggctcgtccaccacctcgcacaaggccgccgccgctcgggacgagaggttgtacacggtgcacttcgacgtgcgcgtcccggctcaccagccgcccgctggcatctgcgatgcgggcgccggccggcagaagattgtcagcggtagttcctggcaaaacctgccggccacatcggcggccgccgcggcagcggcgcagcatgtccggtacctacaccctcagatggctcggccaccggcgacgccgcgtgacgcgacgccgtactcgttcccgcacttcccttacagcagggggagtctgccacccgccgcggcgcttcagcagatgccacagtatgtgtgcggcccggcgtatggtctgcgccctgcgagctcgtcggcgatgatgatgaagcagctacaacaacccatgccgacgcagcagcagcaccagcagatgtggcagtaccatgtctcgcagtaccagccgaggccggacgctacgctttctccggcggcagcgtggcacggcatttcgtcgtcgctgcgaccgatgggcatgcttgctcccccggagatgccgtcgccgccacggccgccgcagatggagctcttctgcgcgccgtaccaaggtggcaggcagccgcagcagctgaggttgatgtagcctggcctcccttctgctgctgatcagctgattgatactactattcagacgcactaatttatagtggataatatacaacatcttagcagtaaaaaagtgggatgttgcaaaaaaaaa

SEQ ID NO: 8378 - DNA, 2395 bp, Zea mays
  misc_feature (1978)..(1978): n is a, c, g, or t
ggatcctgattcattaccacctctatacgtgggcacgaggatttcctacctcatttttagaatctcattgtaaaatctcattataaaccaaacacgttttgaattctgtattagattttatgttagaatctcataacctctctataatatggtaatgagatttgtattggattatgtgcagtatttagatcctcaaaataatctgccatgaaccaaacgcacaagtcaacgaacgcctgggacggggccgccgggcgtcttgtgggacgggaaggggcagggccgtgatgttgtgtcaagggcacgccgaagtcgtgggctcaaatagtgtttttcagcccaacaaatctccgggtaccctgctggaggtttgtcccgctagggcaaagaggcgcgtgagaggtcggagcctgcaccgccgccgccatgctccgcctccaaaaacacctctcccttcgcctgcaagaacatctccttcccctgcaccgctccgcctccctcatacagctctccctccagcgctctctcctctccaccggctccgcgacatattcctctccgggtcacttcgccgccgatgactacctcgtctccacatgtggcctcacccgggagcaagccgcgaatgccgccaagtgcatctcccactggaagtcgtcctccaacgccgacgccgtgctgtccttcctaaccggcccggcgctcggcctctccaatgctgagatcgcgctgctcgtggccaaagacccgcgcgtcctcagctgcagcgtcgacaacaccctgcgggcccgcttggcccgcttccgcagtcatggcttctccgccgcgcagatcagcgaattcgtccgcgtggccccctgcttctttcgcaaattcaacatcgacgtcaagctcggcttctggatgcccttcctcggctcgcccgacaggttcctccgcctcgtcaagcgtaacttctacctcctcagctccgacctcgacaaggtggtgaagcccaacatccagctgctccaggagtgcggtctatctatccaggagattgggagcctgtgcgtggctaacccgaggctgctcaccagcaagccggacagaatcagggccgtcctcgtgcgtgccggtgagatgggcgtgccccgcaagacgcttttgttcaggcacgctgtgaccgcggtggcgggcctctgtccggagacctttgcatctaagctcaagatgatggccaatattctcgggtgctcagaggctgaggttgccagaatggtgcaaaagaacccgttggtgctgaggcgctccatggagacgattcagcgcgcctgtgagttcctgatcaatgtggtcggtgtcggtaccaacttcattctggacaagcccacaatcctgatgtacagtctggaacgccggctggtgccccggcattacgtgatgaaggtgctccaggacaaaggattgatgcgaaaagatcatagcttctacactttggccgcgattagtgctagcgtgttctgctccaggtatgtacatcctcataagaatgttcttcctaatcttgccgctgcatacgcatctggttgcaatgggaaaatagccatctgaggcgcgcgattccagcaaactggctatatgggcagcagctgcagttgtatcttgcatgtcattcttaacacattcagataccctgatgtgtactctgcgaggctgcagctccgtacttggctcatagcttcagaattgcagaaattcagcataacaagtttaagaactcatgaatgaccaaagcacgatgttgtcaatttcatataccttgtttaggattctggcgatgaattttatcgtgtttcaactcatgctactggcacgcagaatgatatggttcggttcagaaattctgccatggttttggcggcctggtgatcatcaacgaactatggatctgttagcattttcactaaccagcaacgtcctctaaattctatttccntcctatacaacacgctctaaaagattctatcctccgtatctttttcattgcagcaacgtcctttaaattcagtcctctatatctacagtataccggattttataatacacattgtttttacatgtcgcttatagaaaaattaattatgtatgttgcgattattttatatacaaattactcatcagtcatattatttaccaaaaaatgtattatgtattttccttatcatacgcacggaaacaaaaatcattcatgtgatctaagaattaattagagactaattaatttttaaaaccgactacaaccaagcaatagcagacaaatttgtacggcatctgacaactgcgtaggagaaaaggtagagagaggaagagtctggactgcgtgtaagagcaggatagcggacgaactagtaca

SEQ ID NO: 8379 - DNA, 2208 bp, Zea mays
  misc_feature (2158)..(2158): n is a, c, g, or t
gggaccctcgcggcccggccggggctttcagcctcatggccagcgcgggactccaccactcctcctccccctctccgcggatcacccaccgaacccacgcgaaaccggcgtccagatcttctcccccgcggttcagatccccggacgcagccggcgccttctgacttgggttggcacagccgtacaggttgctttgcgctgcggtggatctcctggcgtggcgacatgggcctgggtttgggagctcttctcaaatccggcgggctctcggtctcggatcacgacgccatcgtctcgattaacatcttcatcgcgctgctctgcagctgcattgtcatcggccacttgctggaagggaaccgatgggtgaacgagtccatcaccgcgcttgtcatgggcctcatcaccggaggcgtcatcctgctggttactaatgggacaaactcacgcattcttgtgttcagcgaggacctgtttttcatatatttacttccgccgataatcttcaatgccgggtttcaagtaaagaaaaagcaattcttccgcaactttataacgattattttgtttggtgctattgggactctgatttcctttgtaataatctctcttggtgctatggggttgttcaagaaacttgatgttggtccactcgagcttggggactatcttgcaattggtgctattttctcggcaacagattctgtttgcaccttacaggtgcttaaccaggatgaaacacccctactctatagtctagtttttggtgaaggtgttgttaatgatgccacatctgttgtgctcttcaatgcaattgaaaaccttgatattgataattttgatgctattgttctgttgaatttcgtcggaaaatttctctacttgttcttcaccagcaccatacttggagtagctaccgggttgcttagtgcatacattatcaagaagctctgttttgccagacattcaactgatagagaagtttctatcatgatactcatggcatacctttcatacatgatatcaatgctgttggacctgagtggaattcttactgtcttcttctgtggaatagtaatgtcacattacacttggcataatgtgacagaaagttctagggttaccaccaagcatacttttgcaactttatcattcattgcagaaattttcctcttcctctatgttgggatggatgcattggacattgagaagtggaaattagctagtagcagtcctaagaaaccaattgctttaagtgcaattattttgggcttggttatggttggaagagcggcatttgtattccctttgtcgttcttatccaacctaagcaaaaaggaggcccgtccaaagatctccttcaagcaacaagtaatcatatggtgggctggtctcatgagaggagcagtgtcaattgcgcttgcctataacaagtttacagcatctggtcacactgaagtgcgagtcaatgctatcatgatcaccagcacagttattgttgttctattcagcacaatggttttcggcctgctgacgaagccgctgctcagtctcctcatcccaccaaggactggactgaacacgtcgtctctgctctcaagccagtctatgctggacccactccttactagcatgatggggtctgactttgatgtagggcagatcaactcccctcaatacaacctccagttcattctcaccgcgccagctcgctccgtccatcgcctttggcgcaagtttgacgatcggttcatgcgcccggtgttcggggggcgaggtttcgtcccctttgtgcctggttcgccggtggagaggagtgtccctgaatctcacctgggcactgtgacggaggctgagggcagttgaaatgaggcaagagggatgccgacaattttctgtagatcttcagacagataccactcatactcctattttattttcagaatccactggtgcgaattgttctttgtagtaccttgtgcatatagttttatatagagctgctacacaagctgctgtaaatttctgggaggcactcccaactgtagattactgcaattcatctgtaaatttcaatcttgttcaagaagaatgatcatatattggcaaaaaaaaaaaaaaaagaagggtggactatactaaaaatccaaagggcggnccctttaaaggatacaaacttactttcccttgaagggggcggcttttttt

SEQ ID NO: 8380 - DNA, 478 bp, Zea mays
ctcctataaaagggcattgcattatgtatgagttttgaacataggatcttgttttacatgaagatacatgtatttccattagcattactatggctattattgattatttagtctcatattagatcatagtaattattgattctactatgtccaaattgatgctcctccataatgcaacataatctaggtgtagctttagttgctgggagatgtgccaccttcagggtcttggtctgcattaggacatttctccacagtttcaccatcttcagattctggatagttcacaaggcccatatctactgaattgcttcctgtggagctttgcacttcataaatatcgttattcatatcctctttattagtagaagagtttgtgggattactttgttctccatctgtattagctctagggccatgaaagttgtattgatggagcatgtccttcatatggtttgcatcatctttatcttcatcc

SEQ ID NO: 8381 - DNA, 1328 bp, Zea mays
ctcgaggccggccgggatcctgaaacgccaatccgataaaaagcgcgggcacccgggaggccggcgccggcccccaggagccccgatcatctcccgctcccttccttcctcctcatcctcctcatggctctgtcgtccgccggctcgttcgtggcctgcagcctccggccaagcggagctagcatccatgccccgaggtcgacgccgcacctgaagccgggtgctgcggcggcgtcgttcacgaggacgccgcagcgccgggcgaacgcgaccaagggcggcgtgtccaccgtgtgcgagccgctgggccccgacaggccgatctggttccccggcagctcccctccgccgtggctggacggaagccttccaggagactttggatttgaccctctcggactaggttcggagccggagctgctgcggtggttcgcgcaggcggagctgatgcacgggcggtgggcgatgctggcggcggcgggcatccttatcccggacctgctggcgcggtggggcttcatcgacgcggggttctcgtggttcgacgccgggtcccgcgagtacttcgcggacccctggacgctgttcgtgtcgcagatggcgctgatggggtgggcggaggggcggcggtgggcggactacctgaggcccgggtgcgtggacatcgagccgcgcttcccgaaccgaaagaacccggtgcccgacgtggggtaccccggcgggctgtggttcgactgggccaactgggggccgcgggtccccggagccccgtgatggtgctgcgcaccaaggagatccaggaacgggcggctcgccatgctcgccttcgtcggcttctggttccaggccgtgtacacgggccagggccccatcgacaacctgctcgcgcacctcgccgaccccggccactgcaacatcttctcggcattcacgtcccactgatccgatgttgcttcggagctggcggagagaccgcgaagaattaaaaaaaagggcatcctgttgagggagaaagaacttcgcttggtcggtatcattttggccctgctggacatgtcaacattttgtttgtagtacctgcgtagaaatgtcaaaccacctgtacaaacgtacaaataccaccccagggatcgcgatgatgctagccagcagtccagcacacactagcttgtcctgaagatccatgcaacaccgtatacagaggaaatttatggacacggcaatgtaaacatcccccgtatcctcgtcgtagcataacggtgtcatctacaatacaaatcctttatttattttacccgcaccccccccccccaacattagcggtgtta

SEQ ID NO: 8382 - DNA, 3509 bp, Zea mays
  misc_feature (1423)..(1423): n is a, c, g, or t
  misc_feature (1686)..(1686): n is a, c, g, or t
cattgggaccctcgaggccggccgggtttggtttgaagggagctctggcaccatggcgtggcgcgcttcgcggccccccgggagccccgatcatctcccgctcccttccttcctcctcctcctcctcctcctcatggctctgtcgtccgccggctcgttcgtggcctgcagcctccggccaagcggagctagcatccatgccccgaggtcgacgccgcacctgaagccgggtgctgcggcggcgtcgttcacgaggacgccgcagcgccgggcgaacgcgaccaagggcggcgtgtccaccgtgtgcgagccgctgggccccgaccggccgatctggttccccggcagctcccctccgccgtggctcgacggaagccttccaggagactttggatttgaccctctcggactaggttcggagccggagctgctgcggtggttcgcgcaggcggagctgatgcacgggcggtgggcgatgctggcggcggcgggcatccttatcccggacctgctggcgcggtggggcttcatcgacgcggggttctcgtggttcgacgccgggtcccgcgagtacttcgcggacccctggacgctgttcgtgtcgcagatggcgctgatggggtgggcggaggggcggcggtgggcggactacctgaggcccgggtgcgtggacatcgagccgcgcttcccgaaccgcaagaacccggtgcccgacgtggggtaccccggcgggctgtggttcgactgggccaactggggccgcgggtccccggagcccgtgatggtgctgcgcaccaaggagatcaagaacgggcggctcgccatgctcgccttcgtcggcttctggttccaggccgtgtacacgggccagggccccatcgacaacctgctcgcgcacctcgccgaccccggccactgcaacatcttctcggcgttcacgtcccactgatccgatgttgcttcggagctggcggagagactgcgaagaattaaaaaaaaaagtgcatcctgttgagggagaaagaacttcgcttggtcggtatcattttggccctgctggacatgtcaacattttgtttgtagtacctgcgtagaaatgtcaaaccacctgtacaaacgtacaaataccaccccagggatcgcgatgatgctagccagcagtccagcacacactagcttgtcctgaagatccatgcaacaccgtatacgagacaattgtatttttgggactacaaacagtgtgctttgcaataatgtcattccaaacaattagctcgcagaaatgggattataaagatcttataattgattaagatgcaatatagtgtagaaccatgcccccgctcgtcccctctgtgcacgcgccgctctcccgaccgcgttctgcgctcgttcgcccgcaacaactgccgcccgaccctcncactcgcgaaggcccgagatcgcccgctcgcaacaaccgccgcacctcattctgatcctcctcgctgtcgcacgtcccactcttggctgctcccgcggcggcagtggcggtgtttccaaaagaagccctccctaccaaatctgggtacctccccatcctgcccgccaacgcctccctcttctttgccttctaccaggccactgaccctgtcacgttgccggccaccatgccactcctctggctgcagggcggccggggtgctnccgcctcctaggcaacttcttcgagcaacccctaccttgtcaaccctggtggcgagaccctctcgcgcaaccccttcgcatggaaccgcctctttggtctcctcttcgtcgacagcccgctcagcaccggcttcagcacggcatcgtccctggccgacatccccaccaaccagcccatcatcgccgagcacatcctcaccgtgctacagtctttctacgccctgaacctggccctccgcacggagcccttcttcctaacgggcgggatctacatgggcaagtacatccccacggcgggggcgcacatcctggacacgaaccgggagctgccagaggtgctgcgcgtgaacctccgtggtgtggccatcggcaatggctcacgcacccggtggcgcaggtggccacgcacgcggactcggcctacttcctgggcctcttgaacgcgtggcagaagcgggacctggaggagctgcggttggaggcggtggcgctgacacgggcccagcggtgggtcgcggtgacggacgcgcgggggcgggtgttgtcgtggttgcagaacatgacgaggctggccgcgctgtacaactatgcaaagcagtgggactacggacacccccgttgaatcgcgtcgggggcaaggcggctatgggcgcgtgtggggacgtggcatgggaggagtgcagccacgaggtgggcacggcgatgcaagcggacgtgatgtgcagcgtggtgccacaggtggagtcgctgttgttggagcacgacatgcatgttgctataccagggcgtccgcgacctttgggacgacgtcgtgccacggaggcgtggccggacggggtgcgctgggacggcctgtgagcgttcctggacgccgagcgcgccgtgtcgcagacaacggggagctcgcgagctacatgcagcggtcgggcgcgttggcgcacgtggtggtgtacaacgcgaggcacctggtgccggcgaacaacgggcgtgcacgcgcaggagatgattgagagatgggtgctggggatggggatgttcggtcgcagtggtggtggcggcgtcaggagcgacgccgcatgatggctgcccgagcacaccggcaggcacaacgaaatgccgaatgtgttcaagctaccttactgcgcgatatggatacttgttgcatggatttgaatgggctcgattcgattctgtatttatcgagtgatgaaacagatcggaatggaaataaaatagagatactatttgttaatctctactacctattaagccaagtatagctacaagattcacagaagtatattttgttgggatcttgtcctcgtcgcggtctcctgctgctccataagaggagaaatgcagaaaggaagagggagtgccggttgaggttggcggggagcctggatatgcattctgtaactatcgttttgaacaaccagttgagactcaatgggttggtgggaagctatttcaagggaaattgaagtagcacctggtgctcgagatgatttgagaagcagcatctgggtgagtatgtgtggaagtgttatgcagagtgcaacaaaatcatttgcaacatttcatctggactaattgccagaaggatgaatgtgttgctttttttgctgagacacgggctaagtggcagattgggttgcaggtattcttgttccccgtatcattttacatatagatttacagaccaatttgtgggctttgtttctcttcacatgcgactgccacctatttcttcagtaaattgaaggcactaggccaccagccacttcatatctgcaatgtatctaatgcagaaatgcattgac

SEQ ID NO: 8383 - DNA, 1135 bp, Zea mays
cacaacacacggtccacaatttcttttttctctgcgccagtccaaccaaacagacgcttagattgttttaagctcatgtagttcaaaacgagcggagatccatggacacaatagatccgcattggactacagtatgagaacaacaacaaaactggtgatatactcttcaggtcaggaggatttgcgggctcgctcatgccgtttttggcactggggcagcttctgtttgagacaatgttacagaccgcaatggcggttttggcactggggcagcttctgtctgagacaatgttacagaccgtagtagctccagtgagctggatagcccaaggaaatgcgaaaggatcgtgttggctgaagcctgaacaaggaagatatctaaagcaagaacgggactctgtccaggtggtatcccctggtagtagggcactaatgaggtagtcagtgccttgcctaccaaagcacctacagttgcctgcaggcccagaactgcagcagccattccaacaacgttaagcacgatactgtttctcagattattgaccacatcggcgcgtggaggagccttagaaggatcatttgctgttctcttaagcctttcagaaaggcggatgtaaccaaatgaccggaagacgcagatgaaggccacgacgatgccaaccgcagtcgcactgaatgtgaagggagctgttacattccctgtagcgaccgcagagaacgacaggatcccggccgaaacgaccgtacacaccaactgggaccagaaccccagggtgcccacattcttgaaatgccgtgctgttttctctagctttttgctaacctgagccagcttggcgcgttcggcctcggcctccgcggagagagggctggggtcaggaggaccggatgccgccgccccagcctctggagccgcggcggcgaggtggcgcggcaaagagattcggccggcggaatagaatgaggtaccaccgacagcagccccacgactgggagcggagaagtggggcttcggcgccggccgccgcctcagcgtcgggaggggcggccttggtggcgccggggagaggtggagcgaccgcattttgtgatttgtgttgtgtggcggccggcccgcggcctcccggtcccaatg

SEQ ID NO: 8384 - DNA, 3023 bp, Zea mays
  misc_feature (2972)..(2972): n is a, c, g, or t
  misc_feature (3014)..(3014): n is a, c, g, or t
cacacctcaactatgtggtatcagtgattcctcagcagtccttttggcaacagaagagagaaataggatgttgatgatgagatcgttcgcccaggtcgagacttagcttctcagatatctgttggttctgatcacacttatcatggaagtactgaggatcctgtgggcatgccaagtacaacacctgattcggtatcctcctggattgaagccattgtaccagaagctaacaaggaacaccaatcatgcaaatcttctctacttcctatctgttcttcagaaaaggtatcagcaccaaaggaggatagcaagaaggcgttgtcagattcagtagtcaactctgtagtaaaatctcctcctcgaattaatattgcaagctccacagtattgaaggtacctactaagcaggtagctttgcctggttcattgctagagccccctcgcttaaaccagaatgcaaggaacaggacatggcgtcgtgacaatgcatcatcttctaattcgtcattgcatgtttcacagacttcaggattaccccctaaactgccattaaaaaagaacagcaaaagtcaaaactcttatatccgcaagggtaatgccctcattagaaatccagccaatggaaatcatcttcattcttcttctagtctagattctcaaaataagttgagtaagcctgttatgaggagaagcatgaactttgtcaggaatgtcgattcaaaagacgcagcacattctcatatttcagttgaaagacccaagaccccacctttgccacttcataccaaatccatcagttgtgctgtgaatgttttggagccattgtctcaaaatttgcagcaacaggtccttgaaactgaaaaggaagattccagtgggcaggttaactcaggtgctgacaatctaagcattattagtttgcacaagtctgaagcccttgatgctggtaaagcaatttatgttaggccaaagttaaatcaactagttgcacaggggcggcatcttggtgagtcgagtaacatttccttggataaagtgacgttgctgcagccttccgcaacatctgatctctatttcaagaaaaggaaaaatcagattattttgggtccctctacttctgatgccccgagttcaaaagatacatttcaggctgaaaatataaagtcaggtgagagtaaagttctaatgtcttcatcttccaacaacaatatcactgtggcaaaggacaggctgcacaaagctcttcagacaacaaatactgtcagaagtttctctcatgtatggacacttaatggacaaaatcctcgaaagaaatcttatgtgggagctagtcatatgaaggtcttacctcgtatacttccatggaaaagaaaaatattctgccagaactttagaggcagttattcttcgttgttgaatacaagctctataggaataatgagaaaattattgcaaacaaggaagagaagtactatttacactgtctctactgatggattctctcttcggaaatctggagtgttaagtataggcgggtcaagtttgaaatggtcaaggtccctcgagaaacattctcgaaaggttaatgaggaagctacacaggcagttgctgaagttgaaagaaagaaaagagaaaagagaaaacggcagtctctccgtagcaagggaaggaatgatcggtactctgcatcagttgctgccaatcaattaacaaacagaagcagagcatcttcagattcaagggtgtcatcaacttgcaatgaatatgtgcgtgttaacaaaggcaaccaactggtcagaaatccgaagaaagtaatccgcatgctagcaagtgagaaagttcgatggagtttgcacactgttagaacacgattggcaaagaagaggcaatattgtcaattcttcacccgcttcggcgagtgtaaaaaatctggtggcaagtgtccctacattcatgaccgagctaaagtggttatttgtactaaatttcttaaaggcttgtgttctagtactagctgcaaactaactcacaaggtcctgccagaaaggatgccagattgttcttactttctgcaagggctatgtaccaacacagcctgtccctataggctggtaccaacacagcctgtccctataggcatgtgaaagtgaactcgaatgctcctgtctgtgaagattttttaaagggatattgtgctgatggtgatgagtgtcgtaaaaagcacagctatgtatgcctcgtctttgaggcaacaggagagtgcccacaaggatcaagatgcaagcttcatcacccgaagaagaaaagcaaatccaagagaagcaaagtagacaccgtccaaaacaacagtcggggtcggtattttgagacaaacgttggccatggcagtggagcaagaatagtttatttggaggaagatgagagacagaaaccagagcaagtctctggtgaggagtttgctgacttcattgaacttggtgccggtattgaagtccctgaagatgcagacacttcggatgacatacagctgatggaactggactcagggaatctcgaggtgcaggctgacaataatgacgcgataatcaagccacttcggatcatgagaacggcaagagtttgatgagttctttggttggatacagctgcagtgttcctgggtcagggtggtattttacgctatgtttgacgtggcatataggcgctgactggagtttctatttctcgaagactggttctgacgggggcaatcggtttttgcttggttgaaggtttgattttgttcatcttgtacatcttttattaggaaatatataggaccatatggcagtggtagaggccatgagggttactggctgttaacccgtgttttttcaacattacccagagttgaatgtaacaaacagtgctttacaatatgaaatgaatgaaggtttgcatacaggaaatgaagctttcatttaaaaaaaanaaaaaaaaaaaaaaaaaaaaaaaaaaaaaaaaaaaaacaaanaaaaacaat

SEQ ID NO: 8385 - DNA, 3625 bp, Zea mays
  misc_feature (2720)..(2720): n is a, c, g, or t
  misc_feature (2758)..(2758): n is a, c, g, or t
  misc_feature (3119)..(3119): n is a, c, g, or t
acatccttgagcatggagcagacataaatgctgtggatcacactggacaaacagcacttcactggagtgctgtacgtggtcatattcaagttgctgaactacttctgaaagaaggagctaaggtggatgctactgatttatacgggtatcaggccacgcatgttgcagcacagtatggtcagactgcattcatttaccacattgttgcaaaatggaatgctgatccagatatccctgataatgatggaaggagccctttacactgggctgcttataagggatttgcagactccatacggcttcttttgtttttggatgcttataggggacggcaagacaaagaaggttgtactccattacattgggctgctattcgggggaatcttgaggcatgcactgtcttagttcaggttggcaaaaaggatgatttgatggtgaaagacaaaactggcttaactccagcacagcttgctgccgataagaatcatcggcaagttgcatttttcctcgacaatgctagaagggtacacggcagaggatgtggtgcgaacaccagatttgggaaattgtcaaaattagggctcgctcctcttctttggtgcaccattattggcatgcttattacatacacacactctgttatatcaggacaatatgccatgactacgacagcaccatttgggatattcgcatggtcaggagtttttcttgcaactgctggcttggtcatgttctataaatgtagcaggaaagatccaggttacatcaacataaatgcaaggggctcgcaaaatcaaagggatgatgaaccgttgctgaagatggagttagaaaatcctgcacttctttctggcaactggtcacaactttgtataacctgcaaaatagtcagacctgttcgttcaaaacattgttctacatgtgatcgctgcgtggagcagtttgaccaccactgcccttgggtatctaattgcataggaaagaagaacaaatgggaattcttcatgttcctcactctagaagtttttgcaatgatcattactggctctgctgccattataagaattgtaagggatccaaattctccatcatcctttggtgcttggattcattattctgcgtttcagcatcctggggtggtttcatttctcgcattggattgttttcttttttttggtgttgcagttcttacagttgttcaagcatcacagatagcaaggaacattacaacaaatgagatggcaaactccatgagatatgcatacctcagaggcccaggtggcagattcaggaatccgtatgatcatgggattcgcaagaactgctctgacttcttgttaaatggatacaatgaggacactgaacggctagagcagacattgcccactgatgaggaaatgggaatgatacagatgacaagtgcagtttcgcagcagaacggtgtcaatcatttacatcatggtaatggcactgaccatagttgcgctgtttcacaagcaaactcaaaacctcatagccaagtgggttcgtctcagtgttgtgaccacagtaagaggactgataggacaccgttgggcctaggattgggccttggacgaaacagtgcgtcccggcagtatgttcggtctcttatcccattgtgatccatcatttggcgatcatgtgtttgtttgactgtagattggatttgttcacttattctgttatacgtgctcttgacatggttcaccatggctgggcagggttaacgttgttgtgccatgagctccggaatactaagatatatctggtgttgtagtttagcgttgaactcagagaagttgaaggtaacgacctggtttgcgagtatcagctgatcagcagtctggaatcagagagcttgtgcagaaaatgtaagagttatggactcatggcagatgcagtagcatgagatgtcttcagaattgttgtgtacatcaggttctgtggtacccctattgtttagcgtgatacgagtttgggaaaaaaaaagtagtcgtaaattgagaaatttgtaaattgattagtaagctcactgcaacactagctgttttcctagttttcattcatttttgggtctggttattgttatgaaccacggaaagaattttcggttttcgggtatgggtacctcagttatatttggtctggttatggtacttactggtggtgcatgtttgtgtgagtgcttagagtttaggctatggccatcagatcatgtatatgactatatgactgtgtaaaacactgttttttatctgattgtgtaaaacagtgtttttgtatcgtacactattgttttatagattgaagtttaaaataagagatgtgaatgagtaagctactagagatgtccttaggacactgttgttacaaagcatgtttaaaatagcagtaaaagattgacggaggaagttgtatggtaaatacgggtaaattctactctacgctctagcttagatcgaattacatggtacaaaaggcaccttcaacaccttgatgttcatatattgatagtttagtgctgtttggaaattgctgtgcatcgacctgtactcgggctacgcctgcgcgtgctcctatgaaacaagtgtatacagcttcatcttatcgaattaatgatactaagtggattaatttagtggtgaaattttatacttgctttgatttaataaccgagtggtatataaattagtatatanctcgtgctaacgctatgatctcacggagtgaagatgtngacgttgagagtggtagcacgagagaagaggttgacggcgacgataacgcgagaggaaaaggggtggcaggagaggagagactaggagcagcggggtcataggggaagcaatggttcaaataatattatccattaagtttgagtgagtagaggagctaatgatctaaaccgttgattttaatgatgtgtcaagtatgtgtgtaattggtttgacggattcaggtgatttggttagtttgttttttcaaagtttaaactggtggtatttcctatattacaaagccggtaagaaacgacgcaggatatgttgtccacgtcggcgaaaatttttcaggtcgtccgattcctgatcaaacgtcanatcgtctcttagattcttttcaaatcccagctcactatgtctctggatgcttcggccgacactctccctcacgtcagctcgctttgaccccgtgcggggcttctcctcgtcgtcgtcgcttactccgccgcctcttcctcttcgcgtcgagcgctacaggtttgttccgaccttgctccctccgccattgccactgcgctggattttatccggttcggcaccattacgcctttcaacttttggttgcgttcttggttctagggttcgtgtcctctgcctgctagatctttcctcggcttcattttgtactggcggctgtgtgacagcgaatcgtattcatataaatcctcttgaaatctaccctaatctcgcccctaaaaccatagctacggtggtgcggcttggaagccacatgtttgtcagtcggtactaggctgtccggtataaggatttcattacctgctgaactattggaacggccttcaggaaacgacagcgtgattttt

SEQ ID NO: 8386 - DNA, 1693 bp, Zea mays
aaggccttcctcgcgtccgggcacttccccctcattcacttctgccttgcctcatctgcccgtcgtcgtctccctcggtccgccggtcacctcgacaaacggcgaagggcggcaaaatgctgcagtgcatctttctcctctccgattccggggaggtgatggtggagaagcagatggcggcgcactgcgtggaccgcgctatctgcgcctggttctgggactacgtcgtcgcccacgccgccggcgatccttccaaagtcttacaggttgtggtgtcaccaacgcattacttgtttcaaatctatcgcaacggtgtaacgttcttggcatgcacccaagtggagatggccccactgatggcagttgagtttctctctcgcgtggctgatgtcttgacagattatcttggagatctgaatgaagatataatcaaggacaactttgtaattgtgtatcagattttggatgagatgatggataatggtttcccactcacaactgagccaaacatcttgaaagagatgatcaccccacctaacattgtgaacaaaatgttgaatgttgttactggcaagagttctacccttggcagcaaacttccagatgcagctgcttcttttgtaccttggcgaagaacaacagtcaaggatgcaagcaatgaagtctatgttaacatagtcgaggaacttgatgcatgtgtgaacagagagggggttctcgtgaaatgtgaagcatacggtgaagtccaagtaaactgcagcctcccaggtgtgccagagctgaccatgtcctttgctaaccctgcaattatcaatgatgttaccttccacccctgcgtccgattcaggccttgggaatcaaatcagatcctatcatttgttcctcccgacgggcagttcaagctcatgagttacagggttcagaaactgaagaagacaccgatctatgtgaaaccacaattaacatcagattccgggaactgccgtgttagcgtgatggtcgggattcgaaatgatcctgggaaacctattgattcgataacagtgcagttccagttgccccctcttattgtttctgctgatctgactgcaaactatggcacggttgacatccttgccgacaagacctgtttgtggacaatcgggcagataccaaaagacaaagcaccggcactctctggaaatttacgactggaggaagggctcgcacaactgcatgcattgccgacatttgaggtgaaattcaggattatgggagttgccctatctggccttcaaatcgataagctggacgtgaagaacacaccgaacgctccgtacaaaggttttagagcccagactcaagctgggaagtatgaggtcagatcgtaggtgcttgcaggggggcagttgttagttcattcttgtagaaaacgaatgatgctgcggacctggctcatggcctgttaacacattgatatgatcatcagttgagggttcacggccagctgcatttgggtcgttgcatttgatgggaggtgctattgttctttgttcaggtcaataggagtcctgtatctgaatcagattatcctatgtggtgtgaaagcaacagaatactgcgaccctaggcctatctagatcaaggttttggattctggcaccttgtgttataaaattcatttgagtatagaatctcaaaaaaaaaaaaaaaa

SEQ ID NO: 8387 - DNA, 1007 bp, Zea mays
tgatgcatgtgtgaacagagagggggttctcgtgaaatgcgacatacggtgaagtccaagtaaactgcagcctcccaggtgtgccagagctgaccatgtcctttgctaaccctgcaattatcaatgatgttaccttccacccctgcgtccgattcaggccttgggaatcaaatcagatcctatcatttgttcctcccgacgggcagttcaagctcatgagttacagggttcagaaactgaagaagacaccgatctatgtgaaaccacaattaacatcagattccgggaactgccgcgttagtgtgatggtcgggattcgaaatgatcctgggaaacctattgattcgataacagtgcagttccagttgccccctcttattgtttctgctgatctgactgcaaactatggcacggttgacatccttgccgacaagacctgtttgtggacaatcgggcagataccaaaagacaaagcaccggcactctctggaaatttacgactggaggaagggctcgcacaactgcatgcattgccgacatttcaggtgaaattcaggattatgggagttgccctatctggccttcaaattgataagctggacgtgaagaacacaccgaacgctccgtacaaaggttttagagcccagactcaagctgggaagtatgaggtcagatcgtaggtgcttgcaggggggcagctgttagttcattcttgtagaaaacgaatgatgctgcggacctggctcatggcctgttaacacattgttatgatcatcagttgagggttcacggccagctgcatttgggtcgttgcatttgatgggaggtgccattgttctttgttcaggtcaataggtgtcctgtacctgtacctgaatcagattatcctctgttgtgtgaaagcaacagaatactgcgaccctaggcctatctagatcaaggttttggattctggcaccttgtgttataaaattcacttgagtatagaatctctaattttttttgtt

SEQ ID NO: 8388 - DNA, 2607 bp, Zea mays
cccaaggttcgtggcatatctgtaggcatctaccccgtcttcgtcgtccgctcctcactagctaccaagaggtcgccattattgccaacatagagtgtacgtggatgtctatatatatgcctacttgcacccatatggcataggcgttcgatccccttagcgcggaggagagctcctccggttcttctctacccttcgcatggaagttcttgcattgcttcgttgcttctctagtttcttccttctacgtctttccagcatacgcatgcccctcgtccgccggttcacgaggcatcgtctgatgatcagtagataataagcaatataatactgatctagaatcgagttgttgtactcttcgcagataggcgcgtgatggcgctttcagcttcccgagttcagcaggcggaagaactgctgcaacgacctgctgagaggcagctgatgaggagccagcttgctgcagccgccaggagcatcaactggagctacgccctcttctggtccatttcagacactcaaccaggggtgctgacgtggacggacgggttctacaacggcgaggtgaagacgcggaagatctccaactccgtggagctgacatccgaccagctcgtcatgcagaggagcgaccagctccgggagctctacgaggccctcctgtcgggcgagggcgaccgccgcgctgcgcctgcgcggccggccggctctctgtcgccggaggacctcggcgacaccgagtggtactacgtggtctccatgacctacgccttccggccaggccaagggttgcccggcaggagtttcgcgagcgacgagcatgtctggctgtgcaacgcgcacctcgccggcagcaaagccttcccccgcgcgctcctggccaagagcgcgtccattcagtcaatcctctgcatcccggttatgggcggcgtgcttgagcttggtacaactgacacggtgccggaggccccggacttggtcagccgagcaaccgcggctttctgggagccgcagtgcccgagctccagcccgtcaggacgagcaaacgagaccggcgaggccgcagcagacgacggcacgtttgcgttcgaggaactcgaccacaataatggcatggacgacatagaggcgatgaccgccgccgggggacacgggcaggaggaggagctaagactaagagaagccgaggccctgtcagacgacgcaagcctggagcacatcaccaaggagatcgaggagttctacagcctctgcgacgaaatggacctgcaggcgctaccactaccgctagaggacggctggaccgtggacgcgtccaatttcgaggtcccctgctcttccccgcagccagcgccgcctccggtggacagggctaccgctaacgtcgccgccgacgcctcaagggcacccgtctacggctctcgcgcgacgagtttcatggcttggacgaggtcctcgcagcagtcgtcgtgctccgacgacgcggcgcccgcagcagtagtgccggccatcgaggagccgcagagattgctgaagaaagtggtggccggcggcggtgcttgggagagctgtggcggcgcgacgggagcagcacaggaaatgagtggcactggcaccaagaaccacgtcatgtcggagcgaaagcgacgagagaagctcaacgagatgttcctcgtcctcaagtcactgcttccgtccattcacagggtgaacaaagcgtcgatcctcgccgaaacgatagcctacctcaaggagcttcagagaagggtgcaagagctggagtccagtagggaacctgcgtcgcgcccatccgaaacgacgacaaggctaataacaaggccctcccgtggcaataatgagagtgtgaggaaggaggtctgcgcgggctccaagaggaagagcccagagctcggcagagacgacgtggagcgccccccggtcctcaccatggacgccggcaccagcaacgtcaccgtcaccgtctcggacaaggacgtgctcctggaggtgcagtgccggtgggaggagctcctgatgacgcgagtgttcgacgccatcaagagcctccatttggacgtcctctcggttcaggcttcagcgccagatggcttcatggggcttaagatacgagctcagtttgctggctccggtgccgtcgtgccctggatgatcagcgaggctcttcgcaaagctatagggaagcggtgaaggggcagctggaaatttggacatcgacgggcatggaaggcttcatgggatcgaagcaaagatgtatttcttgtttctttagataacagacatgaatcggacctctatatcaacaattatatgggcatgaatacttaagactccagcccttaacacgtagaaactcaaaaaagaagagaggaagctaaagactaagcgtaaggtatatttggaagtaaattgtttttgatagtttctaagcgatcccatggttttataggaatactagagtgtttatggcataaggtgtttggttgcattcataaaacctatattttcaaagtcatagcattctagataccatgatatttttgtaatattggaaactacactccaacgcaaagtttttatgacatggct

SEQ ID NO: 8389 - DNA, 2572 bp, Zea mays
taggcgttcgatccccttagcgcggaggggagctcctccggttcttctctacccttcgcatggaagttcttattgcattgcttcgttgcttctctagtttcttccttctacgtctttccagcatacgcatgcccctcgtccgccggttcacgaggcatcgtctgatgatcagtagataataagcaatataatactgatctagaatcgagttgttgtactcttcgcagataggttcgttccttcacatagaagcgagtacagactacagaccacacagtatcagctggcacgaaacgaaaatggttacttgcaaattgcatgcacgagctagaattatattcttctaatcttcttcgttgactttctggcttcagcaggcgcgtgatggcgctttcagcttcccgagttcagcaggcggaagaactgctgcaacgacctgctgagaggcagctgatgaggagccagcttgctgcagccgccaggagcatcaactggagctacgccctcttctggtccatttcagacactcaaccaggggtgctgacgtggacggacgggttctacaacggcgaggtgaagacgcggaagatctccaactccgtggagctgacatccgaccagctcgtcatgcagaggagcgaccagctccgggagctctacgaggccctcctgtcgggcgagggcgaccgccgcgctgcgcctgcgcggccggccggctctctgtcgccggaggacctcggcgacaccgagtggtactacgtggtctccatgacctacgccttccggccaggccaagggttgcccggcaggagtttcgcgagcgacgagcatgtctggctgtgcaacgcgcacctcgccggcagcaaagccttcccccgcgcgctcctggccaagagcgcgtccattcagtcaatcctctgcatcccggttatgggcggcgtgcttgagcttggtacaactgacacggtgccggaggccccggacttggtcagccgagcaaccgcggctttctgggagccgcagtgcccgacgtactcggaagagccgagctccagcccgtcaggacgagcaaacgagaccggcgaggccgcagcagacgacggcacgtttgcgttcgaggaactcgaccacaataatggcatggacatagaggcgatgaccgccgccgggggacacgggcaggaggaggagctaagactaagagaagccgaggccctgtcagacgacgcaagcctggagcacatcaccaaggagatcgaggagttctacagcctctgcgacgaaatggacctgcaggcgctaccactaccgctagaggacggctggaccgtggacgcgtccaatttcgaggtcccctgctcttccccgcagccagcgccgcctccggtggacagggctaccgctaacgtcgccgccgacgcctcaagggcgcccgtctacggctctcgcgcgaccagtttcatggcttggacgaggtcctcgcagcagtcgtcgtgctccgacgacgcggcgcccgcagcagtagtgccggccatcgaggagccgcagagattgctgaagaaagtggtggccggcggcggtgcttgggagagctgtggcggcgcgacgggagcagcacaggaaatgagtggcactggcaccaagaaccacgtcatgtcggagcgaaagcgacgagagaagctcaacgagatgttcctcgtcctcaagtcactgcttccgtccattcacagggtgaacaaagcgtcgatcctcgccgaaacgatagcctacctcaaggagcttcagcgaagggtgcaagagctggagtccagtagggaacctgcgtcgcgcccatccgaaacgacgacaaggctaataacaaggccctcccgtggcaataatgagagtgtgaggaaggaggtctgcgcgggctccaagaggaagagcccagagctcggcagagacgacgtggagcgccccccggtcctcaccatggacgccggcaccagcaacgtcaccgtcaccgtctcggacaaggacgtgctcctggaggtgcagtgccggtgggaggagctcctgatgacgcgagtgttcgacgccatcaagagcctccatttggacgtcctctcggttcaggcttcagcgccagatggcttcatggggcttaagatacgagctcagtttgctggctccggtgccgtcgtgccctggatgatcagcgaggctcttcgcaaagctatagggaagcggtgaaggggcagctggaaatttggacatcgacgggcatggaaggcttcatgggatcgaagcaaagatgtatttcttgtttctttagataacagacatgaatcggacctctatatcaacaattatattggcatgaatacttaagactccagcccttaacacgtagaaactcaaaaaagaagaaaggaagctaaagactaagcgtaaggtatatttggaagtaaattatttttatagtttctaagcaatctcatggtttataggaatactagagtgtttatggcataaggtgtttggttgcattcataaaacctatattttcaaagtcatagcattctagatacca

SEQ ID NO: 8390 - DNA, 2324 bp, Zea mays
cctcgaggggccggcccgggaaaaaaaaaaaaaaggtaacgataacttggggtgcctctcggagcccggcgggggaaaaggcccaacacaacccaatccggaaccccaaccccacccccaccaccaagggtccaaagccatgcgtgccgccatggcggcggcggtcctccgacccacggccgccaccctccgcttcctctccaccccaccacaccagcgccgccgcgtcttggtcggacacctcccctttgctcgccgacgccgccactcctccaccgctacggccccagcgctggaggactccagcccccgcagtggcgaaggcaaggccgtgcgccgccgccgcgcccgtgaatctccccagggcctcctccgccaccagctcgacatgtgctcccgcaacgccgacctcaccaccgcgctccgcctctacgacgacgccctctccccggacaaccccatcccgctctccctccaccactacaactgcctgctctacctctgctccaacgccgccgctaccgactctgacagccatatctccgccaccgccgctcagcgcggcttcgacatcttcgccaggatggaggccgacggcgtccagcccaacgaggccaccctcaccagcgtcgcgcgcctcgccgccgccacccgcgaccctgccatggccttctccgtcgtccgccgcatggccgctgcgggcaccccgccgcgcctccgcacctacggccccgccctcttcgcctactgcgatgccaaagatgccgacggcgccaagcaggtcgaggctcacatggacgcatctggcgtcgtgcccgaggagcccgagctcgcagcgttgctccgcgtcaacgcggacacgggcaaggccgatgaggtttacaggctcctgcacaggacgcgcgtcctcgtcaggcaggtctgcgacaccactgcccaggtcgtcgaggcctggttccggtcggacgcagcgtcccaggcgggggtggacagctgggatcccaccaaggtaaaggagggcgtcgtcaagggcggcggcggctggcatggccagggatggcttggcaagggcgcatggagcgttggctggaccgagatgggcaaggatgggacatgccaacgctgtggggagaggcttgtctgcattgacattgatccagccgagactgacaactttgcaaattcgctcaccgaactggccattaagcttgaggccagggaagatttcctcagttttcagagctggctacgccgccatggaccattcgatgctgttatagacgctgctaatgtaggcctttacaaaagtaaagatttctgtttttcacaggttaactctgttgtaaatgctatacagagagtaactaaatcaaagaagttgccactgatcgttttgcatccgagccgtgtaaatgttggtcctgcaaaagccccatacaaccagaagattctggacagttggaggaatgctggagctctgtatgcaacccctcctggctccaatgacgattggtattggctgtatgcagctgtcagttgccgatcgttgcttgttacaaatgatgagatgcgagaccacttgttccaactgcttggcactagttttttccctaggtggaaagaaaaacatcaggtcagactaactttctccgggcatggccctacccttcacttgccgcctccttattcaattgttattcaggaatctgaagatggaagctggcatgtaccaacaacaacaggcgatgatattgaaaagccacggcagtggttgtgcactactagaaaatctttgaggtagatgtgatttaattttggcccagtcaagttgacacagaatggtgccaagttgccaaccttggtgggaactgggaagggtggtggcgtgacaaaccctgaaaccagcaaagcttaaatgcagcaacttgttggcccgaacgaaagaaagctgattggagtacaagtgatgaatatgagcaggccatggatatggaaagccttttgttgtaacatcgtgagctgtttattgctagcccaggttattctagagtagtttgagaaccgtggtaaggtaatttgcttcatgtgagttttacttttattaaatgacgtgccatgccagtgatttgaaggatgtggcaggcaagtaatcaaagaaagagatgaatgttatctaatttgtcattagcgcacccacctaacctctggcgccccaatggtttctgacggactggtgaatggtgattgatgagggactgtgttgcaccgtgagttttggtgttaaattttcttaaaagtttaattaaatttagtatatttatagt

SEQ ID NO: 8391 - DNA, 954 bp, Zea mays
acgcgggtatgatccgatacttgcttgacacaaaggcaggcaggcagacagacagagctaatacgaccaagtttgggtcgctctctccttgtaggttaactctgttgtaaatgctatacagagtgtaactaaatcaaagaagttgccactgatcgttttgcataggagccgtgtaaatgttggtcctgcaaaagccccatacaaccagaagattctggacagttggaggaatgctggagctctgtatgcaacccctcctggctccaatgacgattggtattggctgtatgcagctgtcagttgccgatcgttgcttgttacaaatgatgagatgcgagaccacttgttccaactgcttggcactagttttttccctaggtggaaagaaaaacatcaggtcagactaactttctccgggcatggccctacccttcacttgccgcctccttattcaattgttattcaggaatctgaagatggaagctggcatgtaccaacaacaacaggcgatgatattgaaaagccacggcagtggttgtgcactactagaaaatctttgaggtagatgtgatttaattttggcccagtcaagttgacacagaatggtgccaaccttggtgggaactgggaagggtggtggcgtgacgaaccctgaaaccagcaaagcttaaatgcagcaacttgttggcccgaacgaaagaaagctgattggagtacaagtgatgaatatgagcagccatggatatggaaagccttttgttgtaacattgtgagctgtttattgctagcccaggttattctagagtagtttgagaatcgtggtaaggtaatttgcttcatgtgagttttacttctattaaatgacgtgccatgccagtgatttgaaggatgtggcaggcaagtaatcaaagaaagagatgaatgttatctaaaaaaaaaatagcacacatacct

SEQ ID NO: 8392 - DNA, 2564 bp, Zea mays
  misc_feature (998)..(998): n is a, c, g, or t
  misc_feature (1003)..(1003): n is a, c, g, or t
  misc_feature (1034)..(1035): n is a, c, g, or t
  misc_feature (1049)..(1049): n is a, c, g, or t
  misc_feature (1051)..(1051): n is a, c, g, or t
  misc_feature (1058)..(1058): n is a, c, g, or t
  misc_feature (1082)..(1082): n is a, c, g, or t
  misc_feature (1109)..(1109): n is a, c, g, or t
  misc_feature (1113)..(1113): n is a, c, g, or t
  misc_feature (1126)..(1127): n is a, c, g, or t
  misc_feature (1146)..(1146): n is a, c, g, or t
  misc_feature (1169)..(1169): n is a, c, g, or t
  misc_feature (1198)..(1198): n is a, c, g, or t
  misc_feature (1405)..(1405): n is a, c, g, or t
ctgcagtgcactgcactggtaaggatcggggcccattttttgtggtggtttgactggatggactgccgacaaccgacaacccataagaaattgccaagaaaggatcacggacagggtagatccaatcacaaggccatgtgaagtggcgccgaaaatggacaagtccgcaacggtacaatttctcgtgttgtccggtcttgacttggacactgagagaagaagatcataacgcacgggtccacgtttgtttgctcaagcaagcgtgattgcagtctcggttaattgtcacttgtcaatggtggatacaccctatcctgaaattcgtcgtggacactcaacagggagtcatattctaagctgtatttttctgtgaaattaaacttgtcactatggatcaaacataaattagtctgaatcatggatcagattcgaattttcgatagtataaactgccactccaaatttaagttcaactgacaccgtttgcagcttctttgaccgcgcggcgatcgtcaccgacggcgacctggtcacgctgacggacgcggactccggcaagccgtcgacggcccccgtcccggacctgtggcgcctgagcaccgtgcaccgcgtggaggagctcaagtcggtgatccgcatgggtcctatctgggcggcgggcatcctggtgatcacggggtcgtcgacgcagaacaccttctccctgcaggcaggcgagcaccatggaccgccgcctcgcgccgggcctctccacgttcgagatccccgcggggtccatgaccgtcttcgggctgctggccatgctcttcaccctcttcgtctacgaccgcgcgctcatccgcgtggcgcgccgcttcacggggctggaccgcggcatctccttcctgcaccgcatgggcgtcggcttcgccatcagcgtgctcgccaccctggtcgccggcttcgtggagcggcaccgcagggacgcggcggcggcggccggcgccacggacgccggnacgtncccgctgtcggcctactggctggtgccgcannacgcgctgcatggngnggccgangcgttcacctccgtggggcacctngagttcatgtacgaccaggcgcccganagcntgcgcagcacggnnacggcgctcttctggctgnccatctcgctgggaagctacgcnagcacctgctggtggacgctgtgcaccgntggagcgcggggcccggcggcgccaactggctgccggacaacatcaatcacggcaggctggattacttttactgggtcgtcacggtactgcaggtcatgaacctggtgtactacgccatttgcgccaagcggttcacgttcaagccagtgcagctcaacaagaaagaggaggaagaaggcggcaaggtacttgtggagttgcaaganaaggtttaatttgagcagcatgcactttcagctatgtgcaggtacatgtctaatagaaaggaagtactcatcagtgctaggaagatcctcagaaaaactcccaaggtattactatataaatctatgtgagcatctgtattagtcaagtagatcaagaatgcaggaaggttgttcaggcaagcaacctcagaaattgtcaaggatcacatgacagctttgtggatggcagaagctatctggtctggtcctgagacttggcacaggtgcaaaacacaactcgactatatttgtaattagaaagcaggcacgaggcacatgtctgaactctgaaacttgacgttaatgcatagtactgtataagactctgtttgtacattaggatctagggataaacacagagaggcaacagtcttcgaaagttgtcacgcaacacatttctcagtgacagaaatatttcgatctgaatcctggcatagcttattaatattccgacttggacactaggtagtaaggaaataggtttgcacccacaatctggcatgaattcccccccaaagcagatagcagagcttttcaggtaaacagactccggtacattagatgtcgcctctgatctttaatcgcagattcgcagtagtagtgcacgaatagaccgtccaagaacgcgcggcgagacgcgaacctgtcgcgggacgggggggacgggggatcagacggtgaacttgatctcgaacccggtggacggatccacgggctcggccgtggacgggacgacggcggtgacggtggcggctggggggccgaccgggaggcggcgggttatcatgtcttcgatcttcgcggggtctccggagaggagggcctccacactgccgtcacggcggttgcggacccagccggcgaggccgagcgactcggccgtggacgcagtccagtcgcggaaccccacccccgtgacgcgccccttcaccaccacgcggactgcctttcgtgcgggctccggctgcggcgcggatggtggcgtggcggcatcgggatcggcggaggacgccatggcgcggtggtgctggtacggttgtggacttgtggaagcagcgagactggagaccggagacggagagggacgagacgagacgagacggtgcagccggggcctgct

SEQ ID NO: 8393 - DNA, 3241 bp, Zea mays
aaaaatttaatatatgtactaaataagcacatgatatgttttcattaataagtggagtggaggccggcggcgagggacgctaggcaccgttgtggctgtgcggaactgcacaagagcgtttcgcctcggccaccacgaacggagaaggcggcagccatggccatggaggaagcggggaagatgacgtgcaggaagaagggtggtctgagaacaatgcccttcatcttcgccaacgaggtggcggagaagctcgccgtggtgggtttctcgaccaacatgctgacgtacctgaccactcagctgcacatgccgctagcgaaggccgccaccacgctcaccaacttcggcggcacctccgccgcgacgcccctcatcggtgccttcctcgccgacgcctgcatcggccggttctggaccatcgccgccgcgtccgtcgtctaccaagccggcatggcgctcctgacggtgtcagcggcgctgccgcggttccggccggcgccgtgcaagccgggcggcgcggtggcatgccaggaggccgcgccgtggcagctggcggtgctgtacgtgtccctgctcctgaacgcggtgggcgcgggcgggtaccgcccctgcatcgtggcgttcggggcggaccagttcgacgagtcgcgggcggcggagcgcgcgcggagctggggcttcttcaactggtactacttctgcaacggcgcgtccatgctgctggccgtcaccggcggtggtgtacgtgcaggacaacgtgggcctggggctggggccctcggcgtgccggccttctgcatgggcgtctccgtcgccgccttcgtggccgggtacccgatgtaccggaggctggagcccgcggggagcccgtgcgcgcggctcgcgcaggttgtcgtcgccgctgtcaagaagcggcggctgccggcggcggacgtcaaccccgcgttgctgtacgaggacgacgagctcgacgcgcccatctccatgtacggcaagcttgtgcacacggatcagctcagcttctttgaccgcgcggcgatcgtcaccgacggcgacctggtcacgctgacggacgcggactccggcaagccgtcgacggcccccgtcccggacctgtggcgcctgagcaccgtgcaccgcgtggaggagctcaagtcggtgatccgcatgggtcctatctgggcggcgggcatcctggtgatcacggggtcgtcgacgcagaacaccttctctctgcagcaggcgagcaccatggaccgccgcctcgcgccgggcctctccacgttcgagatccccgcggggtccatgaccgtcttcgggctgctggccatgctcttcaccctcttcgtctacgaccgcgcgctcatccgcgtggcgcgccgcttcacggggctggaccgcggcatctccttcctgcaccgcatgggcgtcggcttcgccatcagcgtgctcgccaccctggtcgctggattcgtggagcggcaccgcagggacgcggcggcggcggccggcgccacggacgccggcacgtccccgctgtcggcctactggctggtgccgcagtacgcactgcacggcgtggccgaggcgttcacctccgtggggcacctcgagttcatgtacgaccaggcgcccgagagcatgcgcagcacggcgacggcgctcttctggctgtccatctcgctgggaagctacgcgagcacgctgctggtggacgctgtgcaccgctggagcgcggggcccggcggcgccaactggctgccggacaacatcaatcacggcaagctggattacttttactgggtcgtcacggtactgcaggtcatgaaccttgtgtactacgccatttgcgccaagcggttcacgttcaagccagtgcagctccacaagaaagaggaggaagaaggcggcaaggcacttgtggagttgcaagagaaggtttaatttgagcagcatgcactttcatcagtgctaggaagatcctcagaaaaactcccaaggtattactatataaatctatgtgagcatctgtattagtcaagtagatcaagaatgcaggaaggttgttcaggcaagcaacctcagaagctatctggtctggtcctgagacttggcacaggtcaaaaacacaactcgactatatttgtaactagaaagcaggcacgaggcacatgtctgaactctgaaacttgacgttaatgcatagtactgtataagactctgtttgtacattagagtctagggataaacacacagatattgttcaggcaacagtcttcgaaaagttgtcacgcaacacatctctcagagacagaaatatttcgatctgaatcctggcatagcttattaatattccgacttggacactaggtagtaaggaaacaggtttgcacccacaatctggcatgaattccaacccaagcagatagcggagcttttcaggtaaacagactacggtacattagatgtcgcctctgatctttaatcgcagattcgcagtagtagtgcacgaatagaccgtccaagaacgcgcggcgagacgcgaacctgtcgcgggacggggggatcagacggtgaacttgatctcgaacccggtggacggatccacgggctcggccgtggacgggacgacggcggtgacggtggcggctggggggccgacggggaggcggcgggttatcatgtcttcgatcttcgcggggtctccggagaggagggcctccacactgccgtcacggcggttgcggacccagccggcgagaccgagcgactcggccgtggacgccgtccagtcgcggaaccccacccccgtgacgctccccttcaccaccacgcggactgccttccgtgcgggctccggctgcggcgcggatggtggcgtggcggcatcgggatcggcggaggacgccatggcgcggtggtgctggtacggttgtggacttgtggaagcagcgagactggagaccggagacggagagggacgaccggacgagacgagacggccgaagcaaggaactgctgccggaccggcccggagcaacgcctgccctagtaggacaacccaagcccggcccaaaaaaaatcgtgaccctgcgcggctgggtcgcactcgcggctcgtggcagaggctgtgatgggctacagttgtgggctttttaaccttcttttaaaaatgtgttattatttttctatattcgtagtgtcccttttccatggttacttctctccagcattgctacat

SEQ ID NO: 8394 - DNA, 2033 bp, Zea mays
cctgccggggtgaacactaaaccggaaaccgtaaaccgtgaatggccatcgaggtccaaaaatccatctggattctggagagaggagaccccaaaatcgcagcgcgcgaaaacgcaggagcaacccgcccactcgccaccaccgcccgcgcgcacggcggcgaccgatggccccgctcgtgccgatgtcgcagccatgggtggagaaataccggccgaggcaggtcaaggatgtggctcaccaggaggaggtgattcgggtgctcaacaacaccctccagaccgccgacctgccgcacatgctgttctacggcccgccggggacgggaaagaccaccaccgcactagccatcgcctaccagctctacggtccagagctgtataagtcaagggttttggagctcaatgctagtgatgatcgtggaattaatgtggtgaggacgaaaatcaagaactttgctgctgttgctgttggtactgcacggaaagctggttatccctgcccaccttacaagattattatacttgacgaagcagattcaatgacagaagatgcccagaatgctttgaggcgtaccacagagacttactccaaagtgaccagattcttttttatatgcaactatatcagcaggataatagaaccacttgcatcaagatgtgcaaagtttaggttcaagcctctttcagaagaagtgatgagtagtcgcattatgcatatatgcaatgaagaaggcctcaatcttaatgctcaggcgatgtccacactgagtgtcatttctcaaggtgatcttcgtcgtgctataacctaccttcagagtgcagctcgcttatttggatcttctatctcttccagtgacctgatcagtgtttcaggggttatccctgaagatgttgtcaagtcactgcttgcagcctgcagatctggtgaatttgacgtggcaaacaaggaagttagcagcattatagcagatgggtatccggtctcacagctgatggcacagtttctagatgtgattgttagcgcggatgatattccagatgatcaaaaggcaaggatatgtaaaaagcttggggaaactgataagtgcttggttgatggggcagatgagtatctacagctgctggatgtcgccagcgagactattcgcgctcttttcaacatgccgcggacgctggtcttctaagagttcataaagaggaatggcggtttcgatccttggcgaaaactttttcctgcctcttagatgccgcccaaggttaatctgcctcccctaccgctctgatgttggtagcttcggatgggttgaaaaagcgatgaactcagacttaaaatcccgctgaactgtgcctgtggatggatgcccaatatgacaatgaacatttctcagcgttcatcttgtgtgttatattccctcttctacttccgcctccagagtgcagcagttgacgttttttttttcgcactatggcattgcagtcagattttgttattgtgacttcttcgtggcacaggtcctataacaaagttacattttttgggtgcagtaaaaaaaaaaggtgcgtatataggtaagattaacatgaaaacacgttactttaaaattaacttagtgacacaggttctataacaaagttacattgttttccctaagggcttcccacacgtcatgttgatagtctgtccatccaacatttttttgcttcaagatcactagaacaggaggcttatcaacagagtactcagtatccatattgtgctatgatatttatccagagcagatcctacaattactctgcccaaaaatacattgaagaacaagaatatgtaatacttagatacagatcatctctccagagatgaatgcgatatcagcactctaaatgtagacataaacatagtatagttagaacttagaagcactataagaaagatcttcaaagcaatttccatgccggatactgcatatagagtgaagagaaacaagagatcagaccaagtttaatcactccaccacagagcgcgcacagggt

SEQ ID NO: 8395 - DNA, 807 bp, Zea mays
  misc_feature (169)..(169): n is a, c, g, or t
ggaacactcttctagttttccaagatggttggtgaccttgactgagtcaaagccacttaaaaaatgccattcttgaaatggatgatgcagttattaaggtaggaatgactggtcagagtttcaatgaagcaggaatatctgctcctgcgctcaacatttcagatcctgnttggtgaaaatgtggttaagcctactcaaacttgtggggagggtcaacttcgtggagaggatgtcatatccagtaataacgtcatggaagatgacctaacttctagagcatgctgatgtatgatcattgtattttctgctagaaaaggaactattttagtggacatcaagaatagctggtagtgggcactcattggtataaaggagagatcgttgggctggcgactggcatggatggatttttactgtgtgcgaggcacttctgggagcgcggggaccgtccgcgggaaggcatggcacagttggctcttaagctttcctgacttttggttcttctacattgaggctgttgaccatggagcctttttttagtagtagaagtaagcaaattgaaccatggaagttctatacgacccacaatccgggtcaacattttgttgtagatatacatgtctggtagttttctgttgtcctcctggtcgacccgaactccttattaagagctggtacttggtacccatggtatgcatgtgaaattctgttccatgtccagagagtagaaaagaaaatgaaacccgtgtgccagcggttttaagcaaaaaaaaaaaaaaaaaaaaaaaagaaaaaaaaaaaaaaaaa

SEQ ID NO: 8396 - DNA, 2175 bp, Zea mays
cccaataaaaataaagaaaagttggcacagtgcaactccaagacagcccttgctttcagagttcgggatgagtgcttccggccacgctgtgacgatagaagtggaattaatatgattcacaatgttgcatataattgtggttctgatttcagtcgtttagacttcagtggtttctatgcatttatcctggaacggggtgatgaagtaatagctgcagcatctgtaaggattcatggaactgatttagcagaaatgccattcataggcacaagaggcatgtataggcaccaagggatgtgtcgtcgactactgaatggaattgaatcggccctcggttccctcagtgttcagaaactagtagtatctgctgtgactgaaatggagaatacttggacaactggttttggttttaagcctgttgcaccttccaagaaacaaagaatgaagtcgttaaatctcttgattatgaatgggaccggtctactagagaagaggttgctgccaacacaaacagttgatggacagatcactaccaagacagctaatgctgttggatctgataagatggatgctaaaatgcttggtgaagcaagtggatctgtgacacccattcatgtttctagtgaacccgatgcctctgacaatcgtgaaattaatcgccatgagagtcctcatcctttaggaaactctgcaggcttgacattggaccagtctcctgctgcagacgaaaatgaagcgaaaataactacagaaaggacacccccagtatccataggtgatgctaagacagtcaaggtgcatacacttcctggagctacttgtggagttaacttgcagtgcatggttgaagcagagaacattcaacaagagaaatacaaagaaaccaatgggagattgattgctgaaaatactatttcagagcagaagtgtgaagatagatctaattccagtcgttcaaattcatgtgctactccggtgactgtggatcaatgttctcatttatctaatgagattgggaaaggtgacaactgtttatctagtgaactttctgttggagctgctcccataacaggcaaaactgaatctagtttgacatctgttcattgcgctaaccaagaggatgagaaagcttacgcagcccctgtggacactaaaatacctttagtcattatggatgaaaagcctgataagcatgagtttaaaactatggttgtagggtgtagtcaaggctcaatggaacctaaaagtttggaaaatagaactagtattgtaaatggaacctcaatggacgcctatagagataaaagtcctaatgaagatcacagtgcttctgcagttgacactggagtatctgtgaagctatatgctcagcaaatggagacgattgaggaaaaaactggctcagttttacggccgcgtgggcactcttctagttgcaaagatgtgttggtgaccttgactgagtcaaagccacttaaaaatgacatgcttgaaacggatgatgcaattattaaggtaggaatgactggtcagagtttcaatgaagcaggaataacagctcctgcgctcaacatttcagatcctgttggtgaaaatgtggttaagcctactcaaacttgtggggagggtcaacttcgtggagaggatgtcatatacagtaataacgtcatggaagatgacctaacttctagagcatgctgatgtatgatcattgtattttctgctagaaaaggccctgatcattggtataaaggagaggtcgttgggctggcgactcgcatggatgaatttttactgtgtgcgaggcacttctgggagcgcggggaccgtccgcgggaaggcatgacacagttggctcttaagctttcctgacttttggttcttctacattgaggctgttgaccatggagccttttttttttgagtagtagaagtatgcaaattgaaccatggaagttctatacgacccacaatccgggtcaacattttgttgtagatatacatgtctggtagttttctgttgtcctcctggtcgacccgaactccttattaagagctgatacttggtacccatggtatgcatgtgaaattctgctccatgtacagagagtagaaaagaaaatgaaagccgtgctagctgttataagcaaaaaaaaaaaaaaaaaaaaaataata

SEQ ID NO: 8397 - DNA, 2475 bp, Zea mays
cccccttggggtcagggggggaaaaagactgaaagaatggaaggatctatgaattgtcaatgtcatcagaaaaatggataactctgggacgatcctggcctgcagccattgcttggagctcgcgcagatgttctggtatcagcgtgcccagctgagggttctgcgggttctctgcatatgcgacatggtacgcagccacacatgcttgcggccatgcgatcatcatccggcactgccacagaaaggcaagaaaacgaaatcagaagcaaagcgtatacaaacagtaaaacaacgtccacaatgggtaatctatgaaagcaagtggatagataacattatctcattttttgtgtgtcgaagataatggtatctcattttcatgtaaccctgactccctcatagcagaagaatctagaacaatagggtggaaaggtaggcacattactagattccactgacaccctaaatcaatgtaaattcaaaatttctaggaggttgcttgctgttgactaatttatagtttccaaacacactataatatgcaagccttaggatggtatcgactaaatattcttaaaattatggtgtggcatacaaattttgaaaacagcagatgtatgctgtctttagacaaaagtacatagccagttcaatcgggttgcactagtagtgataaaaacagagaaaaataggagtgagattgagtgcaataccatataataaccgatcaggaatgcatagatggatatgggcaaagctagtttcttctgatccttatccatggctagtgcccatgatccagaaaccaatgaggccaatgcgcctgatgtaacggaagaaaggaagcaaaacgaaccagtgaggtctgaatcaacaagctctgcaatcccacggagaacaaaaagcgaccacacatcccgtgaagccacacagaatgccttcccccgcgcccccacgtgcacaaaaccccaacggttagcacgtcccagcatcttctctgatacagcaaagcagcagccctgtcctgacaaaatgaactcgtcgttgcccccagccgccgttttcattgctcgagccaatccccgcaccgctgagttcaccggcacagccactgcacccatgcatatgtccccaaaggctggtccaaatatcgtgtcacagaatgcttccacagcaccgcccaggacgtgaatcccataggtgagacgtccatgtgccagttttgccactgccacatagacaatgtatctcagcacctgcattgtccaggccatgctcactagaagtgctgccacataagccatccggtagtccatgaagtgcccttctgcagcagcaatgcagctgatggcaactgtccagaaggccatatacccaaacgttgcaagaaggacatagacaacaaggcatgaagtagcaggcggtaaatgtgcaccgatgacagaaacggaaagcatatcagaggcatgcttgagacgtgggccagtggcccaacaactgtataatcctgctgcaattgcgaatacaactacaagcgctccaatgccaagtgcagcagtattgccaacaagaagtatgactacatcacaagcaagtgcagaaacaggggcagcccagagagaggtcttgatggcttttggcgggtttgtgacagcaaggataacccagaagcatgcagcaattgtggatactatgacagaggataccagagggatgaagttggagaagggcttgtaggcagggttctggtggtaagaggcctggacgcctaggaatgctgtgagggcaatgaaagcaagcagatgaaagatgaacagcaacttcgttacactgcctgtgaaaccactgcagcaaccacgactatcctggacctcaatgttgccaaatgctggggaataaatttgctcttcactttcaacagccgcctgagtaagatttggaatgttagtcatgtgaatccacttcgatcagaaacaccaaaattcagttacaggaaatgtgctctttcatttcttacaagcttaagtcaataggcaaagcaatagaatcctgagtccttcaaaaagctaaggaaactcagtaactcatgcctaaagcaatgccttctccatacccataaggtatataaaaaattcgaactatgtcatagatgtgttattaaacagaaaattaacaaatgtcgcctggaagacaagcattgtcatcagtttacctgctttggaaaaggcaatgaacctgaccaaaggcctaatattggagtaatgtctagggggaaacttccattctatcgatttaatgtccacaagatttttttcctcaaaacaaatcatacgatattcttttgaaaacataaacaacaattattccttccttccaaagtgaacacaactgaaattgctatgatgctatttttaacttgtcgtacattgaagctgccacaggtccaagctaagtctctgtttgtttctttccagg

SEQ ID NO: 8398 - DNA, 1279 bp, Zea mays
tgcagatgatgcagtctccacaactaggacggttctgatggttgtcggagcaggccgaggacctctagtaagagcatcattgcaggctgctgaagaaactggtcgcaagttaaaagtatatgctgttgaaaaaaatcctaacgctgttattactcttcatagtttgatcaaattggagggttgggaaagcctggttactgtaatttctagtgacatgcggtgttgggatgcccctgaaaaggcagatattttggtaagtgaattgcttgggtcctttggggacaatgaactatctccggagtgtctggatggtgctcaacgattcttgaagcctgatgggatttccattccttcatcatacaccagcttcatccaaccaataacagcgtcaaaattgcacgacgacatcaaagcacacaaagatattgcacattttgaaacggcatatgttgtgaaactacaccgcatagcgacacttgcacctccacaacaggtttttactttcacccatccaaatttctcaccaaatgccagcaaccaaaggtacaccaagttgcaatttgaaatgctgccagacatgggttcatgccttgtgcacggatttgctggctattttgactctgttctttataaggatgttcatcttggaatcgagccaaacaccgctacaccaaacatgttcagctggttcccgatcttcttcccattgagaaagcccatctacgtgcccgaagggtctcctatagaagtgcacttctggcggtgctgtgcccccacgaaggtgtggtacgagtgggctgtgactacgccgaccccgtcgccgatccacaacagcaatggccggtcctattgggttggtctataataaggcatcaagatcatctgtgttgtaacagagaggaaaaagaacagagatgatatggtttagttctatctgagttgagcagtgtgcttagtgctactggtttctgcctggagagctgatcaaaggatatctgtagcgtgttgttatctgatctgaaagggagtgcttgacccccaacgttgttctactcgattttgctagcgtttcagtaggatttttctagacttgcaaacgttatgctttcgtcagattctgaagcgtctgcatcctttcctttttcatctatgtactgtggctcttgtgtgtgactggaaattcgttaccagtttgctatgctggaacatggaaaagaaaaaaaagagataattataattgtttccatcccggttgcgaaaaaaaaaaaaaaaagcggcc

SEQ ID NO: 8399 - DNA, 692 bp, Zea mays
ccaatttctcaccaaatgctagcaaccaaaggtacaccaagttgcaatttgaaatgctgccagatatgggttcatgccttgtgcatggatttgctggctattttgactctgtactttataaagatgttcatcttggaatcgagccaaacacagctacaccaaacatgtttagctggtttccccatcttcttcccattgagaaaacccatctacgtgccggaagggtctcctatagaagtgcacttctgggcggtgctgtgcccccacaaaggtgtggtacgagtgggctgtgactacaccgaccccgtcgccgatccacaacagcaatggccggtcctattgggttggtctatagtaaggcaatcaagatggtcgctttgtgttgtaacagagaagaaaaaagaacagagagatgatagggtccagttctatttgagccggatgctactggtttctgcccggaggagcagatcaaaggatctgtaacgcgttgttatctgaaaggtgcttgacctccaacgttgcctactcgattttgatagttgtagcagtaaaatttcttgtcttgcaaatgtttcttgttccgacaaatatccttttcccccatctatatcgctcttgtccacctccacctatgttgtgtccccatagcaagtctagccgactagccttggcaaagcatggttgtgtta

SEQ ID NO: 8400 - DNA, 1540 bp, Zea mays
ctctttaggatccccctgtacaacactgcctgtaggcataagaacgcctagcctctacaacttgtatactgcacaacgtggcagcaggtacgagaacgtggcgggaaatgggactgcgagtgggtgggacagtgcattggcgagtcacagcagctcggtaaagatggccagcgacgggaaggtgatgccgagccagatgaagaagcgagtatgaaagccacgacgcttttcatttttttaccgagcaaaggcacttcatcgagcctcttggacttctctaaaatccggtccatgcgcggtaactttaagttgggtccacctccacacgaatcagcacgatagtgcgtagtggcaggctgccaagctcaatcaaggattctggactcagcatgccattctcctctcgcggccctgttgtttgccggaaatccgctcggggaccccgcgcgcactagccatttttgcgctctacctccgcaccaaccatccgcggttagttcacttcccacactcccccacgccactgtttcagtgttcccctcaccacccgagccccaccaccatcaccaccagtccaccaccaccaccggcccgtgccccagccacaacaaggcgaaatcaggggtggtcacgccgagcgactacgcgaagacgcagtcggcgggggcgaagatctcccaacccacattgcgcgcgcgtctacgcccgaggatcgatggttggcggcggggggcgccgcgcggcgctggggcgctggtgcctggtgatcctggccgtggcctccgcgctaggggtctctggccccgccttctactggcgctacaagaagggcttctcctcctcctccccctcgtccaccgcggcggcggtggcttcttccccgtcgtgccctccctgcagctgcgactgcccggcgcccctttccctcaagtccatcgccccagggcttgccaacttctcaataacagattgtgggaaaaacaaccctgagcttgccaaagagatggagaagcaatttgtcgatcttcttaatgaggaactcaagctgcagcaggttgtagctgaggagcatagtcaccacatgaacgccactcttgtcgaagcaaaaagacaagctactcaataccagcgagaagccgaaaagtgtaatgcagctacagagacctgcgaggaagctcgggagcagtctgaagtagcaatttcaaaggagaagaaactcacagcaatgtgggaacagcgagctcggcaactgggttggcatgattctcgagccacgagcatgtgacagctttagttctgaattttcaggtgaaattatttctggtagctgcatgggttatgccttgcagccaaaccaaccggcgacgtttgtctatgtaatatcagtttccacgacaacattgttaattttgagtctcaacattatagttccagcttccttacaaatgtgactagcttgctgccgcctagatatctgaattttgtcatagtactgttgaaagcctttttattaaggacatgtttgtttttctcctagatt

SEQ ID NO: 8401 - DNA, 2349 bp, Zea mays
actcgtgccgccaccgtcacatacaacctctaccatcacgcttctgccactgtcgtcaccaatccctccttttctctccacaggatctagtatggatagttggtaagaggtgaccacgagtgcactacaaatgacaccaacaaagatgagatgattctaccaaattatataattaaccaaataaaattcatacaacacatgcatagacaatacaagcaaaccaaaacaccagactcacatttcttgcattgctctatgctaaattgggctaccagattttattttgatgcgtaagtttggcaaagaagcgctcagccaatgttatctggacatacttgtccacgtgctccgccagcgaactcctgttcaccatttacgtccgcaacaagacgggctgaagcaaaagcaaaggcggttgcccacacaatccggcgggaacatggttccagccttccaggcctcccttcgccgcgcccaattcacgcttctgcccgaaatcccaccgctcgctatgccacgtcgctgggggccgaacagtcattccgcatccctcccgtttttaggaaaaccgattccccgcctcggggcccgccgggaccacaatgctgacctgcggaagcgcgaggaggacgaaagggaccggacgaagctacgcgctgcaccgaccgaccaaaccctaggcgttcggcgggcgtcaccacggcggcgaagaaagggtgcctcgcgtcgccttggtgtccccgaagtcgtcgacggtgcagctcgatccgcctcgtcgagcatgtcgaggagggtcccttgcaaattcttcttgcatggagcttgcttcaaaggagattactgtgaattctcccatgactgcaatgatcaaccagataatgtaaagggacccgccccggtggtagccgttgcagaaatgaacatgttgaagttcattgtaactgcccccaaccagcaaccactgtagcgcgtgcatcctccaattcttctcagctagttgcttcttccagagatccccattgcagcgaatgccaaacggatttatgtgaccaaacacagcagatttgcaagtcaacagcagcactttctgcacatcaacctgcatgggttgttgattatcatgaccatgacactccagatgatactacaagctggccgttgcaccaagctgtgcaaaatcaaacatcacaatatcctgttcatctgccaatttgctcttctgctgctgatggcacttgtccttatgggaaaggctgttctcagatgcatggagatctgtgtgcattctgtgaaagacagtgcatgaatccttatcaatctgatgaaaggggggtacatgtcaagctatgcaagaaaaacaatagagttcttgaggccatgagaagaagtgaagacatagaatgtggtgtgtgcttggaccgtgtgctttcaaaacctacggcagcagaaaggaggtttgggctgctatctgactgcgaccattccttctgtatctcatgcattaggaattggcgtagcacctctcctacgtctggcatggatgtcaactctacactcagggcttgtccaatttgccgcaaattgtcatactatgtagttcctagcattacttggtactcctcaaaggaagaaaagcaagaaattgttgaaggttacaaggccaagctcaggtctattgattgtaagcactttgacttcggaaagggcacttgtccatttggaagcagctgtttttacaagcatgcctacgatgatggccgtttggaagacgctttattgaatcatcatgatgccgacgatgcaagcgcagcgattgccaaacttatgaggttgtcgtacttactgactcggctgcatgtgtaaggaaactcaaacgtatctttgagcaaacattgctgagttcgattggagttcgttgaccgagcaggcaaccttggatttcgctttgtaatggatattataaaaaacatccaaaaaaaagagggcagtcatttctgaattttatcttttcgctgaatgttcaaatcatcagaaggaagcagtcccaatcgtgccacttccacttggaagctagcattttctatccgggttggtacctgattggtggttgtgaccaaacttaactatacccaatactggtgatcctcgtttgttgcagcatctcgaaaaaaaaaaaaaaaaagccccgagaaatgctctattgctctgtaattgaagagtggagaaatgttaatctcgatctttagtgctgctcgcctgctatggcgcgtggaactaagttcagttaaccccagctatgggtattctttaccacgaaatattcatctcttttattgagattgagagaac

SEQ ID NO: 8402 - DNA, 815 bp, Zea mays
ccggccgggatggccgctccagttctggcatccccctccgccggatcacaggctcctccccgtttgctggcttcgcggtcggaagcgagacatctgggggcgtggagaacgtccttgcagagcacttgaacttcttcaactcagggtttgggatccatgtcaagaccaacacaggcaggggcggcttcatcaggaacatcactgtctcggatgtgacgctggataacgtccggtacggcctgcggatcgttggcgatgtcggcaatcaccccgacgacagctacaaccggagtgcgctcccgatcgtcgacgcccttacggtaaagaatgtccagggccagaacgtcagggaggctgggctgatcaagggcatccccaactcggccttctcccggatctgcctgtcgaacgtcaagttcactggtggcgcacctgtccggccgtggaagtgcgaggctgtcagcggtggcgctctcgacgtgcagccgtcaccatgcacagaactgacttcaacgtctgggacgagcttctgtacaaattcgctttgatgctttgccagctagctgagctgctgctatgcttctgtatctacgagtatgtatactggtgctttaaagcttgggcacccaagtatttatcttcccgaaaattaatttggttttactaatttatttgaacctctctatacgaagagaataattcttgactcgtataggactgaacaaaaaagtgtcactggttttcttatttacctgactcaatgttttattcacaaagtacttgtttctaagcaaaaaaaaaaaaaaaaaactcga

SEQ ID NO: 8403 - DNA, 1925 bp, Zea mays
gtagcggtgtcagtgcgtcactactactttccacacgcgcctctcgccccgtacgcagccgctctctcgtaaatcgagatcttgtctgttgctctgctcttcgttcttcgcgtccgtccagcgacatcgtgcgcccggcaaggcaagaggcaagctgccccacttccagttactattcgagggagagagagagaaagagaccactaattaccttgtaaatcccccgtacccccggcgcgatgtacccaaacccatctgtgtcccattctcccatcccacgtaaatccacccgcaaacaactcgcagtaaccttttgtttgttcttttgttgccttccttttctccgcactcatcgcttgttgcggttcgctctctacaaggaggcggcttgcgcggggggcatcgtgcaatggcgcggcggtgcccgtgcaggctgctgctagccgtggcggcggcggccgtgctcgtggccgcggcagcgcaggcgcaggagacgtgctcggggaccgtccccgcgccgccgcgccgcggggcgcgggtgtccgtggccagcttcggcggcgcgggcgacggacggacgctcaacacggcggcgttcgcgcgcgccgtcgccagcatcgagcgccgcgccgcgccgggcggggcggagctctacgtgccgcccggggtgtggctcacggggcccttcaacctcacctcgcgcatgacgctcttcctcgcgcgcggcgccgtcatccgcgccacgcaggacacatcaagctggcctctgattgaaccgctgccctcatacgggagaggacgtgagctgcccggcggaagatacacaagtttaatccatggcaatgggcttcaggatgttgtcatcacaggcgagaatggaactattgatggtcaaggcagcgcgtggtgggatatgtggaagaacaggacactgctctacacaaggcctcaccttcttgagctgatgagctcttctgatatcattgtctccaatgtcgtctttcaggattcgccattctggaacatccatcctgtttattgcagcaatgttgtgatcagaaacgtgactatcctagctccacatgactcccccaacacggatggaattgatccagattccagcagcaacatctgcatcgaggattgctacatttcgactggtgacgattccatcgccatcaagagtggctgggatgagtatggaatcgcctatggccgccccagttctggaatcaccgtgcggcggatcacaggctcctccccgtttgctggcttcgcggtcggaagcgagacatcaggtggcgtggagaacgtccttgcagaacacttgaacttcttcaactcagggtttgggatccatgtcaagaccaacacaggcaggggaggcttcatcaggaacatcactgtctcggatgtgacgctggataacgtccggtacggcctgcggatcgttggcgatgtcggcaatcaccccgacaacagctacaaccagagtgcgctcccgatcgtcgacacccttatggtaaagaatgtccagggccagaacgtcagggaggctgggctgatcaagggcatcgccaactcggccttctcccggatctgcctgtcgaacgtcaagttcactggtggtgcgcctgtccggccgtggaagtgcgaggctgtcagcggtggcgctctcgacgtgcagccgtccccgtgcacagaactgacttccacgtctgggacgagcttctgtacaaattcgctttgatgctttgccagctagctgagcctgagctgctgctatgcttctgtatctacgagtatgtatactggtgctttaaagcttgggcacccaagtatttatcttcccgaaaattaatttggtttccaaaaaaaaaaaaaaaatctatacgaagagaataattcttgactcgtataggact

SEQ ID NO: 8404 - DNA, 1823 bp, Zea mays
atgacagtagatgcgctgtgcagtagatcacacctccaatggttgatggacaagctagaccccaaggatatgacaatacgtcctggtccaggaaaggaactcaagatcacaaaggatattgttcatcttattcttggcgtgccacatcatggaggtggtaaacctttgggtattgatgaagcagttgcagcaagcaacttgagggcagagcttggtgtggccaaagatgagttcaatgtggcatttctacaggatcgattaaggaaaggcgaggatgatgacctttcaatcagatgtttcttcctcattctattcaaccgtttgctgtttccaactgctagctggggcatcacatatcatgaggtgcttctcacagaagaaatgcaccgtttccatgagatcgactggtgccagttgatttttaatgatctatgtgaagctgccaagaagtggcacaaccggatcaccacaaatgtctccacgactatatatggatgctccattgttgtccttgtaagtatagtgtttttccgtatgcacatttatttcattattggttcctaacttttggtagttatgtaacatgttttacgatgtttgttatgtctacttacattgctattgaacattgtaattctttttaatgtagttgtactacttggatcacctgcatacagccgctgccccccataataagagtggcacacctcgcattaaattttttgataagaatagcataaaagctttgaccaaagctgacaagaggaaggttcgccatggggctgaatctttcggacactgtgaagtaagttattcatattttcacagttggttatgcacagttacacagttggttactcacagtcactacaattttatttctagttccgaagctcgacggagacatgctatgcagttggacctaagatcgatcgccaatctgaggcaagtttatgatgtattatatccattgtttatgattatttatggaacaaatagaatacgaaggtggacatggattcttactattttttgctcaacaaccagccggagtgcaggaccaatatttttgatgcaccgcgccctgcccccatgcctcggccaacttttaacatcaaacttccatctatcaaagagatgatgtcaagtaagatcaacgatctcccacatcgtcatcgatctaaattcacagatattcttgctgcatatgacttggaggttgacaagtcatgcgtagccataaaagacagcatcgacaaaattattgtcaagcaatacgacatagcagacaagtttatagaattgatagacgaggtactacgtgccgagtctgaaaatttggaaaacgagactgatgagccacagcaaccggggaattcggctgattcagcaggtattccttattcagaacattttatctttcgacatgtgcatacgttttttgttataagtacagttaacagcttatgtttttgtcaagtatacacagcaacatttgatttataatgcaaattttgacatatattattttcaatataattgtgtacaaggacacacagttgatgccacccagcccacacccgatatgccatcccaagcttcgcagcttgagacccaactgggtgctactcagtttgaagaaattcacgaaagacaacagcatatccgtacagtccttgagacctttcccgacgaatcggatgtggtttcagatcaacaggtaatttgtccaacgacaatactatttttactcattatacgtacatgtatgcatacttctttttagcagtatgcgaaccacactttttttgtcaaccatgatt

SEQ ID NO: 8405 - DNA, 1063 bp, Zea mays
ccgggacctttacacatatctccgtatttacaaattaggttgttgatgtaggctgtacgcacctgctggtttgctactcgatcctatatatcgtccaatcctatctgacctctcgacatctggtccttgattactcgtcctttttgcttggtgcctgtgtatatcgtcgccccggccgcttgagctagcttcctctagtgctcgctctcgtcgtcgatcggttgtttgcatagcccacggcgagccgaagcaatgtcgtcggcgcccctgcagatcgcgccggtgccggagcatgtgtgctacgtgcactgcaacttctgcaacacaattctcgcggtcagtgtcccgagtcacagcatgctgaacatcgtcacagtccgttgtgggcactgcactagcctgctgtcggtgaacttgagaggactcatccaatcacttcctgtccagaaccaccactactcccagcagcaggagaatttcaccgtccaaaatatgggttttactgaaaattaccctgagtacgcaccttcgtaccgcatgccaacgacgctgtcagtgaaaggtgatctggatcatatgctgcacgtgcgcgctccagagaagaggcagcgtgttccttcagcatataacagatttattaaggaggagatacgaaggattaaagcatgtaacccggacataagccatagggaagccttcagcactgcagcaaagaattgggcacattttccgaatattcattttggtctagggccctgtgaaagtagcaacaatcttgatgaggccaccggtgcaatgtgccatccccagaaagtccaagatctctactaagacctatatcagcactgccctttgtttcctcttagttctggactagttggtgagtgccatatatatatgcatgagtgtgatatgatcatgaggtaaggaattatgattaagatgatatatatgtacgagatgaacatgcccctaggttcatgaaagactaaataaggatcgtcatctcaccatgttatcataggtagtaactattgtttgaaataaattatcctttgtgtgc

SEQ ID NO: 8406 - DNA, 787 bp, Zea mays
agtcagacatagagaatccttctagacacagcgatgtgccggtgccccagcaattcattgtggcatttcgcacccacatcaaccccttcacacacgaaccagatcagaaaagccactactgctttctctctctctctcacacacacacagacacaaataaaagaaatcagtagttcgatttctcctctcacctttatttacacatatctctgtatttacaaattaggttgttgatgtaggctgtacgcacctgctagtttgctactcgatcctatatatcgtccaatcctatctgacctctcgacatctggtccttgattactcgtcctttttgcttggttatatcgtcgccccggccgcttgagctagcttcctctagttctcgcgctcgtcgtcgatcggttgtttgcatagcccacggcgagccgaaggaataatgtcgtcggcgcccctgcagatcgcgccggtgccgggagcatgtgtgctacgtgcactgcaacttctgcaacacaattctcgcggtaaacaccctcatctctctgtttgtccccctccctcctttgaattcccagttctcgatcggcatgcatgcctctgaagtgcagatctacaaaggggagatgcacatgaaatgattggctgcgcgcgcgcatgcatcatacagtttattttgtaggatttggctgtcccctcttgctggatttcttcttcttcttctttatttttttgctctataaattgttttgtaaaggttgaatgaaatttctgaacaaaaaaaaaaaaaaaa

SEQ ID NO: 8407 - DNA, 2075 bp, Zea mays
  misc_feature (1128)..(1128): n is a, c, g, or t
atcgactggtgccagttgatttttaatgatctatgtgaagctgccaagaagtggcacaaccggatcaccacaaatgtctccacgactatctatggatgctccattgttgtccttttgtactacttggatcacctgcatacagccgctgccccccataataagagtggcacacctcgcattaaattttttgataagaatagcataaaagctttgaccaaagctgacaagaggaaggttcgccatggggctgaatctttcggacactgtgaattccgaagctcgacggagacatgctatgcagttggacctaagatcgatcgccaatctgagccggagtgcaggaccaatatttttgatgcaccgcgccctggccccatgcctcggccaacttttaacatcaaacttccatctatcaaagagatgatgtcaagtaagatcaacgatctcccccatcgtcatcgatctaaattcacagatattcttgctgcatatgacttggaggttgacaagtcatgcgtagccataaaagacagcatcgacaaaattattgtcaagcaatatgacatagcagacaagtttatagaattgatagacgaggtactacgtgccgagtctgaaaatttggaaaacgagactgatgagccacagcaaccggggaattcggctgattcagcaggacacacagttgatgccacccagcccacacccgatatgccatcccaagcttcgcagcttgagacccaactgggtgctactcagtttgaagaaattcacgaaagacaacagcatatccgtacagtccttgagacctttcccgacgaatcggatgtggtttcagatcaacagagaggtgcaattgcaacagaggaaatggaacacaatgacagtgggccagtttttgaccagaccccaactcctcatgttgatacactcaaaggtactacaaactctggatctgatccaccacttacagagcaagagtgtatccgttctctgtgggatttaatttgttccaaggacattgaccaaagcagggttgttattgattacggtgattacagtgcaaactgtatggatatttatgaatctttcgcggagggtaaatgtcttgaggatgtcttcatgcangtgtttcatagagtgtgttcgtgatgattctaaaaatcatcgtcgaactctgacatctaacagattaatacttgatgtcaacgttggggctctgttaaattttgaagaacaggaacgtcacagcaagaatcctcagtcgtttgatcaaaatgtcctacagaattgcttgcacaacacattgcctgctttggtgaatccggataaatgcaagtcgataatggtacctatgcttagcaggggtcattggacactctatgtgatcaatctacaccaccgggttatccacattttagattcgaatccctatggtatacaacttggtggcaccgaatggaaggactatcattatgatccaatttatttaggtggcaggaaattcccatgggctagggtgataatgagtaggctgagcaaagcgttacaacacgtttgccccaacgcagaatttcctaagtttggtaattttccattggatatgccatctaactgcccaacaatgaggacagggtcaaatgactgtggattttttgtgatgagttacatgaaatcttatgatcacaatgcaggtgtcatatcttctttcaatcaaccagacaattcccgagatctacgtgctcatgcccttcatcaactcacattccatcgcatcaacaaggcgttgccacttccattagatatccagagatttatgtttgcgcgcaattagtgaactatgtcagatctaagcaatggtgtgggcaatgtaccgtactgtggtattttggccattttgttcagttaacaattgtaggaagcttccttatatgtgctgttttcagaacaattgtcatgctacttttgtgttaggggtgttacccaggttctttctgtgaactttagttggctggatacttatggttatgtcgcgaatatgtgaacatcagatgttttcacttctgtgtgcttta

SEQ ID NO: 8408 - DNA, 1164 bp, Zea mays
cctcgaggccggccgggactacttctttctctctctctcaccacacacagacacaaataaaagaaatcagtagttcgatttctcctctcacctttatttacacatatctctgtatttacaaattaggttgttgatgtaggctgtacgcacctgctagtttgctactcgatcctatatatcgtccaatcctatctgacctctcgacatctggtccttgattactcgtcctttttgcttggttatatcgtcgccccggccgcttgagctagcttcctctagttctcgcgctcgtcgtcgatcggttgtttgcatagcccacggcgagccgaaggaataatgtcgtcggcgcccctgcagatcgcgccggtgccggagcatgtgtgctacgtgcactgcaacttctgcaacacaattctcgcggtcagtgtcccgagtcacagcatgctgaacatcgtcacagtccgttgtgggcactgcactagcctgctgtcggtgaacttgagaggactcatccaatcacttcctgtccagaaccaccactactcccagcagcaggagaatttcaccgtccaaaatatgggttttactgaaaattaccctgagtacgcaccttcgtaccgcatgccaacgacgctgtcagcgaaaggtgatctggatcatatgctgcacgtgcgcgctccagagaagaggcagcgtgttccttcagcatataacagatttattaaggaggagatacgaaggattaaagcatgtaacccggacataagccatagggaagccttcagcactgcagcaaagaattgggcacattttccgaatattcattttggtctagggccctgtgaaagtagcaacaatcttgatgaggccaccggtgcaatgtgccatccccagaaagtccaagatctctactaagacctatatcagcactgccctttgtttcctcttagttctggactagttggtgagtgccatatatatatgcatgagtgtgatatgatcatgaggtaaggaattatgattaagatgatatatatgtacgagatgaacatgcccctaggttcatgaaagactaaataaggatcgtcatctcaccatgttatcataggtagtaactattgtttgaaataaattatcctttgtgtgcagttttaaaaaaaaaaa

SEQ ID NO: 8409 - DNA, 1085 bp, Zea mays
tcgaggctcggcccgggctctcacctttacacatatctccgtatttacaaattaggttgttgatgtaggctgtacgcacctgctggtttgctactcgatcctatatatcgtccaatcctatctgacctctcgacatctggtccttgattactcgtcctttttgcttggtgcctgtgtatatcgtcgccccggccgcttgagctagcttcctctagtgctcgctctcgtcgtcgatcggttgtttgcatagcccacggcgagccgaagcaatgtcgtcggcgcccctgcagatcgcgccggtgccggagcatgtgtgctacgtgcactgcaacttctgcaacacaattctcgcggtcagtgtcccgagtcacagcatgctgaacatcgtcacagtccgttgtgggcactgcactagcctgctgtcggtgaacttgagaggactcatccaatcacttcctgtccagaaccaccactactcccagcagcaggagaatttcaccgtccaaaatatgggttttactgaaaattaccctgagtacgcaccttcgtaccgcatgccaacgacgctgtcagcgaaaggtgatctggatcatatgctgcacgtgcgcgggtcaaatgactgtggattttttgtgatgagttacatgaagtcttatgatcacaatgcaggtgtcatatcttctttcaatcaaccagacaattcccgagacctacgtgctcatgcccttcatcaactcacattccatcgcatcaacaaggtgttgccacttccattagatatccagagatttatgtttgcgcgcaattagtgaaatatgtcagaactaagcaatggtgtgggcaatgtaccgtactgtggtattttggccattattgtcagttaacaattgtaggaagcttccttatatgtgctgtttcagaacaattgtcatgctactttgtcttaggggtgttacccaggttctttctgtgaactttagttggctggatacttatggttatgttgcgaatatgtgaacatcatatgttttcactacaaaaaaaaaaaaatataatcgtttttagttctaaaaaaaaaaaaaaaa

SEQ ID NO: 8410 - DNA, 2749 bp, Zea mays
cccgcatccgactggtcctttgtgacatccattgtgctggtgcggccgcgcgcatgcagttgtcgcggggcacggttgctatcgcataggagcgttcccggcccccgtcctctgccttgtacagcgtccctgtttttttttttttttttaaaaacacagtggagattaatataaacaagtaacacccgcattcaaatgcatgctatataaacctcataaccactaaaaaactacttaggaacttgaatgtgttatcaattgtacatctataaaaaactcatagccactaaattagcgagatgataccttcgatacctaccctgaaggccttgcccatctttccatcaggctattccctactctaatgacttcttcccacaaacacgggaccaaaggaaaagaaaaaaacaagaaattaaacacttcgtggtacatatgctgtatttgagaaaccattagctacttttggtggtagtggtggcttcttgtagtttgctaagctacagtgggggcagatgtattccaaaccgtctgtcttagcgtaatccttgaaagtgcctagcccttgtcgtctgtcgcaaccaaagtgagcccattcgccacataaaccgcagttcacccaatctccaggtgcgctactgtgacaaagcaagcagcattcgccatccacatcatcatgtgctaactcatattccaacaagtatgtctcgtaatgcctttttaatgtgttacctacaccagtcattctgtttgttgcagtatggttacgcatctttgagaagacttgacccttccagtttatgccgttacccacataaaatccacctctagacaccacctctttgtacagggtataaaggtcaaggcgcttggcgttaaggactgcatcaggaaattcagctagtcctccgtgaggtacaagtcgattgtggcccctcgggattaaccccgccggccccgccttcaagaagtcctcctcagagcatacttgtatagacaacctatcacatccatgtttcttcataggcagaggattcaactgaatgactgaaggagtatgagatggccctgatgttgattttctgtgcgtggttggggcataagaaactgaattgtgcttcacagttggcgcaactgtcaagcttggcttcacaatactagtttcatgaaaggaagtttcaggtaaacacataaaaggatgcatttgttgcttttgagagtgaggaattggcctcatagttgcaggctttaatttagccttgacggctgaaaatgaggaaggcccttccatcatatgcttcttgtcttccaaaactccatttgcacccaacagattttgttttgattctgaacccaaactttgttctgtccttggtaagggaggctgaccatcttggcagatgaaaatatggaccgttttcattagccaaatctttgcactggcttgtgcaaaagaaaagaagacggtctgcatctcgcctctcaaatgaagcaacaggagtaccatttatacaaccaataccaagtgcaaccaaactcctgtatgatatatctggcgctagatgcttcagaacctgtgctgcccacttaggaagggacatccaaacttcaaaggtagaagccccacaagccgtagacatggaagttaaaggctcacttgatggtaacttgtcctcactatttgagagagcccggactaactggcttttctcaataatttcattttttatgtggctctctagaagctggtcatcgaaacaagtctgtgcgctaccagaaacgaggagtgacacatgggaagagctgcaagtagtgatatcacagcgcatagtaaccatcccacgtggtagagatgcagcttcaagaggtggtggagaagcactgattcgattctgcagtttgctcccacgaatttcaatattcagaagtgcattcagaccgtcctctaaagagcccaataaacaaggatccaaggtgcatggcactccacataggagtaacttcatgttgatttcttcatcatatatttttatagccggggtcacttcagatgaaccttcttcatcagccatttctgtcccaggtgggcttatatttatttttggagcatccccaaggagacgcggaccaagcttaacactttgcacatgattgtttcttacacaatatagacgaaaggatgcgtgagcaagctgaaaagcatcccaagtatggctcaccgaactttgaactactgacatcaatgcatggcgaaaatgagatgcggcataagacgagaatgaatttctccagtaaattacatatgggatcccctttgagtgaactgcttgggcaagtttttcaccaataggaacttccagatatactatcgttgggaatggtgggctgataagagtgctaaacgcctgcggatcagagacatcggcgtccccccacacaagtgagccaatctccttctcatcctcaagctgctgaccctggatgtacaagaagttgggctgcaccacccgctgcgcctcgaggaactgctctggtgtaggattaaacagtgtgtggacctccaatcgcccagctgagctgagctccgggaatgggtaagacggccgtggccgcttcgcctccagcccagacttcgctgctggtgctcgcttctcagcatacttcccacacagcaccacaaggagcacacagttgttccgcgagaagctttggatttgagacatggctggcaggccggagcctccctggc

SEQ ID NO: 8411 - DNA, 1665 bp, Zea mays
tttgttcctgtcttgggcaactaaaaacacaattgagattaatataaacaagaagcttacaccagcatctaaccaactactgtaggagcttgtctgtgttatcagttgttacatgttatataagcctcataataaccactaaattaacgagatgatacattcgaagactactacatacctggaaggccttgcccatctttccatcagcctattatctactctaatgattcttcccataaacatgggaccaaaggaaaagaaaaaaaaaacaagaaaattaagcatttcgtggtacagatgctgtatttgaaaaaccgttagctgcttttggtggtggtggcttcttcttgtagtttgctaagctacagtgggggcagatgtattccaaaccatctgtcttagcgtaatccttgaaagtgcctagtccttgtcgtctgtcgcaaccaaagtgagcccattcaccacataaaccgcagttcacccaatctccaggtgcgctactgtgacaaagtaagcagcattcgccatccacgtcatcatgtgccaactcatattccaacaagtatgtctcgtaatgtcttttcaacgtgttacctacaccagtcattctgtttgttgcggtatggttacgcatctttgaaaaaacttgacccttccagtttatgccattacccacataaaatccacctctagacaccacctctttgtacaggttataaagatcaaggcgcttggcgttaaggattgcatcaggaaattcagctagtcctccgtgaggtacaagtcgattgtggcccctctggattaaaaactgcatgacatccttcaaaaaatcctcctcagagcacacttggataggcaacctatcacatccgtgtttcttcattggcagaggatttaactgaatgactgagggagtatgagacggccctgatgttgattttctgtgcgtggttgtggcagaagaaactgaattgtgcttcacagttggtgcagctggcaagcttggcttcacaatactagtttcgtgaagggaagtttcaggaaaacccataaatggatgcatttgttgctttcgagagtgaggaatgggcctcatagttgcaggctttaatttagccttgacggctgaccatgaggaaggcccttccatcatatgcttcttgtcttccaaaactccatttgcacccaacagattttgttttgattctgaacccacctttgttctgtccttggtaagggaggctgaccatcttggaagatgaaaatatggaccattttcattagccaaatctttgcactgacttgtgcaaaggaataatagacggtctgcatcccgcctctcaaatgaagcaacaggagtaccatttatacaaccaataccaagtgcaaccaagctcctgtatgatatatctggcgctagatgcttcagaacctgtgctgcccacttaggaagggacatccaaacttcaaaggtagaagccccacaagccgtggacatggaagttaaaggctcgcttgatggtaacttgtcctcactatttgagagagcacggactaactggctcttctcaataatttcattcttgatgtggctctctagaagctggtcatcaaacaagtttgtgcgctaccagaaacgaggagtgacacatgggtcaccta

SEQ ID NO: 8412 - DNA, 1104 bp, Zea mays
aaaacgttccgacctaaccacattccttccatcatttcatccttcccggtgcggctgcggccagatgcgtccaaattcctcatattttctctcctcccctggtcccttctcgttctcgcccgcgtaattcctctctggcgtctaccaaaagcggagcaaccgaggcaagaaaaaggggtgggcgaggaaaagcgattaggcttctcttccagttcctgattcagtctgagaaacaatggatatctgaagcatgaaaagtcaacccacctcactcttttaaacagttcggttaacacacttaatggctgcggtgtttgcatgacattctctttgagcttatatgggtggctgtattggtaatttaagcagatctcagtcacttccagattctaaaccgaagcgatctttgagaaagaaatatcaggattcatcgactggaaacagaagacgatggcaatcgggtctagaagcaatggagaagaatgttagcatatctgtttctcttgaggggaatatctcttctattcccaattcaatagccaacgactctaaaacgtcaatggaaaacagggtagatacatcatttatcaaccatgcggctgaagcatgggctgagatgagaagacaatgggttggacgccaggcagaagttctgagaaagaccccccgagagccagtgataagttggtccacaacatatgatgacctcttgtcgacaagtgagcgttttccacaacgaatcccattatctgagatggttgattttttggttgacatatggcacgaagaagggctctatgattagctgacctctgcctttctttacgccttgcttttagaatgtggtcaacttcctccccacaaaatatgtgaccttcagaagaaatgaaaaaactacatactctatgaattagtcgcaacatttgaattagtcgcaacatttgaaattgaaaaaaaaaactctcatgtgaaaaggtacaacagtgggttggtatatttggttgaaaaaaaaaaaaaaattcttcatgttgaaggactcgatgacctgtcattcctgaatgaacgattgcttaagaatataagggggaagggcatttttttctc

SEQ ID NO: 8413 - DNA, 1205 bp, Zea mays
gggaccctcgaggccggccggccgatccttccggtgggggcggccagatgcgaccaaattcctcctattccctctcctctccgcccacccttctctcgcccgcgtaactcctctctgtcgcctaccaaaagcggagcaaccgaggcaagaggaaggggtgggcgaggaaaagcgatttggcttctcttccagttccggattcatcgtaagaaacacatgactgcaatggatatctgaagcatgaaaaggcaaaccatctcactcttcaaacagttcacttagcacacttaatgacggaggtgtttgcatgacattctctttgagctgatatatatgggagcagtggctgcattggtaatttaagaaaatctcagtcacttccagattctaagccgaaacgatctttaagaaagaaatctctggattcatctactggaaacagaagacgatggcaatcgagtctagaagcaatggagaagaatgttagcatatcagtttctcttgaggggaatatctcttctattcccaactcgatagtcaacgattctaaaacgttaatggaaaatggggtagatacatcatttatcaaccatgctgctaaagaatggactgagatgagaagacaatgggttggacatcaggcagaagttccgagaaaggcccctcaagagccagtgataagttggtccgcaacatatgatgatctcttgtcgacaagtgagcgttttccacagcgaatcccactatctgagatggttgattttttggtcgacatatggcacgaagaagggctctatggttagctgacgtctggctttctttccgccttgcatttagaatgtggtcaacttcctccccacaaaagatgtaatcttttgaagaaatgaaaaaaaaactacttagtcgcaaaattagttttagcatttgatttttttaaaaaaactgttatttggaaagatactacagtggtttggtatatttggtgatgagctgtcagaggtttgtttatgttaaatgactcgatgacctgtcattcctgaatgggcggttgcttaagaatagaagagggagcattttctgtagtatcatctttgggggcacactatgattgggcccccggattgaagtttagtctaggttttagatgccaattaagaaaagtaaatgtgagttaattataaaactaattgcataagctgtttccg

SEQ ID NO: 8414 - DNA, 6052 bp, Zea mays
  misc_feature (5997)..(5997): n is a, c, g, or t
  misc_feature (6000)..(6000): n is a, c, g, or t
  misc_feature (6017)..(6017): n is a, c, g, or t
gtactagtagcagtaaccatactggttaaatctcgatgttattttttcactgctgcggcatgcggtgagcgagcaagcgaccggtcatcaggaccttttttcctgatttgagctgaccagagctcggcagcggcaacctgacatgtccgctgcccgctgaagcttccggctttttccgatgtatgtatgtacaagccctggaaaacgtcacctcaagaacctgcccagcccagcccagcccagcccagcccagcccagtgctgctgctgcatcggtcaccgatcagtggtgggtgcgagacatcctggatcgccaaggaaaggaaccacgtccactgttcacgcctcggctttgcccatatgatgcgtgccgtcgttattcgttaagcttcagctgaaacctaatcggccgcaagcttccacacctactggagctggacagacacaggctcactcccttgatatgtttgttgatcatgcatgcatacatctagtcgtcacacacggtacgtgtattggtgtactggtccaattatacggtctaaacaagtgcatagtctcgctgtaatccatggagctccacggataatggaggaatagattaataacaccaccaataataataataataacgaacggttggttcgatcgatgagtccccgcctaatagcatatttggtgaggcaacaatagtactgtccttgtgagtaaggtgggtccacttgtcaggcaccctatcatccctgccactgcaggtcggcggcgctgctgccgcggcatgccaatgactgcataaacaagtttctcgcttgcttacatcatcccctccacagtttacatcctgtgatcctgataagttggcacttcacagttcaaaccccccacctcggctcgagccccctctctcctctccacatatatatatatcagccttccgcccatcccaaccccaagtacacagagaaacaaatacagagaggcagaggcgccatcatctcccttcttcttcacccacaagcctctaggtgcctcacaagtcctcctccgctgtcatctcccctctccactcctccctggtttgttcaagaaactttctttggacaagatgggagtgcagaggtacaggttcttctgctgcgggtgtggcgccaatgcggcggccgacggccgggaacgcgacgaggacgggggcttcggggtgtccgacggcaaggccgagaagggggtcgaggccggcccgcgggggctgtcgtgggcgcaggttgaggcgatgacgggcgggttcacctcggccgtggtcggcgagggcgggttcagcaccgtgtacctggcgcgcctctccggcgcgctcgccgccgtcaaggtccaccgcagcagcgagcgcctccaccgcgtgttccgccaggagctcgacgcgctccagcgcgtccggcacccgcacatcgtccgcctcctagccttctgcgaccagcaaggtgggtcatctcctctgctctgctttctcgcgctccgcctagtgcgccttccttgtgctgtgctgagtgctgacggaaggctctggcttttttttccccccgagtcgcagacgaaggcgtgctggtgctcgagttcgcggcgaacgggaacctgcacgagcggctccacggcgggggcaaggccgcggggacgatgccgtgggcgcggcgggtgtcggtggcgctgcaggtggcgcgcgcgctcgagcacctgcacgaccgctgcgagccgcaggtggtgcacggcgacgtgaaggcgtccaacgtgctcctggacgcgtccatgtccgccaagctgtgcgacttcgggtcggcgcggccggccggctcggccgccgtccgcccgcgctcgtccgcgcgcaccatgctgggctcgccaggctacgtcgacccgcactacatccgctccggcgtggtcaccaagaagagcgacgtgtacagcttcggcgtcctgctcctggagctgctcacggggatggaggccttctgcgcggaggaaggccggctcctcactgccgtcgtcgcgccgcggctcagggcaggcgacccgccctgcgacgcgcgcgggttggtcgacgagaggctcggcaccgcctacgacgccgccgaggccgccgcggtggcggcgctggccgcggcctgtgtcggcgacaaccccagcctccggccgtccatggccgacgtggtgcgcaccctggagcagcgcgcgcagggatccatctccgccgtggagaggagatcggacggccagaggaaggtgtgagccacgagggcggggtcgtcgcgtcctccgaggcgcccagatctggcttgccgacttgttaacttgcggtgctgacgtgcgtgcatcgcacacgtggcgcgcgaacattggttgctaggagaacaaagcgttgctggtgtgcgagcacatcaaaaggacgaatcaaaaaagaagtggagaaaagcgtggtgaaaattgaagagagagagagagagagagttgattaggggaaaggtttggaggaggtaaaaaggcagggctaatctgtgtgctgatggggggtttgcatcatatgttatgtgccaaagcagcatctacttgggagagcccaaaaaatatggatcgtgcagcacacgattctaagattttgttgattcttattggtagtttcttttgttattttggcaaagtacatggagtgtttcttctttgtacctataatttagctagatttcaatttgtattggatttgttgagagcttggtttgttaaacctgtgtgaatggggaaaaaatcgcttcttgggaatgcgcctttggtgaacggcccgggcattgttcagaaataaattgggcgctgatacgattttattccgctgtcagaggtccagccggactaataaattgggtgtttgcatcaaagcgttcaaacccttagtttcgggggcacatattcgcatctcctttctcggggacaactcaagccgattataataccaacccataccctgctatcagtagacgtaagaaaacactgcaccgttcattcttggtcaagaaattatatcccttttctctcgtttattctcctaattatatgcacgaaagaaccgacgtgtggccaacaatcggtctcattgttagaataataattttttcatagtaatacgtttagtttggctcatttctggtaaattgtcgatatcggtaaagttttaaattgaaaaaaaaaatctaataatgcaagacaaatgattagacattaggagtacgtatggtgtttagcacggcacgacgaagtagccagttgagagcttgactttaacaaaaaccgttgaaagggacacatgtgctcccagactaggcgcacgcagctctctctctctctctctctctctctctgatctggcacgcatttattattggcgcggactgtcacaggtcaggcctggccaacgccacgaaagcagagctcggaactgtacgttgacgtgcgaggacaacccgtaatcctcacaccacacgggaaacgccgtgacgccccggaccccggagcctcacgtcagggtggtcgtgccggcgctgcacaggcagccaggcatacatggtgtgcgtcgccggtcgccggggagcggtcacgtgcggacggggggagagcgggccgggcgcgtgcgccgcgccgtactggtggccggtggcgagtctctgttggcgatggcgcgcccggaccgccggggacattggctcgccatctctttcgtgtttcgggcagccgccgacgcgacaggcatccgcctgatgggttaccgggttactctatatgacattttgtgaaagctcggttaggttagttcttttctgtatgggaagtactcgattttatcttcttgtccattgattttttttctctcgcaattattatatgtatcaagattacaaagacggataaaacaaggttgtattctgtatagagcagagacagtggaagacgagagacgacctctttaaacaattttaaaaactgaaaaaaaggagacggtggaagacgagagactacctctttaaacaattttaaaactgaaattatagatttagcatcttaaattatagatttaggaagttgctaaaacactttaagaagtaaaaaaaaatagtgctccaatagttatgtatttattggttgctaattttcaaagttgtctatatcaacatgcagaatactaaaattactacaattctaaaacacctttaggtagaattagaatataacaaaaactttgaaagacttagcatcatcactcataatattatccaattaaaatttgacaattaaacaaagaacaaactaattgtacgtggtggaaaaacttagctaaaaaacttataaacttataagcagaataattacccacagctgagctgcgacatatctcgtggttgggcgccgaagagcaaagatcgtaaactctgtaataatcaccaaatcagacacattggcgtacgggtagatttctgagatccaaaacgaacactgccatggcaccgatatgtagataacgacggcacaggttaattgttgtggtccgagtccgaggccgatgccctggccctgtacatatacaaccaaccagttcgatggatccgacagtcgggcgtgctttccagagagaggcctcgtcgaggatcaagtcatcaggcttgctctgaataattctgcaggtgcgtgatgtgtgcgaactaactatgcagggagcagttgagacggttgacacagtacttagatcatcatacggccgggatgccagaacaactaaatttgctctggtttctgtactttggctcccaaaaaaaaccaaaaaagaaaagaaaagacctgagtagcctggctggaatgttggctggatcatatgctgattacgcctgcgccatgaccaaagaaacgctcacttcttaccctcccctgcaataatttgcagccacgagcaggcgagctcgtccagtgcgattacgctcctattctaatgccattattatctgcatgatatgatggttttgcaaggaaggtagcagcatcacatgccatcctctagctaggttgtgcttgtgccatgccatgccatgcatgatgtataaaagggagagataataatgtctggattaaattcttttggacagtccgattgattttttttatcagttagcactatcaacctcgtttgattgtgcgcgaagttttgaacacagatttctttctttttttaaaaaaaaaaggaaactcattccaaatccactggaaccatcaacatctttttcatcggagaattattaaatgtggctagcagtgcaagaagtaccttctcttaggacgaagagaatgttactttacaagttgcttacgatcccctccagattttcgacgccctaacgaggagcacgtcacatgcagatgcaggcactgcagtggatagagctgaaccagcgccagtccctttaattgcaagttctggtgactgctggttgtgctgttgcaaggttattattgctaatcgcgattagtacgagatcagaatccagagcagttctatgatgctgcttttgacgacgccaaaaagggtatctgcctttctcgttatgtaaagtaaattagtgagaccctcgtctgcagggaagcgtagaagactaccgtacctgtgcagaatcagatctctctctctgagctgttaactgtcctgtgacgatgcgtgggtagctagctgccgctggagcgagtacacacctcaccagcaagctaagggagatgatgaaactaccaccactgaacatgcatgcaaacaaacacgccgatactagctaccaggcacagagtagcacaggttgttcgtggagaaaaaaggcagccgcagcgggaacaccaaccatgcatctcggcctaatccagatctcgtgtactaccggttcacggattgcaggcatagaagaaaagggggggggggggggggggngcnaggccttttgcatgcanttgtaaagaactaacgatgggttgggttaaccaac

SEQ ID NO: 8415 - DNA, 4242 bp, Zea mays
tggctacgtactgcagcgcgcagggtctttctcgtgaagtacagacaggtatatgtatgtatacctgtatagagctgagctcgatgtgaatgagcaagagaattgcaggggatttgaggggctctcccaaactatagcctgcagtgaattaactagagagacccaaccgtatgcatgaaccaacacgcgaaattcgttcgggaaatggagattgcatctaattcgtcatatcatcaagacaggaagcaaacgcatttatcacgacgactctcggatgcgcgcgcgctgcgtcctcctcgtccctgcagcactgcacgcatcatcgctctccctggcagccctgcagcggcgccaacagccacaggcccacgctggcctgcagcagcacagctccctaccgtccgcccgtcgccgtcggcctggcgtccattttgaccatcccttggcggccactccaaactgagaacaggtaatcggatttaagtgttgaatttttaatataaatcgatggtggaagaatttaaatgttgaatttggcatatggttaaatcatgatcaaatagactaagaagttcgcttgtacgcttgcacataatatctggttacacattagcgtacttggcttgattggatggcttcgtgtatatgcgccaagctggaccctctctagccggctgcatatggtaattttgcacgcgcggacagatgcaggttaatagcttttaaataatttgatttgcatctactcatatcgtctacgtctccggcaaggcggcaaccccggcaaccgacataagtttgcaaccccggcaaccgacataagtttaaacaaagttaacacatatggtggtttgagatgacttggtgtggacaaccaatcagaccccacagcgtagtgctggctagttaaaacaaatccgtgaatgtagtagttttccactgctgctgcggcctgcggtgagtgagcggtcatcagtaccttcttttttttttccctgatttgagctgatcggagctcggcagcggtaaactgacatgcggctaaagcttcctgcttactagcccttaattaacgtacgtcgtgccgtcatctcaagaacctgccctgcccggtgcccaggaggctgcatccatcaccgatcagcggtgggtgcgagacatcccggttcgtgaaggaaccacctctactgttcattcacgccttggcgtactggtccagttattatgagtctaaacaagcgcatgataaatgtcgatgtaatccatggaactccatggataatggaggacgactagattatattgaatgataaacggttggttcgaagcatatttggtgcggcacaatatcgctattggagacttgagagtaagatgggcccacgtgtcagaaaccccccatcatgcctacccactgctgcataaatttctcgcttgcttacctcatcaccaccacagcacacgtcctaaccccacaccgacagacctgtatataagccttcccccaacccaagtacccagagatacaaatacagagaggcagagggcaggcggaggcaccatctccctcccttcttcatcacccacaagtcctctcctctgcggtctcctctcctctcctgtctattttgtgcaagaaacttccttggacaaagatgggagtgcagagttactacaggttattctgctgcgggtgcggcgccaatgcggcggccggcgaccgggaaggcgacgaggacgggggtttcgaggcgttcgacgacaagggggccgccgaagccgggccgcgggggctgtcgtgggcgcaggtggaggcgatgacgggcaggttcacctcggccgtcgtcggcgagggcgggttcagcaccgtgtacctcgcgcgcctctccggcggcgcgctggccgccgtcaaggtccaccgcagcagcgagcgcctccaccgcgtgttccgccaggagctcgacgcgctccgacgcgtccgccacccgcacatcgtccgcctccttgccttctgcgaccagcaaggttgggtgctctgctctcctctgctacgctccgctctctcgcgctagttcgccttgtgcttgagctgctgacgaaacgctccggtggccttatcgacgcgcagaggaaggcgtgctggtgctggagttcgcggcgaacgggaacctgcacgagcggctccacggcgggggcaaggcggcggggacgatgccgtgggcgcggcgggtgtcggcggcgctgcaggtggcgcgggcgctcgagtacctgcacgaccgctgcgagccgcaggtggtgcacggcgacgtgaaggcctccaacgtgctcctggacgcggccatgtccgccaagctgtgcgacttcgggtcggcgcggacggggttctcggccgccgtgcgcccgcggccgtccgcgcgcaccgccatgctcggctccccggggtacgtcgacccgcactacatccgctcgggcgtcgtcaccaagaagaccgacgtgtacagcttcggcgtcctgctcctggagctcctcacggggatggaggccttctgcgcggaggagggcggccgcctcctcaccgccgccgtcgcgccgcggctcagggccggcgacccgccccgcgggatggtcgacgagaggctcggcaccgcctacgacgccgccgaggccgccgccgtggcggcgctggccgctgcctgtgtcggcgagaaccccagcctccggccgtccatggccgacgtggtgcgcaccctggagcagagcgcgcagggatccatctccgccgtggggatggcatcggacggtcactggaaggtgtgagtcaccagtggaaagtcgtcgcctccgccgacgcgctcagatctggctccccgagtcgttaacttgcggtgctcatgcgcatgcgtcgcgcacgtggcgcccatccattggttgcgaggagaacaaagcgttgttagtaggcgagcatatcaaaaagaaagaggggacaaaagcgtggtgaaaaaacgttgatttccatagctaaattaggggaagacttggggagataaaaaggcagagctaagttgtgtgctgatggggatttccatcatattatgccaaagcggcatctacttgagagagacaaaaaaaagagaggatctttgcagcgcacgattccaagattttgttgattcaaaaaaaaaaaataaatttttttgtaaagtgcatcgggtgtttcttccttgccgttgtctgtacctataatttagctagatttggatttgtataggatttgttgggggcttggtttgtgaacgctgcgtgaatgaacaaaagaaatcgcatctcgaaaatgtgcccttcgcagaacggcacagtcctggttcaaaaacaaatgggcgtccatacgacttttattccgccgccagtggtcgtgctgaaataataattgggtgtttgcatcaaagcgttttgaacgcacatactcgcctcctgctctctgaccgagtgtactgccaacccataccctgctaccacttgacataagaaaatactatcacgtatgttattggtcaaaaaaactatatacttttctctttttttctttttttctaatttgctgtgcaaaatgcgtgaaagaagcaacatgtagccaaacaactgttctcatttgtagaatgataaattgttcgtacttaaaaaacgattaacccagtatgaactgtgtgacttttcattaattaagaaagagaaacggaaaaaaattcaaatagaactgtgtggttacatgcattacctcatcttccattcactaagtttagtttagctcatttctgctgaattgtctactcctatattggtaaactttaaataggaaaaaaaactagtagcggaagttaaatgagtagacatacttgtggtgtttagcacggcacgacggaccagccggtgcagagcttgactttaacaaaaccgttgagagggacgcatgtgctcctaaactaggcgcgcacagtgtatttttttccctgaactggcacgcatttgttgttggcgcggaccgtcacagcaacatgtctcgcttgcccaacgcgacaaaaacagagctcggaactggacgtggacgtgcgagcacacgcacaacccgtaatccccccacacggagacaccgtgacacggcccggagcgcctcacgtcacggtgctcgtgccggccggcgctgcacaggcatacaaacggtgcgtcgtcggtcgccggggaagc

SEQ ID NO: 8416 - DNA, 2641 bp, Zea mays
  misc_feature (770)..(770): n is a, c, g, or t
cggacgcgcggcccgacgcggcaccccccaccctcacgactgggccggccgtcgctaacgccttcggtgccccttcgccggcgacgagcaccaccagtcatcatgtcatcatatcctgttctaaacaaccgaccaatcgatcagtggagagttactgatctgaaggatgagctccgtaaaaggaagcttcctgttaaaggtttgaaagaggaactcgtcaagcgactctctgactccattcagagtgaaagagaagctgacgaagctgatgaggatgtggcagtgaatgtggatgatcagttgcctgatgccaatgctattgaggaaaatacagttactgttacagaagttcatcaggaaactgtggttgatgtcactcatcaagttgaagttcctacaaccgaagttggtcaagaatccataatttctcccactagaggcccccccagtgttgatgttgaagaggcctcaacaaccaaaggaaaagtacctgaatcagttgctcgaggaaatttgacatttgaagaagtgcaagtgcatactaaaagtactaatgagcctcttcatgagaagaccacagatgttgacaccaatgatgcagtcgatgtgaattcagacttgatccctgctgaagtcaagtttggtgctacagaagcaagcaaaattgaagaacaggattttcccccagcgcctgtagatgacttaacttcagattctactggtcctttgggtactgatgttgtcacagctgcaacttcagctgcaccagntagcgacgaaggggagaaactggcacccaaggatgcttcgggtaacaaggtgtcaatgcatgatgaagagcagaataattctgataccatgaacgaggactgcaagcccatcatatcacaatcaaataatcaggtacccgaggttagtcaagatttagggtctcaaattaagtgtgagtcgatttctactgataatctatcaactaacaaaaagaataatatagaaggtaatttaaatgctaataattttgatttagaactagagattcagccgagggatggtcgaaccatcatccggcattactccattaggtggagatttgcagccattggatgatgacaaagagctggttaagaaccagacatctttggaagacatagattccacagataatgtggactcatacaagaaagatagtcctgaaggtggatctccagagaaattaaatctagacaggagttcaggtgatgaatcaatggaggaggatactgtggaccggccgcaagatgagtccaatatgaaatctgatgatctcggaggaaagaatgagtttaactcagaagatgtgaaagaggtgatcctccctgattctgttgttgaggcttccaaggaggctatggctgaagaaaagtcagcagcttcaacagaaaagaggaaacttgaagctgaagaaggtgttgcaagcactgaaccaatcaagcgacaacgtcggtggactgcagatattgccaaagtttcagggagacaagcattgagtcaaactggtcctgaaactcctaaggaaagttttcagcctgctttcaaacgatcttttgggaggtctgattcaacagccagtgtagattctcctaaggagcggattgtaccaccttccgagaaacctcccacaacttctttgagaattgaccgatttgtacgcccatttaccctgaaagctgtgcaggagtttcttggtaaaactggatctgtacaagacttctggatggaccatatcaagactcattgctatgttacattttcttcggtggatgaagctgtggctactagggatgctgtttacaacctacagtggcccccaaacaatggcaataagttggttgccgagtttgttgatcctcaggaagtgaagctcaaggtcgaccctcctcccccgccagctgctcctgttagcccagctgctgccacaagggcacctcctgttcaacatactcagacaaatcaaagtgtgccacgccaggctgctgcaccaaaggaggaactgccacctccacctccccctccccttgctaagccccctatggctgacctgacgcctttaggaagagagaggcttccacccactccaaaaaagccggagcctcctgtcgtgacacttgacgatctctttaagaagacacagtcctctccgaggatctattatcttcctttatcagaagaggaggtggcagccaagctcgccgcacagggcaaaggaaaaaagggataggaggtgttagcttccattttcggctagcttggagtttgttgcggaacatggcgtgcggtggtcacagcagctgacacgtgctactgctgtggcgaaagagttgtagccttgtagggctgttctgtggaaaaaggacactagtgtaggagcagcagcttgtatttcctaatgagattgttagttttgattgggtctccgagtagagtgtgtgctgaagttatttgatctacatgaagtgttgaggtacttagtttaatttatgctgccaggtactgtaaaactgaaagatactggttctagttttgagtctatggagaatactgttacaccgtctcttattttagtcttcgccttggttgctgaccgcgaaaaaaaaaaaaaaaa

SEQ ID NO: 8417 - DNA, 6102 bp, Zea mays
  misc_feature (915)..(915): n is a, c, g, or t
  misc_feature (1154)..(1154): n is a, c, g, or t
  misc_feature (3618)..(3618): n is a, c, g, or t
  misc_feature (4577)..(4577): n is a, c, g, or t
  misc_feature (4655)..(4655): n is a, c, g, or t
  misc_feature (4691)..(4691): n is a, c, g, or t
tttggccgtttgttgttccagtttttttttcagaattaatctgaaaaagtagaagttgttgatacctagctttagctagtttttgtaactcagtcaactataaataaatccagattattaacaacggaaggatccaaatatctccgccgttttatctagattttagaaactagatgtaagatctaacagtttatttatccttgtaccctctttaaatttcactctacaactagtgcggtcgtgttttgaattttcatacggctgacacggtctaacaatccggaagcgagcgatcagtatacgcagccagaaaacccataggaaaaatagcgtagcgtagcgcgcgcgcgcgcaaaagacgacggcacaccctgcctggccgccgtactgctgcaggtctgcagcactgcgactgaccacgacctgcacaggcaacgcagtcgtctgtcgtcccgtcccagcgctcgatcgggtacccacccacccacattcccgagaaaacgtcccccgaaatggacaatgattggtggcggcgcgccgcaccgtccatgccggacacgtcgcgtcccatgtcgtcatgcctcgggcaacgggcacgccggggcaggccccactctgtcccctatccttccgcgagcaccgccgccccgtcccgccaattccatgggtctgtttggttcaattttttttaccagcttttctgagaatctgactgtgtagagaatttaagtattattaggattacgtgcgaagaaagataaacttgtccataggactcaggatctagaaagtgacggattactactattacaataactcaaccaattatgtgtttatgttgattttgaatgatttttatctaaacgaattttataaaagctggctaaaaagttaagtgtttggttcagcttctancttctgatggccagaagcccccaagaagctgaaccaaaccggggccatgtctccccgtcgcgtcgcgtcgccttgtctgggagctccagcactcagcagttcatcgcggcccttgctagctgccagcctcaaaagaactgcgagctcggccacctctcgctctgcttttattacttttccatctccagcctcggctagatcctgcttgctcgcttccactgtaaatataaatattctcnggtcaccatcaccggcgcaaggcaacaagaatataccgtctcgtctcctgttgctctgggctccggttcccctccctgcttgctttaaagctgcaaagcccttggcggctccggctcctggtcatatagaagagcggaggccgatccgtgaccgtgagcactctgctctctgctgctcgcttctctcatccgatccatgccaccatagcggtcaaatagactaggtcgaccagcctttttctttcagagccttgtgtctccctttgcctctttttcttttctgctgtgttcccagctcgcagcccttccatgctcttgtcacatacactcgcacgcaggccggcctttgagctgagaccgccgagaggcatagcacaggcaccaccacacaccaccgcaccagcccttgccgcgtataaaacgtctcgtgcgtaggcggcggcgactagctaggctgtccccgtcacgcatacgctacgcgcacactatattgggggggttgcatgatcaggcatcatccgaccgacggcatgaggaggaaagggagcgactgtacacggatcagcccagccgagatcacgcccatgatctccctgccgtccaccaggcggtccgcgggccggacggcgtcggcgccggaccgggaccgggaggaggagcgacctcggcaacggcgagtgcgaggcgcgtgcggctctcgcctgctgcggaccgcgcggtggacggccgcgcgcttctacaggcgagcgcgggtaagcatcgccagggcgtttcggcccccgtcgacgacggcggccaagagagcacaagcaggcgccggcgccgcttcgcccgactgcggcacgccggcgaggcggcgtagtagcaggcggcagcagcagtcgtccgcgccgacgacggtcgtcgtcgtcgatgactcgcacaagagcgaagcggtggaggagtgcatcaggttcatgaactcgtcgtcgaggaagtaccggtagagtctctggaggttccgtgtgcgcgcggatgctagcggcctcgttcttgtatttgttccttcctcttttctatctctctctctctctttttgcctttcatctgtatgcgcatctgttctgatgtacttgagaaacatactggttacttgcaaaaaaaaaaaaaaaagcctgaaatctcgtattgctagttctattttacatttgagcgaaacagcatttttcatcttattaagcagttatttgcattgtgtaactagcagatacttatttcagccaccatattacggttacagatattttatatagtatgatctcactctcttatccaaattgatccaggatatctcgctacctatagttaactactagctcacacgatccttttatatgggagttaatttttcctccctcatgcgtgcccacagcccacgtcaagagttgtggggagtcgtgtgacgtgaccaacgagctcttcctcaaacctcctctgaccaacggagaacggtcaaaattcatttattactattatcctgtcctctttaattttagtcgcaaatactcgcaacatgcatgttatcaccatgattagaccactgttgtttctttctttcgaggggaagaaaagaagcatatctatcatcccacaaccatgtacagtgtcgaatcatcactttgttcctcccgcaactctggttttgcagttggttatgatggctgtcggaggtaaactccagctggtcgtccgaggaggtcaactttagccggttggcgaagagcacccgtctaattttaagaacaaagggatacgcgagaatctagagtggttcaggttgtcggagcgtaatatcatacatccgcttttgagttgtatcgctgggagctcccatgcttgtgagttttgagtgtgaaattgagagagcttgtccccttgtatcgtatgtgccctcccttttatagtcatggggacacgtacaaggatgctgagctccaacaagtttgcccgacaatatagtattaaataacatacaacatcgagctttaaatgatgcgtcagacaaagatcttctcactcggtcgtcgtgcggatctttcgaccagatgtgcctccgtcctgtctaccggctcgagtcggcaccgaaggagagtctgttacgttgacgtgtgtaggggtcagccatactgacatgcacatgagttaatggtgacagaggtgaactgccgcctctagtcggcgctgcagtgggtgcactactcgagccaacggttactcatgatgacgccacccacgcgcgtggcataactgctcgcctcggtaacccgtggtacattgtgcgacctatgtgcactatgctgacacgcaaccgctcgcctagttaacgcgtggtgcggtcattcgaacctgcgcctcaaccgtctacgttgaatgtgggtggacgagcttgcttttagccaaaggcttgtgccacatgcccatgggncacgcggcagcaccgaacctctatccatgcggagagcgatgacccagagcacacgatatggcctgaagtcttgggtccccttgttaggggtccagatgaaatacatagagtctgggacccttctgtgggggcccgaacggtacatgttgaggtccaggacccacctatggggcccggacgacatacgtggggttcgggtcacaccagcggggttctagactcatagcagtagttcttgagcacttgcacccctaggacacatggcgacatcagatctgtccggctgtccccgagcgaggagcaggtcccgaggccaatggtcccgttaaatgggtccggacccataagcctgacttctcagttcctcagtgtgtggttacaggtaaccacacaggtatctagccttggcacagtaaaagagggtaccgcaattacggcgtactgacaatggtacaatgtgtcctctatactagatacaacttcgctcatcatcgaatctaataggatgtccccacacactactaatcttattggcaatcatcttggtaaccgccttcatggtgaaggtcgataccttggcctacagacaccatacaatccaagaattaccggatgggtacgattccatatccatccctttttcgaggattgagaaaaccattcgatttatcatttaggtgaagaggattattgctaggaagtggagtgtaggtatgatgttgcattctattctaagtttgtatgtgactatgttgttgtactaggatatagtgtgaagtgaacattatttttcttagtttgtactagaatctagagtgaagtgaataatattctccatccgcttctccttgtggttttgcttcactaccacttggaaaaccttcaactacagtgcatgcttcttgtggatctgcacaagtattgtaagataccaatcaccctccaaagttgcttagtgntgtgtatgtgcttcaataaccacatgcctaaccaaatagtcatagcttgcacgttcaagaactgtgtctccgagttancattaaaacaacgctacaaccatctatatattaatncaaaactcatgtatagacatccatacgatcattacatgtgacaattcatctatatatagaattgagaagtcctattatctatgctccaatttagttttcaaagttattaaacttttacacaaatttcgtaccttataacctcatatatactctatctagtaaaagataaccaatacacaatgtcaattaacgtaactacgtgattaaataacttatatatggattcaaaataaccaaacaagccctcacttgggggcagccgggtaggtaccgtagtcacttcttgagtggcgggtcctgagatcccgctgcgaaaaaagtttgaaaaaatgcaattaggtgtctgtggcccattagggggatggaaaacacttatttctgcaatctttcagttccatggtatagttttgatatttagaatatttttaaatttaaaaatgaaaatgctactttaaaatcctaactgtgctctcgcatctcgtccgtgcttcaaaccagttgagccgctgggctgatctgggctacatcacagacgagcccataagcattatattcctgcgacaagcctacgagcacatttgtttccagcccttccaaactgaaacgatgggctctgatcagtacaggcttcctccattcccttggcaagtgatttttccttatccagtcctggcctcctccttttccttttatctactacaccctctttgtcttccttttgcatctgcgtgcttctcactattataatttataaccgtccgctgcaacggaagaaagaacttccgtgactttcatatgtcttaatgttattatgtaaaattctagtaagcctgtgttaaattatttggacataaatatagtataatgttgattttcatagtactattcatgtgtagtttcagttacatattaggttccataaatttctttgaaggcctataaaaatcaataattctaatctttaactaaagtcggcaagttgttagttgagagatctcttgtttttcccctgaaatatcttaattagaccctacagttacttctgccttcagtgccttcaacacatactccagtgtgcatgctttatacttttacgtggcataaagtgtgcgaaagagcctctagctgagttggtttgttggtttgagtagcactcctcagatcctgagttcgaatcccagtgggagcgaatttcaggttgagtagcactcctcagatcctgagttcgaatttcaggttaaggtcactccttggttcccttggtgccttggtggtgtgcacataagatggactaatctatgggggtccgatccttgtgtagagactgagggctcaaagaacgagtaaagatctggcctatagggggcggaccctcaatgctgcatgggggggggggggagctttcgtgacc

SEQ ID NO: 8418 - DNA, 1881 bp, Zea mays
ccacgcgtccgcaaacaatcaggtacctgaggttagtccagatttagggtctcaaattaagtgtgagtcgatttctactgataatctatctcctggccggccgggtactataaaagataatttaaatgctaataattttgatttagaattagaggttcagccgaagatggtccaaccatcatccggcattacttcattaggtggagatttgcagccattggatgatgacaaagagctggttaagaaccagacatctttggaagacatagattccacagctaatgtggactcatacaagaaggatagtcctgaaggtgggtctccagagaaattaaatctagacaggagttcaggtgatgagtcaatggaggaggatgttgtggaaattaaacaagatgaggccaatatgaaatctgatgatctcggacaaaagaatgagcttaactcagaagatgtgaaagaggtgatcctccctgattctgttgttgaggcttccaaggaggttacggctgaagaaaagtcagcagcttcaacagaaaagagaaaacttgaagatgaagatattgcaaacactgaaccaatcaagcgacaacgtcggtggactgcagacgttgccaaagttccagagagacaagcattgagtcaaactggtcctgaaactcctaaggatatttttcagcctgctttcaaacgatcttttgggaggtctgattcaacagcaagtgtagattctcctaaggaacggattgtaccacctgcagagaaacctgccacaacttctttgagaattgaccgatttgtacgcccatttaccctgaaagctgtgcaggagcttcttggtaaaactggatctgtacaagacttctggatggaccatatcaagactcattgctatgtgacattttcttcggtggatgaagcaatggctactagggatgctgtttacaacctacagtggcccccaaataacggcaataagttggtcgccgaatttgttgatcctcaggaagtgaagctcaaggttgacccccctcccccgccagctgctcctgttagcccagctgctatcacaagggcacctcctcttcaacagactcaaagtgtgccacgccaggctgctacaccaaaagagcaactgccacctccaccaccgcctccccttgctaagccacctatggctgacccggcggctatagcgagagagaggcttccacccactccgaagaagccagagcctcctgttgtgacacttgatgatctcttcaggaagacacagtcctctccaaggatctactatctgcctttatcagaagaggaggtggcagccaagctcgccgcacagggcaaaggaaaaaaggagtaggaggtgttggcttccattttcggctatctcggagtttgttgtggaacatggcgtgcggtggtcacagcatcagacaggtgctactgctgcagaccatttgaaataaccggcggccgtgactgccgcggcggaagagtagtcgtagggctagtgtaggagcagcagcagcggcttgtatttcttaaagagattattagttttggttgggtctccgactgcagtgtgtgctaaagttatttgagctgcatgaggttttgtttgggtactctagtattgatcccaatctatatgtgttgaggtgtaaattagtttaagttacatcctaatccaccttaatagatgtgggttgagttaaatattagagtacccaaactaggcctgaagcgtctgaagaacttggtttaatctatgctgtcaggtactgttaaaaggcaccagttttagtgttgagtctataaaaaaaaaaaaaaaaattccccctattaaaaaaaaaactcgagactagttctctctcgtgc

SEQ ID NO: 8419 - DNA, 887 bp, Zea mays
cccctcccccgccagctgctcctgttagcccagctgctatcacagggcacctccgcggcaacagactcaaagtcggccacgccaggctgctacaccaaaagagcaactgccacctccaccaccgcctccccttgctaagccacctatggctgacccggcggctatagcgagagagaggcttccacccactccgaagaagccagagcctcctgttgtgacacttgatgatctcttcaggaagacacagtcctctccaaggatctactatctgcctttatcagaagaggaggtggcagccaagctcgccgcacagggcaaaggaaaaaaggagtaggaggtgttggcttccattttcggctatctcggagtttgttgtggaacatggcgtgcggtggtcacagcatcagacaggtgctactgctgcagaccatttgaaataaccggcggccgtgactgccgcggcggaagagtagtcgtagggctgtttctgtggaaaagggactagtgtaggagcagcagcagcggcttgtatttcttaaagagattattagttttggttgggtctccgactgcagtgtgtgctaaagttatttgagctgcatgaggttttgtttgggtactctagtattgaccccaatctatatgtgttgaggtgtaaattagtttaagttacaccctaatccacctcaatagatgtgggttgagttaaatattagagtacctaaactaggcctgaagcgtctgaagaacttggtttaatctatgctgtcaggtactgttaaaaggcaccagttttagtgttgagtctatgaagaatattgttgggattccttgtcttaaaaaaaaaaaaacagggctcaccgtgagtctcggcagagcaggttggt

SEQ ID NO: 8420 - DNA, 4343 bp, Zea mays
  misc_feature (4191)..(4191): n is a, c, g, or t
  misc_feature (4206)..(4206): n is a, c, g, or t
ctagcctgcgcgcaatccgacccacccacacgactgggccggccgtcgctaacgccctacttcggccccctttaccggcgacgagcaccaccaccaccagtcaccatgtcatcttatcctgtgctaaacaaccgaccaattgatcagtggagggttactgatttgaaggatgagctccgtaaaaggaagcttcctgttaaaggtttgaaggaggaactcgtaaggcgactctttgactccattcagagtgaaatagaagctgatgaagctgacgaagctgatgaggatgtgggagtgaatgtggatgatcagttgcctgatgccaatgctagcgaggaaaatacagttaccgttacggaagttcatcaggaaactgtggttcatgtcactcagcaagttgaagttcctaccaccaaagctggtcaggaatccacaatttctcccactagaagggcccccagtgtcgatgttgaagaggcctcagcagacgaagaagtacccgaatcagttgctgaaggaaatatgtcatttgaagaagtgcaagtgcatactgaaattactaatgagcctgttcatgagaagaccacagacgttgacaccaatgatacagttgttgttaatgatgcaatcgatgtgaattcagacttggcgcctgctgaagtcaagtttggtgctacggaagcaagcaaaattgaagaacatgatttcccccctgcacctgtagatgccttaaattcagatgctgctggtcctatggatactgatgtcgtcacagctgcaacttcagatgctggttctatggatactgatgttgtcacacgtgcaccagttagcgatgatgaggagaaactggaactcaaggttgatttgggtaacaaggtgtcaatgtatgatgaagagcacaatagttctgataccatgaatgaggactgcaagcccatcgtatcaaaaccaaacaatcaggtacctgaggttagtccagatttagggtctcaaattaagtgtgagtcgatttctactgataatctatcatctaacaaaaagaatactataaaagataatttaaatgctaataattttgatttagaattagaggttcagccgaagatggtccaaccatcatccggcattacttcattaggtggagatttgcagccattggatgatgacaaagagctggttaagaaccagacatctttggaagacatagattccacagctaatgtggactcatacaagaaggatagtcctgaaggtgggtctccagagaaattaaatctagacaggagttcagggggaccagtcaatggaggaggatgttgtggaaattaaacaagatgaggccaatatgaaatctgatgatctcggacaaaagaatgagcttaactcagaagatgtgaaagaggtgatcctccctgattctgttgttgaggcttccaaggaggttacggctgaagaaaagtcagcagcttcaacagaaaagagaaaacttgaaggtttgtctctctcttaagttctttctgcttgtttttcccctgaaatatcttaattagaccctacagttacttctgccttcagtgccttcaacacatactccagtgtgcatgctttatacttttacgtggcataaagtgtgcgaaagagcctctagctgagttggtttgttggtttgagtagcactcctcagatcctgagttcgaatcccagtgggagcgaatttcaggttgagtagcactcctcagatcctgagttcgaatttcaggttaaggtcactccttggttcccttggtgccttggtggtgtgcacataagatggactaatctatgggggtccgatccttgtgtagagactgagggctcaaagaacgagtaaagatctggcctatagggggcggaccctcaatgctgcatgggggggggggagctttcgtgacctgtctcggtcggggctccgattgagcttcttagtataatacagtgggggtggtctttctcctaccggccgagtttaaagtacccatcttgagtcataatgtttacagttctagtgaggacgcaaatgctgcacacatgtttatcttggcagctttgctttatatgcaatgactttgcagcaaataggaactgttggggatgtcaacagatcatccaaaaggaaaatgcctagagtaatcacattgtttctctagtagagatttggtgccttaaaatgttttatttccttttagtactctttatattcacgaaaaccatttaaagccttcaatctgggataatttggtcaacagtattatatggtacacttgcattgagattagatttattttaatgtttgtttttttcttatcgttggttccatctttataaatttgctttatgcatgaatgtaacaagtatataatcagctggacatgaagtttttgaaatttggacatagccattgaatgtgcaagttaaatgctaacccctagttgaatgcacagatgaagatattgcaaacactgaaccaatcaagcgacaacgtcggtggactgcagacgttgccaaagttccagagagacaagcattgagtcaaactggtcctgaaactcctaaggatatttttcagcctgctttcaaacgatcttttgggaggtctgattcaacagcaagtgtagattctcctaaggaacggattggtgagtcattggctccttgcaagaactcagtttctgtatccgtacacttcatgagtgactatctgttaacctttttttatttgtgttgtagtaccacctgccgagacacccgccacaacttctttgagaattgaccggtttgtgcgcccatggcctctgaaagctgtgaaagaacttcttggtaaaactggatctgtacaagacttctggatggaccatatcaagactcattgctatgtgacagtatgttttctttcctaaaccaagacttgagtatcttaactttgttgtttatcacatcattttgaaatgaacaaagctgccattcaacttcattcatgaagcaaattcaggctgcatggggcgaaaaacattttggactccatttttaagctgttggtgtttgataagtaataaaccatgataataatattagtgaaagcattcaattattgtggtaaactggaattatacatgttgttgtggctttatggaattgaatttgtgtagtgccaacactggacttttaattgaaaatgtttgtttcactgcatgtgtatgttgactatgttctatgcatattctgactgcgctgctaagctgactttgcctcatttgcactccaacttgatagttttcttcggtggatgaagcaatggctactagggatgctgtttacaacctacagtggcccccaaataacggcaataagttggtcgccgaatttgttgatcctcaggaagtgaagctcaaggttgacccccctcccccgccagctgctcctgttagcccagctgctatcacaagggcacctcctcttcaacagactcaaagtgtgccacgccaggctgctacaccaaaagagcaactgccacctccaccaccgcctccccttgctaagccccctatggctgacccggcggctatagcgagagagaggcttccacccactccgaagaagccagagcctcctgttgtgacacttgatgatctcttcaggaagacacagtcctctccaaggatctactatctgcctttatcagaagaggaggtggcagccaagctcgccgcacagggcaaaggaaaaaaggagtaggaggtgttggcttccattttcggctatctcggagtttgttgtggtatgcttaagttctgttgtaatgtgctttactaatctttctttggttcgaataaaatggtgaggatatctcatacaattgccctcccctcaggaacatggcgtgcggtggtcacagcatcagacaggtgctactgctgcagaccatttgaaataaccggcggccgtgactgccgcggcggaagagtagtcgtagggctagtgtaggagcagcagcagcggcttgtatttcttaaagagattattagttttggttgggtctccgactgcagtgtgtgctaaagttatttgagctgcatgaggttttgtttgggtactctagtattgatcccaatctatatgtgttgaggtgtaaattagtttaagttacatccnaatccaccttaatanatgtgggttgagttaaatattagagtacccaaactaggcctgaagcgtctgaagaacttggtttaatctatgctgtcaggtactgttaaaaggcaccagttttagtgttgagtctatgaagaatattgttgggattc

SEQ ID NO: 8421 - DNA, 957 bp, Zea mays
ccggccggggaaattgacgtgtgtaacctcctaaacctagagcagccctgtttgaaaaaaatggcatcgactcttcttctggccactcctatgggcgattgggtgccccggggccggccgggaaggaaactgaagttgcactttgaggagagacgagatcatgaggaagcaatactcccctgtgctctccttgtgcctgatggcccttgtcgtagctgctatggtctgtgtcatgtacaccacctcggcacaagcaggaaggagtggctacaactcgtacgaacctgatggaaggagtggatacaactctgttccaataaacggcggtggcagcccctagccaggcggtggagcctgtatcagaaatcaaaaaaatataaaggctcatcggatgaaaactgtgtgtgtattctgtcatgtcatgtgtgttggtatatgatggcttggtcgtcgtaattaatgtaatgtgtggacaataaatatgcggggttgcacctcaaaaaaaaaaaaaaaaaaaaaacaaaaaacgccgggcggcgcgggaacaaaccaaggaaactgaagttgcactttgaggagagacgagatcatgaggaagcaatactcccctgtgctctccttctgcctgatggcccttgtcgtagctgctatggtctgtgtcatgtacaccacctcggcacaagcaggaaggagtggctacaactcgtacgaacctgatggaagaggtggatacaactctgttcccatcaacggcggtggcagcccctagctaggcggcggagcctgtatcagaaatcgaaataatataaaggctcatctgtcatgtgtgttggtatatgatggcttggtcgtcgtaattaatgtaatgtgtggacaataaatatgcggggttgcacctcaacataacttactagtacagtacttgctattgcgatacaaaaaaagcggccagcggcc

SEQ ID NO: 8422 - DNA, 527 bp, Zea mays
cactcctttgggcgattgggttcctcgaggccggccgggaaggaaactgaagttgcactttgaggagagacgagatcatgaggaagcaatactcccctgtgctctccttgtgcctgatggcccttgtcgtagctgctatggtctgtgtcatgtacaccacctcggcacaagcaggaaggagtggctacaactcgtacgaacctgatggaaggagtggatacaactctgttccaataaacggcggtggcagcccctagccaggcggtggagcctgtatcagaaatcaaaaaaatataaaggctcatcggatgaaaactgtgtgtgtattctgtcatgtcatgtgtgttggtatatgatggcttggtcgtcgtaattaatgtaatgtgtggacaataaatatgcggggttgcacctcaacgtaactctagtacttgctattgcgatatatatgtactttattattattattaaaaaaaaaaaaaaaaaacaaaaaaaaaaaaaaaaaacccccggcccaatttgcggcc

SEQ ID NO: 8423 - DNA, 838 bp, Zea mays
cctcgcgcggccgccccgaggccgcctccgaggaaactgaagttgcactttgaggagagacgagatcatgaggaagcaatactcccctgtgctctccttgtgcctgatggcccttgtcgtagctgctatggtctgtgtcatgtacaccacctcggcacaagcaggaaggagtggctacaactcgtacgaacctgatggaaggggtggatacaactctgttcccatcaacggcggtggcagcccctagctaggcggtggatcggagcctgtatcagaaatcgaaataatataagactgtcttcaacggatcacactgccgctcccccacgctaaatttgggggctacagtgcacacgctagccgatcaacggctcacgctaccaggcgctctacgcggatgtgccccctagccagcttctctctccccctcgttctgtggtgcctctctcaccctctctaatattgttcacgtgggcccacttccaattattagtagatgaaaaattgataggaggtgaaaagtaggtatagaaaatgatattttatggttgtagtggggtataggggaaggatttagggggaaacgctgtacagagtggagatataggggggaagagaacgctgacgtggcacgtgagtgggatatagggagagaaatttaggggtaaccgctgaagacagtctaaaggctcatctgtgtgtattctgtcatgtcatgtcatgtcatgtgtgttggtatatgatggcttggtcgtcgtaatgtaatgtgtggacaataaatatgcggggttgcacctcaacgtaacttactagtaaaaaaacaaacctcgagctccag

SEQ ID NO: 8424 - DNA, 2070 bp, Zea mays
ggccggccgggggtagccgagggagtgcatctccgtgttcgcgattcagcgccgtgctcgacgcccctcctcccttcagaagtcagcgccgcatctccggttgcagagacttgcgctgccacctctccgcttttcgtccttcagttgctcgacgcccctcctcccctcagaagtcagcgcagcgtctccactctccacgccgtcgcgtcggcgacgcgggtccttcgaataagacggtttgttctcgcatcgggcgtcagccggattcgagggacatagatgatggaagtcgatcttgggtgccaccacgtcgaagcggcttgtgctgtgtagatccggcgaaagcgcgcaggcaaagcccgggtctgcgtcgtcattggcctcatgatcttcgtattgccatcgcgctaaagggaacgaaggcgacgaggtcttaaactttgattgatatatgcggatatgaaaatgcatgcaactacatgctagaagtctgtcttggttgtgttggagaaaaattctttgttacgtttttgttgatagtgttgagtgccaaaaatggagcttctccctgttgaagtcgttggcaacattctttcccatcttggtgttgcgcgtgatgttatgattgcctctgcggtatgccgcaagtggcgagatgcatgcaggaggcatctccgtttgctgtccttcaactccaatgactttccacgggacatgactacacgtcagttggagattgtcatcacacagactatatttcagactattgggctgcaacgcctttcgattcacattgataacacccatgagttctctgcagcaccagtgattgcatggctcatgtataccagggagaccctccgaagcctgtcttacaatgtcaggacaatacccaatgtaagcattcttgaaaagtgtggtaggcaaaagctcgaagtgctagatttggaattggaccataacaccatcacaggtgttgaaccaagctatcagaggttcacttgtctgaaatccctttccctgaggcatgtcagcattttggccttggatttgagccttttagttgctgcttgcccaagaatagagtcattagcacttgatgtccttgaggttgtcacttcagaattacagtctacgatggagctcacaagccatacattgaaaagtctatttgcaaaatcggtaggtgtagataagatcatacttgatgcagataatttggaagttctgcacctgaatgctttaaatctcgatctgtttgagcttaacgggaaaggaacactaaaacattttaagattgatgatgtcagtgttactcatttggatattggggacaatactgatcatttagaggcagtagacgtgagcaacttcacaatagtctggccaaaattctatagcatgatatccagggcatctaatttgcgtatgctacgattttggggtgttgtgtttgatgacgaggatgagatcgtggattcagaaactatagctgtttcatttcctcttcttaggcatctttcattgagttatgaattacgagatgggttacttcactacagccttcagggatcatcattactggagaatgtctcagttctggaacttggttggacagtaataagtgagcactttggaccctgggtatttggtatgattggaaggtgtccaaatctcaagaaacttgttattcatggtgttctttctgagacaaaaacgcgagaggatcgccagatgttagcaagctttacctcattcatagtctgtgtcatgaggaagtatgtgcatgttgatgtacaatttgagtatgagtgacagctactaggttgggtgggcatcttgtcattgttcagatgaagctgtgccatcagttgcttgatactgggttcttccacattgatccacatctaggcaatatgatcagaacacctgacggagattatgttgcagaactgtatcaactccctctaattttatgttatattatatttggtaggaatttctactgggtctgaaacttgtaacatacagttttctgaagatctacgaaagatagtggatacttatcag

SEQ ID NO: 8425 - DNA, 1663 bp, Zea mays
ttccgtgcttggccggctagctggccgcccatgcatttcagtggccattcagtacgcgcgcgcgtgtactcacaatttgacgagcgggtgcgggttgcacttgcacgtcatcaaagcttaacagcaactacttactccactaacaatacattatacatacatactcctatatagaaggtagaagcaaaagcagcagctagcacaagaaagacacatcttccgttgaccagatcaacgacagatgcctcttcttctctatttgacgatagagacgaaagttaggcacgtcacgtgtatttttaagggaaaaaatatgtatgtatgcaaaacggtttacataaatacttgcactatatagctcaattcatgaccttattgaaacaacgacatatataataataatgtaaaagaaagtacaaaccaaagcgtttgcgcacacagcctaacatatatactccactactagctagcagtacgtgtcgatctagtgacgacgacgacgacaaaggtatcaaagaatcatatctagtataagtgcgtgctcttaattagcactttagtacaatcatatttatactatcatcacagctagcagagagacaatatctatacaaaagctccatacgtacggcggtacgccaccatctgctcgctaatgcttggccaatacgtacgtacgtacgctagtgaccggggcccttcgggctgggcccggccggcagcctggccaagagcatctccaccgtctccaccaccgccgggtacacctgccgcaggtacgcgggcgtcgtcgtggccgtggcctcctcctccccgccgccgccgctgctcgctgcaggcgccggcctggcggcgctcgcgcacgcagtaaggaaggcgagcgccaccagcacggcgacgagggccgccgcgacctgcctggacgacaaagccatggcgcgcgcgcgcgcgctcagccgacggtcgagcttgatctatccaattaagtagtggactggaagatcgagcttgttaggccgccggccggtcttgggcgctagcttgggcttttgatcggcgcgtgcgtgtgggttttggcagctgggcgaatgtgcgcgcgcgagctgagtgtcgttggtgccgattgatcgatcggtgcggcgcactgcttttatagagctagctaggggtcggtcggtggcgctgcgcgcagtagtggcggccgggggtcggttggattttgattggatcctgacgcggttgctgaggcatgaggtagctagcctagctacacggtggaaagggagggagccgccgtggtgtgtgagcgcgtgatgtgcactagactagacgagaagagactggtggtgactgctggaggatcggagccggccggcgaatgtcgcgtcccgtggacgacgcagcttcgtagtgactcgcgtgcggcatatgtgctctgtgttgaccacgcatctcttatattaaaagctacggggattcttggtccctcggagcagccacgtcgctcagaaaatgttagtcgttcgatctcaacacccgatctctctcaacgtccgatgtttgaatcaacgcgatggtgcacaagcccaacgctcgcttcgctctttcgtcctcgcgaggctgctgcccaccaccagcgtcttctctctcccgtcctcgtgag

SEQ ID NO: 8426 - DNA, 3733 bp, Zea mays
tgttaggggccttcctcttccgaaggtcctcaaaatataactaaccgcctgcttttagcataacatgtattactacaaggagcttcagcttcaggatggaagttttctcccatggcaaaggtgtacaagacaaagatatagcccgaagatgataagaatgaacgctgaagctatagccgaagagtaacagcttcggcttaagacgatgatgaaaaccaaacatgatgctagcccgaagagaaaaagactagccaatccctaatgatttacgttatagttgtgaataaatgttgaggacacaaatgtacttttactcgggctgtgtcccgtgtctataaatagatgaacagtagcaccgtactgttcacgttggattgtaatcgctctcgcgtcagcaccttcgaacaagccgaaggtatcaatgtaatgtaaattttgttaatgtttgtgtgtacattatgaaataaatatgtgaatgaagatccttattcattatctatatgtattcttattcattcgtgaatgatgaaggcatgtccttcataaccctcgtctgaagatcattatatccaagagtagataatgcttcggaggactaaagtccttaatccttaacaattgtattggcttgttcttgatttacaacatttgagaataagtgaccaacaaaatgtgacatacacctctcaatgaatgagtcctaaaagtaaatgggctaggcccaataatttcaacacatacacccccttaggaacgtgggacttgtgtttttctctaaaaataaactgattcctataaaattcatgtatgattcatctgaaattcctgtattccaacttatatgatcgactagcgtgggtgtagctcgggacactgatgtatctaaagatattaatgtttatctttaatgtgctctagattttatactataaaatttagagatttaatcggattgaatcaggctctatatttatacttatttttgaaataaaaaaaattaataactctaatttattatgaaaaaatcatttaaatcgtgatctgttaccattcctaaacgtatcttactagcagactctagactcaccgtcaccgctactgctgtcggggaagccacaggccatcatgccgcgcctctcttctcccaccggtggtggccagatcggttttgacctagctctgttattgatactgtacaacactgtagcatgaagccaaacatcatccctctgacatgcatctagtaaaatataactagaaagtggaagcaggagctacacgcagcactccaaactggcccgcagacataccctgggattatgtatttatgttaggtatgcaggctaagttgaatgcagataactaggctaaattttatatagataaccaatcaaactatgtaataagtttccggccaaaagcagttgttcccatgtcctcacacggtcgaaatgtttttttcctcttcgttagactatatgagcctataatcatcacatcatacatgtagccgtataaaatattatattatttatatagtgagatttaaaataaaagatcattgtgtttagttggacgagtttaaattttagtcccgtcacatgagatatttaactactagttagagatattaaatatagtttaattacaaaactaattatatagataaagggtaaaaggtaagatgtgtcttttaagtcgatcatatggtgctatagtaatatttgtcaatcattgattaattaagcttaaaaaatattgtttcgttgtttagtctttaactgtgtaattagttttgtaattagattatatttaatatacttaataggcattcaaatatctgatgtaacgtgggctaaactttagtctctaaaaccaaatatctataacagtggtaaacaattagttacagttagacaaacctacggcatttataacgtcttattggctgtttgcattgggcgagcgtagtgcgcttggcccgctggaaaggagatgctctgtgcctgtgcgtatgtgttcatgcagctgcatgcaggaggtttttctagtctagactctagactgcacccggctggcctcatgtatacagtaaacgaaacaccatcgtgcacttgatcaccggactattgtgtaactattggaagtcctggtctccagctggctttgtacagcggaaagaggtatggcactccgtatatatgggttggtgaacttcattttgcattaatttggttccacacgcacgctgtcacgtgtttgagcggaaaacgacacatggatcgggacgaatctttcactcagctttgtctgcttctatcgatcaatgcgtaccggctgccatgccactattagttgtcgtggtccccggccgttccgccattccatatttccatcctccattcacgcatcacaagctggaaggcactgtgggcaataatggctctgctcacgctccagccagcgatacccttcctcctgctcctcctcctccccgccgcgtccgctgggctgcccggcggccggacactggtgttcatcctggctgggcagtccaacatgagcggccgcggcggcgccaccaacggcacctgggacggcatcgtcccgccggagtgcgcgccctcggaccgcatcgtccgtctctccccggcgcttcgctgggaggaggcgcgcgagccgctgcacgccggcgtcgacgtgggcaacgttctcggcgtcgggcccggcatgcccttcgcgcacgccgtgctcgccagcgagggcgcagccgcagagccccccgtcgtcgtcgggctcgtgccgtgcgcgcagggcggcacgccgatcgccaactggtcccgggggacggagctgtacgagcggatggtgacgcgcgccagggcggccgtggccgagtgcagcggacgcggtcacctggccgccttgctttggtaccagggggaggcggacaccatgaggcgccaggatgctgagctctaccagcggcggatggagactctcgtgcgtgacgttcgctgcgacctcggccggcccgacctcctcgtcatccaggtggcccgcatctgcttctctcatgactctgtttttttttttttgggtgggttgtgattttgttgttgcatcacatacacacacatgggtcgatccaaatttaagattttttttgtttatttctacatatatatcacaaatgtaatgtatatataggtgggcattgcaactgcgcagtacaatggcaagttcctcggcgtggtgagggaagctcagaaggcagtgaagctcccaaatgtcaagtacgttgatgccatggggctgcccatcgcgagcgaccacacgcatctcaccacggaggctcaagtccagctcggcaacaaactagccgagtcgtatttagaaacgctgtaattttcaaataccggtatgcctaccaaaaacaaggcattcccccacgatttggaaacggacagagcaagcaatatgtacactcaaattacgatgctgcgttgagattaatattttccgtgctattgaaaccgccctcgtgttaagcggccagtcagtgcactagttaatcggcaaaagtcacacaacattaaatacaatctccatggttgtagaggataaaatcatcgctttatttgagttttccattaacatgtcatccactagcagtcagaaacccgtgcattcactattggcgaacacggccaggcccatcccttaatttcag

SEQ ID NO: 8427 - DNA, 981 bp, Zea mays
attcacgcatcacaagctggaaggcactgtgggcaataatggctctgctcacgctccagcagccagcgatacccttcctcctgctcctcctcctgctccccgccgcgtccgctaggctgcccggtggccggacactggtcttcatcctggctgggcagtccaacatgagcggccgcggcggcgccaccaacggcacctgggacggcatcgtcccgccggagtgcgcgccctcggaccgcatcgtccgtctctcccccgccttcgctgggagcaggcgcgcgagccgctgcacgccggcgtcgacgtgggcaacgttctcggcgtcgggcccggcatgcccttcgcgcacgccgtgctcaccagcgagggcgcagccgcagagccccccgtcgtcgtcgggctcgtgccgtgcgcacagggcggcacgccgatcgccaactggtcccgggggacggagctgtacgagcggatggtgacgcgcgccagggcggccgtggccgagtgcagcggacgcggtcacctggccgccttgctttggtaccagggggaggcggacaccatgaggcgccaggatgctgagctctaccagcggcggatggagactctcgtgcgtgacgttcgctgcgacctcggccggcccgacctcctcgtcatccaggtgggcattgcaactgcgcagtacaatggcaagttcctcggcgtggtgagggaagctcagaaggcagtgaagctcccaaatgtcaagtacgttgatgccatggggctgcccatcgcgagcgaccacacgcatctcaccacggaggctcaagtccagctcggcaacaaactagccgagtcgtatttagaaacgctgtaattttcaaataccggtatgcctaccaaaaacaaggcattcccccacgatttggaaacggacagagcaagcaatatgtacactcaaatcacgatgctgcgttgagattaatattttccgtgccttgg

SEQ ID NO: 8428 - DNA, 3152 bp, Zea mays
gtcgaccctactgcttcacatcgtcgacgttattgcctcgacgttgtcgaccctactgcttctactcgcgtcgtctaccagtatgtctgatcagtacgcatcatttaatttgacctcatactttagcttatttgtttttggtagaggtgtgttgtctttttatgattagcatgttaggtaacatgttagattacttgtggtggaacagacatctagactatttattgttggtcattatttatattcggattttaatatggaaaatatctaattactcaacaaaattgagatttggaatcagatacccaattccctggaattggactacaactagaaactccttctcccgatacagagtgtcacccctttgaattgcgtggaattagactgcataattctaaacttccattctgtgacatccaaacaataaaattggaattacatctaatttaaatactatgactgatttagtattaaactcgattcaattccatgtcgttccatcatctagccttttttttaaatgaagactcatatctatgttatccctaactctggctctaccaatcttaatcatttccactacatgtcaacgacatatatacactctgtttgctacaattaaggttagaaaataaacctagagacgatttgatatgccacaacaacattttagcaaaaacaaaccaagaccgcatcatctgtcatactgtatccaaatcatactttttccaagatgacaaatagtttatctgaaaagaaaaaaccaattcttttggtaggatgagaccagaacactgatgatggttttatggctataaaacaacgccgtacagtagaggcatttgcttataattcatttttctagcaagattaaccagaaacactgataaagatttcacaaacttacgtaacataagcattcgcgtataaaccaattcgtttctcctgctagagctcggactcggaagcaccgcaggcacatgaagttgattgaacatagaacaattacatcaaacaatgatagcacatgttttatccattttaaaactataagacgtttggacatgtatcgctataaaaactatgaaaaaaagcggcgatgaaaaaagacggaaaactggaggaccatcttgagagagcgccagatgagaaaagttgagcggagaaagcaaaaggagccgaacgaaggcaactgttcctgtgcacctcgccccctataagcgctcctcccgaagcccaccaccacacatgccaccttcgcttctcccccttccctttctttggtcagtcccaaaccctaacagcccaccaccctccgcgacgaggaggcagagtggggcttaaaccctaccgcccccgaagcccagcggcggccatgaagacgctgtgccccaagcccggaaagggcggcaagatccacccttcgcccgccgaggaccccaccgcggcggcattccgcctcctcccggccgccatcctcgtcctcgtcgccgggctgtgccccgaggaccagcgggtgctggcccacctcgtcacgcgctcgttcctgctgggctgggacaccatcacggcgccgccgccggagcaggcgcgcgggggcccgcgtcgcaggcgcggccacccgcccaccgtcgggtgcctgtgcttccagtgctacggcagcttctggtcgcggtgggactgctccccgcagcacgaccgcatacacgccgtcctcgacgccttcgaggagcacctcaacgccgccgagtccgccgccgccgccaccgccacccctccctcctccaagcgccgcgacaagggaaagcgcagcagggctcctgccgctactacacctccgccacagccgccgacgcggggcagccccgagtcccaggagcccccatccgaggtggcgcatgaaccctcggcgccgctcctcccttcctgcccttgtaccccgccaccaccggcccccgcggcgtgcctctccgagaacaaggagaatgtcccggaagagactggcgcggaggccaaagcggagcaatgcggcggcgaggtggcggcggaggccgatgaagagaggaagcgcgggtgggcggacgtgatgggcggggtgctgaacctgcgccgctgggggatttggagccccgccgtggagagcggcgccacctaggtgcggcaggcggccaatggcattcctgtaaatgctgggcctgtctagggtacttttggcaatagatcggactgcgcacgcagcagcagaggtagagagagagagagagagagagagagaagcgctggtaactcttttctctcctctgttgggggcagggaaatggtgatctgcaagcgcgggtagctactgtattttgttggtaattatggcaactaatgatggtgcaactgcaactgaaacaagatggacatcacttggtgcttgataactgtgtggattctggtcttggccaatgccgctggtcgatccggtcctgctggtttctccagctcttgatgcactataggtgaactggtgtagtagttcatcatttccgtctggtatttgccttatccgctagtacacccttcggccccagttcctttttcttccccttctgagtatccattatcttttgttttgcctgatctatctttatagcattgtattctttcgtcccagtaccattctcagctcgagagatggagagtggtggggcatggtgacatgtgcttatcagctggacaacacgagctatcgctatcagagagaggagtagcatcggccattgtttggcggcagcactggtggggattgttttgggatccaagggggttcattactccgtccccgagtacaccgtggaccagtcgtccataaaaccggagcagtcctgaatctcatctaggttcactcgtacacatcctgggtcgtcgtacctggagtactactctccagtccagtccttatatactctacgcagcttgccgaatactacaaattgtggcatttctgttttctttatatagataatatgctgtcacaaactgttgcatcctgacggtgaaaccagcgggacaagattaactagtactccttccatttacaaaatcacttctttctacgactttttttttgatataatgttacgtgtatatataaatgaataaca

SEQ ID NO: 8429 - DNA, 2613 bp, Zea mays
ggtaccctcggtgtcggccggaacacttcgccgcccccctcccgcctcccgctgttctctgcctcccacccccacgccgccgtcccatcaccgccgctgggatgaagaaccctgacttcgccgcagacaaagcgctcgccaaggacttcctgtccaatttcaccggccctcacggcgagcccaagtacctgaacatcctgcaagatgtcgcgaacaggaagatacgcgcggtccagatcgagctggacgacctattccactataaggatgtcgacgaggagttcttgcagcgtgtcaccgagaacacgcggcgctacatcggcatcttcgcggaggccatggacgagatcatgccggagcccacagaggcgtacaccgtcgacgaggaccaggacatcctgatgacgcagcgtgtggatgagggggccgacggcggcgcggacggcacggacccgctacagaaaatgccaccagagatcaaacggttctttgaggtttacatcaaggcattctcaaaggtgactccactcaccattcggcaagtgaaggcatccaacattggtcagcttgtgaaaatatctgggattgttactcgctgctcggatgtgaagcccttgatgcaggttgctgtttatacatgtgaagaatgtggcttcgagatataccaggaagtgactgctagagtgtttatgcccctcattgaatgtccatctcaacgatgcaagctgaacaaagcgaagggaaatctaatccttcaactgcgtgcgtcaaagtttttgaaatttcaggaggtaaagcttcaagagttagcagagcacgtaccaaagggccacattcctcgtgctctgactgttcatctaagaggagagctgactagaaaggttgcacctggagatgtggttgagatgtcgggtatttttctccctatgccatactacgggtttagagcgatgcgcgcaggattagttgctgatacttacttggaagcaatgtctgtcacccacttcaagaaaaaatatgaggagtatgatctaaaaggtgatgaacaagaacaaattgaccgattggctgaggacggtgatatctacagtaagctggcaaggtccttggcacctgaaatatttggccatgaagatgtcaaaaaggcactgctgttactacttgttggtgcaccccatcggaagctcgcagatggcatgaagatcagaggagacctgcatatatgcatgatgggagatcctggtgttgcaaagagtcaacttctgaagcatattatcaatgttgcaccaagaggagtgtacaccactggacgtgggagcagtggtgttggacttaccgctgcagtccagaaagatccagtaacaaatgagtttgtcctcgaaggtggagcactggtactggcagatatgggcatttgtgctatagatgagtttgacaagatggaagagtcagacaggacagcgattcatgaggtaatggagcagcaaacagttagcattgccaaggctggcatcaccacctctcttaatgcgagaactgcaattctggctgctgcaaatccagcatggggaaggtatgatatgaggagaaccccagcagaaaatataaatctacctccagctcttctgtctcgtttcgacctcctttggttaatcctggatcgtgcagacatggaaactgatcttgaaatggcaagacacgttgttcatgtgcatcaaaatcttgaatcaccagcgctggggttcacaccacttgagccatctgtactcagagcatacatatctgctgctagaagagtcattccttctgttcctagagagctcgaggaatacattgcaactgcatattccagcatccgccaagaggaggcgaagtcaaatgcaccaacctcctacacaactatcagaacacttttgagcatactccgtatctctattgccttggcaagactgaggttctcagaaactgtggctcagagcgatgtcgacgaagcactgcgactgatgcaaatgtccaagtactcattatactcagatgaccgccagcggtctggccttgatgcaatatctgacatatattccatcctgagagacgaagctgctaggacgagcagcatggatgtgagatacgctcacgctcttaacttgatctccagaaagggatacagcgaggctcaattgaaggaatgcttggaggaatacgcttccctgaatgtgtggcagatccatccaagcacatttgacatccacttcattgatgcctgatgcagaagccgatgccgatcacctaacatttcatcatgatccaaggatttgaagaccttcgactgaagcctaacaagatttaaaagttttctagtgatagtgaacgacagcccatttcttgatggcaatgatgtaatgctgagaagcctatctcaattgcactagtagaaacaatctcaattgtactagtagaaccattcttgtatgacttgtgagtagcttgtttttatattttctgacatttttccacacttgatagtgaagtagatgtaacttgcgtgtttcttgtttgcttgttataaatcaatacgacacaaagtagatcaaatatgtaaaaaaaaaaaaaaaa

SEQ ID NO: 8430 - DNA, 2580 bp, Zea mays
attgggacctcgagccggcccccactcggtgccgcctccctcccgcaccccggccttctctgcctcccactcactcgacgccgccgccgccgtcgccgggatgaagaaccccgacttcactgcagacaaagcgctcgccaaggacttcctgtccaacttcgtcggccctcacggcgaccccaagtacctgaacatcctgcaagatgtcgccaacaggaagatacgcgcggtccagatcgagctggacgacctgtttcatcacaaggacgtcgatgaggagttcctgcagcgtgtcactgagaacacgcggcgctacgtcggcatcttcgcggaggccatggacgagatcatgccggagcccactgaggcgtacaccgtcgacgaggaccgggacatcctgatgacgcagcgtgtggacgagggggcggacggcggcgcggacggcacggacccgctgcagagaatgccaccagatatcaaacggttctttgaggtttacatcaagacattctcaaaggcaactccactcaccattagacaagtaaaggcatccaacattgggcagcttgtgaaaatatctgggattgttactcgctgctcggatgtgaagcccttgatgcaggttgctgtttatacatgtgaagaatgtggctttgagatataccaggaagtgactgctagagtgtttatgcccctcattgaatgtccatctcaacgatgcaagctgaacaaagcaaaggggaatctaatccttcaactgcgtgcatcgaagtttttgaaatttcaggaggtgaagcttcaagagttagcagagcatgtacccaagggccacattcctcgttctctaactggtcatctaagaggagagctgactagaaaggttgcacctggagatgtggttgagatgtcaggaatttttctccctatgccttactatgggtttagagcaatgcgtgcaggattagttgctgatacttacttggaagcaatgtctgtcacacatttcaagaaaaaatatgaggagtatgatctcaaaggtgatgaacaagaacaaattgacagattggctgaggacggtgatatctacagtaagttggcaaggtccttggcacctgaaatatttggccatgaagacgtcaaaaaagcactgctgttactacttgttggtgcaccccataggaagctcgcagatggcatgaagatcagaggcgacctgcatatatgcatgatgggagatcctggtgttgcaaagagtcaacttctgaagcatattatcaatgttgcaccaagaggagtgtacaccactggacgtgggagcagtggtgttggtcttaccgctgccgtccaaaaggatccagtaacaaatgagtttgtcctcgagggtggagcactggtactggcagatatgggcatttgtgctatagatgagtttgacaagatggaagagtcagaccggacagcaatccatgaggtaatggtccgccgggcagttagcattgccaaggctggcatcaccacctctctcaatgcgagaaccgcaattctggctgctgcaaatccagcatggggaaggtacgacatgaggaggactccagcagaaaatataaatctacctccggcgctcctgtcccgtttcgacctgctttggttgatcctggatcgcgcggacatggaaaccgatctcgaaatggcgaggcacattgttcatgttcatcaaaaccttgaatcgccggcgctggggttcacaccactcgagccatctgtgctcagggcatacatatctgcagctagaagagtgattccttccgttcctagagagctcgaggaatacattgcgactgcatattccagcacccgccaagaggaggcgaagtcgaacgcgccaacctcctacacaaccatcaggacgcttctgagcatactccgtatctctatcgccttggcaaggcttaggttctcagaaaccgtggcccagagcgacgtcgacgaagcactgcggctgatgcagatgtccaagtactcgttgtactcggacgaccgccagcggtctggcctcgatgcgatatctgacatatattccatcctgagagacgaggccgcgaggacgagcagcatggacgtgagatatgctcatgctcttaacttgatctccagaaagggatacagcgaggctcaattgaaggagtgcttggaggaatacgcttccctgaatgtgtggcagatccatccgagcacctttgacatccacttcatcgatgcctgatgctgaagccggcaccgatcaccaaacaaatttcatcatgagtttgtggcttcatgatttgtgactggagggatgaacaccgtcgactgaagcctaacaggatctaaaagttctagcccagttcatgatgtcgatgatgtaatgctatcacaggcacagctgtactagtagaaccattcttctctgacttattatgagtagcaatctccttgtgtgacactaatgtagatgttaccctactgtgtttcctttattgctgctgatacaatagctgtgtattcttttggctaccaaggacattggagattatttttttg

SEQ ID NO: 8431 - DNA, 971 bp, Zea mays
cccgggtcgaacccacgccgtccggttaacgggccaggagttcacataagctaatccttaccaatacaccaaggactacccgacgatgccaccgcaacctgtagccaaagccctgtacaaggtcagaagctgtcaactagagagtttggtgaggacatgaactagagcagcgataggctgatgggaagaaaaaacagagaatggagagtgaagaggctcagtaggagaatcttcaaagctcaacctgtaatgaaagaggatcctttcccacttaacggagaaagagcggaaacctctcaccgaagttgaacagtttgtgttgcatgttgatgagagggcagtgcagagatcagaatttgatacattgataaaagagaaagaaaagacttacaaaaggttgagagaggagaacgaattcgcgcacaagatcgaggaagagaaggcattgaagcagctgaggagaaccatggtgccacatgctcggccgctccccaagtttgacaggccattccgaccacagaaatcgacgaagcaggtgacaaggccgaagtcgccacagcttcaggtggatgagcgaggggcgaggaggcacgctttgatcagatgatcaccgccgttgtttatctatcttgtactacactgattgtcatgcgcggtcaagatcatatctcaatcttgccgtcgatctgttgttggttactagattctttcttctgctgaccagtgaccatatgtagagcaggccaggccctaataacagcaatctttgtcagcacaacgcagctgacacggtgtatgcccttgccctgtgtgtgtttgtgtgccagtgtgtgtgtgtatgtttgtgtaagtgtaatatgattacctcgatggtgagacttcttaatccgatgatggcttgatataaaaaaaaaaaaaaaaaaaaaaaaaaaaaaaaaaaaccctcgtgccgaattgcctgcagcccgggg

SEQ ID NO: 8432 - DNA, 2654 bp, Zea mays
aggccggccgggccgggctcctccctcattccctcgccgacgtttcctcctcctgcttcattcactcgtcttccagttcctcgccgcttcagggggcagacgcataatttgattgagctagcgagcgagagagccgatggcgctggacacaggaacggtggcggcgggggcgatcgacgaggcgtacgagttctctgcgcccaggttcttcgatttcatcaccgaggaaacggaggaggccgtacgcgccgccgagagctggttcgaggccgcccgcagccacgccccgtcgccgttcaaccccaggataaaggaatcgagggcggaagccaaggtcgctgtcctctgcgatttcgcggaagccgaggagccggctccagaggcggtacccgtggaggtggcagcaggaagcgtctcggtacacggagcagatgctattgatggtgctccatgtcctgaggcaatatcggaatcgccgccggcttcacatccggctcaagaagagaaggataaatcgccccaatcgttcgagttcctctcggcgacagacctatccgtaaaatcagacggtggtgctgccagcacgcctaagatgcagacgcgtcctccttctccttctaccaaaattgcccctccaatttcgacatgtgacagctcttcagtgaatactggtgcgcgcacgccaaagacgcaggcgaacatgtgcagagcaggtactatggctgcttcgacgaatgccaaggggagcgtgatcaagggtggttgtgatttggttgggactggaaaggcagccactgctggcgctgaaattgcacaagcgaaccaagcggtgaagaggcagaagcttgatgatggaagagccagacagatactcaatgttaagactaaggtcctgcctcataaacggagaactgatttagatgtaagcaatgaagtgaggaggtcccgtgaggatatgtgttctctgaaggaagcaacaacatatgtatcaactgcagaattggttaagaagtttgaatcagggaccagaaagctgagcatcactcacagcagatctcgttctcgtgacgatgctgcattacagggaaggcctaagcttgtgttaactagacctaaggaacctgagttccagacttcccaaagaatccgagcagtaaaagtaaagagctctgcagagatagaggaggaaatgttggcaaagatacccaagttcagggcacggccattcaacaaaaaaattgctgaagccccttcgttccctccacttccaaggaaacccccacagatttctgaattcgcacgagaccattacctagaacatcctaatcgaaaacgatatgcggacacctgttcggaagtatcttgtgcagatactatccggagtcgaaataagccactgaaatcgacacaacgaaagccaccgcaacttcatacagcaaatagagctaggccaccaagtgtgaaaagttctcaggaacttgaactggaggagctggagaaggcccccaagttcagggccaagccactaaacaaaaagattcttgagagtaagggagacattggagtgtttgtccatcctaagtctcaggtcacagctcccaaagaattccgtttttgtaccgatgttcgcttgggtcctccatcagttgctgacttatttgacaagctctctcttcactctgaatgttcttcaaacagtaacaggcaaggtgtgcctagatgcaccataccaaaccctttcagtctacaaacagaggaaagaggtcaattaaaagagaggcagctagaagcacaactcttacaaaagaaggtggaggaggaaaaggccagggttcacaaagctaacccttacccatacaccacagactatccgatggtgccgccgaagcctgaacctaagccctgtacgagaccagaaggctttcaactagagagtttggtgagacacgaattagagcagcaaaggctgatggaagaaaggcagagaatggagagagaagaagctcagaggagaatcgtcaaagctcaacctgtactgaaagaggaccctatcccacttccggagaaagagcggaaacctctcactgaagttcaacaatttgtgttgcatgttgatgagagggctgtgcatagatcagaatttgatagcatgataaaagagaaagaaaagacttacaaaaggttgagagaggagaacgaattcgcgcaaaagattgaggaggagaaggcgctgaagcagctgaggagaaccatggtgccacatgcccggcaggtccccaagtttgacaaaccattccgaccacagaaatcgacgaagcaggtgacaagaccgaagtcgccacagcttcaggtggatgagcgaggggcgaggaggcatgctttaatcagatgaccaccatcctcgcctcaagatctctgcgacgttgtttatgtatctgttcgtcgggctactaagattcttttttcgctgaccaatttgtagagcaggccagcaacccattgccgctgctgtgtgtgtaggttggtgatgttttatgattatctcaatgatgacactttttaatcggaaaaaaaaaaaaaaaattctcggacacgtatggaacttagcgctccacactcgcatgttttccccgcaaaaaaaaaaaaaaaaactc

SEQ ID NO: 8433 - DNA, 6418 bp, Zea mays
ggatgtgaggaggctactggagtacggtgtccggttatcagatactggggaggtggacgagaggcacctgttgtcgtactgcaggtcaaggaaagatcatgtgaagaggttccatgtccttccaccatacaagaacccggcacgactgtaggctgaggaggtcggcgaggagcagtagagagctcaattttgcattaaccacttatgacgagtgtaggtttgagtggccaagcttttaaactggccatgctggtaaatttcgtgtcgtgactggtgtaggttttggtaatctggtgactggtgcactggtgttcaggcggtagtatatcatgcatcgtacatcactattgttcatctgtgataagattggaaagcaggtagcagacctggagatgatagcatgatgtatatagggtaaaggcatagcattgcattgtcgatgagttataagctggtggtctatctgtcaattaactatatagcagagccccgacccagaattgtaagcctttcgtctactgatgcaattttgatgtttatcgttctcctgtatcttccatttgacaattatcccattgcttggaaggactgagttctatgaaattgcttcttttcctgttgtcgttgccaaaatattgttcaaactttttgttgcttgtatattgttaatttttacaggatgcttgattgtgaattgttgcgtattatcatggctgtggacccatgacaaatagattctctagtttaatagcagtggtgaactggtgattgatattcattatccccttaccgaatttttgttcctgtctgacaaacaggggattgtatccttttgaggagcacatttcttataccaaccagtcattcactattcatgaaatcaaacatttctggaggaaacatcaatgtgctagggcatatgatagagatctgaatatcagagtggacaaactgttgttcatccgtgataagattggaaagcagatagcagatatagagatgggttgatgtataaattcatagcataacattgcattgcatcgtcaattagttataagctggtggtctaatctactggtgcgattttgaggtttttcgttctcctgtctagtatacgtgcacgcttaggcggccttgtctgtttcagctcaggactgtgttcagacgtgcaagcttgcctgcttgggatggctttccaagctgaaacaaaaaaggttcttgaaagatgcgtgggtgcacgatgccagttcggtgtcgagccatgccgcgcaaagtggacatctagtgggcctgtggcgactcagtgatttgaacctaacgcatgatgtcactagatatactacctccatttttgatatactacctccatttttatttatttgacgccagttagttcaattttatactaatcggtgtcaaataaaaataaacagaggaagtactagatagaaggtctaacagctaatagaagggccccttattaccagtcatatttcagtttcagttcaaatggtcgaaggctctcgattctcgaagctaacaattttccttgtttctttctttaggcccttgcgagatagcatgtacatcggtcctagcggtggcttctttgttacaaactggtatcaaattttacgcgaggaggtgactctccaatccaagtaagtagaaagctcatggcagcccccgttcctctcgggcagcacaattcgatgcgtttcctcagcttcccgcagggcggcaggaggattccttggcaacagagcaccgcaacccctgttgcttccttcacgtcgccacgggcaagggccacacactcttagcacctgttgtcatgttatttaactcgatctcatcagctatctagtcagtcagcgacgctcacatggacgaggttcatcgttctgctctggccgccgcgcgccggcgcagatacgtttcatggtaccctcttgcatcgcactcccacatggcggctgcggctcaagctaggtcgtccttcctcgtcctgctcgtcgccacgtggtcgctgtcgccgcggcttgccggggcctccacgtccacggaagcagcagctgccggccgtggcgttacgctacgcctcgacgcgagccaggtacgcgtacggtatggtacgaggcagcagccaagctcaccgctgggcgctggcgtggcattgctggcgcgatcgatgaccagttggtttggttatgtccattgaactcgttctcgttcccaggtggtcgtggacaatggcgcggtgcaggtggcgctgtcggcgccggagggccggatcaccggcgtcagctacagcggcgacggcgagaccaccaacctgctggggtacgacgccggcgagggagactccggagggtaactgacgagtgcatgcgtattacacttgtgctgcctcttcttttatctgcctgcactctgccctctgccactcggaatgtcccttctctcttgcaggtattgggattcggtatggaactatcccggctctggtctcccaggacagtacaatacgtgagtgatgactagactctgtactcttgccaacgtcataagcattgctcaatactcacaacttgattctgaaattaatagaaattgccaacaaataggaagctgtgccttatattgatcagcaatagagataatactggttacacttcgtgcaagaaatgtttaaatgcctatgaatgggcagtccaatctttttttgtttacagtagtggttcgagtcaacaacccattccacatgtatcctggaatttgcagcaaggagggattggatttactggttacgctcatacatacaggttggatagcacagagttcaacgtagtgtcctcaagtgaagatcaagtggagctttctttcaggagcacatacaacccgtcgcatcgaaacagccttcggctaaacatcgacaagaggtgccaaaatccttcacgttattcgctccacgcaacaacctgttttggatactgttttcctcatctgaaacagtaccaaactgtctctcgggagttcgctaagacggctggttcaggctggtgatgctcagaggtagctctgggttctactgctacgccatctttgagcatgacagggcctaccccgctctcaacatcacggaggctcggctcgtcttcaagcttaacacggcaaagtgagctagctagcatccctctttaagtttttgaacacaaatgatcatctcgatcgagctgtatcgtacgtgaaatctttgctaggttcaattacatggctattacagacgatatacagaggtacatgcccagcgcggcggacagagaagagcctcgtgctgtcccgctggcttacaaggaggctgttctgctggttgaccccaaggaaccccagttccgaggagaggtatatacatatatcgtaatttatggttggtccattgaatcctttaaatttgggggaactgtgccaagctgcaagcatgaacattcatgtgtgcaggtggatgacaagtaccagtactcgctggacaacaaggacaacgttgttcacggatggattagccgcggcgatcccaacgccgtgggtttctgggtcatcactcccagcaacgagttcaagagcggcggccctctcaagcgggagctcacctcccacgtcggccccacatccctcactgtaagcctcgcaactcgcaagcaccgtccaaaaccaaccaaactggaactacgtttatactctatactattgttccggtcagatgtttatggggacacattacgttggcaagtacatggtggccaacatcaacgacggcgaggcgtggaagaaagtgctaggcccggtgttcatctacctcaactcaggtcccagcagaggtgagctctgggaggacgccaaggctcgggcgcgggcggaggcggcgagctggccctacagcttcctcgcgtcaccggagttccccaaggcggccgagagaggatccgtcgtaggaaggctcctggtcagggacagccacgagaagcatggcatgcctgctgggtcgtcggccttcgtcggcctcgcctcgcctgggccgcccgggtcctgggcgacggagagcaagggctaccagttctggacgagggccgcgcccgacggcaccttccgcatcgccaacgtcagggaaggagtgtacggtctgtacgcgttcgttcccgggtttctcggagactactgctacggttcgccgctgaccgtagcgccaggccgtgccatcggcgtcggcgacctcgtgttcgagcccccgaggtcgggcccgacggtgtgggagattggcgtccccgaccggacggcggcggagttctacgtcccggatccggaccccaggtacgtcaacaggctcttcgtcgtccgagacaggtaccggcagtacggtctgtgggagaggtacgccgacctgtacccggacaaggatctcgtcttcaccgtcggcgaaagcgacgaatccaaggactggttctttgcacacgtcacaaggtaagtgataatgctgcattactgcaacgcacaccccaactttagtactactaagtatgttgatcgatctgcagaaaggtagggcaggttgccgtgccaacaacatggcagatacggttcagtctggaccgcgtcgtggcagacgacgacacctacacgctgcggatctcccttgcagcttctcaaatgtgcaggttgcaggtatgtatatatgtctgcagaagtgcagagttttacataataacccgccacaacgtaaatgtagtttggttcttaggctattcttaatgcatagtttcatgagaagtttcatacattaattagtagagtgctacatcagatttttggatgatatgtcaccatatttgttatgacatggatagaagtagtttcatcactgtgaaaccatatcaactcgtttccaagacattgcaaaacacatgaaaccaccatgaaaccaccattcagaacagtttgtttcatctccattcatttcatatatttctattggctatttagacgcaatgacattgtggcttgtaaaatcgtgaagtgaaactttgtattcagactatatgtttcatttatttcatctcaatgatgtggcagcattgaaaataatgcaataaactctcatcgagaatgaccttatttccgcaaaacaaatactgttcggttctgaacatatctctgtgcatttcatcaaggtgcaagtgaatggggatgcaaggagaggcagggattttacaacgcccgacatgggcgatgacaatgcgatcacacgccatgggatacatggctcacagtggagccttgagtgtgtggtcgggggccacctgctacgccaaggcgataacaccattgacataaaactcatcgcacaacaaggaccgaaaggtcctgccatggtcgccggggtcatgtatgactatatccgcctagaagggccaccatctagaggcgttgcctcgagccgcattccagcgttctcccttcaccggattttgttcctgttagccttcctagtcatgtcctagtatgtctagctatgtggccatctaacatgtagcattttttttgctagttgttgtatgaaagcaagaaatatgatgatgtagtacaagcaatgttattgtggagagaatggaggcccatgctacactgattaagtatgtattcaacagatcatcaattggccggagataagggatcatgctaaatgttcacatgcaacttctgagtgttaaactagatatggcttaggacactcatgcaaggagcctttctatccaccatagataacttctgttggtcatctattaagattactataagaaaccaaaacaaagcaacacaattaagttggtgaagccttctccccatgtgttcccatgaagagagaagcgtataaggggagaaggttaagtaaagcatggaagatacatgaagcaaaatatataaagaaacatgctatgaaacatatttatcatcctttattatttccccttaattacaaatgtctacattcatacttttaggatatataaacgacattcaaaatacccctatttatagggacaaggcgatgtacaacttcatatgaaattacattagtatctttaagctctatacacatgatctatagaatctaataggggcattgtcgtattttcgttatttttcttcgcagaacgtgtggtgcaaacttcccttctcttatgtgacaccaagggtggtatttggtcctactcagcggcggagccaggatttctctaagtataggaccggatataacactaaaaattatcataccggctaaaaaatttaaatcgaaaaatacatagataatgctacatatgaactttatttggacacataattgtaattaaaataaaattgg

SEQ ID NO: 8434 - DNA, 1603 bp, Zea mays
gggtacctcgcggccggccgggattctccggcgccgtcaaccccgcgacgcgcaaaggtgagcttcgacccgaagccgaaccgatcgagaggcccagccgccgcaaccggaggagagagagaggcggatacacaaacacgaaaccctagcaagcaagccctccacgcacagtcaagaagggagggggaggcgatggagtacccggcgacggccgccggatcggggagccacaagtactactacccgcagcagcactcgcactcacagccgcaggcgcttcgccgcccgccgcgccccgccgctcggtgggtcaagcaatggatcccgcaggatctcgcgtcctccggcggcaaatgctcgctcttcaagtgggtcagagaggatgggtacagaaactccaaggacaaccccagagtgttagatgtagaagcccccaagcctgaacccaccacggagatcctcttcctctgcagctacgagaactgcggcaagacctttgttgatgtcagcgcgctccgcaagcatgctagcgtgcacaacgagaagcagtatatatgcaacgagcccaactgtgggaagaaatttgttgatagctccaagttgaagaggcattatcttacccacacaggacaaaaggattttgtctgtccacatccaggctgtggtaaggccttctcattggattttaacctacggtcacacttaaaaacacatgcattggagaattatcacatatgccctttcccagcatgtggcaaaagatttacaagtgacttcaaactaggagcacatgtcaagtcacatgaaaagactggaactcctattgcagtgcagcatgcgccagcgccaccagcagaaaaaccgcgtgtcgccccaaagcctccgactccagcaaccacaagctatgctgatcggccatatgtctgcccctatgaaggttgtgacaaagcatacattcacagttacaaattgaaccttcatctaaaaactcagcaccctgaacacggtcaagaggaaaacggtaaggtcggtgcttctggtgggcagcatgctgcgaacgaacacacttaccagtataactatgccgaggttggcgagattgcaccaaaccccaaaaggagcaagacgaatcatgggcacaaggtccactcatccaaagcctacaatgccaaggtttcgagagcaatgccttctgacattggcgtcaggaaccagtggccaggtaaagctacgtaccaagatgatagtgaagagacggaagaagatggaggcaacaacattgaagatggctggagatatggcaacaatgatgacgatgaggaaacaccagatgaagattgacctttatttaggtttggatatgtagatatatgagggtgatctgttgtcctttagtttcaatgcagtcatggggaagttcaagctttaaccttaggtagtagttcattcagatggtgcatggatatattgtactcagttacctgctcctaaatgctttcactcccctatcttccagagccacatgtattttagatagtttggatatgtttgccttggaataaattttcatttgaaatgtcaaaaaaaaaaaaaaaaagcggcc

SEQ ID NO: 8435 - DNA, 899 bp, Zea mays
gggtcgtaggccaacgaaggcccaagccaaaaccttcccaaaacccttttcccgttctggtctctctttcccgtctccgagcgctgccgccgcccgccgccagcgccggcgcgcgagaaacaagaggaagaagaagccaaccgatccagcagcgatggcggtcggtggcctgttggggggcgctttctgggcgacgcgggcgctggaggtggtcaagcggaacgattccccgggcctgctgtggaagcgcatcaagctcaccaccacccgcaagaacaacgccaagaagcgccttaagcggctctggcagaatgaggcggttataagggcttgtggtgaatcagaatccagatcagcgtctaacgtggcttccaccactgagaaacaacagtagcctttgactatttcccccagtttgctgtcatcagattgaaagccaagtgcgtgtataaatcttactttcttcaacatcattcgttgctaccatatgcaaccttgccccctcccgaactccggcgttatttttatttcactgtttccatgttacttctgaaaaaactacttgggattgttttctttcctcaattattctgcatatgctgattgatattgcctgcggtaatgtaatgcattgcacccgttgctgtcgctggcatgagcttgccaccattttttgaagcttgcaatcaattgacatgtggtgtgttgtgtactagttacgtgccgtacgcagcgtactcgcatgtgctgatgttcttcattgtacgttgtaatagttttttttgttatattggctaggtggatgtaaatgtgagtttggaaactatagttcaaattcctatgtgtataatttaagcttttttactatttaagactttgttcggtccatggatgattag

SEQ ID NO: 8436 - DNA, 1043 bp, Zea mays
tggatttttttttacaatttcgaaccgcacaaaatagatgtggcacgtttaaccataacgtccacgaatcgagatctaaacccaagggcagtcccgatacggcccctaataattaagaaccagcccgatctgaaattcaatcataatagaccttttcaggtttagtttggattgggcagcccttggattacgcggtcagggcccaatacccgtaattcgctgtccgttgggcgccgcgggccgggccgggaagcccaaacccttcgaaaacccttctcccgtcctgctcactcccgtctccgagcgccgccgccgccagcgccgacacgcgataaacaagaggaagaagaggccaaccgatccagcagcgatggcaggcgggggcatgctggggggcgctttctgggcgacgcgggcgctggaggtggtcaagcggaacgattccccgggcctattgtggaagcgcatcaagctcaccaccacccgcaagaacaacgccaagaagcgcctcaagcggctctggcagaatgaggcggttataagagcttgtggtgcatcagcgtctgacgcggcttccacagctgacaaacaacagtagcttggagcacaactggagcaggtcctgtgacctacctatgcttgataagctgaagccttgactttgctgtccacccccagtgttttgattttgctgtcctcggattgaatactttctccatccagaggacaacatcattgcttgttaccagggggcaaccttgcccccctcctctctctctcctgcttacatcagttcctagcacctttgcgccctcctgaattccatcgattttcgttgtttccacgttacttctggaaggagagggaaaaaacattttgagcctgcttgcttttcctcttttctgcatcatgcctaggtcagtctgcacatgctcatattgctattgtcttctgcatgtaatgtaatgtaatggaatgcattgcaccggttgctgtcgttgacatcaaaaaaaaaaaaaaaagcggccaaaaaaaaagcggcc

SEQ ID NO: 8437 - DNA, 1905 bp, Zea mays
agttcgggaaaacccgtaattcgttactcgtcggccgcccaggcgccggcccggaacccttcgaaaacccttctcccgtcctgctcactcccgtctccgagcgccgccgccgccagcgccgatacgcgataaacaagaggaagaagaggccaaccgatccagcagcgatggcgggcgggggcatgctggggggcgctttctgggcgacgcgggcgctggaggtggtcaagcggaacgattccccgggcctattgtggaagcgcatcaagctcaccaccacccgcaagaacaacgccaagaagcgcctcaagcggctctggcagaatgaggcggttataagagcttgtggtgcatcagcgtctgacgcggcttccacagctgacaaacaacagtagcttggagcacaactggagcaggtcctgtgacctacctatgcttgataagctgaagctttgactttgctgcccccccccccaagtgttttgattttgctgtcctcggattgaatactttctccatccagaggacaacatcattgcttgttaccaggtgcaaccttgccccccccccccccctcctctctcctgcttacatcagttccgagcacctttgcgccctcctgaattccatcgattttcgttgtttccacgttacttctggaaggagaggaaaaaaaaacattttgagcctggttgtttttcctctattctgcatcatgcctaggtcagtctgcacatgctcatattgctattgtcttctgcatgtaatgtaatgtaatggaatgcattgcaccggttgctgtcgttgacatcagctcgccaccccattctttttcggagcttgcaagtttggttaaagacatgttggaagagtccggtgcccatcaatggaccggatgctgccccatgtactctctcatgtagtcatgtgctgcgttaacaaaacatgtggtgtgtgtggtgatggtacaaggaagcacgcaacggaataccatgctgcgtgtgccgacgaagcaggacccgattcgatccgctgatgaacgggcacacggcaagatacggcgtcgtattttattttcctcgtttcatattttttttaaaaaaaattaattttaatttcgcttttatatgctctgatggattgaaacaacagttcggtcaacgcgaaccgtaccgatattgcatagggtcccactgtgtagcacaatgctcatgctcagttcctggtgcccactgccagagacagtttggcgcgaacgagcggaatctttcggagaccgcggaaaccaaacatggttttgacttttgtcaaatgagaggatggtttcttctgtaaaacagcctgacgacccgtgaggctggattagcagccctcgtcgccaccgtgtcaactatcccgtcaagctatcgtagctagcacacaatcttttagtgtcggcctacacgttaatgccgcatcacatcacctttgttttttttataaagtacgacattttgtttagaaacaaactcatgaagccgttatataattcaaacaaaataaaaaaatgcaaataaataaataaaattatatatttcatgaaaattacttgttatcatcgtcatcatggctccatctctttcgcattttctttatcatctagttttaaatgtttgatcaattgttttacagacaatgtttggaccatttttattgtaacatctaaatagacggtggactgatccggcaacttgataaagtgcgtgtacaattatatatataatgtgatttttagattgataaaacaccctgttatctacaaagaagtatattttgggatggagggagtaacgtttatgccgaaacggaaacggacatccatcctgtttctgtgtcgggctggcgggcaaagcggggaggcgagac

SEQ ID NO: 8438 - DNA, 577 bp, Zea mays
ttttttttttttttttgctacaagagttctgcactcgatcgtccattaccacaaagttttagtctccggccggctgacgaagagtagccctcaacaaaagcgtgagagaccgtataagccaactagcagcaagcaaacgaagctctaagcctacaccagtactgctattttacatgacccaggtcagttatgcagaggattcggcccctggggcaccagcctcttggacgacacacccacaccaagcatgtgcttgcaacagtcgccaagaaggtgtcgccctgccgccgaagaatcttgctgctggtcggtcttagacaagaagcagcctctggccggcggcgacggcgacggcgagccaccgcctccgctgtcgctgacttctgagacatgcggttctgctgcaactcttcggccgtagcagctgacggtggtcgccaggtcggccattaggagaaggctgacgagcaccagcgtcggcgtggctgttaggtgtctcctcctcgccatgacgcgacgcccggtccccggaagcaggccggaagtctgtttgccgtttgcgcacaacacaaatgtt

SEQ ID NO: 8439 - DNA, 1718 bp, Zea mays
attgggtacctcgagccggcgggaaacattgggtacctcgaggaaaacagagtagtcactgcctattcttggccatacggcttcccccacaccccaacacaaacaagagaaaaaaacaaaaactagacgaaagagggaagaaaccaagaaattggcgaatccctgacgctccccactttcaactctcatccgcttgccgttgccgcgtttgtttatcgagccaatttgatcagggcgccacaccgaaccctagttcttgatttaatcacgggttatgtggtcatgccggccgggtcaccccgttcttcttctcttccacgagttcaggaggtagagtgagagagaaaatggaacgacaggggatggaaggcaacaatcttctgcattttcttgataccccgagcgcccattacagaaggacatgcgacggatttgaggcccaacacggcggcgatgaacactctgagacatcagatactgatccggcgaatgcaagggaaatgctggaatatttgttgaaccaaccagcaaacaaaatctgtgcagactgtggctctccagatccaaaatgggtggccctgccttttggcacattcatctgcattaagtgctctggaactcatagaagtcttggtgtgcacatatcaaaggtgatttcagtgaatctggatgagtggacagatgatgaagtcaactgtttagctgaatcaggcggaaattctgttgtgaactcaagatatgaagcctttttacccgaaaacaaaaagctaaaacaagattgctcaacggaggagcgtaatgattttatcaggaaaaaataccagtttcaacagtttgtgtgtgatccacaattttcatgccctttaccacttaacagaaagcatgcaccaccagataaaaatcaccagcagcataatagcagcaagtatggttttggccatacttttaggaatagctggagaaaaaaggattcagatagcaaaagcctaaagaaaatgtcggatgtgggaatgatagaatttgttggattagtaaaggtcaatatcgtaaaaggcacagatttagctgttcgtgatgtgatgtcgagcgatccgtatgtcttgattcatctagggcaccagtccatgaaaacaaaggtgataaagaacacactgaatcctatctggaatgaaagactaatgctttcgatccctgacccaattccgcctcttaagctgcaagtatttgacaaggacacattcagctccgatgaccggatgggggaggccgaggtggacatccggccgctgattgcagcaacgaaggagcacgagaactcgaccatcaccgaatcgacagaactctacagatggtcagccagcgaagacagcaacggtgtgctcgccaaggacagcgtcatctctgttgcgagtggaaaggtcaagcaggagatcacactcaggctccagaatgtcgagcgcggtgaggtcgagatcgagatcgagtgtgtgccgctcagccagtagcagtcccattgttgtgacaaggacactgctttgcaatgcagaaagacctcagcttcacttgtttgattgctccatgcctgtaattcgcgtgcatgtgtgagatgtgtaatgtgttgtacggtagataggcaaagggaaattatctacttatattactttgatgataggcatacggttgaactgtttccagtagatttcctgacctcagttgct

SEQ ID NO: 8440 - DNA, 4356 bp, Zea mays
  misc_feature (133)..(133): n is a, c, g, or t
cgtgtgtgtgctgaccttgtcctagtcctcggttgtctccgtttggcacgatctggatgtgtttgtataaatatctcatttaagcaaaatctttctatacaatatataaaactgtagtatatatcgtaccaanacacaaacacttagctagtaaagtatttatgtgttaatattaacatagtaagtgccaacaaaatacatacattatgttttaccacttaaaaataacttcttgataatttgaatttagtgccaacaaaacacattatctaatattttataatttgcatgcatacaattactgtattgttaaacattatctaatactacatccattcacaaatatatgacatcgttgatttttttcaaaaactttatattttttaatatattttgaataagatgagtggttaaagttttttttaaaaattaaatggggtcatatatttatgaaaagattgagtacttgtattttttaaatagttttttaagactctagacgttgcggaagcacggcttgatcgacaagctaaaagtaatacggagtgcaggagtttttagtaagtctagcttttcattttctattaagacaaaactcacttttcttttgtttcgttttctatgaagacaaaacttattacttctctctcgcaggcggcgcacaggtaggtttattcggttggacaatacttcaatcgccactaaggagtgacggaagaagaatgttagcccggtccgaagcacggcaagttgacaataacgcgatggccattgcacgagatgatctcaaacacatgcaggtagcgtgggtcgtcagattgcgtacatcctcttgaaatcctcgtcgacccactcgccctccgacatgccggagcaggagaaggagcgggagtgggtgagcgtgttgcgcttgattgtgcgaatccgcttggcctcgatgcggtgcgcgatcacccagtagagcatggtgccgatggtggtgaccaggatggtggcgcccatgatggtgacggacacggccagccagcgctcggtgcggcccacaacgacgaacgagagcgccaggaaggatacgctgatgagcacgcaggccacccacatgagcttgttgatcaccgccatcatctgcttcttggccttgcgctcgatgaccacgaccgacgtctgcaccaccaccacggccagcgagatgaagagcgacaccgagtcgaagacgaagaagatgatgaaggccgtctggtgggagatgttggcctcgcccagatcgtgcccgggcgccaggctgcccgggtcctgcacgtactccccgggcaccgtgaagatggccgcgaacgccaccgtggcgatcagcacggccaccaccgtcgtggagttgatggcgttgttgagcccttcctcgtgcagcttgttgatgcgcttggcgatgccctgcatgcgcacgcgcgtctgccgcgtctgctccagctgcgagtgcacctcgtgcttgatgtcgctcacctgctgcttcagctcgcgcgcctgcttgttgccgcccccgccgccgccgccggggctgatggcgcgcgccgactgcacgccgtgctccgccaagagttccgccgcgtccgtgttgcccatcttctccgccgtgtccagcggggtctcgcgggaccggttgatcgccctgacgtccgtgtcgggcatcgtgaccagccgcctgatgatctcgtgccgcgccttgcgcgccgcgatgtgcagcgcggtgttgcccttgctgtccgtctggttgagcagcgccggctcggcggccaggagcgcgtcgacgaggtccagcctggtgcccttggcggccatgtgcagcgcggtctggcccttcttgtccgtgcgcagcgcgatgctgggctccgcctccagcagcgcgcgcaccacctccacgtggccgttccgcgccgccgagtgcagcgccgtcttgccgttgctgcgcgcgatcagcgccaggctcccgtccacctccagcaggagcctcaccacgtccatgtgcccctgcgtcgccgccgtgttcagcgccgtggtgttggaggagtccaccgtcacccacgcgcagtagtagaaggatgtcttggtgtgctgcagactgcatcttttgttgttgcttgaagcactgcgtatattgagaatatgaagagaaaaactgaaaacaggcacatagtcatgagcatagtcccacgatttggatggttggattgtaatcttttttttttttttttagagcatccacatccactagacaaacacaacttggggcatcaaaaaggaaacaggaaaagaaaagcaggcacatgagccatgaggtggtgcaactttgcatttctgaatcttgttccctgcacaaactacgtgaccaacgacatgcgcgggcctcacatggacatgcacacgcacgggacaaaaaaaagtctgttcgactggacgtttttgacaactgcatgcatcgtcgtggttattagccctactgctagtgctaaatggcatggttgccgcaccgctcgaagtcggcgaggagggacggcagcgcgcccctgggtgctaccggggtggtgccggcggccccgtcccggccaggctcgtcgtcgtcgttgcacgtgaggtagcacgccggggcggcctgccggcagctgaccacgtcgacgacgacccagctgccgtcggggtacaccttcatgacgtagcagtcgtcggcgtccctgccgctgcccccgggggcggtcaccgggggcggaggggagggcgtggaaggggtcggcagcgtcacacaggccacgtggcagccgtccttcgcgatggggcaccgcttcatcatcaggctcttgcgcttgtggcacaggtagcaggtgtactggagcgaggacgccgctgtcggtaacgccgcggtgttcatggccacagcggcattgttcgcccctgcctcggtggtggccgttgcgaagaggacggctaagacgacgacggcggagacttggacgacggaagccgagaaagccatcggagagggaacacttttcgcgtgagtggaatcgcagagacggtcgaggatcgggttgccggcctgcgtgtggttacatacttacatatagggcgttgaataggtgaagttgattagcggtaaccccttaccatatgttagtcagaataaatacttgttttgagtattcatgtatggggataagtaaaagatgagacttaatcctttcttcctacataaaaaccaggaatcgttagcgcattttggagtgttgcaaatgggaggtattagtcgtcccaattgattagattccttacagtagaatatgtccatttggatttgagatttgattcagtacacttggtactcatttatgctaattatttctttttaatgatagacaatgtgtccatgcattgatattaagtagcatacatttctttcatcagccataacatttgtcgggttaattctctcgaccatttttgtaagggtagagtgagcatgtacatatatgagcgtatgtatctatagtctgttttaaaaatgtggccataaaaacaattgattttaaatgttttaaactataattaaataatatttaaaaggcaatagaaataagattgactcaactctatagacaccaaaattatagacttactagtgcaatgcctatgcgttgcgacgtcacccaaattattcgaagggagcttgctgctgctcgtctgggtcaatagcgggctatccttgttactagttactgcaagccgctagactatgcgctcatctaggaattccaagtcggtggtaaccgtggcaatgtcgaccactgtgggggacaaatatcctctgggtctccactccacggaccagattcagcttatgagccgctaaaggaccttacatattagatagatgggcttggtgggctgatccgttggcccgatacataagataacgacgtggaattcaaagacataggtgtggctattccaaaatagattcacgtgcatgcagaagagataagccaaccggaccacacgtgtacgtgttagtcggagttggttttgtgtatataggcgtaactgtagcaatttgttcgacgtcgtgtaaccctaacttcgtcacgtatataaggcgagctagagcattgacttcacacactatgtaatattgaacttgagattaattccatcacatgcgcacatagaatatagggtattacacatctttgcggtccgaacctgtataaatttctatgttatgtcgagcataggcacgaaccatcgagctacttgtcgatcttgcctaccaacaaaagcactgcgtgggataccacgtagggcattgccggg

SEQ ID NO: 8441 - DNA, 4555 bp, Zea mays
gccggccgggtccgtgtcatgtcttccttctcgtccccggcccggccggccagttcagagcgtgagcatggcagacacagaagcctccggtactgtcgtccatccttcccgttcccgccgtcgacgctcctccatcttacacggtgcaaccgtagctatcctcttctttgtcatcatatttgcctacctttatctttatctgtatctttatcttgtgcttcatcgctccgttaggtatggtatcgcatcgctagccattgagatagtagcctaccttgccgtcgcctgcctgtacatctgcaactcggttcggcaggagaagctcatctccgctggctttcttctacttctcctgctcgtcttcctcctctcatctattggagttcgcacctccaggtttcgcgtcgacttcgttttcggggccaatattgtggctgtatcctcctactgcgtctggaagtttagctatacttcttgggtgagcaaagtgagaagaaccatctcacatgttgcaatcgtaactatcctattatctgtggtcttatttgactatgtttgtcgtttctaccctataagctattatccagattcgtattctcttcctgattactacagagacggtgcaatacggctactcattcagttggtagcctacgccgccatcggctgcctatacatctgcaactcctccactaggaagatgaaagtcgtctctgctgcttttcttgtgcttgttctggctgtctcccttctctcctcgattaacgacgacaatgatcgtttcggatacatcttcgtggcaaatatcgtgactatatccttgtattgcatctggaagcattaccttgcgatactggtgacactggcttggctccaacgatggctttctgaagaagaagaagcagcagctgccgccatggccccaagcaaacgactggcacggggagaggatgaagaagcagggcttctcaaacccttggaccttgacctagtggaatccggcccacggcagttctcttacagtgagctcgccgccgccaccaagaacttctctgacgaccggagactcggcagcggaggctttggatccgtgtaccgcgggatcttgacaaccgacggcaggaaccgctgcgtggccgtcaagcgggtgtccaagaccgcgcggcaaggctggaaggagttcgtctccgaggtggtgatcatcagccggctgcggcaccgcaacctggtgcagctaatcggctggtgccagggcagcggcaacaagctcctcctcgtctacgagctgatgcccaacggcagcctcgacgaccacctccacaggccggacagcgtgctgatgtggccggtcaggtacggcatcgcgctcggcgtcggcgccgcgctgctgtacctgcacgacgacgccgagcagcgcgtggtgcaccgagacgtgaagcccagcaacgtgatgctggacgcgtcgttcaacgccaagctcggcgacttcggcctagcgcgcctcatcgacgacggccgccgctcgcacaccacgggcgtcgccggcacgttcgggtacatggacccggagtccatgctcgccgggaaggccagcgtcgagtcggacgtgtacagcttcggcgtcttcctcctagagatcacgtgtgggcgtcggccggcggtgctcgtgagagaggaggactacgtccacctggtgcagtgggtctgggactcgtacggtggcggaagcatcctcgacgcggccgacccgtggctcggcaacaacttcaacagccaggagatggcgtgcgcgatgctcgtcggcctctggtgcgcgcacccagaccgcagcctgcgtcccacgatccggcaggccgtcaatgtgctgcggttcgaggcgccgccgccgagactgcccgccaagatgccggttgcgacgtttgggccaccggcggctcatgcttccggctcaacaacgtcgtctgcagaagcactgatgacctggggcagtagcctgccaaccatggcaatggcagcgtcatcactcgacatcgagcattccagcacgaaaacatcttgatgtaatggcaagcaacacattgtggatttttatgtccgaattatttttatttttatgggccgggggatggttcatccagccatgtagcacagtatgagtgtgagccaagtcaagtcgacggggacagaacaggtcaatcagtgccatgatgtgcggcagcgacgactttgctcaacaagacaaggaccgggggggcggagctaacgtcgagttcggcaaggaaatacgtagacaatttctgtgaaatggagtggagttgccatgatgtttggttcgaataattcaatccattctttgaacgaaagtgaatgactaacggtaacaaattgactaaaactgtaacagaaattatagtgcaattactaaaactagaacggaatggcttaaactgtaatagaatggatgactaagaatataacggaatgccttaaactgtaataaaatgactaaaattgtaacataatgaatgtgagaaggtaacagaatgactaaaactgcaacggtaaggaaatgactccaattgtaacagaaaccataatggaatgaatgaaactgtaacgtaatgtctgaatgtgtgaacgagaacgatagagactataatagaatgactaaaatgcaacggtaacagagtgactaaaattataacggaaagtctgaatagcaattgagttgtagtctcaggatgacaggatggttgttgcatatctcacaacagtgtcaaacgcgtgatgaaaattcattgggaaaaaaaagactgcacgacaaaatcaagcaaggccgtaaaagattagtgttatatataatttaaggttcataccaatacacaacacatgttcaaataaagaaactatataaataaaagaagcaaacatatcatcaaattgccgttgatagatcaactcattcattccacgatcaaaaaagaaactgatgaatgcaccggtctagtggggttccgccgaccatgcgtcgctgattagtccggttggactgtaggtccagatgatacacgattggctcgagtatctctacatacatacagagagactagtgtgtgtaaggaatacgtaagtttggcatgtatttggaggaaaggagaaaggacacagaagtggtggagtccggttgttgtctaaaaggccctggcgaagctgtataaatagattagtgttatatagaatttaaggttcatgttcaaataaggaaagtatataaataaaaagaagcaaacatatcaccaaattccggggcaattgcatccttgtagttttgaggtgttgaaattgtctaaatcatcaatgaatttgaaaatctcatcatgaattggcgaacagtaatctcatcatcaatttgtcttcttaatgctgtcatctccaattcacaatcaaaactgaatattacaatgtaatgtaatgctaaacagagtattttaaaaatatatgtatctttcactctaaagtggtaaaaactagatactgctttgactagtgagcgacagtgtcgtctgaggaataagtgtattaatttggagaaagcagaaaggacagagagagttgatcgaaatacactgatgcgcgtgcaggtgcagttggggcggccgaccgctgcaggcatattcaatcctcttaaatgggtcctgtctggacctttaccctgatatatctacatgtaagtatttacacatacttaaccatgccaatgaatgaattaactacgaaaacgatgagcgaaaggaaagaatgaatcggcagctatttttattatatactatgtttgtacttgtctgcatcatcatgctcccatgagcaaattgattcctcatggcctggtgggtgtgtggtgcgcagaaacgatgtagccagtacgtacgtggagagcaagtaggcgaacttaacaaaaatcaaatccatggaagtagcttgcaagagcagatagagagagagatacctgatgagagatggaatccatggaagatggaggggcgtgtggcacgtgcggcgggggtgaaggcgcgagtggaaaatgccaaagggatggcactgatcttgtgcggcgacgcgcagcgcatgcagcaggcggcaggtgagaagagatcaatgcgatccctttggagtcctccaccagcttcctggacggcatggatggggggcagctggtagcgtgcgtagctagggtagggaagggggggcaggcagctgggaggaagggaaagcgaggacgtagccagagaagggtgggggcggggctggtggggacgccaaatcgccatggatagacagaagaagacgaggatgatggataggcaaggtgaatgacgatgatggctgttgcattgctcgcttaggtaggcgtcctcctctcgctctcacgctttcgacgtgcacgtgggccatcccgggccgaaggggacacggagggcccaccacggagatgctgcttcccgcggtcgacaagcgtcatgtgaggtcgggccccgcggtggtctgggcccattct

SEQ ID NO: 8442 - DNA, 2851 bp, Zea mays
ctgcagccagctgtgttcggcaaattccgcgagaggcgaagtttctgacaacgatgcgctgaatcgtacagtattatggaacgggaagtttggcgacatctactgccatgacgtggaccagggagctttctgatttttttttttgccgttcgtacttgaggattgattagtccaaaccaccatgtctttgcttagacttggaatgaaagcgacgtcatcaggagacaactgcaaaaaattatattagcggttgtcatgttctatcagggaaaaccacaaatacacaaacccaagttactggtacacaatacactatctatctgatctgtctctcttgcgttgccatccggtagatcttaagccgctaaaccatctcgttttccagaatcaagcatcgtcatttatcccttgataacaattttgcccatgcggcagtgaaggacgacgggggaggtggtaacacggcacctggtccaagtggaccaagtcgtgcttccaacatttttctacgtcaaaaccgagtatgagccagacaaaatcacccaatgccgacgttaacctcgtaaagatctccaaattcaagcttggtccctgctactctgctgtatcgtgcaaaaaaaaaaggtatagcaatgttttacgcgtctataaatgaaaacgatgacctttttctgaaaaaataaaataacacctacccctaacgcaaacgcgagagcgaaacggaacaccattgttggaaataaaataaaagaacaccacatcgacatcctctcacctccctcgcactccattggatttgggggagctcggggggcgcgggccactgatgatccccggaacgagcaccgatccgtggcgaggaaactccaccgggtagccggcccgggagcgcggggcacggcgatggcgggcgccggggcagcggccaatggcggcaggaacaagtacgcggttctcgatcggagcgaggagcgacagacggacgctaggacggagcggcggaggaggccgttggcgcccgagagcgagagggggagaagggagcggttcgtgtacgcctgcgcggtcttcgcctccctcaacgccgtcctgctcggctacgatgttggcgtaatgagtggcgcgatcatctacatgcagaaagacctccacataaccgagtttcagcaagaaatcctagtaggctgtctgagcgtggtctcactcttgggaagcctatcaggggggcgaacatctgacgcaattggcagaaaatggacaatgggcctcggtgcaattgtgttccagataggcgcgaccatcatgacgtttgctccatcattcactgtgcttatgatagggaggctccttgctggggttggcattggctttggtgccatggtatctggagtgtacattgctgagatctcccccgcaggtgcccgagggacgctcacatcccttcctgagatctgcatcaattttgggatccttcttggctacgtttccaattatgccttctcaggcctttctgagcacatcaattggaggattatgcttggtgtcggtatcctcccatcagtcttcattggctttgcgcttttcgtgatcccggagtcccctaggtggttgatgatggagaagagagtttcagaagcaagggcagtgctgctgcagattagcgagtctgaagctgaagctgaagaacggctggctgagatcgaggaagccgcaggtctgatgaaatcaatgaaatctgaggacaaagaagtgtggagggaacttttgaacccgtctcccgccgtccgtcggatgctgtacgctggttgcggtattcagttgttccaacagatcacaggaattgatgctactgtctattacagcccaacaattttcaaagatgctggcatcaagtctgatcaggagcttctcgctgcaactgttgctgtgggtttcactaagacagtgttcatcttggttgcaattttcctaattgatagagttggacggaagccacttctttatgtgagcaccattggcatgaccatctgcttatttctcttgggggttgcacttacactgcaaaaccatgcggtggggcttatgtctccacgtgttggtatcgacctagcaattttcgcagtttgtggcaacgtggcattcttttcaattggcatgggaccaatatgttgggtcttgtcctcagaggtatttcctttaagattacgagctcaagggtcagcgcttggtcaagtaggtggtagagtgagcagtggtttggtttccatgtcattcctttctatggcccgtgctatatcagtggcaggaatgttcttcgtctttgctgcaatatccactatctctgtactgtttgtgtacttttgtgtgccagaaacaaaagggaaaacactggagcagatcgaaatgatgtttgaaagtggggacgaatggggaggaggtgaaattgagcttgaggatacacagcatttaataccgagtatcaagaagtctgtgcctcttggttgatatttgtagcatcaataaaattcttattagctccatgtttcaatgacgagccaaccaaaccagctggattctgaactttggtttcgagtgatctggccacactgagccacgaccgatctgataaaagataagcttgatagacataggtgcaacgtagaagattaattgtgatgttagttcaaaatgtcaatgattttactgggaggcggtctgtaatgtatgatcttacatctcttgtaccttcttacatctctcgtacctcccagcggaagaatatactcgcagaaaagttttctactgtgcatttttttataacaccaaaatgagtattagatgctatttgggg

SEQ ID NO: 8443 - DNA, 2468 bp, Zea mays
tgtttgtctaccgtatttgcgtgtgcgtctcttgtttgcctgcgattgaaagccttctctgacctgtctccaaattggcattcctgagcaaaaatcccctgcaacccgacccatagccatgggcaagctcgaggagaggacgcgtgcgttctggacgaaccgatggcttgtgttcgttggggccatgtggatgcagtccatggccggcaccacttacatcttcggcgccatctcgccggtggtcaaggccaggctgggctacgaccagccgcaggtggccgcgctgggtgtcgccaagaacctcggcggctgcctcggcctcctcgccggcgcgctctcggcgacgtggccgccgtgggcgctgctggccatcggcgccgcgcagaacttcctcggctacggctggctctggctcgtcgtctccgggaacgtgccggcgctgcccctctggctgatgtgtgttgttatctttattggaacaaatggccagacgtatttcatcacggcttcacttgttacaagcatccagaatttcccaaagagcaggggcccaacagtgggcatcctcaaaggatttatgggcctaactagcgccattctgacacaagtttatacagtgatgcacactccagaccatgctgcgcttatcttcatggttgctgttggtccgtcgctggttgccattggcttgatgtttgttattaggcctgttggtggtcacaggcagatacggccatctgacaagaacagcttcatgttcatctacactgtatgcttgctcctcgcctcataccttgtcggtgctatgcttatccaagatttcctgcaaccaagctatgatgtggttgtttttctgactgtgattctgttcgtcctccttatttcaccaatcgcaatccctgtgattgtgtcgttcatgccggaaaaagctcagcatctcatggaagatgctctcttatctgaaccattgacaggagaggcaagcagttcacgacaaaaggaggatcaaccagaggtcattttaagtgaggtagaagaggagaagtctaaggaaactgattcattgccgccatctgaaaggagaaagaggattgcggaattgcaggccaagctagtggaagcagcggcaagaggtggggttagaatcaaaagaaggccacaccgaggggataacttcaccctgatgcaggcattggtgaaggctgatttttggcttatttggctatcacttttgcttgggtcgggatcagggctgacagtgattgataacctgggtcagatgagccaggctattggttataaaaatgcacatatctttgtgtcactggtgagcatatggaactttcttggtcgtgttggaggtggctacttctctgagatcattgtcagggaacgtacatacccaaggcacatagcattggcagttgctcagatcgtgatggctgctgggcatttcctctttgctatggcttggcctggaactatgtacattgcgagcttgctggttggacttggatatggagctcactgggctattgtgccagctgctgtctccgagctttttggtgtaaaacactttggtgcgatgtacaattttctcatactagcgaaccccgcaggatccctcatcttctcagagctaattgtcagcaacctctatgaacatgaagctgagaaacaagctagccaacaccagatgtcagcattgctgtctccacgattgcttcgtgataccggctttcttgcagatgatgcactcaagtgtgaagggcctgcttgcttctttttcagctctctgattatgtcggtgttctgtgctgttgccgctgggttgagcctcctcgtcgttcaaaggaccagacaagtttatcctcgcctctacagttctgtccgcacttgagattctccaattctccatggatgggaagctcaaatcctcgtattctatgtccgtttattcttgcatacatatgcacaaagataagtatgtgaataaattctcaaatcttttcctaagctggtattgtaaaaacagatattcttgaatggactgtcccttgtgacttgcctatggattctggcacttgctgtcctgaaaagaaactatccctctccttttttttgaagcaattactgtatggagttcctacaatatttttctattaaatatgggtatgtacaagtgtaagtattcaaattacaaggaaatcaactataaacatgatttaattttggctgctatttggggttttactctatgacaaagaatcatttcttttacaaacatttctttgcatattgtcgccatgggggtttattctcaaagatccatccatttctgcattttcatatgcaccaaaccatgatgatgataatctccatcctccaagttttcgttagttgcgcaggcatatgttgcacagctagaaattgattggaagtgcgcggtggtacaaccctatcagggg

SEQ ID NO: 8444 - DNA, 4628 bp, Zea mays
  misc_feature (2685)..(2685): n is a, c, g, or t
  misc_feature (4417)..(4417): n is a, c, g, or t
  misc_feature (4539)..(4539): n is a, c, g, or t
  misc_feature (4546)..(4546): n is a, c, g, or t
  misc_feature (4586)..(4586): n is a, c, g, or t
gcgtgctccaggttatgccacgcttataaacgcgtcgtagacgaatgagcgtgccagtgttgccagtaccacttgtactaggtacaaggcaccagccaagtgtcagcgtctaagggaccagcacagaagtcctccatgactgttgttatggaatcagtttatagaatcatagaggcagatgcgtctttgatggcctttcccctaatattgctaatttcttaattcaagttgggcacgagcaccgtctgtgagagtctactggagccaagggattgtcatcccttgctgcctccctatcagacgtggattagagctttatagatagatcagtttatgtttgttacgtttagaccgccataaggcgtctcttgtactccggtctatttcggaccatgcttatttctccttttaatataatgagtcacaactctcctgcgtgtttgagaaaaaaaccatttggttgtagtattttactatgacattgaaattatcagatcatccatatatatgactatactttttacatttcatttggtaacagaaccagttgtcgagaggaccttacgagcctccatcaccgagatatctgttcttcttttgttcagtgatgacacagatataaaaaattccagtgttcctatcagtgcattggatgatatgagacattctgaaatgttttcgagctgcctttcctctgagcattttgagaaatcaattatatctcctgctacagcttccagcttaaatatgcatcatctcaaagccaagtgtgagaacattcatcttgatctacaggtattcattttgtctgtactggtactggtacatcagggcttcttagtccatgcatcattttagtttcaccaagcttggtatttgatattttttcttgttgatatctgcaggcttgcccgcaaaatgtaaggctcaaggcatcaattgcccaaattaaacttgatgaatactaccacgccggaaacaatatttcagatgattcaaaccttggtaatcacttcttgaacaataacttgcggcaaggagttcaagcttccctccctcagtgcctgtttgctgttggagatcattcggtggaaacctatgaattttgtggcaatagttcaactgaattgactagagttgaattgctaaaaacttttggcgagtgcacattctgttatgatgtcagtaccaaagatcaagatggcaatttagtgagctcaacttccatgtcgatctatttggctcctttgcttttatgggtgcactttcatacaatatacatgctactgagttttgtaagtaatgttgagtctgatttgtcacatggagagcataaaattcaaaagcatggtgacgaaaagggaagcagattgactaccagcacaaccatgtcctcaagtggaagtcttaaaagttcagatatccctagcacaggcaagaattgtcctgtgctttccatctgagttttcatgggatttgagccacccatctgtcctggataagttcctggtgatcgaccatacttcatgtctgaacatggtagaaactgcatcacaccctcaaaacgaaatgccaaatgaggttcatcttagcaagtcgtgtacctcaatccatttggctgtaggggacgtagacgtatatttggttaagccagtcaataatgtattggttggtagaatctgttcttcaagtaggcaaactttctctgcaatgaagattctttctgttactggatccagttataatgactctggcatcacactgatcaggagaaagtttcctgtaactggccctgagattttgaacaatgcttggagtttgccaaagctgcatgatgaaaagatttctaaaaaacagaacagcaaatgggctggcatttccccttcttcaacacatgatcttgtggagacaggatctagtacgcgccaggagctcctaaagagcactgaggtcttatttcatgttcaactttcttgtgtctcagtacaaattagtaaaaaggattgcgagttactaaataagttgctagatcatgtcattgaggggatatcaaatcaacaaacaagcatttctggaaattccaaggaccaatctgttctgatcaatgatatctgcattcaaacatctgtcctttttgaatgcagtatcttggaaatttgcactgaattgaatgaaacagtggaagttggtcctttattacagtcagaactaaaaggatcctggaactctctgaagttgaaagtttcaaaattttctcttttctcctgttcaaatgttggaggcctcagcagtgccagttttctttgggtgaatcatggtgaaggtgagctttggggttctgttagtgctaagaatgataaagtctctggagaaagtaaagattttcttatagtcgcttgcaaggactctgcctgcaggcgggctgacggtgaaggtactaatgcgctgtctattggcgctgctggctgttcggtgacccacatcaggaacccaaagctaaaagagaactacacttatgttgatgttcgttctggtacaattgtagcacctggtggccgtatggattggatcaatgtgatatgcctgctgttcagttcaggttcaaatggaactgaaaagtcagttgataataacacagtaaatagctaccaattgaatgatccttattcgtcatctttgtttctngagttctctgatgttgctgttagctatgaacctcattttaaaaatttcactcttagtgctgcaccaactgaccccaagtttttctcatgccttttagctgcatcatcatttaaactccataataaatctgcatcagcctctgcagctgctgattttgatatccagttacgtgatcttggaatcctcatttctcaatcatctggctcaacaaatgccacctgcagttacagtgtaggttaccttcatcaagcaggttatactaaggttgcccagaatacattcattgaagcttctctaagattagattctaccttttggaagcttgaaatatttgctccccgatttgatattggtacatgtcatgacacgacttatggtcttattggtttgggatcccaactccagcagctatatggtccagatatgcaagatgctttagatcatctacagtctaggtggaatagtgttcagcaggcaaacaggcaaaatatggctgctgatgaatcagacacgtctgagagcagtttggagattttggcggattctgggaattatcagtcagatggactgcttgatgatattattgagaatgctttttacacagaggactgcatggacaaccatttttgggagagaaattgccatcacctatttaataacagtgaaatggatgatggatttgagctgaatgcagccacttcttcacacgaatttcttagatctattccggaaggcaatgttactcagatatcactagaacggaatgcctgtcctgatcaaatcgactcatattatatgcccgaatttcatcaatcattatcaactctatgtgatgaagagcataaatgtacgtttggtgacaattctcatagaaccctggaaagtgaagatgctggatggtataaaaatgttcccttaacaatagttgagaatcatgttttgaaacaggaaaacaagcaagtacttcaacacgaagtggcttctgtttgcagtttgaatcctgatgaatatagtaatctgaaaggaaagattcatattcatgatatagatgtaaagtggcggatgtatgctggagatgagtggttattacctcagaaagattctactagcttaacattcacagatggaaaagataggagctcttcactggaatttaccttgagagggctcagtatccaagttgacatgtatccagatggggatgtttctatatccaagctatccatagctgctgaggacttaactctgtgtgatcaaagtatccatgctccatggaaactggttcttggatgttacaactcaaaggattatccaagagagtcgtggtccagtgctttcaggttagaactggagtctgtgaggcctgagccacaggctcctttggaagactacaggctccatctcgaaattttgcctctacagttgcatcttgatcaagagcaacttaacttcctaatcaatttcttcaagaatgattcatgtaacaatgaccctcattcacattgcgaaaatgagactgtcgacgtgaagaacacaagcaatggaagcaatacagttgtggatgaggcattacttcctttctttcagaaatttgatgtaaagccgcttgttctgcacattaattatataccccggcagtttgatccaattgcactaggcaaaggaaattatgcagaacttctcaacattcttccatggaagggaattgatttgaagcttaagcatgtttctngcaatgggtgtttacggatggagcagcataggtgatacagtagctgcggaatggttggaagacatttctaaaaatcaggtgcacaaattgctaaaagggcttgctccaataagatcactagnctgctgntgggttcaggcaccagaaagttggtctctttgcccatcanaagctacaagaaaggatcgggaaattgctcaaggggagtgca

SEQ ID NO: 8445 - DNA, 3013 bp, Zea mays
gagagcagtttggagattttggcggattctgggaattatcagtcagatggactgcttgatgatattattgagaatgctttttacacagaggactgcatggacaaccatttttgggagagaaattgccatcacctatttaataacagtgaaatggatgatggatttgagctgaatgcagccacttcttcacacgaatttcttagatctattccggaaggcaatgttactcagatatcactagaacggaatgcctgtcctgatcaaatcgactcatattatatgcccgaatttcatcaatcattatcaactctatgtgatgaagagcataaatgtacgtttggtgacaattctcatagaaccctggaaagtgaagatgctggatggtataaaaatgttcccttaacaatagttgagaatcatgttttgaaacaggaaaacaagcaagtacttcaatacgaagtggcttctgtttgcagtttgcatcctgatgaatatagtaatctgaaaggaaagattcatattcatgatatagatgtaaagtggcggatgtatgctggagatgagtggttattacctcagaaagattctactagcttaacattcatagatggaaaagataggagctcttcactggaatttaccttgagagggctcagtatccaagttgacatgtatccagatggggatgtttctatatccaagctatccatagctgctgaggacttaactctgtgtgatcaaagtatccatgctccatggaaactggttcttggatgttacaactcaaaggattatccaagagagtcgtggtccagtgctttcaggttagaactggagtctgtgaggcctgagccacaggctcctttggaagactacaggatcccacaatgtactgctgcctctggaggtctctgttggacatgtccaaaccatctcaactggtgttggacaaacttctattcaattggtgctaccccaatcctatgatatattattatcgttttggacccaattccttcttatgtagccacaaattcaacacaacatacacattttcgcaaaaacttttctgttgaacagagctcttcatagcaacattatgaaataatctttcttacttttgtgctctcttgatattgcaattgcaattgattctcttctgttgcactatcttaatttttgcaggctccatctcgaaattttgcctctacagttgcatcttgatcaagagcaacttaacttcctaatcaatttcttcaagaatgattcatgtaacaatgaccctcattcacattgcgaaaatgagactgtcgacgtgaagaacacaagcaatggaagcaatacagttgtggatgaggcattacttcctttctttcagaaatttgatgtaaagccgcttgttctgcacatgaggtatataccccgtcagtttgatccaattgcactaggcaaaggaaattatgcagaacttctcaacattcttccatggaagggaattgatttgaagcttaagcatgtttctgcaatgggcgtttacggatggagcagcataggtgatacagtagctgcggaatggttggaagacatttctaaaaatcaggtgcacaaattgctaaaagggcttgctccaataagatcactagctgctgttggttcaggcaccagaaagttggtctctttgcccatcaaaagctacaagaaggatcggaaattgctcaagggagtgcaaagaggcacagttgcttttattagaagtgttagcattgaagcagtaggtcttggagtccatttggctgcaggagctcatgatatacttatgaagacagaacatgctcttacaactgttccaccacctttagcctcatgtgaagcgaaacgaacaaaacacaacattagagctaaccaacctgaaagtgcacaacaaggaatgaaacaggcatatgaaagtttgactgttggttttggaaggacagcctctgctctcattggcaaccctattaaagtttataaccgaggggcgggtgttggatcagttctagctactgcaatctgtggagcaccagctgctgcagtagctccagtctcggcatctgctcgcgctttacattatgcacttcttgggctaaggaacagccttgatcctgagcacaagaaagaatccatgtacaaataccagggaccctctcaagcatagacgtgattgagaagatgagttgggagttcagttcattcttttggcgcgccttacaccatctccttgaaacaactggtttaggaactcctttgccagtctcgtccaatgatgaggtgcaaacttgtacagtgtgtacagatcgtaggacagattatatgtggcaccaaagccttacactatgtaaattaacgcattagggtttaattaccactgatcttttccaccacgaaggcaagtggaagttttgtatcccctcttcgcttagtttagtaagatacctatggctcgcatgactgtcccaatgtacataatgtggttgcgagctgtgcggatgtaaatattctcgtttgctttggttgtgtgcgtgcacgcctcttggtccgctgacaacaggaatttgaagagtttccagtggagcatttggatacagcctaggggtatggtaggacgaagcggttccactctaaatttgttgtttgaattggttttatgtaggatagagtgactctgaaaaagaaaaattatgcttagatgctgaatcatttggcttcctaaaagtcgacgcggccgaaaaaaaaaaaaaaaaaaaaaaaaaaaaaaaaaaaaaaaaaaaaaaaaaagggggcgggccgtttttaaagaatccaagtttacttccccgtgcttgcaacgtaatagtttttttttagggccccctaaattaaattaactggcgcggggtttaaaaacttctggactggaaaaaccttggggttccccaatttaattgctttgaaaaaaatccccttttccccagttggggtaaaaccaaaaaggccc

SEQ ID NO: 8446 - DNA, 1084 bp, Zea mays
ttttttttttttttttttttagtatgacaacttgagcattattcagcttttttttttctatgcagcattcttgttgagcaaaaacgatcgaagaaactttacacggtcggtcactcgatgctgggcatggtaccaggtagtagctcaactgattttctgactcgggtgacgagtttttttttgtgtgtgtgtgtgtttatttatacatcaaacgttgaagaacagaaaaggctggtacagtcaaagccgccaggcatagtttcgtattcgctatacggctgtgtcgaactggagtaaaaaatagcgtcgtcaaatcttgagctgctcgcagttacgcagctgtcctgtagaagaagcttaggcagcgcagcccccggtgacctacacacctcgcagtctcgatgattgtgttcttacgagagatggctggagtgcgtcgtagtgcccgtagccgtcgtagagaacgcggactggatcgtcctttccgtattcctggccgtattccgctatgatccttgggccgtcggagctgcccgtatacatgtagacggtgatgggcatcctgagaacgtgggaacacatgaacagctcaggttcccctccccaagcatgaggctttctcatctgtctcacataactctcaaagctgccttcaaggaaccattcggtgtctcctcttcgcttgacgaactcatcagctactttggctcggagctcgtcggccagttccttctgggcgctgtcgctgggcgcatgctttcctctcctcaggcaggcgccgtaggcgacggacctgaacaggcatcgaccgtcccctgtgattctgatggagcgcagggggcggagctcccgatccgacatccgccggtgcagggcgccggtggcgaccgtcgtctcctcctgcccctgccgctgccgggggtggaagcaggagggcgcagcgagcacggaaggaggagctgcaaaatgggatgggatggaatggaatgtaaaacaaagcggggcagggcagggcagggccccggccggcctcgagcgtgaggctggaattggaattgggattcccggcccggccggcctcgag

SEQ ID NO: 8447 - DNA, 2477 bp, Zea mays
  misc_feature (19)..(19): n is a, c, g, or t
  misc_feature (70)..(70): n is a, c, g, or t
gagatggggatgataccgnccgacatcgggggagagcatcgtgggcgccggcgggtgcaacagctccagngacgccgcgcagtcctcctcctacctctccaggaccttctccgtcggctcctgggacgacaccaactccatcatgttctcgtccgcccccagcaagaagcccaaggtggaccccgccgacgacatggtcgccagcttcagcaccattgacccgcagcgcagttcggcctgtccaactcgtccctggagctgcccggcatggacgactacctgcagctgcagcaggactccgtcgcctgcagagtgcgtgcgaagcgtggctgcgcgactcacccacggagcattgccgagagggaaagaaggacgaggatcagcaagaggctgaagaagctgcaagacctcgtgcccaacatggacaagcaaacgaatacgtcggacatgttggaccttgctgtggattacatcaaagagctcaaggaccaagtcgagaagctaaaacacgaccaagcaaactgttgttgcctaggcaacaagagctgctgctgatgctggagaagcagacggaggagggtttttacgccgtaacaatgtaacatgtggagcggcttccatgactcagcttcctcttttcttggttgttccacggactagcgacccggccggtgccaacggcttgaagactaggagataacaagtaggacgatgttgtaatttagctaccacgacgcggtggctctggcttgcgtgtaaagaagtcctccctttcaacgcgactgggattgttgttgctggtaaaattgttgtaggaatatcatctgcgctccatttttcatcgagctcatcttttttttgtgtgtgtcactggattttgacaagaccgtaactcagaaaccgagcactgaccgagcgttcatgccaccccatacgaagtccaagagaattttagtatgacaacttgagcattattcagcttttttttttgctatgcagcattcttgttgagcaaaaatgatcgaagaaactttacacggtcggtcactcgatgctgggcatggtaccaggtagtagctcaactgattttctgactcgggtgacgagtttttttttttgtgtgtgtttatttatacatcaaacgttcaagaacagaaaaggctggtacagtcaaagccaggcatagtttcgtattggctatacggctgtgtcgaactggagtaaaaaatagcgtcgtcaaatcttgagctagctgctcgcagttacgcagctgtcctgtagaagaagcttaggcagcgcagcccccggtgacctaaacacctcgcctgcaggctccccagcgccagtggaggtggggtgttactggttccgagctagatgagagctgctgaagcagccaaaacagcaatctagtagtgcaaaagcctgcctattgtcggattctgttcagtgcagaatacttacagtctcgatgattgtgttcttaccagagatggctggagtgcgtcgtagtgcccgtagccgtcgtagagaacgcggactggatcgtcctttccgtattcctggccgtattccgctatgatccttgggccgtcggagctgcccgtatacatgtagacggtgatgggcatcctgcaacgcagcgttttctcagtctcagtcctcgctgaccgagtgaccataacgatgtgcacaaaagaaaaggggctacacttagcacggacaggttggccaccataccgacctgagaacgtgggaacacatgaacagctcaggttcccctccccaagcatgaggctttctcatctgtctcacataactctcaaagctgccttcaaggaacctatgtatgattggaaaggagttaataagacatagtcgtctttgtatatttcgagctggagcatgttcttttgacatagatctttattaaggatggaaggacatctatcaacaaaattaagggctagtttgcgaaccccatttttctaagttattttcatttttccaaagaaaattagtctatttttccttgggaaaatagaaatcttttggaaaaatagagttcccaaactagccaagttactatatggaaatagtctgtatgcagaaacagatagtacgtccatggaaactaataatacatatatcataaaagcagtaatagaaagaggatgaaaccattcggtgtctcctcttcgcttgacgaactcatcagctacctggaacagatcaacggcaggttattagcaccaacaaagacggggagattattccgttctgtcgagatgcacggaacaaggacgcgcttagtaataatcaagaagcccaggtgtaacggacactcactttggctcggagctcgtcggccagttccttctgggcgctgtcgctgggcgcatgctttcctctcctcaggcaggcgccgtaggcgacggacctgaacaggcatcgaccgtcccctgtgattcctgcag

SEQ ID NO: 8448 - DNA, 851 bp, Zea mays
cccggtcgacccagcgtccggccggcgccgccgacatggtcaccaacttcagcaccattgacccgcagcgcagttcggcctgtccaactcgtccctggagctgcccggcatggacgactacctgcagctgcagcaggactccgtcgcctgcagagtgcgtgcgaggcgtggctgcgcgactcacccgcggagcattgccgagagggaaagaaggacgaggatcagcaagaggctgaagaagctgcaagacctcgtgcccaacatggacaagcaaacgaatacgtcggacatgttggaccttgctgtggattacatcaaagagctcaaggaccaagtcgagaagctaaaacacgaccaagcaaactgctgttgcctaggcaacaagagctgctgctgatgctggagaagcagacggaggagggtttttatgccgtaacaatgtgactgttaaaccagagctgttgcttcaggagaccaggccgcgggcagaagtgcgtgacatgtggagcggcttccatgactcagcttcctcttttcttggttgttccacggactagcgaccggggtgccaacggcttgaagactaggagataacaagtaggacgatgttgtaatttagttaccgcgacgcggtggctctggctttcgtgtaaagaagtcctccctttcaacgcgactgggattgttgttgctggtaaaattgttgtaggaatatcatctgtgctccatttttcatcgagctcatctttttttttgtgtgtctcactggattttgacaagaccgtaactcagaaaccgagcactgaccgagcgttcatgccaccccatacgaagtccaagagaattttagt

SEQ ID NO: 8449 - DNA, 4482 bp, Zea mays
  misc_feature (442)..(442): n is a, c, g, or t
ctgccagcagccagccgaatcctctctctatctctctcctcttcttcctccgtataccgagctcagccgagcatctcctccattccccaagcacaacaactccttccacaggcggacgcagtcggtgccattcaatgccctgactgccggctgcccggcccatgcacagagagacagggcgcctctgtcttctctctctctctctctgagacacgacgcagtcaccgccacctcctttaactcccctgcctcgtcgcttcccgacgctgactcgctcggccgcccgggcgcccatgcacgcacccgccgcctacgtgcgcctccctacttgcccctgccggcctgccctgttcatgtacccaccacaatcttacacctaggaggacgctacgagctcaagctctgggctgtggcgagcggcgagcattgagtcgaggggcanccgagaagatggcaatgacgcggccgttcttggcgccgctgatgatagtggcggctgttcttctttcacgcatggcggcggcggcagcggacgacggcgacgtgctgctgcaggtgaagagcgcgttcgtcgacgatccccagggggtcttagcgggctggaacgacagtgctggctccggcgccggctcgtcggggttctgttcctggtccggcgtggcgtgcgacgcgtcggggctcagggtcgtgggcctcaacctgtccggcgccgggctggccgggacggtgtcccgcgcgctggcgcggctcgacgcgctggaagcgatcgacctgtcgtcgaacgcgctcacgggccccgtcccggcggcgctcggtgggctacccaacctccagttactgctgctctactccaaccagctcacgggccagattccggcgtcgctgggggcgctctcggcgctccaggtgctccgcttgggagacaacccgggcctgtcgggcgccatcccggacgcgctaggcaagctcggcaacctcaccgcgctcggcctagcctcctgcaacctcaccggcccgatccctgcgagcctcgtgcggctcgacgcgctcacggcgctgaacctgcagcagaacgcgctgtccggcccgataccgcgcggcctcgccggcttggcgagcctccaggcgctcgcgctcgccggcaaccagctcacgggcgcgataccgccggagctcgggacgctcgcggggctccagaagctcaaccttgggaacaactcgctggtgggcgccataccgccggagctcggcgcgctcggcgagctccagtacctcaacctcatgaacaatcgcctcaccggccgcgtcccgcgcacgctcgccgcgctctcgcgcgtgcacacgatcgacctgtccggcaacatgctctctggtgcgctgcccgccgagctcggccgcctgccgcagcttactttcttggtgctatccgacaaccaactcaccggcagcgtccccggcgacctgtgcggcggcgatgaagcggagtccagtagcatcgagcaccttatgctctcgatgaacaacttcaccggggagataccggaggggctctcgcggtgccgagcgctgacgcagctcggcctggcgaacaacagcctctccggcgttatccccgccgcgctcggcgagctcggcaacctgacggacctggtcctcaacaacaacagcctctccggcgagctgccgccagagctcttcaacctcactgagctccagacactggcattgtatcacaacaagctctccggtcgcctgccggacgccatcggccgtcttgtgaacctggaggagctgtacctgtacgagaaccagttcaccggcgagataccggagtccatcggggactgcgcgagcttgcagatgatcgatttcttcgggaaccggttcaacgggagcataccggcgtccatggggaacctgtcgcaactgatcttcctcgacttcaggcagaacgagctgtccggcgtgatcgcgccggagctcggtgagtgccagcaactcaaaatccttgatttggccgacaatgctctgtccgggtcgattcccgagacgtttgggaagctccgttcgctggagcagttcatgctgtacaacaactcgctctccggcgccatcccggacggcatgttcgagtgccggaacatcacgagggtcaacatcgcgcacaaccggctcagcggcagcctcctgccgctctgcggcacggcgaggctgttgtcgttcgacgccaccaacaactccttcgacggcgcgatcccagcgcagttcggccggtcgtcggggctccagcgcgtgcgcctggggagcaacatgctctccggaccgatcccgccgtcgctcggcggcatcaccgcgctgacgctgctggacgtgtcaagcaacgcgctcactggcggcttcccagcgacgctcgcgcagtgcacgaatctcagcctcgtcgtcctcagccacaaccgcctgtcaggggcgattccggactggctgggctcgctgccgcagctcggcgagctgacactctccaacaacgagttcaccggagcaatcccggtgcagctcagcaactgctccaatctcctgaagctgtcgctcgacaacaaccagatcaatggaacagtgccgcctgaactcggcagcttggcgtccctcaacgtgctcaatctcgcacacaaccagctctcaggtcagattccaacgacggttgcaaaactgagcagtctctatgagctgaatctgtcacagaattatctgtccggtccaatccctccggatatcagcaagctgcaagagctgcagagcctgttggacttgagcagcaacaatttcagtggccacatccctgcatcactcggctcactctccaagctggaagacctgaacctgtcccacaacgctctggtcggcgcggtgccgtcgcagctcgctggaatgagtagcttggtgcagcctggacctgtccagcaaccagcttgaagggaggctgggcattgagttcggccggtggccccaggccgcgttcgccaacaatgcagggctctgcggtagccctctgagaggttgcagcagcaggaacagccggtcggcgttccacgcggcgtccgtcgcgttggtgactgcggtggtcacgctgttgatcgtgctcgtgatcatcgtgcttgcgctgatggcggtgcgccgccaggccccggggtcagaggagatgaactgctcggcgttctcgtcgtcgagctcgggcagcgcaaaccggcagctcgtcatcaagggctcggcgcggcgggagttccggtgggaggcgatcatggaggccacggcgaacctgagcgaccagttcgccatcggatccggcgggtcgggcacggtgtacagggcggagctgtccactggcgagacggtggccgtgaagaggatcgcggacatggacagcggcatgctgctgcacgacaagagcttcacgcgggaggtcaagaccctgggccgcgtccggcaccggcacctggtcaagctgctcggcttcgtcacgtcccgcgagtgcggcggcggcggcggcatgctcgtgtacgagtacatggagaacggcagcctctacgactggctgcacggcggcagcgatggccggaagaagcagacgctcagctgggacgcgcggctcaaggtcgccgccgggctcgcgcagggcgtggagtacctccaccacgactgtgtgccgcggatcgtgcaccgggacatcaagtccagcaacgtgctcctcgacggcgacatggaggcgcacctcggcgacttcggcctcgccaaggccgttcgggagaaccggcagccgccttcggaaaagactgcaccgagtcagggttcctgcttcgccggatcatacgggtacatcgctccagagtgtgcttactccctgaaggcgacggagaggagcgacgtgtacagcatgggcatcgtgctgatggagctcgtcaccgggctcttaccgaccgacaagacctttggcggagacatggacatggtgaggtgggtgcagtcaaggatggacgcgccattgccggcccgggagcaggtgttcgatcctgctctgaagccgctggcgccgcgtgaggagtcgtcaatgacggaggtgctggaggtggcgctccggtgcacgagggcggcaccgggggagaggccgaccgcgcggcaggtctccgatctgctgctccacgtttcactcgattactaccgcgcctgcgaaaaacgttaggatttcgaaactgggggatgaagttgtcctagtagctgcttttctaagtcgtccttttaagctagcttaatcttttcattcatgaaactagggaaaaagagacttatttttagggtttgaagttgaatcgagtcaagaatgcccttcaaaattgtatttcttaagttcaaattttgggatcgcttgtaaaaagcacttggaaatgcgcagcaaccaggaatgccgaagcatcaaaaaaaaaaaaaaaa

SEQ ID NO: 8450 - DNA, 838 bp, Zea mays
ccttggggccctcgaggccggcccggaaccccgcccgatcatcttcctcgttccgccgctcccccgcctccggcagcgaggtgaggccaccgatcggaccttccctagcggcggcgcctaccaacctcaaggagcgatggctctgtctgcgacgctacggatttctcttagcgtcgcgttctttggggttctggcgttcgtgcttggtgtcatcgccgaaaacaaaaagcctgcttccgggactcctatcctaggaaaggatgtcgtcatctgcacgtttccaagtgatccgactcttgcgatggggagcctgtccattgtggcacttgtggtagctgccatcgtaggccatgttgccatcttctttccatactcgggcaagtcagttcctcgtggagcgctgtttcaaagcaccagcttgacagtgttctttgttgttgctgagcttgtctcagccctggctcttgcaatgtcgctgtgggcaactgtcaccgagggtcttcaccgcagcaagaacatccaccacgacatggactaccagtgccctactgccaagaccggcctgttcggcggcgccgctttcctcgcccttgacgctgctctcttctggcttgtttgccagatgctggccctcaatgcaagggctgactaccttgacgaggatgacggcaagggagaatatggccagatttatgctgctcaagtcgatgatggctcgaaggtctgagcctatgtggtcatgctcggcagggttctatgattagtgtcatttggctacattatgccatcaacaaagtcgctttagctctcagtaaatttgtatataagttgcaaagcc

SEQ ID NO: 8451 - DNA, 1239 bp, Zea mays
aaagtaactaaccatattggccgtgcgtccgtggctttgcatctgcaaccccgcccgatcaatcttcctcgttccgccgctccctcgcctccggcagcgaggtgaggccaccgatcggaccttccctagcggcggcgcctaccaacctcaagtgcgtgggttgcttgtcctgcaggagcgatggctctgtctgcgacgctacggatttctcttagcgtcgcgttctttggggttctggcgttcgtgcttggtgtcatcgccgaaaacaaaaagcctgcttccgggactcctatcctaggaaaggatgtcgtcatctgcacgtttccaagtgatccgactcttgcgatggggagcctgtccattgtggcacttgtggtagctgccatcgtaggccatgttgccatcttctttccatactcgggcaagtcagttcctcgtggagcgctgtttcaaagcaccagcttgacagtgttctttgttgttgctgagcttgtctcagccctggctcttgcaatgtcgctgtgggcaactgtcaccgagggtcttcaccgcagcaagaacatccaccacgacatggactaccagtgccctactgccaagaccggcctgttcggcggcgccgctttcctcgcccttgacgctgctctcttctggcttgtttgccagatgctggccctcaatgcaagggctgactaccttgacgaggatgacggcaagggagaatatggccagatttatgctgctcaagtcgatgatggctcgaaggtctgagcctatgtggtcatgctcggcagggttctatgattagtgtcatttggctacattatgccatcaacaaagtcgctttagctctcagtaaatttgtatataagttgcaaagtcttacataaggctggtggttattgcactttcgtgtttcagtgtgatcgataaacagtatctcagtacaatcggtttgctatgccccttggcgaacttgtccttgagttttctggtgtctgaatggcactataatataatatactccctctgttccaaaaaaaaaaaaaaaaaagcggccgcctttatgtctattcaaatggattatgataatctacaataggacatacaacgcaacattgattgagatgcaatataaaatcaaggctcataatccatcatcatgatcaaagtatactgtattatgctaggttcaaaaggaagacatcacaagtatgggaatcctatcttcatgctgca

SEQ ID NO: 8452 - DNA, 1339 bp, Zea mays
cattgggtacctcgaggccggccggggctatctctgccctcacgtcgaaaatagccacacgatagcaacttgtacacaataaacacagggggaccctcgggcgggcgggaagtaactaaccatattggccgtgcgtccgtggctttgcatctgcaaccccgcccgatcaatcttcctcgttccgccgctccctcgcctccggcagcgaggtgaggccaccgatcggaccttccctagcggcggcgcctaccaacctcaaggagcgatggctctgtctgcgacgctacggatttctcttagcgtcgcgttctttggggttctggcgttcgtgcttggtgtcatcgccgaaaacaaaaagcctgcttccgggactcctatcctaggaaaggatgtcgtcatctgcacgtttccaagtgatccgactcttgcgatggggagcctgtccattgtggcacttgtggtagctgccatcgtaggccatgttgccatcttctttccatactcgggcaagtcagttcctcgtggagcgctgtttcaaagcaccagcttgacagtgttctttgttgttgctgagcttgtctcagccctggctcttgcaatgtcgctgtgggcaactgtcaccgagggtcttcaccgcagcaagaacatccaccacgacatggactaccagtgccctactgccaagaccggcctgttcggcggcgccgctttcctcgcccttgacgctgctctcttctggcttgtttgccagatgctggccctcaatgcaagggctgactaccttgacgaggatgacggcaagggagaatatggccagatttatgctgctcaagtcgatgatggctcgaaggtctgagcctatgtggtcatgctcggcagggttctatgattagtgtcatttggctacattatgccatcaacaaagtcgctttagctctcagtaaatttgtatataagttgcaaagtcttacataaggctggtggttattctgcactttcgtgtttcagtgtgatcgataaacagtatctcagtacaatcggtttgctatgccccttggcgaacttgtccttgagttttctggtgtctgaatggcactataatatacttcctctgttccaaaacagtagtccttttagctcttgttttttatggctatattcaaatggataatgatgtacaaatgatgtacaatagggcatacagcacaacattgtttgagatgcaatataaaatcaaggctcataatatgatcaaagtatactgtattatgctaggttcaaaaggaagacattacaagtaggggaatcctatcttcatgctgcaggtcgactttagagg

SEQ ID NO: 8453 - DNA, 1169 bp, Zea mays
ctcgaggccggccgggcattctatttcacaaaccaaacaaagtggcccattaatcaggcccttgaacggttaatccctagacggcctagagagaaaggaaagaagtgctccggggaagcaccgtgacacccttgctcgcccgcatctctctaaccgccggcgccggcgccggcgccggccatcgttcacatggctgcgatgccaccggccttcacgggcaacctgaagaaagcacttgcaggtctgagaagaatcaatttagatgggcttcgatggcgcgtatttgatgctaagggtcaggtgctgggacgattggcttcccaaatagccgttgtgcttcaaggcaaggataaaccgacctatgcgccacatgtggaaaatggagacatgtgcattgtacttaatgcacaggatatcagtgttacaggaaggaaaatgacagataagatttactactggcatacagggtatgttggccatttgaaggaaaggaggctcaaggaccagatggagaaagacccaactgaagtgattcgcaaagctgtgctgcgcatgcttccccgcaacaaactgcgtgatgatagggatcgcaagctgcggatattttctggaattgagcatccattccatgaccgccctcttgaagcttttgtgatgccaccacggcaagtacgggagatgcgaccccgtgcaaggcgtgcaatgttaagggcccagaaaaaagagcattcaaacagggccaaggaggaagaagatgctaagaatgccacagctgaggtcactgcataggctcctcatgtgaatttgcatgatgcaaatttgctcgatgctgttttaggcctatcttttttgcttggtagccttttccagtggaataggcactagaggctcggaatgtgccaacctcgttctgaatcacctttttatttccattgcaatttgtaactggaaccctgcctgtcacagctgctttcttttgtaagcgaataagaccgtctgaattgttgaacttctgatctcatgagtgcacaagaatgtctccagggacatcttctatcctttctttacgtgtcactaggtgagtgtccgtacgttgcaacggaaacatatataatactaagataatttatgtgcgaatgtgtgttatactgttgattgactcctcgtgc

SEQ ID NO: 8454 - DNA, 1145 bp, Zea mays
ggtaccctcgggttcggccgggatattcatcaagccggccctagaatggttaaaccctagtagagagaaaggaagagaagggggcggagaagcacgtacgtcgtacatcgcccaccgccctttgcctcgcctcgcctcgcctcgcctgcatatctaacagccggagccggagccggagccggcgccgacaatcgttccaactgatatggctacgacgccgccaggattcacgggcaacctgaagaaagcacttgcaggtctgagaagaatcagtttagatgggttgcgatggcgcgtatttgatgctaagggtcaggtgctcgggcgattggcttcccaaatagctgttgtgcttcaaggcaaggataaacctacctatgcaccacatgtagaaaatggagacatgtgcattgtacttaatgcaaaggatatcagtgttacaggaaggaaaatgacagataagatttactattggcatacagggtatgttggccatttgaaggaaaggaggctcaaggaccagatggagaaagacccaactgaagtgattcgcaaagctgtgctgcgcatgcttccccgcaacaaactgcgtgatgatagggatcgcaagctgaggatattttctggaaacgaacatccattccatgaccgccctctggaaccttttgtgatgccgccacggcaagtacgcgagatgcgcccccgtgcaaggcgtgcaatgataagggctcagaaaaaacagcaggcaaacagagccaaagaggaggaagatgctaagaatgccgcagcggaggtcactgcataggctcctgatgtggatttgcatgctgccaatttttttgcttggtagcatttcgagtggaataggcactaaaagctgggaatgtgccaacttcgttctgaatttattttgtattctattacaatttgtaactggaaccctgcctgtcacagctgcttgaaaggttagaaagttgaaataaaaaaaaaacaaaaaaaaaaaaaaaaaataagctatctaatactaacttattttagcttatttgtgactttaaagtaatattttacctttctactctttcaccataatccaacttatataatctaggagggaacaaacatatccaagaccctctgaattgttc

SEQ ID NO: 8455 - DNA, 1226 bp, Zea mays
  misc_feature (1026)..(1026): n is a, c, g, or t
  misc_feature (1038)..(1054): n is a, c, g, or t
  misc_feature (1132)..(1132): n is a, c, g, or t
  misc_feature (1136)..(1136): n is a, c, g, or t
  misc_feature (1139)..(1139): n is a, c, g, or t
gggtacctcgaggccggccgcgccgccgtcggccagacggcctagaaagtaaggaaagaagcgctccggggaagcacctgacacccttgctcgcccgcatctctctaaccgccggcgccggcgccggccaacgttcacatggctgcgatgccaccggccttcacgggcaacctgaagaaagcacttgcaggtctgagaagaatcaatttagatgggcttcgatggcgcgtatttgatgctaagggtcaggtgctgggacgattggcttcccaaatagccgttgtgcttcaaggcaaggataaaccgacctacgcgccacatgtggaaaatggagacatgtgcattgtacttaatgcacaggatatcagtgtcacaggaaggaaaatgacagataagatttactactggcatacagggtatgttggccatttgaaggaaaggaggctcaaggaccagatggagaaagacccaactgaagtgattcgcaaagctgtgctgcgcatgcttccccgcaacaaactgcgtgatgatagggatcgcaagctgcggatattttctggaattgagcatccattccatgaccgccctcttgaagcttttgtgatgccaccacggcaagttcgtgagatgcgaccccgtgcaaggcgtgcaatgttaagggcccagaaaaaagagcattcaaacagggccaaggaggaagaagatgctaagaatgccacagctgaggtcactgcataggctcctcatgtgaatttgcatgatgcaaatttgctagatgctgttttaggcctatcttttttgcttggtagcctttccagtggaataggcactagaggctcggaatgtgccaacctcgttctgaatcacctttgtatttccattgcaatttgtaactggaaccctgcctgtcacagctgctttcttttgtaagcgaataagaccgtctgaattgttgaaaaaaaaaaaagaaaaaaaaaaaaaaaaaaaaaaaaaaaaaaacctgcccgggcggccgcccgggcaggngtacaagccccnnnnnnnnnnnnnnnnnttttttttttttttgggggttttttttttttttttttttttttttttttttttttttttttttttttttccctcgggngttngtncctcctttcttctccttttttttaaacgggggagggggcctttttttttggggggggccccctccttttccacaaaaattttttttt

SEQ ID NO: 8456 - DNA, 1651 bp, Zea mays
caacaccgacccccgcttcaccaccacaatccacaagcagctccggcctccagctgagactctcgagttccgagtcgtccgtacgtgtcgtacgtcccagcagccggcgctcgtcgtacgtactgcgtacgcgcgcaagcgcttggtacgaccgattcagcacgcatggcgatgaagaagggcggcggcgcggcggggctgaagcagatcctgaggcggtgctcgagcctggggcgtcgtcagcagcacggcgcggggtacgaggaggaggaggacgaggcggcggcgacggggctgccgtccgacgtgccgcgcggccacttcgcggtgtacgtgggcgagcggcgccgccgcttcgtggtgcccatcgcgctgctggaccgccccgagttccgctccctgctgcgccgcgccgaggaggagttcgggttcggcgccggcggcatcctcgtcctcccctgcgaggaggtcgccttccgctccctcacctccgcgcttgcctgcgcccggtgaaggggtgcgggttgcctgccacgccgcgtcgccgccgctatattcgttcgattcattggtatctcggcgagcttactcacctacactagctactagctcggcgagagctccagcggttacgttgatgatggcgtgtgtcgtacgtgtgtaaatatagattactcgtattagagaaaagcgctaagctaagaacaggccggtggcgcggccggccggctgctgcgcatgcgcggaggattgtgccagcgcgcccccggcccggccggcattggagacggccgaccgaagattcgaaggatgaagcacaaggacatcgacggatcagatgcatggagctgagcgagagcgagagctccagatcagcttcgctgcagtcggctacgtacggctatcatcatctatctagccgtacgttgccacgttggccgctgctagctgcattgcatgcatgtacgttgtttgtgatgcgtttcacttactggccccctgctggtgcaacaagtgaaccatcattttttcccttttttttcggtacatgcaaagatactgctggctgactgtggcctgtgggtacgtagccagaggcccagagctaggtagctggtatatgggcgaccgtacgcaccgacatcaagcattcagatatgcacacacagcatacaaacaagtgtgtgttccgtccatccttcaattccttgcagcttcggttcgtttttatatatcctgatgattcatcgatcaataaatataggagtattttttttttgttgccgcaaagcaaaaaacatatatgcatggttcatgacaatgatgtgtcggtcctgtatgcgtgtgacgcgtgctccggaagaagctggtttgcgctgtcgtcgacccatcctgccatcattcacggctagcgggcacgtcgtgtatgtatatgatgaccaacgtacaaaggaagtcatcggtttctagttaagggcaggtctcgtaggttcacggctctaggagttggaattcaagtgtgcatatagatatgagaccgaaagcttaataaaaaaaaggaagtttttttccccctggcccgaatataactagagagggagacgaaactgaaataaagtcgatcgatcgggatttttccgagacagaagga

SEQ ID NO: 8457 - DNA, 4356 bp, Zea mays
  misc_feature (2131)..(2131): n is a, c, g, or t
  misc_feature (2177)..(2177): n is a, c, g, or t
  misc_feature (3288)..(3288): n is a, c, g, or t
  misc_feature (3756)..(3756): n is a, c, g, or t
ggtgcacacataacagcacgcatcactatactctatagctcagaagatccggtccattttccagctctaaaactaaggcatagcggtaaacaccaccgaagtctcagcttctccgaggaaggggcgcaattgctgaagcagccacttcaccttggggccatacagaaatggcggcttcttgcgcctccacactcccttcactttccttcgtttcctcctccagttcatcccgccgattcaggcgctctggtgtggtggccatggccagcgttgggcagaaggtgtatgcgcccggtgtggcggtgtcggagggcaatggcgggctgccgaaaatcgacctcaaatccccgcacgggagcgaggctgagatttatctgtttggagcgtgtgttacttctttcaaagtccctaatggcaaggacctgctctttgttcgaccagatgctgtgtttaatggacagaaacccatcagcggtggaattccacattgtttcccccagtttggcccaggtcccatgcagcagcatgggtttgcacggaatgtgaattggtctatcacagattcagaagtcacagaaggagatccagctgtaactttggaactgaaagatgacacttatagccgttctatgtgggatttcagcttccatgcactgtacaaggtttccctgcactctaaaagcttgtcaacaactctagcaataataaatacagatgacaagcctttctcattcaactcagccctccacacttatttcagtgcttccataactggcgtttctgtgaaaggtctaaaaggttgcaagactctcaataaggaccctgacccgaaaaatcctttggagggcaaagaagagagggaagaggtgacttttccaggattcgtcgactgcgtctaccttggtgcaccaagtgaactcatcctggacaatggattgggtgacaaaattgccattgcaaattcaaattggtcagatgcagtcttgtggaatcctcacttgcagatggaggcctgctacaaagattttgtctgtgtggaaaacgccaagattgaaatggtacaactggagccaaaacaatcttgggtggcagaacagaaaattgaactagtctgatgataatgtcttgcagcaactgcatcaagtagagtgagacgcaaatggcgctcccccagtgtcattcttcatggcacatgtcatcacaatagctatacatgtgatgttttctgttaaaaagaataaatgatgcaaatcatgaatttttttctagcagtctgatgtgtactgaattgcaaatgtacaatttgaactgcatggatctgttgaaataaagggagtgcccatttgatctttgacataaaaaaaaaaaaaagcttatgctactgaaatatgtttctccagttcgctggcaatgcattatgattttactcttaacattaatgcagtcgaggcatcaaatcaataatgttgtcagtcaggcctatttctcttaggcactgtttgtttagttggaattgaattccattctaataactataatttgtctataatttagacaaaactagttgagttaatatatttctctatgtaatatacttgtatattatcctaaatcatatgagatagataattataaactacatttatattatagagaagcaagtaaaagagtttgcaataagttgtatattagaaaagtagcatataaatctatataatcaatttccatttcttacatttcttaccccatgaatttaagatagacttatatataaactttgaaaagttatagaatgccacgttctaaaaattagtctacttcattagttagattctaattcctaaaaaaaatgcaaagaaatcgtgtcttaaggtatgttcctgctgttgtgtgttgattctaggtaataggataatatgataaaaaaatacaaaaaaatacttagggcactcacaaattcacaaagcagatgccaccatggttactacgtctatttattattatatctctatttctttctttaactttactatgtgccaatctaattattaaactttgctcatatggcgccgtgtttatccatcgaagaaagagaggaaaaagcaagaaatcgtttctaacatggaagcgntggcttcacttcgatcgaagccgaaggaaccagccaggtccgtgtncgttggggaaaaccacggcggtggtttccatcctggctcctaatcccctgccgccttcccttttctccatctcgccagttcgccaccgccatcctgtcacgcatgtgcatcactcagggtggtcatagtattgtgaaattgtgccgtatggcccgtggattgtaattggcccatattgatcggatataagtagtctgtaaattgggtgatgaaggcataccagacccataccaaactacttacctccacatacctgttcttcttgcttgctcaacccctttgcttccttcaacttttcggctatcttcttcgattccctggtactcctcgtaactcactcagcgcaggccaaatccgggccaaggaagtcccaattggtattggattcttccttcttgggcacttcccttgttgctgcggtgacagaagttctgaccgagtcgggtggttggcgtgatcgtcatgatgactccaggaaagcaaactcatgatgactcctggaaagcaaacgtcgcaggcgcgacaggtgatggcggccatgcaagacatggaatgccggctggtggattgttttcaacaggctttgaacaaactgcaagagacaactctaaaagacttgtcaatgaaggtggatcgggtgagcgacatccaagccaagttatcagagattgagaagcggcaaggtgagagcgacaaggttgctcagtatgtttctgccaaacttgacctatccatgaagattttggcacaagtttgtcaagattaggcacgtggagcctcaaccaaagcaatgggagttccacctcgacctcctcctcatttggtacgggattggtgggtacatctcctttgttaggaatgtgccatgctcaagtatcgaacactacaagacccattcatgtcatcattgaagatgaggagcctgtgttgggtggtgggaatcagggcgactagtttgataggaaacattggttgcctaaaatagactttcctcattttgatgacattgatgcaagagtctaggtggacaagtgtgaaacatattttttgttataccagattccagagtgattataggttcgtgttgtttctttacatttgttagggaagntgtatcaaatttataaagaagtggttgctgtctatgggtggcaacaatttagacaagctgtgttacatgagtttgaagtttatacacatgaggataaaatgttgcagttactcacattgaaacaaactagtactgctttggattataagtctcaatttgaatagttggtctatcatgtcaagttgtttgacaaatccataagcgagatattcttggttacccaatttgtgctgggacttattagcagtgcaccattccttttctgtaatgcatcattcccttcatgtaatggcgtgtgattgcatagataggatccagggctattatggtaggagatgccttgattgatgtagggatcaatcaacatcagacacattaggaaggtctgatccttgattgattgaggagatcactcctggcactatttctataagccataggagctcctccttcctatatattttgtanccagttggttccatattcactcaatacattgcctacacaacacatcttctctcatggtatacatgtggtattacagaacaatgctagagtattccatgtacctgattcacttccaccatccagatcttatgaccatgtcatatccctcattctaggctccacacctgtcaacattaggccctatagatattctcctttgcaaaaggatgaaattgagagataagtgaatgacatgttggctgcgggattatcaccaggagcatgagtccctttacatcacctgtgcttttggtgaagaaaaaggatggcagttggcagttttgtgttgattacagaaggttaaatgatcttactatcaaaaacaaatttccaatggctgtgatcgatgaatttctagatgagttggcaagaaaagaggtgaaaggagggcattgcttggtggcttggggaaaagtatgtcgtccgctgcagcttggaggtctaggtattgctagccttcctgagctctgctgggcccttcgcatgcgatggctttggttgcaaaaaactgacccaagacgcccttggtctagcctgtccattcaagttcctagcatggcc

SEQ ID NO: 8458 - DNA, 1815 bp, Zea mays
cattgggtccctcgacgccggccggagctgccgtcgtcgcgccggcctcgatacgttcccgggaagtcggaggcgccgcgctcgtcacgccgccggctccgacgagatggaggatggcgtatctacttatactgtggatgaggcacttgtgtccatggggtttgggaaattccatgcattcgtgcttgcatactctgggatggctaaaatctctgaagcaatggagatgatgcttttgtcatttgttgggcaatcagttcaagctgagtgggggctttctgcacatgaagaaagcctcataacaagtgttgtctttgtggggatgcttgtaggagcatatgcttggggcatagtttcagataactatggaagaagggttgggttcaacttcacagctattgttactggaggagctggccttcttagcgcttttgctccaaattacttatctttgattgtactgagatttatggtcggtgttggactgggtggtgggccagttttaggttcttggttcctagagttcatccctgctcctaaccgaggaacatggatggttatgttctcagcattttggactgttggcacaataatggaagcttctcttgcttgggccgttatgccagcttttggctggaggtggctgctggcactctcatcattgccatcgtttgccctgctactcttctacccagtgacacttgagtcaccaagatacctatgcatgaagggtagaatagctgaagcagttcatgttctggaaacaatgtcacgcgtgaactgtgtttctctcccctctggccgacttgtctctggccatcgggtggaacttcatgatatcggggattcttcagaaacggcacagttggtgacatctaataagaataacactgctgatcgtggtagcaaatccgagattggaggcctcagtgccatcttaaagcttctatctccaaacttaatcagatcgactcttctactctggactgtctttcttggtcatgcctttctgtactatggtcttgttctactcacatcagaactaaatcatggaaataggatctgtggatcagaagagggggcagaagtgacaacaacagcccacatacatgatgagaatctctacagaaatgtatttataacaagctttggagaggtccctggtcttctcctgtcggctgccattgttgacatgatcgggcgcaagctctcgatgtcttccatgctttacatcagttgcctgtgcatatctccgcttatgttcgcccagacggaatcgctgacgaccatctttttgttctgtgcccgggtttgcatctctgcaagcttcactgttctgcacatctacgcccctgagatatacccaactgctgttagggccacgggtgtcgggtttgcaagctcgattgctcgctttggtggaatcctgtgccctctcgtggccgtcggcctggtgcacgcgtgccaccagatggcagctatcctgatattcatcacggtgatgctggcttcaggcatcgccgtgtcatacttccccctggaaacaagcggccgaaagctgagcgaccacgtcgccgccgcgtaagagctgattaattgaagaactgactttttgagagggatacaccaatacagaatcaaggcccaaggggccattattttttttgttcagttgttgacaaaggatacagtgggaaagaaagtgcaaaggaggcactagattgttacgttattatactgttgcttctcaatagaaatctacagattcactatatgattaaaaaaataaaaagtgccgccgccgcgaccacgcta

SEQ ID NO: 8459 - DNA, 3260 bp, Zea mays
  misc_feature (2528)..(2528): n is a, c, g, or t
ttccctcatttgaattatcatcctctaatctcagtatgcttgttgtcaggttaattcctttggcaatattgtatatgatgaatatgttcgcgccgtggagcgaattgtggactaccggacatggattagtgggattagacctaagcacatgaacaaaggtagatagatacatcactacattatgggtcattcattatatggtattttgttgctgtcaagggtggtgacctttgtgggttatgcaactatcttatgtcactgtagccaaagaattctgggctgtgcagaaggaagtagctgagctgattaaaggaagaattcttgttggtcatgcactgcacaatgacctcaaggttggtggctttaactcctttctgtatacaccctgtgtgtgttcttgtgtaatttaattagtattttccaggtgctgctactaagccacccaaagaaggacatcagggatacatcagaatatgaggttttcagaaggttagatggtctgggcatctgctgtgacatgattattcttgtgattacccaaaactgtattgacatgtgaatttcaattcactagggagagaaagaggcgatcattgaaggatcttgctgctgaagtccttggtgctaaaatacaacagaatgaacactgccccgtacgctctacattatatgcatgatttgtgttgtgttgttcttaatactttctgtactcttacagatcgaggatgcgagagctgcgatgctctttttcttcttgctcttgtttgcttgggagaagaacatgaaggaacagttcagattcaaaaagaagctcaagaagcgaggcaagaagaaaactactgagtccaatgggaatgatcccaatgtccccactgttcttctatgaagataaagaagtaacaaagggagttcttgtcctttttttggaaacaatatctgtaatgaaatttttgtagttcaacattaatgaaaattcaggttctgcaatgattgtctcaagtgaaaaaggtaacaggtgacaagaccgggttgctgagcattgggttctgcggactggtctgctgtctcgtagtcgtggcgatggttggcgtgagagcttgccgtttcctaactgtgaattggtgttggtgcaggggcagggagttggtgtccagcatgtgcaggatgagcaccatgagcacggagcaggcgaacatgggtatgggcccgaagacccacatgagcagcgtggtggccaggtagagcgcccggaggcccatggaccagaagttgccgccccggatgacggcgtgctgcacgtaggtcgccggcacgtcggagtcgagggtggtgacgaggaagctggcctgcacgtagtacctggcggagtggatgaagcaggtgaaggaggcgaggaagcagacgaggagggagatgtacttgacggtggccgtggactggctgcggtcgccgtagacgagctccgtcatgaacatcttggtggtgctgctgacccaggcgccgatgagggagcccagcgcgatggacagcgacgccaggttggtggacgccgagatgttgctggagatgacgctcagcgccagccccgtctcgtcgggggtcgcctgcaccatgcgccgcacccaggcgagcttgttgtggttctcgtagccgatcacggtcgtggcgggatgccggagaatgcggtagaggagtaggaggtggtagctcagcatcaccaccagcccgcatggcaccagcaccaggtccagggaccccttctccagctgcatcgtctcgtctcgtctctcttcaggctttctgctccctagctactaggcttcatttgctattgctttagcatttcgatgctatttcttggttggagttggagttgatctgtgcagactgaactgccctcatggcttgtcccggccgcctccaggtcccttgctagttacagtggggccagctagcaatgatcatgatcttgcttatgagtcttgctcaggagttgtacgcgtagccgtgcggtaccgatcgatggtgtggctagcttgtgtcttgggggcaaagactgcgagcacgcacggcaagcaaaacttgtgagcttgcttccaagaaaggcctggagatcttaaaaaccaataagatttcattttttgtcttgaaggctcctgtatataataccaaagcgtggatctgtttcatacgttgcggccgcaatctgcagttctgagtggccaccgttctaatgacattacaatacaacaacgtgaaaaataaacgatgttgtctcctagtgtttccgggttcagcaggccaccaacccggcaacccgttacgtcgccccctgtgctgtgtgtcagtgtgtgtaccaccatgtgtttgcttgcactcaacaggcttcaacctatcttactagtacactgtacatcatataattgactccaccagaattactcgaatttattatctttctgactacagttccactgtttacttgcccgtgtacctgctaattacaattattttcatgatttcataanagttgaagacacggatcgggtgattaaaaaaacgcgaatccagaatataacgaagaattcatcctcgctggttcagaaccctcaatcgacattttttaatttatactaggtgagggcgcctagagagagtgaataggtgatccgacaaaattaacactaaaaacacaaacttggtctaaaaatgaagttagtgcaaactaaaaccaagtttgagtaaagagaagatgaaaacaagtactcttcacttgattgctctttcaagatatagaatagattaagagcaatattacaagtgaatttgagagacttaggaagagggagaaaaatcacaagcaaataagcacacaagacacaatgtttttcacatggttcagtcaggcctaaaatgatttcctactccacgttgtggtgtcccaatagacaagtgttgcactcaaccactctcaagtgatccaaagatcgaacttgagtgccatagttgaaagttccctttatccgagaacaggacctggatgtcacataaaggggggtgaataggagagtaaaaaatattactttaaaaaactggaagttcttactctactcgaagacttgatcgtagtggaatgaaagacccttcgaacagatcgcagcagaattgaagttcctgtctcaaaataccctgcacttcatagacaacttatgccacaaataagtattgattgcaagtataaaagtaataaagacagagag

SEQ ID NO: 8460 - DNA, 4624 bp, Zea mays
gtcgacctgcagtggtgtggtgtcctgttgacagtgaaaggagcacaagacaacactcaggcactcagctgattgatgagctagcattgtatatacagtacaggtcggacgcgtgggcaagcgcgcgcgcacacagagagagagagagagagagagagagagacaagacaacagcaacagatagaccgggccaagttcgtgagtccatcgtgtacatacggccgagtggcgacgccgtcgtcttcaccacgcacgccgcgcctcttccatagtctcgctcgcctccattaattccaatcctctctcctccgctagcgctccaccagcacgcaccggcagatgaagaacatggcgtctacgacggtacggtgatcaccttcatcatcacatcactcgttcatcgcccgccggcccgccggttgttggtaggccagggtcagccactcagccgagccagccatgaagctcgtcgtcgagatctccgacgcagccgacctcgcccccaaggacggcaccgcctcctgcaacccctacgtagaggtggacttcgacgaccagcgccagcgcaccgccaccaagcccgccgaccgctccccgtactggaaccagacgctggtcttcgacgtccgcgaccccgcgcgcttcccttccctccccatcgacgtctccgtcttccacgaccgacgcctccaggaccacaacgccctccgcccacagaccttcctcggccgcgtccgcatcaacggcgcctccgtcgcgccgtcgccacaggaggcggtcctgcagaggtacccgctcgagaaacggagcttcttctcacgcgtctcgggcgacatcgcgatcaggatctacctcgtcggagatgatgtcaataatgaaagcgtacaggttcctgctcctcccaaccaccaccaccacccgcagcagcagcagcagcagcaggagtcggtcgcggctgctgccgccaccggagatcccgaaaggatggtcaggtccgccttcgcaccacagcagccgtcggcggttgagcagccagcggcagctgggaacggcggggatgagcacgaggcacgccctcctcgcatcttccgctccgtgccagcagccgagccccgccgcgcgacgctccacgctgtggccgcgcctcctcccccgcccggccagacggtcgtcatgcccaaacccgctgcctccgcccctcccggccccgccttcggcctggtcgagaccaagccgcctctgccggccaagatgggcccgcgcgcggccgccgccgccgccgccaagatcgcgtccacgtacgacatggtggagccgatgacgtacctgtacgtgagcgtggtgaaggcgcgcgacctccccaacatggacgtgaccggcgcgctggacccctacgtggaggtgaagctgggcaacttcaagggcgtgaccaagcacctggacaagaatcccaacccggtgtggcgccagaccttcgccttctcccgggagcacctgcagtccaacctgctggaggtggccatcaaggacaaggacatgatcaaggacgacttcgtcggccgcgtcctcttcgacatgaccgacatcccgcagcgcgtgccccccgacagcccgctcgcgccgcagtggtaccgcctcgccgaccgctccggcgagaagctgcggcacggcgagatcatgctggcggtgtggatcggcacgcaggccgacgaggcgttcccggaagcctggcactcggacgcacactcgctgcccttcgagggcctctccaacaccaggtccaaggtctactactcgcccaagctcgcctacctcaaggtggtggccatcgcggcgcaggacgtggtccccgccggctcagagaagggccgcccgctggcgcccgtcatcgccaagatccagctcggctggcaggtccgccggacgcgtccggggcagccgcagggctccgccaaccccgtgtggaacgaggagttcatgttcgtggcggcagatccgttcgacgagccgctcgtggtgacggtggaggagcgcgtggcggcggggcgcgacgagcccgtgggccgggtgatcatccccgtccagttgccgtcgtacgtgccccgcaacgacgtggccaagtcggtggaggccaagtggttcaacctgtcccgcgcgctgacggcggacgaggccgcggcgggcgtgaccgccgccaaggcgctgtcggagaagacaaccttctccagcaagatccacctgcggctgagcctggagacggcgtaccacgtgctggacgagtcgacgcactacagcagcgacctgcagccgtcggccaagaagctgcgcaagtcccctatcggcatcctggagttgggcatcctgagcgcgcggaacctggtgcccatgaaggccaaggaagggcggctgacggacccctactgcgtggccaagtacgggtccaagtgggtgcgcaccaggacgctgctcaacacgctggcgccgcagtggaacgagcagtacacctgggaggtgttcgacccctgcaccatcgtcaccgtcgccgtgttcgacaacgggtacgtcctcggcggcggcgagggcagcaaggaccagaggatcggcaaggtgcgcgtgcggctatcgacgctggagatcgaccgcgtgtacacccacttctacccgctgatgacgctgacgcccggcgggctgaagaagaccggcgagctgcacctggcggtgcggttcacctgcacggcgtgggccaacatgctgggcatgtacggcaagccgctgctgccgaagatgcactacagccaccccatctccgtgctgcagctggactacctccggttccaggcgatgcagatggtggcggcgcggctggggcgcgctgagccgccgctgcggcgggaggtggtggagtacatgctggacgtggactcgcacatgttcagcctgcggcggagcaaggccaacttctaccggatcacctccctcttctcgggcgccgtggcggtggcgaagtggatggagggcatctgcaagtggaagaacccgctgacgacggtgctggtgcacgtgctgttcctgatcctggtgtgctacccggagctgatcctgcccaccgtgttcctgtacttgttcatgatcgggatgtggaactaccggcggcggccgcggcagccgccgcacatggacacggtgctgtcgcacgcggagtccgggctggtgcacccggacgagctggacgaggagttcgacacgttcccgacgagcaagcccggggacgtggtgcggatgcgctacgaccggctgcgcagcgtggccgggcgcgtgcagacggtggtgggcgacctggccacgcagggggagagagcgcaggcgctgctgagctggagggacccgagggcgacggccatcttcatcatgctgtcgctggtggtggccgtggtgctgtacgtgacgcccttccaggtggtggccgtggtgctggggctgtacctgctgcgccatccgcgcttccggagcaagcagccgtcggtgccattcaacttctacaagaggcttccggccaagtccgacatgctgctctagctgcgctgcgctgcgctgctctctgccctgcctgttggaattggaacaccaagcatgttccttagtttcttttaatttgctcccaattaattaaattatatattaccacgcacgaatctcagataaataaatgtaaatccctaccagtactactcctacataggagttgagttggatcagcagataccttacctagctacctttttgtgtgtcagaagagaagagaagagtacagtggtacagtactactactctgaataatatgaggaacagaattttcattcagaagcttccttctcttgctgtctctgattaagcctgtgcataatcctcttcttgttattataataaacctgtgcataatccagattatatatagcatgtcatggcgtttctgcagttcggagtcttgtaatgaactctcatgtcctatttcataatgaaatagggggttaatcccctttgaaaaaaaatccagattatatataatggtcaagctatgatccaaagaggccttcatgcatactagtaaaccatccgacccttcgtattaatagatagatagatagatactgtatgaatcatccatgggactagtcaatatatatgatccacaacaaaagctcatccgtcatgtggggatcgagaccaattaattaaaaggtggttgatacattcttttcatctccttttctttcatcaatcatgtgatgttgcctgtgcctacaggggagggaattgcaacttgcaagtcatctatatgaacatggagtagcggtagttgttgatgcatcatccatccacccttttggtgcatgccctatcgtttttccctccatgatacgaatataatacgatactgtacaagaataaagctttgcattgaaggtaaaaactgccattgtatattcttttttctttctttcttctattttgtttttgcctgtaggccatctactacagtatatgcatctcctcctgcaagtccaatgtgattgatgtggcatggaccttgctttctttatttgccgcctttcaggggtaccga

SEQ ID NO: 8461 - DNA, 1662 bp, Zea mays
  misc_feature (63)..(63): n is a, c, g, or t
  misc_feature (67)..(70): n is a, c, g, or t
  misc_feature (91)..(92): n is a, c, g, or t
  misc_feature (470)..(470): n is a, c, g, or t
agacccgcacacacacagaccacaccttctcgccccctcgcaagtcgcagcagggacagcggnagcnnnnccaccgcaccaccacctcgtnngccacccgcaatggggaacagcatcgggggcaagcgcaagagcgccaaggtgatgcagctggaacggcacctccttccgcgtgaagcccccggcggcggcggcggccgacgtgctgcgggaccacccgggcttccagctgctcgagtcggaggaggtcaagctcctgggcgcccgcgcgcgcccgctggcccccgacgcgccgctccgccgcggccggctctacttcctcgtcgcgctcccgcgccgcgcgcccgcgggggggcccatgcgccgcgcctggtcgggcaacctcaacgtcggcgcccgcgagcggctcgagtcgctcaagctcgcgcgccgctccacctccgacctctcctcgctccccgcccccgccnacgcctccgcgtcggcccccgcctccccgctccccggcggcggcggcgccacgcccgtgcgcctcaagatgcgcctcccccgggcgcaggtggagaagctcatgggcgggagcaaggtaccccgccaaggccgccgccaagatcatggagctctgcggcgcggccgtggcgggcgacgcgcacgccagcgcccgggccaccccggaccgcccgcggcccgggatcctgcgcagccctaggttcgccaagacaccggagtggggcgcccggttcatgctgccgtcgccggccgccggcgccggccaagacgccgccgcagcggtggcccacgctgccacgcaccaacgagaaaaaggcgcggttcgtagagttgccggacgagctgatagcgtgacctgggcttcgccgaagcgagttaacactcccttttttttccttcttcttcaatgtactgtcgcaaagcatgtttggtgatcgtgaggccaggagacgaggaattgtaaacttatctccaggcgggcgcgctgtactccttcagccgctcatatccgagcgaaacacaaagtatggtttgaagatgagaagccgcccgatggcttccgattcaccttgctccagtgatctgactgactgacaccgtgttacttataccgtcagtatgttttccttccgccttcttctcgaacctctctctctctctctctctctctgattgtgtgttccttcctgttgtctcaccagtcaccactacggtgcgttatgtgctacattgccaaggccaattattccagtcagctctggttgccattgggggcagcttcgtcgtaggaagaggcgcgtgtgcatatgcatctctgcatgattttgaaaacgaaaaaaaaaggatatgtataacagccgctctacgctgaatggttccttgagagttagtaagctggtggaccgtctgttggagaatcattgggaggcgttgctcaactgaattcctcttgcacatgcaagcagcaagagcaagagcatcgtctgcacaagtcgtgcggtctcttctcgccacaccgaccatgcggtgcgggcttggataaaagatatattgccgccagtcacctgtaaaccttcacatgacaagcagtatgatctgaccttagacctacaacccgtaggagcgtgtacagtgtactatatatacaatgcg

SEQ ID NO: 8462 - DNA, 2441 bp, Zea mays
gttcattagatattagataaaaaaaatttaaaaaactttgactgtatctggcttccctgcagctctgaaaacaactccattttctaagaaaaagaaacatcgcgccttgcaaaaatcaagtataaacttacggtatataattagccactaatgcatgcatggttgggcaaaaacacgcaaaggagacttgctggaactagtgatgaggcgtgctaaaagcatgcaatacacacttgctagtgtcgtagtagtagcatagacgacgttgcaaccacgcactgacggctctcgcccagcttccctgtccgttgaacgccttttaactgtgtggaaaactgacccctcttcttggttccgattcttcgcacgcatggaccatggggagaatttactacgaccaccggggcgggccgggccgggagagcgcgctgggctagccggcggcggcggcgtgcgtggccgctcaggagtgggcgcgccgccgcgctagctagtggggcggcaccgccgcaaagaccgtgcctcgtggccgtcgccgtcgagaccgcgacggaggacgtacgcacgcggtcgatcgtgccaatacacggcggccgcccggctgtggctgtggctctgggcggccaccgccatatctcgcgtcgcgcgggcgcacgcgttgacacgacgaacactgtggagtgtggaccgtgggctgcttatctgcaaaccttgggccaagtgggtgatggcccatgcattattgccggtcggcaagggtaccacacccggttccggcccgtgcaggggcgagtctagaccgggaagtatcggtaaggacactggccttttcttctttttttaggaggatgcaagttgttccagcttcaacttgaccagtgacagggcatcggtccaaaattattgcaaataagagatacagatagatatcgggtggccccccctgtaacacgcatgcagtcgcaatggctcttgaaacattatgacaaggagtatagtttgatatatagaaaagaagaagctaaaattggcatgcttcaagttcaagcagttctaattcccaaccgctcaaaacggtgtccctcaagcgagcagcgactcctgtccgctcgaactcgcctcttttccgctgcaacgcttctacacagccatatctacatatatatgcacgacggaaatccaggccggccggtcgtctgactcccatcgcctttgaaagaagctagcatcaggttcgacgtacaaggggcacaaataatctatctaccagtgcgtgtgctcatccgtgcacgtacgccggcaatggtgtcctccgcccgtgcgctcatcggcctcctcgtcgccgcggcctccctcgccgtcgcgctctcgggtacgtatatatatagcacgcacgtgcagtgcatggctgcatgcgttgccggccggattagtaaaatgcatgcatgaacggcagatggcggcgggatggcggcgccggtgtacgggtacgcggcggggagccccaacgggccggagaactgggggaagctgagccccgcgtacaagctgtgcggggaggggaagcagcagtcgccgatcgacatcgtcaccaagcaggccgtccccgccgccaccctcgacaccctcaaccgcacctacggcgccaccaacgccacgctcatcaacgacggccacgacatcacggtacgtagctagtaggttccgaacttgcgatgagagagagcatctatatatgtgcatgtgcaatgtatatgcagctggcgctcgagggcaaggttgggacggtgacggtgaacggcaaggcgtacagcttcgagaagctgcactggcactcgccctccgaccacaccatcaacggccagaggttcccgctggagctgcacctggtccacaggagcgccgacggcgcgctggcggtcatcgggatcctctaccagctgggcgccccggactccttctactaccagctgaagcggcagctgggcgagatggcccaggaccggtgcgacttcgccgaggaggaggagtcgcgggtggaggccggcctcatccacctgcgctcgctgcagaagcgcaccggcagctacttccgctacacgggctccctcaccgtgccgccatgcaccgagaacgtcgtctggagcgtcctcggcaaggtgcgccagatcagccaggaccagctgcagctgctcaaggcgccgctgcccgggagcgacgcgcgccccacgcagccgctcaacggcaggaccgtccagttctacaacccgcccaacagcaccatctccttccagatctaacactaaaaagtactttggaatctttaatatagcgtaactctgtttatgataaatcaatattctatcatttgtattcgtcccaaggttcatcaccaaaaaaaaaaaacaaaaacgaaaaaaaaaaaaaaaaaatttgcggcc

SEQ ID NO: 8463 - DNA, 1069 bp, Zea mays
gactactaagggcgattgggtacatcgaggccggccgccgacaacaacggacacacacatcgtctatcagtgctcatccaacaatccgtgcgcgaccaaggcaataatggtgtcgtcctcccgtgctgtcgtcgtcgtcgtcggcctcctcgtcgccgcgtcctccctcgccgtcgctgcctccgatggcggtgggccgacgtacgggtacacggcggggagccccgacgggccggagaactggggcaagctgagccccgcgtacaagctgtgcgggcaggggaagcagcagtccccgatcgacatcgtcaccaagcaggccgtccccaacgccaacctcgacaccctcaaccgcacctacgccgccaccgccgccacgctcatcaacgacggccacgacatcacgatgacgttcgagggcaaggtcgggacggtaatggtgaacggcaaggcgtacagcttcgagaagatgcactggcactcgccgtccgaccacaccatcaacggccagaggttcccgctggagctgcacctggtccacaggagcgccgacggcgcgctggccgtcatcgggatcctctaccagctgggcgccccggactccttctactaccagctgaagcggcagctgggcgagatggccaaggaccggtgcagcttcggcgaggaggagtcgcacgagggcgtcgccctcatccacctgcgctcgctgcagaagcgcaccggcagctacttccggtacacgggctccctcaccgtgccgccctgcaccgagaacgtcgtctggagcgtcctcggcaaggtgcggcagatcagcaaggagcagctgcagctgctcaaggcgccgctgcccgggaacgacgcacgccccacgcagccgctcaacggcaggaccgtccagttctacaacccgcccaacagcaccgtctccttccatatgtaatgtaatgtaatttaatatgattaacgagatgtatatgtcgttcgtgttatgaagtaaatatatatgtgcatgcattattattacctatatattatttggtgcagtatttgtggcagtatagtgcta

SEQ ID NO: 8464 - DNA, 1140 bp, Zea mays
gcctttgaaagaagctagcatcagggtcgacgtccacgcggctactaataatctaccagtgcgtgtgctcatccgtgcacgccggcaatggtgtcctccgcccgtgcgctcatcggcctcctcgtcgccgcggcctccctcgccgtcgcgctctcggatggcggcgggatggcggcgccggtgtacgggtacgcggcggggagccccaacgggccggagaactgggggaagctgagccccgcgtacaagctgtgcggggaggggaagcagcagtcgccgatcgacatcgtcaccaagcaggccgtccccgccgccaccctcgacaccctcaaccgcacctacggcgccaccaacgccacgctcatcaacgacggccacgacatcacgctggcgctcgagggcaaggttgggacggtgacggtgaacggcaaggcgtacagcttcgagaagctgcactggcactcgccctccgaccacaccatcaacggccagaggttcccgctggagctgcacctggtccacaggagcgccgacggcgcgctggcggtcatcgggatcctctaccagctgggcgccccggactccttctactaccagctgaagcggcagctgggcgagatggcccaggaccggtgcgacttcgccgaggaggaggagtcgcgggtggaggccggcctcatccacctgcgctcgctgcagaagcgcaccggcagctacttccgctacacgggctccctcaccgtgccgccatgcaccgagaacgtcgtctggagcgtcctcggcaaggtgcgccagatcagccaggaccagctgcagctgctcaaggcgccgctgcccgggagcgacgcgcgccccacgcagccgctcaacggcaggaccgtccagttctacaacccgcccaacagcaccatctccttccagatctaacactaaaaagtactttggaatctttaatatagcgtaactctgtttatgataaatcaatattctatcatttgtattcgttccaacgtattcgatcgagtcagtcatgcgtgcctaataggccaggatttaacacaccgtagacccgataaaatgggtccgatttaacccctaagatacctaacccgttattcaaccacgtctcaccgaataacc

SEQ ID NO: 8465 - DNA, 3532 bp, Zea mays
aattcggcacgaggcttaaacccgcgaagtcaaagcattccgccgctcctctcctcccccgtcggcacgagatccttgcccgaacaaaaaccagaagatgggcgaggggagggggagacgagatctcactccccgcttcctctccacctctcaaatggcgccaccgagcgctaaccgtagccaccagcagctcgtcgtcctacccgtcctgctcctactcctgatccggatccccgcatccgcggcagcggcggcagatacctccctgtccaccttatcctactcccaccactgccccaacctcccgtccgcgctcgacctgcccggcggcgaagtttcggcgctcgggcccgacgcccatgtccccgtccccgaggtctccaccgggtacttcgtcggcggggaccgcatcttcggccccgacccctcctcccagccgcgctccttctcgttgctcccctcctctgtcgcccgcaccaccaacgcctcgctcctccacgtctccgccactctcaccgtctccggcgggcggcgcccgttccgcgaccgcggcggccggaacctcttcgagtacgacggccgcgcgcgccacttccgcccgcgcctcccgcgcttcacggggcggcgcggctccatcaccttcggcctggagggctactactccaccgggtccggggacctctgcatggtcggcaccgggtccgggcgcgccgccgacggctcgcccgtgcacttcctccccgtcgtgctccgccttggctttcccagccccgccaacgtgacgcggcccttcgtcaccggtcgcctcgagaacgtcgacaccatcagccccatcgagcccatctcactcgtcgcctacacccaggagggctacgcgtacggggagagcgcctcctgcccgccgccgcctgcggggaggcttgatgcgctccaggtgttcgagaataggaatttctcgtgcgcccatctcagttccatgctcaaatcgccgttcaggttggactacccgagtggcagcgagtcgaccgcatcttcactcgggattcaccaaagctacatgtatgtcaaccggatgcactgcaacgatgacggcgctgtccgtgcttatgtggcgttcactaaccagacagagttatcgaggtactacttcatgctgggcgagaaggccgtcgtggtggatggattctgggatcagaagagcagccggctttgcctcaaagggtgtcacgtggtgaagtcggggccatcccgtgcagatttggcagtaggtgagtgtggaattgggatgagcttctggttcccggcagtgtggtcgttacagcaacggagcttttctgctggtctggtctggaatgcaagtctgaaaagtggtgaggccatcgctgccggttctagtgcaatcactcccaactataggggcaatctttctggtttgaagtataattacacaaaggtggacgaggctatgaaatactacgagaaatctggattgaacaagaacaggaaagggaagttcccagatagcaattcataccaggacttggtgttccgttttttcgtgaagagagggggcggctctggatatgcctcacctgtcacaattgggtcaatgttgtttgatggtaactctttggtggttcaagatcccttttctcgccatgtcacagccgagatgaagcaaaggctgcttaatgtcagctatgatatctactatgttgggaattggtctctagaatcattccatcgtcgacatatctctgccgagggtgtttatgatactaagacaggttccctttgcatgatcgcttgtcgcgagcttaatgtctcgtcagattgtgaaatcctggtgactgctcagttttcttctttggatgcaaaagttgcacaacatgtgaaaggggcgatcaaaagcttgaggaagaagactgaccctcttttctttgaaatgctggacattgcttcatatgggatgtacgtagagcaagtggatgcatcaatctggagaatggacatagaaagcaccatgaccttgatctctatgacactggcatgcgtcttcattgctgtgcagctatttcatgtcaacaaagtccctgaagcacttcccgccatgtcgatcaccatgctggtcgttctggctttgggttacatgatccctctcgtgctgaactttgacgctctcttcaagaacagcaacaagcagaccgttccactctcaggtggcggatggcttgaggtgaacgaagtcatggtgcggatcattaccatggtaacctttctgctgcagctgcggcttcttcagcaggcctggtccgcacggtccgtggatgcaagcaaagccgagtcatgggctgccgagaagaaagtgctctggatatgcctgccactgtacatcattggcggagctattacttgggttgttcacatgaggtcaaaccacagccgaagaatgctaaggcaggttgtccacttgaagccagttgagcagcaagcgttctgggaggaccttgtgtcttattgtggactgatactcgatgggttcctgctccctcaagtgatcctaaacgtgttctcagactccaaagttagagccctctccccagggttctacatcggaagcaccttgatacgtgtcctgcctcatgtgtacgatgtgttcaggagacagcactttgttcccagcctgagaccatcttacatgtatgcaggccctcgtgacgacctcttcagcctcgcttgggacatcgtcataccttgcggagcactgctactgtcggcgctcctcttcttccagcagtggcgcggaggagctttcttcctctgttcgaagaacaggaggacgagagagtacgaaatggtttccatggccagctcttaagaaaaatcgagtggatatgaaatgcttttatagccggttcttgacatcgttgttgcaagggaaatgtagaggaggtttacctatagacttttaaaaaaatagctattccatttttcggatccatgtttctttttgcaaatgtgcttggttgcagcgaaaaccaccgtgcatgtatacgaaagacgatactaaacaagttgggcaaattattggggttttgatttaggattccttgttaccttttgggtgtcgtttggttcacgaaatgtaacttaaatggtaatggtaatgattcacactcgaataccggtgtaacaagtatgaataagctgatatccatttttagtgtggtatcgattatcgttagacttaaacaaacataatatgatgggttcacgaaatgtaacttaaatggtaatagtaatgattcacaatcgaataccggtgtaacaagtatgaataagctgatatccatttttagtgtggtatcgattatcattagacttaaacaaacataatatgacgttatcggttacctattatgtcactaatatttaaatcaaatgacaccttactctgttgctaaccggtccctctttcagtttcagggatggtaatttgcctcgtccttatgtgtgtcagggggatcctcta

SEQ ID NO: 8466 - DNA, 8882 bp, Zea mays
gccaattggcagaaatggagaagatccaggtttttcatcccgcaaaaagcgcattgaggatccagttcgcacaaatgttgaagatgcaggcttctcatctacgaaaaggctgtctgagaagcccatcagtgtcaacggtcacgagcctcgtgaccattgtcatcaggagtcatctaaggaaccgagttgcggagttgagcaggatggtcaaggttactcatgcgatgaagaggctgtgaaaaagccagtttgtatggatagccacgatgcccaaggttcagatatctctgctgccactattgcttctgtgggagatggctctaatggtttaagcatgtcacagcctaatgccactgaacctactggttgtcctcttaccaatggggttatagacaaagacatcagctctccactagatgaaataagatctgagaagactgacgatattttggccactccttgcttcttgccggctgtgcccctcgaccaccttgtctactgctgatccattagttttaaggcctaattgcttatgcttttgtgcattggtgatcacatgtagctattttagactggaatttggtttataactatgtcacaggagtggatcaattagcaaaatggtgatatgaataaatgtgattgaccatcaaaatacaaaactagatgtctagaggggttatggtagtatatgacatatacacttgtaatacacatttgatgttcatttattttcaggccctttttcaagaaaactgaattgttaaagtattaatagagctgcatgtggtagggtgatgtctgatatataaccaatattcacttttacaaggcatgttttaatctgaaaacatcaggctacgagttttgaccaaaagtcagtccaatatacgcattgcatgttttagtgcacaaaagttgtggcctggtcgcccccgtgctactaatgtgatgcttattttgtagcaattggctatatattgtaagataacttatgataaaaattctttcgaagacttcgttctaagatacaccctaaagtaatgcagagtgatttgtctaatggaaactcggtcatttgatatgtttactgctgtgcagctaaatgctttgaaaggaaattcagattcactttgtttttgatggtttctaattatttttcctaatttaccctgttttcagccaaacctagctacaagccaattgtggtagacgaaacgagacggaaaacttatgatgcatctgaagaacagcctctgatgaaatctgatccagtttttgatgttttctctgcggaaccaaaagagctcgtgaatgtgggttaatgcatctatgattcaatcaaatactgacctatctgtgattattggtccattttttcttacttagattagctcactggctgagtgtgctttgcaggttgggctcgatgctgaacactcatatgcatatgtaaggagtctggctcgttttgctggttcgcttggtactcaaggctggagaattgcttctgaccgcattcggcaagcattacctgctgatgtaaactatggtcgtggttgggttggagaatatgagcctccattaccgtctattcttgttgtgaatgatcaacctagatacccgaagagctctgagacaaatagacgaaggaatgctcctctgcctagggataatgaaaggttcagatcaacagaaactaataatccaaaggatatgagacgggtagccacttgcaataatgtagttggagtggctggaccactagagagtccagaaattaagccaagattatttggtgttaccactgagcctcaacacaggagcacagacgcgttatcactgcacgagaaccacagagtgtctggtaatgtcgcaaagaccaaaagaacaacgaatgagcaaacaagaaaaggcaattcatcttctagtgcccgacctcttgaaatgcagctacagaaaggagcttcttctggcgcgcttgatatccctgccccaaataaaatggctggccagcctagaccgtttttgcaaccaccagaatcaactagagctcagcaaatgaaaaatattgactcatcaaaaagcaaaattccaattgaaatggcaccacagcaagttgagtgtgcaaaagatgctgattctagtgtgcatgatactccttcctcaaatgggcagcctaaacacttcttccagtcacaagcagcagcttcctctggtgtgcatgatatgcattcctctaacgggcagtctaaacactaccaatcacaagcagcagcttcctctggtatgcatgctatgtcttcctctaatgggcatcctaaacactacttcaagtcacaaacagcaccttcgtcgggtgtgcatgatatgtcttcctccaatgggcagcctaaacattttttccaatcacaagcagtagcttctggtgtgcatgatatggcctcaaacgggcagtctaaacccttgttccagtcccaagaagcaactgtactacagcccaaaaatgaagcaacatgggtgtaccatggacgacctggtgatggaaaggttggaacatcaaaaaaaagcagaccatcgacaagtattgggttcatcactaaaaatcaatcaataaatgctgcaaaatttgccatgaatttgaatggccaaagtattgtcagtgaccatacaaaatcagcaggcgcaaccgctatgcctgcccaagcaaatataccaaacagaggtcttgatgctcctcggaacatagtctcagcatttccagctaatgttagggagaaccagagcattccatcagctccagtggctcaatcttggatctcgtttggtgctgctacagagaacaaaccaaccattgtcagcccagctttcgttgacaataattgtggctggaaaatgccatttgctaatgtccaaccttgtgatgataccaaattaagcgttgttcctcagttctttagacatcctgttcaggtagttagagagaactcggttcaaaacaaggggctggtaatatttccccagttggtgcagccagatttcgcaagatcacaagggcaaccacagtggcaggggctgtttccccacatgcaacagaagccaggcaaggatgtactccgcccggacttgaacatcgggttcccatctccaggttcaccaccagctcgacaatcgtccggcatcaatttggaagcacagcagccagacctcgctttgcagttatgatctgggaaaagacaatgaaaacttcatacggccaggccaggatttatgctataatctctaagcatgtgaaggcatgaggagctcaggtgcgaaacaaggcgagaacagcattgggacatccgggacatggatcggtgatgattgattgtgatgttgactttacatgccatatggcgtcatcgcaactcatcaactcatcgcgtcgatgtacgacgatatcagaaaatggatggatgaacactgcttgaaatgagatcatgtctacttgggggcattctgacaggagttaagaatccagcatttggggaaatgctttggtggcatgcatgtaggtagcacactagcatgcccatgatctgaaaacttggggcgcgcctctctgaccacgatacagctttcttcggtggaaattttggcaccagaatttagaatttagaatttagaatataagccgttcattcggtagtgtaggtcctgtggtcacccctatgtaatgtaatgcccataccaaaatgaatgttggctgtaaattgttctgtgttgaatagattgttagggtagggcagtggccagtggccttcacacctcttctgaatgaaattgcttcttttgttcatgatgtatgtagcaggaaaccaggaactgtggtctccgttcagttcaaatggcatgctgaatctaaagaggtcattaggtctcgtgaagatgcactggttcagtttgtccttgcattggattttttctagctttaagcatgatgccataagaatgagcaatgccatttccctctgaaagcataattttgctgataaacttatattcactggacgtaagtttgcttggaatgtatattggggtaatcgtattttcctctgaacagcagacatgggagtacaggttgaacgccggccggggattgctgcttacatttagtccacggtgaaaaaactcgtggacagggaaatagagggatctatgggaaaccttcttattatttaaaattaaatagcgagaagatttcttttttataaatctcctctattttaaataacaaggagatttcttcccatgaatctcttccaggaaaatgaaggggatctacgatggaatagcagtattttcatgctcaccaaatcaaccctaaaaactgacatgtgtagttatttttaagacgtagtgagtacagcaatgccataggtatcagacggtaaaatagctacaagtaccagacagcaaaaaaaaaagctaggtacaagtcaatcaatctcatatttaaacttatatattatcagtattaatatttattaggcataattatgaatatttttcataataaaactatttcaaaatatatgttatacagttttcaatgatctagtggaacttaataagcttgcattagtccaaactcaaaattatatatttttttgggactcaaagtagtacaaacagatcgtgctatacaagtacatcgaagtaatatcgtagaatcgagagactaaactaatgttataccaataacacgctacttgcaaaccggcaatagacaaagatcatgtgtttatgcatacaatagaaaagtgaaattctataaagccctgtgtacaagcattttacaccacaagcagagaaagaaatcaggttcctcagcggcggttgcctttgcctacagataacaaagagggtaatcagaaacaaccaacagcatagtgtccaaaccttattcccagcaggacctaggggccacgttaggggcagcctccccaagggaaatggaggatagcttctgggtaagtaactcaactaacgaattcgcatcgccattagcttgtatgttctgattcaaagccggaatattctccttggaatagtcctgcagccaccactgtcttagacttgcgcgtgcatgattcaggttcggcgacaagttgcagttgcagcagtgctccagcgttttggtcaatggatttgttctaaaagaaaacacagaaagatagtcagaagcacaccaatatagggcatttccacttactttgatagtaaagaagacactcctacaaattgaaatgcacgtacttcgggcttcacgacaactggactggacaggtgtatgcacgcttcaggtttgtccaccttaaaagcttctacttccatttgcacagcttcaagaggtgctgctataggttttaatacttgttgatgaaaggttggctgagggtttggtgtggcaggtagcaagcactggatctccatggattgcggttgcacctgtacatgcataataagataactaaaatcacattgatataggcattttgcaagggaaacaacattttaaaaaaatgcacatacagattcaggtctgaccacaactggatcagtcaggtttgtgcaagctagttcggccaccttaaaaggctctacttccaccataagagacagtggcgtcatcagcttacttttggaaacacagctttcctcatgaggtgctgctgtcaattttgattcctgttggccgtaggtagatggtgcggcattcagattcatgttctgagtaggtagacactggatatttgaaagttgtggttgcacttgtgcaccgatgttttggtcaatataattctcctgaaacatacatagcaagattgttagaagcactaataaagaaaccacatattgcaagttaaagagtatacaaaactgcacatacagcatcaaaataaccaatcttgggtgtgggtctccgaagccccgatggcttaaggccttttccctggttggttatttctgcagtagcttttaaattatctctagatgctgctgttccagaagaatgtccctctgtgacaataggaggcctaaactttggattcggatggcagtcattgctcttcctgagggagggggacagtgcattcaaattatcggatgtatgactcatcttccctacggtggaagcagttgaagccccagatatcacagagctcatgctgtccatggagctgctaggtgaaatgcttggtgatgcacggtcagcatggcccttagctgggatcctgttccctgatgatcttgagggtatagttttgctgatatcagattttgatgacggacgaacagggaccctctgagcaggtctattcttgatgcttagtgttgctgatttagttttggcttctggcttagtgtccatcaacatacaatgggaagaagttgctgctgatgtgaagaaacctgatttcaagattgaactggaatttgtacccctgccagatcgcaggacagctgaagtactggcagttttaccaactgcctgcctgttgacagcaccccctgaaagacaaaatacatattaggctacgtttatgttatattgttctatgcagggggtctcgatactaatgagtgaacaaaaatgcatgccaatttacacaccagtgctgtttcttttgtctgaagccctagaggtgacagttgtattagttgatgatctcatcatagcaactcttggcaaagccctaggaggctttgaggatatctttgcttctgcagctcctgttaaattcttcttaagaaaaaatgcaaatatgaagctgaaatcagaatatcgcacagcacagaactttttaattaaaaagatcaagcaaaaaaataggtcgtgcatccacagacatggtgagtaattaaaaagatcaagaagaaatactaatcactgggattttgattgcatgttcaggtaagtaattcaaatataaatttagacaaggggatactttacatattagacaaggcagactgaagcttagctgggtttacttaataatttcagtcaattgcaaagtcagaaactagcacgcattgcctatgaacattttagtaacaaaataaattgctaaacaagcatccaattatggtgaatggataaaaaactacaatgggaatcactgacaggggacatacatctcttgcagccacaggctcgttgatggtgacttggggcctttgtctgctaacagctccttggcttgttgaaacaggggccctcatctgacaataagcaaatgtaatcagtgatgataaatgattacataaatttgaaattgaacaatatgatcaactgagcatacctttgactgtggcatccgatcaacaccttttctagctggaaggaacaatggaatatgctcatcagttatcaacagcagacaaagatcgctagagttaaaattttggatgttaactagcatgttgtgtcagcatttgaggcttgttacctgcaacacgaggtgcatttgctgtggcctttggggggtttgaggcagcaacgggccgacctgaaagtttatcaggtttgccaagagatctctggatcgaagcacggacattatcaaatagttcagtctcaaggctttccatcgcccaggtttcactttccagagttgaggttgttgactcccctgatctcctcgtttcctcaatgattccaggcagcctggaaccttgggccttacgataggtgctgtttacaatggctaattcctcagtgtcgagaacccctgcatagaccaggaaagattaagagttgcgatcaatctgcataattaaggtttaccagagtgtataacgagaggcaataattccagaaaacagatagagtttcacatgggtggggaccaggaaaaaacaaaagcgaagatgaaccttcactggtaaaaaattcgctgtcccaagccaagctcttgcggaggtttacccccttcttggccttgcgctgctccggggactccgtccgctcgggatcttcccgctcctccatcacacagtccggatccgtagcccgaaccaccgccgatggagaaacgccggaggaggttgcctcggctcccactagagactctaacggaaaatcgtcgcccgtcagatccacaaaatcgcaaccaaaatagcaggcaccaatcccgcgcgatgggggggcaacacctcacctgcgtggagcggatcgggacgccgcggggccggtgagacgaggttgaagagaagatcgtcctcggtggagacgtcgatgaggaagagtccctccataggcgcagcgaggagtcctgcggccggccggagtcgctggggatcggtaccggtgggaaacccctaaatcgccgccggtgagggattcaagagggagagaaggcgaagacgagctggagagacgttgaagatgatgaggggcgaccgcgcgagggtaaatgggtaatgagtgggatgatttaaattttggcgagtttgggctgtattttcgttgggccgtttttagggttgggtattggatctgtgggtcacacgtttcatgggctttgtctttcagcggtctgttttttcttcttctttttgttagtccatttcaaatgcgcttgctaacgctacagctacagggaataattagtagggggacttctaaactcgtgtccttagttcaacataaaactgaaggagaaatataactaaaacacatgattactcaacataacacaacataatttgagtaataagaacatcaatatgtcgtaacaaaaaacaagtagtattatccttacatccctcaagcagctgataccagcttttctctgaaatccgacagaagatgagaatacatggctcttgag

SEQ ID NO: 8467 - DNA, 7473 bp, Zea mays
  misc_feature (1874)..(1874): n is a, c, g, or t
tgcaaaaggtgctgcttctggtgtgcatgacactcctttgtcagatgggcagcctaaacacttcttccagtcacaagcagcagcttcctctggtgtgcatgatatgcattcctctaatgggcagcctaaacactacttccagtcacaagcagcagcttcctctgatatgcatgctatgccttcctcaaatgggcagcctaaacactacttcaagtcacacgcagcagtttcctctgtcgtgcatgatatgccttcctccaatgggcagcctaaacaaattttccagtcacaagcagtagcttcttctggtgggcatgatatgccctcaaatgggcagtctaaacccttgttccagtcccaagaagcaactatactacagcccaaaaatgaagcaacgtgggtgtaccatggacgacctggtgatggaaaggttggaacatcaaacaaaagcagaccatcgaccagtattgggttcatcaataaaaatcatcaatcagtaaatgctgcaacttttgccatgaatttgaatggacagaagattgtcagtgaccatgcaaaatcagcaggcacaactgcaatgcctgtccaggtaaatataccaaacagaggtcttgatgctcctcggaacatgttctcagcatttccagctgctgttagggagaaccatagcattccaccagctccaatggctcaatcttggatttcatttggtgctactacagagaacaaaccaaccattgtcagcccaacttcccttgacaataattgtggctggaaaatgccatttgctaacgtccagccttctgatgataccaaaataaatgccgttcctcagttatttaggcatcctgtccaggtagttagagagaactcggttcaaagcaagggtttggtaatatttccccagttggtgcagccagatttcgcgagatcacaagggcaaccacagtggcaggggctggttccccacatgcaacagaagccaggcaaggatgtactccgcccggacttgaacatcgggttcccatctccacgttcaccaccagcccgacaatcgtctggcatcaatttggaagcacagcagccagaccttgctttgcagttatgagctggggatagacactaccgggatttatgctataatctctaagcatgtaaaggcacgatgagctgaggtgtgaaagaaagcgaggacaattgggacatccggtacagggatcggtgatgatcgattgggatgtaggccttacatgccacatggcatcatcgcagctcatcaactcatcgcgtcgctgtacaaaagatatcagaaaatggatggatggacactgcttgaaatgagatcatgtctactgggggcattgtgataggagttcaaatcccagcattcggagaaatgctttgggagtttgggtggcatacatgtaggtagcatactagcaatgcccatgatcagaatactttggaggaacctctctgaccacaatacagctttcttcggtggaaattttggcaccagaatttaggctttcatttggtagtgtagacccctgtgtaatgcccgtatcgaaatgtatgttggttgtaaatggttttgcgttgaatagattgttagagtagggcagtggggagtggcctttacccccgtcttctgaatgaaattgcttcttttgtccatgatgtatgtagtagcaggaagccaggaactgaggtctgtgccctattcagttcaaatggcatgctgaagctaaaaaaggttgccaattctctcgttgcgatgcactgattcgtttgtccttgcatttgattctagccttgaagctgggatgtcattaatgatgagcaacgccaggcatgactttgctgataaactnttattcactggacataagtttgtttgaaactggaatgtatgtttttctctgaacttcagacatggtagtacaatgctggggttcgctgctcacaccctccatcctaaaaatagcgcttgttcaactgcagagctagaactcctaaaccctaaacccttttttgaaggagcgtgtctacatttacagctagaatgaaccttttttgaaggaggccaggagggtgtatgcatatgttgctaatgccagtccgacattttctattgcagagtatctactagccctagattatttcccgtaataaaaagaaattctgtcctctctggaactccatcgtgtacaaataatccagcgaaaattcggttcggttttggggacgaatagaacagactatgtcgtgtgattaaacctttcgcagggcgtcagagaccaaaataaatatccaatagcaaagcagccatatgcatagattggagacctcccactggtagatttctctttgatttgcggaaaccacgtcacctaaaaaaaaaccttctctagtccagtgcgtcaacagggaaacaagagactttttaaaaattaatgccgtcccctccaccgatggcatggttctctagttcacagcttcaggaacctccgagcattgctggcttggacgtgttccctgtccatccgcagacacctttttgtctcgctccaaccagcgctgcccggccaccacggctgacacgcgacgatttttttttaaataatatgttctaatgattataactaccaatctagaaactgctaaaaattatagatgtagtagcctatcagccacccaggtgctgataagtgcctcatcacagccggcagacctacgttacagacaatgtccgcatgaagagccatatggcatatatatgtaccgacatcaaaacatataccattagaccctctcccacaaaaaatcacccactcgtatagcagttacaaacaggctctctaggtatccattgtgaattactaaacaaagtaaaatataattaccaaacaaacacactttacttgcaaaccggcaatagacaaagatgaggttttcatgcatacaatagaaaatcttagttctataaagctctgtgcacaaggattttacaccacaagcaggttaagggaattggactcgtcagctgcggtacggttgcctacagataacaagagggtaataaaataacaaccagcataccatccctccctctcgccctgcaggacctgagagccacgttagagttatcgctcccccagagaaatggaggataacttctgggtcagcacctcaactaatgaactcgcatccacattagcttgtatattctcatgcaaaaccggaatgttctcttttgaatagtctgtagccagtgccaccactgcctcagtcatgagcgtgcaatcttcacgttcagcgacaagagctctagcattttgatcacagaatttgtcctgaaaacacacacagaaagaaagttaggacatttcgaccaacacttcgatggtaaagcaactcctacaaaatgaaatacacatacttcgagtttcaccacaattggactgaccaggtgtctgcacgcttcaggtttgtccaccttaaaagcttctgcttccaattgcactgcttctagaggcgcttctacttccatttgcacagtttccaaaggcgtctttactgtgttacttttgcaagcactaacctcatgaggtgctactataggttctaatacgtgttgaccaaaggtttgcggagagtttggtgtggcatatagcaagcactggatctccatggattgctgttgcacctgtacatgcacaggaaaatagttaaaatcacattgatatatgacattttacaagggaaacaacattttaaaaaatgcacatactgcttcgggtctgaccacaactggatcagtctcgttgctgtcgggttccgccaccttaaaaggctctacttccaccttaagaggcagcagcttcacgaccttactttcggaagcacaactttcctcatgaggtgttgctgtcagttttgaatcctgttggacgtaggtagctggtgcggcatccacattcatgctctgaaattgtgttgtgtcaggtagacactggacctttgaaggttgtggttgtagctgtgcaccgatgttttggtcaatgtatttctcctgagacacacagtgagattgttagaagcacaataataaaggaaatcactattactgcaagctaaggatttttttaaaaaatgcacatacagcatcaaaataaccaatcttgggtgtgggcctccgaagcccagatggcttaaaaccttttctctggttggtcatttcagaagtagcttttaaattaactccaggtgctgctgttccagatgaatgaccctctgtgacaacaggaggcctaagctttggagttggagggcagtcattgctcttcctgagggagggggacagtccatttaaactctcagatgtatggctcatcctccctacggtggaagcagttgaagccccagatatgacagagctcatgctgtccatggagctgctaggtgaaatgcttggtgatgcacggtcagcatggcccttagctggaatcgtgttccctgatgatcttgagggaatagttttgctgataccagattttgatggcggatgaacagggaccctctgggcagtcctatttttgttgcttaaggttgctgatttggtttttgcttccggcttagtgtccattgacacaccatgagaagttgctgctgatgtgaagggacctgattttgagattgaactagactttgtacccccgccagatctcaggccagctgaagtactggcagttttaccagctgcctgcctgttggcagcaccccctgaaagagaaaagtacatattaggctaggtttatgttatattaatactatcagtgtttaaaaaatgaatgctagtttacgcaccagtgctgcttcttttgtctgaaaccccagaggtgacagctgtggtagttgatgacctcatcatagcaactcttggcaaagctctaggaggttttgaggatatctttgcttctgcagctcctagtaaattctactccagcaaaaaattgtaaatgcgaaattggcatcagaataccacaaatggaacttttaaatgaaaacaaacaaaagaaaatttgtctctcaaaataaaatgactattggaattcagttgtgttaaggtccatgtttagaattatagtgaaccaaatagttaaccatattcatccgtgacatggtgacttagtgagatagctctcaccactgtataaggcctgcccttcgcaaaaggccatcctagtcattgagattaatttccatgtgaaggtacatactcagacttgttgagcaagatcaagaggaaaatactagtcacttggattttgatttgatgttcaggtacgtaattcaaatattaatttatacagggggatagacaaggcagcctgaatactattcagctttacttaagaatttcagtctattgcgaagtcaaaaggtatcatacattacctatgaacattttagtaacacaataaatatctaaacaagcatccaattatgaatgaatggttaaaaaactacaatggccatgattgttaaggggacatacaactcgtgcagccacaggctctttggtggtgacttgggccctttgtctgacaccggctccttggcttgttgaaacaggggcccttatctgaagataagcaaatgcaatcagtgatcataaatgacttcagaaaattgagattgatcattgagtatggtcaagtgggttacctttggctggggcatccgatcaacaccttttctagctggaaggaacaatagaatatgtttctcagttaccaagcgaagctcactagagttgaagttttagctgttaagcagcacattgcatcggcatttgaggcatgttacctgcaactgcaacacgaggtacatttgctgtggcctttgggtggtttgagccagcaacaggccgacctggaactttatcaggtttgccaagagacctctggatcgaagcacggacattgtcaaatagttcagtctcaacgctctccatcacccaggattcactttccagagttgaggttgctgattcccccgatctactcatttcctccacgattccaggcaacctggaaccctgcgtcttacggaaggtgctgtttacaatggccaattcctcagtgtcgagaacacctgcaaagattaagaaaaattaaaagttgctatcaatctgcatcatcaaggtttaccagagcaagcgactgcagccacgccagaacagaaatgtttagtttgtgagaattgggcagtgattataaatagtattaactggtgctagcctatctactacagcatacggcaacgacaatcacaataaaaaatagtaatattaagtgaattgtgtaagatgcacaagtttataatgagaggcgataattcaacaaaactgatagaatttggatcatggatgggaatatgagatcaaggaaaaaaatacaaaagcgaagcgaaccttcacttgtaaaaaaagcgctgtcccaagccaagctcttgcgcaggttcacccccttcttggccttccgctgttccggggagtccgtccgctcggggagcgcctgctcctccatcacactgtccggatccggagcccgtcccgccgccgacggaaaagcgccagaggaagtcgccacggcgcccaccagagaccctaaagaagaatcgtcgcccgttagatccacaaatccaaacaggcaccagtcccaccattcttccacaagaaaaatcctccagaaatgggggtggaacacctcccctgcgtggggcggtgaggcgatgtcgaaaagaagatcgtcctcgacggagccgtcgatgagggtgagcccctccatgggtgcagcgcggaggcctgcggccggtcggagtcaccggagaccggtgggaaaaccctagatcgccaacagttgtcaggatcggagaggaggcgaagggaatgcgagacgagctggagagacgttggaaataggcggcgaggggcggctggctataaaaatgttgggaggaggccaggttggggcgttgcggccgctgcgacttgcgagcctgcgactgcgagcgacgcgtcctgctgctgcggcagagactgaccagttgtcccggaagcgggtcgagcagagggggttattatattattgccttccttttgtggagaaggaaaatgggtgattattacacgggcggcatgatttgaattttggcaagttggggctgtgtttcgttgggccgtttgagggttggacatggatttgtgggccaagttctctaggctttgcgcttccgtgccctgctttttattattattattactgtatatctagtaatgcttatgcctatataactttcttaacaaataaaatatttcagaaaaccatctaactatatgaggagtaaataaatataataagactttactactccctctcctactttacgttgtggtgaactccttcg

SEQ ID NO: 8468 - DNA, 1288 bp, Zea mays
  misc_feature (1257)..(1257): n is a, c, g, or t
tggggtcctgccggcccggccggggttcttccaatcccccctcccccggcgtgcgctccctcgtgtctctcttggcgacgactgggcaacggtcgcagctgtatgttcgagcccttcgccgacgacgttcaccaccaggaattttctcagctgtgccaatgatgggttgcttcactgttctcagatccaagaagaagaaaagccattttgataatcctcttgtcccaagcaagaaatcagttgatgcaagggaaagtacgtcctctagacttccggagccagaagttcatgtgccatctttgcaatcagctcctcctagttttaggaacagggtcaagatatccgagtcatcaaatgaagtttcaaacagaaacagcagggctcgcgtgctgtctgctccatcagcccttattgtggtcgatcagtttggctttccatattcggaataccgagatcaagatgactccagggataaggaaggtttgacaaaggggcatcgcttttcaaatcctttgccccttcctcttccttcacgcgaaggacattcttttaggaactctggtagcttcaaagccagcaacgtaagcgggccattggagatgtctggccctctcccattgcctctaaagaaatgtgatggacttagaatcttctcttatgaggagatttcatctgcctgccaacggttttctagtgatcagtgtgtttcagaaacacttggttcaacatcatacaaggcaacatttagagatgaatttattgatacgaggaccactgaagcaacagtagctcgattactcccctccactcagagtttgaaggagtttaaaacgcaagcgaccacattggcatcgcttcagcatcccaatttatgtaaactgattggctattatgcaaaagaagattctaatgaaaggatgttggtctatgaacggctttatcatggaagcttagataagctactctttggaagatcagatggtcgtttcatggactggtctaaacgtttgaaggttgccctgggtgctgccagaggtctagctttcttgcatgatgaaggaccctttcaggccatgtacagcgagttctcaactttgaacatccaaatagataaaggtttcactgctaagctttcaggatatggttgtgttggcttcaataccgaggagatatctaatgcacctgtgtctgcagcaaatctttcggtggagaccttggagaagggtttactcactcccaagacaacgtctggagctntggagtcgtgttactggagctaataactgga

SEQ ID NO: 8469 - DNA, 6411 bp, Zea mays
gggtaccccgccgcggtcttccactcccccctcccccggcgtgcgctccctcctgtctctcttggcgacgactgggcaacggtcgcagctgtatgttcgagcccttcgccgacgacgttcaccaccaggaattttctcagctgtgccaatgatgggttgcttcactgttctcagatccaagaagaagaaaagccattttgataatcctcttgtcccaagcaagaaatcagttgatgcaagggaaagtacgtcctctagacttccggagccagaagttcatgtgccatctttgcaatcagctcctcctagttttaggaacagggtcaagatatccgagtcatcaaatgaagtttcaaacagaaacagcagggctcgcgtgctgtctgctccatcagcccttattgtggttgatcagtttggctttccatattcggaataccgagatcaagatgactccagggataaggaaggtttgacaaaggggcatcgcttttcaaatcctttgccccttcctcttccttcacgcgaaggacattcttttaggaactctggtagcttcaaagccagcaacgtaagcgggccattggagatgtctggccctctcccattgcctctaaagaaatatgaggagatttcatctgcctgccaacgattttctagtgatcagtgtgtttcagaaacacttggttcaacatcatacaaggcaacatttagagatgaatttattgatacgaggaccactgaagcaacagtagctcgattactcccctccactcagagtttgaaggaccctcgaacgcccgagcgaccacattggcatcgcttcagcatcccaatttatgtaaactgattggctattatgcaaaagaagattctaatgaaaggatgttggtctatgaacggctttatcatggaagcttagataagctactctttggaagatcagatggtcgtttcatggactggtctaaacgtttgaaggttgccctgggtgctgccagaggtctagctttcttgcatgatgaaggaccctttcaggccatgtacagcgagttctcaactttgaacatccaaatagataaaggtttcactgctaagctttcaggatatggttgtgttggcttcaataccgaggagatatctaatgcacctgtgtctgcagcaaacctttcggtggagaccttggagaagggtttactcactcccaagagcaacgtctggagctttggagtcgtgttactggagctaataactggaaggaagaaccttgatcccaattattccaaagaagaacgcaatattgtcagctggagtaggcctttccttactgatgacagtcgcctatctcttatcatggactcccgtataaaagggcgctttcccactaaggctgctcggatagtagcagacatcattttgaaatgcctgcgtaaggatccatcggagaggcctaccatgagggatgttgtggaggccctagcaagagtccaggaaataaaggttccgtgcagatatcctctgcaagaaccttctgctgcaccaagaaaagtgatgttgaaatctacatccctcaatgggattgtgcctcaccatcctgtcataaccttctctccatcgccgccttcacataaccagcacttgatttcaccaaggtcgtcgacatctgccttgtttcatccaagggcatgctcttctaccctggacgatccgagtgtaagttctataaagaaaacaccacctattatgcgaaggtctagcgtcgaaggcttttgattgtccatattgttcctttatttccttttcttggatttatttgtttctttgttagtagtgtagcggtttttagctgtgttctgtattgtaagacaagtggcctcatatgtagtgcccttgggtctggagtaaagcagaacaggatgaattgtaaataggaccaggttgtagataccttttttttgtgctcgaattgggtggaagcagcgtgccgagtgggccttgtaacctcataatgcaataaactccgtttcccagtttctgtaaaaaaaaaaaaaaaaaacaaatgtctctgctcgtccctttggcgccaagtgttgggtgcctagtgttgctgcatgtcggcaagcgtttgtgttgtcgaatgtctccatccacatgatgatctcatgtggcatgttgccacgggtacaaggaaactgttcatgatatctgttgcgttagttagagatgttgaattcctgtctgtggaaagcttgtttaatggtctgccgttgcaattgttgactctgaccccagcctgattgcatctctgcctgtagctactcaattgctagtcatgcttttggcgagcgtcgttttctgctgcaatcttgattttttttccttccccggcacatgttagtattttgttggtttcattgtgtgtattctacgatgaccacacaagaatgtttattatggtcctgtggactatggctctataatttctgtaaaatggtttgaacgttgggcggagagtcagagcaatttcttttgtattctaccgcacgccagaaagattagtccatctcttcagattttgctttgcaatgatgtgtatgctcttttcttttgacctgtaggcaggcggtggcaggacgataaaaatctctcctgttctccaccagctcaccctaatgtctgccggttggtgatgtctgctctttctgactggtttgttttttctaccgggatgtgaatggttagaaccagccctgattctatgaatcaggagcaatatatgactgaacgaaaatggccggattcagcgtcacagctatgcaaatacaactgatcttcaaccggaagtccgataccactttgttccattttcccctttgccggcgagccgaaccaaatcaggatcgagcaggtcaccgggagtttgatttatgcaacaacagaaatcaacacgcacaatttcgtagtgtcccagcacgtgtcgccgtattctgttgccagaagtgtctaatacgggggcaaattgaagaatttctaaagaaaatataaaaaaagtaacttaaaaatagaatccggcatcgacgacgacgctgacattgccgccaccgccaccatgtccattgctcccatagtcgtcgactttctcctggtctcgtggagctgggctacgtgctcttcacctaccgatccccctgctcgccctcatgctccacctaccagtaccatctcttcgtgatcgacctgacgacggtgatggctcggactgcatggttgtgttggggaagatcgggcacggtgcctcgccgactttgcggcctccctcggccttccgttcgagttccatcgaggggaatttcaggcctaggatcagcagccgccaggaccagtagctgatcaccgtcgtcgtggaggacctgggccacagcggcgtcttccagggctggttcatggaggcgcccactactactcggcgctgggagagacagcgccggcgcggcagagaggagtcggccgagcgtagctcctggtcctgggcgtggagatacgcaacatcgtggccgggcgagaaagatgacgcaggaaaactagcgcgaaagggtttccccagcgccgagacgcattttcccgcgtgatcgggatctttctaccgagtaacgaaagatgtgaagattggattggaagttattcgagatgtataagtagtattttttatctttctaaaacccttggatttggattagaggttatgcttaagccacctttactaacatgcatttcaattaaggacccagctaacagaaaactatatttgatttctacacacataaatattttagtgtgttaccgtgctaaactgtttagatcatttaacttctattgcacgtgataatttaaatagcgtccaaacgtcctaaacacgaaacagctggtgatcgactgtttaccgtttcagaataacgcgtgtagttgctcaaatccaataaaaaaaggacaaattacatggaggaggagaagcagcccatcagccacaacatgcaaccctcagcagcagaaggcatgatgatcaagtctgcattacgagtttgtgaccaagcgcggttttggagagattttcacgaaccagccggacagatatagcaccacgcgctggctgggctctcgaagccatcatcagctccaggttcccgcgctgggattgaggcggaggaaacgcatgttctccgatctaattcctggcggacgcgccggaatctgtctgccgcggtggactagctagatctctccgtgtccgccggagtccaccgaccagctgagacttccggtatttcccgcctcaaatctgccctagatcgaatggttctcttgaatctctggcgctgctgtctcggcggtaaagggtcgcttgggatcgtatttacagccgcttaatgttattagatcgtgcaggcaaaattaccgaaccaggtgctcgattcgaacccaccttccaaagctggtgtacaggtctgaagctgtttgggctttggtagggttggttctattgtgtcgtagcattcaattagtgagctaatttgaatctgtattggtcatatgaaagccaatgtcgaagtataactaatatgaggaatggccattgcactgctgttgcacctgtgaatctgaacttttgcatgtattctagtggccatttgcgttggcagttcatttgttggctattccagattttcgagcgattaaaacttgtttgaagtgtgaacaagtctgttattccacagtatcgaccatcactacctgaagataggatctcttggtcgacgctgccccaaactggtgatgttcccaactgcttgtttatgaatattcagcgtaagacatgtttcgtcttcttctatctactcacatgatttcatccacaccgatttatgtcatcgtgtggaccatgaccagcatttcagtagctgttttaagcttgcataagaattctccctccgatcggaactaatacaatcattggctaccatttttatttctgtatcctttatctgtcgtctttgtttctccagacagttacttttttggggttgttgtccttctattgccaggtgcaatcagaactaatacaagggaaatgccaatgctagtctactatcagcagcttgagtgtggagttcaggatcctagctcagctgtggcaaaccacagcacaagcattctgctgctaggatggaaagatgaactctcttgatcatcagaacaaaaaaaaaactgctcagagttcagggaatggctgataagtgaaaattcagatgactaaacttcagaaaattagaaaaacacactatttgtttgttattcagtcagagagacttgagccatgtgtttcaatgctgccctctacagctagattgagggcaccatggacacatttgcttgacaatgaggtataatatccttaggggaatctgcaggctgcccgcggcccttatcacgtgctttgtgcaatagcctcctttttccttttcctttgttctgttttgcacgcgtgccactataagttaatctgcagtatgcatcagtcacacgtagttagttactccatcaacagttgccagttacctgtgaaacagcgatgtcatcctttcttatttgcaattttaataatgcatgaatggctcattagctccagattgcaaggttcttcatgctatctttgacacttaaccatattcgacactagtgcactgacatcgtaagtttactttatatgtctcagtccaagcagatctcttatgtgatactgatttggttcagagtttgtaccttcctgaacctgtttacagagtctgttcaatgctgaacttgtctgggaaatggctttgaagttgtatacttgcgagttaaaatcaatcacatctcttatgtgagtcttgaaacttttttaccttgccaatcgataaattgcagaatcgaaatcactactgtcattatatctggttcctgggttagtgtgctaacctgacctacttctattatagatgtgtgctccatgatccgatacatatgtgcttgtaatttgtaaattgtcaagtctgcggcagtgatatatgataatgtcactgggaggtgtggggaaacagttttggttcccactccgtaggtcaggtcagcactgcccactggtccacacatttcttttccctttttctttatgtctccttgcctttaacatgatgcctgcccctgctgtcttccttttgggcaatatagttttcataatctggatctgtgttcctggtcattgattcattgggtcatactaaagtttcttggactaatgaatggatttataacagaattttgaaattgcatgtgccattcaccattaaaaatgataaaataaataaaaaactagac

SEQ ID NO: 8470 - DNA, 1123 bp, Zea mays
ctggccggggacacgcactctcggcaacggatatctcggctctcgcatcgatgaagaacgtagcaaaatgcgatacctggtgtgaattgcagaatcccgcgaaccatcgagtttttgaacgcaagttgcgcccgcaccccgcgctcggcgcgcacgtgcgcggaggggccaagcgccacacgccgacgcgaaccaaccaggcaaccagatggtagtaggttagctaagctcgggatcggaggagaggtgccccgcgaccctgacgatgacgatgcctcgccgcgcccttctcttcgccgcggtgctcctcgcggcctccgccgccgcggtctccgggttccacctcgccggggacgagagcggcctcgtgaggggcgtgctcacagcggtccgcgagcgggccgaggccgaggccgaggacgccgcgcgcttcgccgtcgcctaccacaacaggaaccagggtgctgctttggagttcactagggtgctcaaatcgaagcggcaggttgtgaccgggaccctgcatgacctgatactggaggcagctgatgctggaaaaaagagtctgtacagagcaaaagtctgggtgaagccgtgggaggatttcaagtccgttgtcgagtttcgccttgctggagactctgaatctgaacccgagccttctgttgcttctgatgaaggctctgggcaaggagttgccaagctctctcttgaagcagacatcatacacgaagaggctcacctgcacaccattgagaatgatggactttccagcgatttcgcatcatccgcttagacatacttggtgtgactaggattccaggcaaggatggaaagcgtgaaagtttaaaatgaaggtttaggtatttagaattctaatagtaggttgctgtcaagctgaaatgctttgcctctatcggaatatgtatgttttgtttggaacgtaggagcatagaactgtatatttcggtatttcacaccgttcatttccatgtctgtatataagactatctccagccatattctcccatatatatttcactacctatactttttattatattttacatttttactacattcataaaaaaaattcttcttctacctaaaaaaaaaaaaaaaa

SEQ ID NO: 8471 - DNA, 1373 bp, Zea mays
cattgggaccctcgaggccggcccggccggcccggcacacccgttcgaagcaaaaagagcgaacacgagcacgaacacaagcgcagagcagccaagcgccacacacacgccgacgcgaaccaaccaaccagctggtagtaggttcgccgcggcgccgcgctgacgatgatgcctcgccgcgcccttctcttcgccgcggtgctcctcgcggcctccgccgccgcggtctccgggtttcacctcggcggggacgagagcggtctcgtgaggggtgtgctcgccgcgctccgcgagcgggccgaggccgtggacgccgctcgcttcgccgtcgcccactacaacaagaaccagggcgccgctttggagtttactagggtgctcaaatccaagcggcaggtggtgaccgggaccctgcatgacctgatactggaggcagctgatgctggaaaaaagagtgtgtacagagcaaaggtttgggtgaagccgtgggaagatttcaagtctgtcgtcgagtttcgccttgttggagactctgaatctgaacccgagccttctgttgcttctgatgttagctctgggcaagcaattgccaaactctctcttgaagcagatattgtacaagaagaggctcgcctgcacaccattgagaatgatgggctttccggcgatttcacatcatcatcttaggattccaggcaaggatggaaagcgtaaaggtttaaatgaagatttaggtatttagggttctacatagtatgtcaagctgaaatgctttgccttgtttattggaatatgtatgtttcgtttcaaacgtgggagcatagaactgtatatttcggtatttcacactgttcatttccatgtctgtatataaggaggttcttctggctatatgtatattttgatcctcaagtacttattctctgtcttctgtgtactttagagaatcagtcctgccgcgtctttggttagtgcgtaatatggaatagacgatgacaatatttaaagatctaattgaagaaattattggatgagcggcctttcactaaaatctctattctcatttactaggaataatatttctaatacaaaaaagacttttggagttgctctaaatcaacattttctttgtcttaaccatatgtagagattgatgttgtttgttttcattgtagaacatactaatacttttttatactactaaaaaagattactcatacccatgaattgtcgcgtgttgcaatgcatcgccactaacaacgcctcactcgactgctgctagggatgacaacgagtcgagtagagtaaatatccgcgagttgggtagagtaaatatccgctcgtgatcatacccacgaagattactcattatt

SEQ ID NO: 8472 - DNA, 1918 bp, Zea mays
acccctggtagttggttcgccgcgctgccgatgatgcctcgccgcgcccttctcttcgccgcggtgctcctcgcggcctccgccgccgcggtctccgggttccacctgggaggggacgagagcggtctcgtgaggggtgtgctcgccgcgctccgcgagcgagccgaggccgaggacgccgctcgcttcgccgtcgcccactacaacaagaaccaggtgtgcgcctccctcctcgtctctccatcctgccgataccaattccatcagcgtgtggactcttggtatgtactaccatgagagagtgaattgcattgacttacgaggtgacgccacctaattaggtcaatgaagtttcactcccgagaggggaaaagagttgggtccatggattcgctaacgggcttcccagttgcatcaacttgcaggggtccttaaacttaggtctcaactctttgggggagtgacctactagatttgctagaatcaacgtttcggttaatggtcgaacttgtattttctcatattagtggcatgatctctcatctctccgtagatgtatgtacccccacggccacgctgagtttcttccgagtttataatatttggagaattttcttgtacagggcgccgctttggagtttactagggtgctcaaatccaagcggcaggtggtgaccgggaccctgcatgacctgatactggaggcagctgatgctggaaaaacgagtgtgtacagagcaaaggtttgggtgaagccgtgggaagatttcaagtctgtcgttgagtttcgccttgttggagactctgaatctgaacccgcgccttctgttgcttctgatgttagctctgggcaagcgattgccaaactctctcttgaagcagatattggtcttcagtgtttggataatatatattgctaattatccaatataatccaacaggataaataaacgtggtgttgattttttgccagcaattgccaagctctctcttgaagcagatattgtacaagaagaggctcgcctgcacaccattgagaatgatgggctttccggcgatttcacatcatcatcttaggtatgatttcatctctttttatcttcttgtgcaacgggtgccacttctggtctcttgctatttggttaaccgacctatgatcacacgagccaaggacaggctgccagtgatcccaatgactgtaaccatgatttgtttttatcttgcattggtatcttgtatagtaatggttcagtgcatgatgcaaactaaacaatgtctatatagttgcttttatctttgccatggctattgtgggaactgggaagtatctagtcctgatgtgggaccttatatgttggcatctggaagatggtttttactggatggatactgttagttgaattcgttgggattgctatttgtttttttatggaaaaccaagagtgatactcttcatgtaatcatgtgatgcattcgcactggtgctttgggcccatcaaaccgtgtactatcagtagacagcttgctgttcggattcttaacagaactttgtatgcaggcatacgaagttttgttaagaaactaaatagcaggaagcacacacctatgccagacactcctcgttccacaagacagcatttgcatcatgcagtgcttaacatagccatatctcattcgcagtgtttgtttatcttgtaatactatgtggaaaaacagtggcatagctcaggaatctaggccacaatcaaatccttttcaggaaccaggtgatatccaatgctttgatgaacaatagatgtttatgtgtggtgtgctgcggttgtatcagtcctcagaaaagaacttcccttttttaggaccaactggactcttatctctgtctgtttatttgctttctgatgcatacatcataaattgg

SEQ ID NO: 8473 - DNA, 1083 bp, Zea mays
  misc_feature (34)..(34): n is a, c, g, or t
tcgagggccggccggggggacggtctttcgatancggatcacacgtcgctgtccccaccacgccaacctgccccaccacccggctcccttggctttccccagtccccgcccgccccactgagacactgacaccgttcgaagcaaaaagagcgaacacgagcacgaacacaagcgcagagcagccaagcgccacacacacgccgacgcgaaccaaccaaccagctggtagtaggttcgccgcgctgacgatgatgcctcgccgcgcccttctcttcgccgcggtgctcctcgcggcctccgccgccgcggtctccgggttccacctgggaggggacgagagcggtctcgtgaggggtgtgctcgccgcgctccgcgagcgagccgaggccgaggacgccgctcgcttcgccgtcgcccactacaacaagaaccagggcgccgctttggagtttactagggtgctcaaatccaagcggcaggtggtgaccgggaccctgcatgacctgatactggaggcagctgatgctggaaaaaagagtgtgtacagagcaaaggtttgggtgaagccgtgggaagatttcaagtctgtcgttgagtttcgccttgttggagactctgaatctgaacccgagccttctgttgcttctgatgttagctctgggcaagcaattgccaaactctctcttgaagcagatattgtacaagaagaggctcgcctgcacaccattgagaatgatgggctttccggcgatttcacatcatcatcttaggattccaggcaaggatggaaagcgtaaaggtttaaaatgaagatttaggtatttagagtatgtcaagctgaaatgctttgccttgtttattggaatatgtatgtttcgtttcaaacgtgggagcatagaactgtatatttcggtatttcacactgttcatttccatgtctgtatataaggaggttcttctggctatatatatatataatttgatcctcaagtactttttctcaaaccgcgcccgacagtaaagaatcagtcctgccgcgtctttggttagtgtgtaatatggaatagaggatgccaatttttt

SEQ ID NO: 8474 - DNA, 3586 bp, Zea mays
gatggataaatgtgcatttaaataaggccttggtgagcagcctctgcctttcctctgttgtttttattctcttcttaatgatatgacacacaactcttatgtgtctagaaaaaataaagtaccaaattttcattcagtcttgctttttgctggttcagtgatttggacaaatatatttgaactgcaattgccttgtgttttatttgaaggtccgactagtggatacagaatggtgccaacctctggagatagtaaaagaagacactattgttatagcaatgagaaagcagggtggtactcagaaatttgtaaaagctgagatacgtggttatgaggaaggttcaagattcttgattgtattccgtctgggcccagcatatggaccaatcaggtagtatgaaatggtaataagagcatccagacatttgtttcccagttttacgactatgaccattgtatgattgtttgtaggattgagaaccggacgagtcataccacaatcagtacttgccagtctggtttaggggaggagagttggatccaagtgaagccacatgcaaccagaaaatattcttgggatgacccatatggacagaaagttattgatgttagcagtgccctcggcctcgccgcgtgtgtcctatgtgttgacctggaaaatcctattggaagttccaccagttttagggaacatggcctcatgtttactgttgataccagtgacattaagatattgaagtttgctgattacataaggaaagaggaagtatatggattgcctggatctgaactgactgatcaccaaggatcgtcattgaaggaaaatgagacagagccaggtgctggacccttggagctcattgttgaacttggagttgttggaatatctttgattgatcataagccaagagagcttttatacttgcatctgcagaacgttttcgtttcatacttgactggttatgattttgggaccactagcaggtttaaattaatccttggcgagttgcaactagataatcagttgccactgtctacaatgcctgttgttttgtctaccgagagcaggcctgattcaaatcgttctgttttcaaagcaaacgttgctgttagcaatgtaacttctaatggcattcaagtttacccacatgtctatatccgggtaactgatcaaacatggagtcggtacctccaggccccccgggtttgggcactgcttgacttctacagcaatcttcgttttgtcaccaccagcaacagcacaactgtcacgggaagtggatcctgagatacgaatagagctcattgatatttcagagataaggctaaaaatatctctggaaactgcgcctagtcaaagacctcgtggtgtcctaggcatatggagccccatcctatctgctgtgggtaatgcactcaagattcaggtgcatctgaggaaggtcatgcacagaagccggtttatgcggaagagctccatcatccctgctatcacgaaccgaatcaagagagatctgattcacaatccgctacatctaatcttttctgtggattttcttggagtaacaaaatcaactttatcatcacttagtaaaggatttgcagagctctctactgatgggcaatttcttcagctgagatcaaagcaggtttggtcaaggagaatcactggtgttggtgatgggctagttcaagggactgaagcatttgctcagggtttggctttcggggtttctggtgttttaagaaagccagttgagagtgccagacagtatggtgttataggtattgcacctggcattggccgtgcttttgtgggtttcattgtccaacctttaagtggggctctggattttttttcactgacggttgatggaatcagtgctagttttatgagatgtgttaacattttaagtaacaaatctgttccgcagaggataagagatcctcgtgctatacatcgtgatggtatagtaagagactatgacaaatttgaagctgctggccagatggccctttatctggcagaagctagcagatattttgcatgcacggatttatttcgagaaccttctaagtacgcatggtctgattactatgaagaccattttattttaccaagccagaggattgctttagtaactaataagcgggtgatgctgcttcagtgcttggatctagataaaatggacaagaaaccttctaaaatactttgggatgttccttgggaagaagtactttcattggagctagcaaaagctgggtatcagaggccttcacatgtaatcatacatctgaagaattttaggaggtcagagaactttgtaaggcttattaagtgcaacattgacaacgaacgggaacctcaggctctttcactttgctgttcaattcggaaaatgtggagatctcaccaagcagcaatgaaagttataccattgaaggttccatcaggccagcgtcatgtgtattttgtgtcagatgatgataaaaaggaatcccacagtttatctaggcctttgctaagctcgggaggaacctctactgatgttgagcaacagttcataaacaatacagttcactttcagaaaatgtggagcagtgaaccagaaattcagagccgatgcaaactagttgccaagcagattgcggatgacggaagggtgttcagcatatggaggcctctctgccctaatgggtatgtctcaattggtgatattgcgcatgttggcatccatccaccgcattttgctgctgtatacaagaatatcaatgggaactttgcactgcctcttggctatgacctggtttggagaaattgtgctgaggattacaagagccctgtatcaatatggcttccaaggccaccggggggatacgtagctcttgggtgtgttgctgtcccttcattcaaggagcccactcttgactgtgctttctgtgtggatgagagactcgcggaggatgccgcgtatgaggagcaaatcatatgggcctcatcggatgcttacccatggggatgctatatctaccaagttcagagcgcctcaatgcagttcatggcacttcgtgtcccaaaagaacaatctgagctaaggcccaagaagatattggagtcatttctgcagcaagcatcagagactcaaacgtcccgtgcatgaagaagctgcacatgatgcttgtgcgtgcaagagaactcggctgggacaaagggcaagtctcgtgcaagaaagctcgaagaatgccacttctttcggatcactccatttctccgttgtcaaagcatacacagaggacagagccttgcatgccaacactcgggttgacggaagtgttgtatactagaatagtaggttaaaggttgtaaatgtaaagttttgtaacgtttgatatagtttttgtccagctacatttgttaaggcccatgtggacgtgggccatattagttgtggctacatattctactaagaagttctcaggactaatcatactttctctaatttaaggttgttaaggcccatgtggacgtgggccatactagttgtggctaaaaaaaaaaaaaaaaaaaacaaaaaaaaaaaaaaaa

SEQ ID NO: 8475 - DNA, 4742 bp, Zea mays
ggaagaaacgaacagggccttagcgggccgaacacggccgaccgtggtggcggatggccatgcacggatcaacacggatcaggtcggattggtactggttaaaatcgtgacgggcgtgtggtcgaacggacggacatctatacacaggatgctgttgctgtgtagattttggcatttaccggttccgtgctcgccaccctccatcgggaatggtgctgctggtcttggcgctggcgtgggtgggaactactagtagctaaccctagaccctagccaggactggggactcgcgatcctactagcttcacattttttccccccaccttttgatgccacccaacatgtatatttttcctgataatgtttttggctgctgctggccatctcgaagggagagaaatggggagagagagagacagcgagagcttgaagtgaccatgtactttgcttgacatgattgggcctcctccctcctaggacaagaggtcacagtcacagccgcagccgcaggaggcggagggaacagggaggggatagattacacccatcccattcaatggcttgagagggaaaggcagcaggcagcgagcccgtttttaaaaatccaaatccacctccactgctccagtccaggctctcttgcctctctcactgccattcctgtccttgaagctgaggcatccgggggagccaagaacacccgtcgcccgcttccgagatgaggctggatccttgaagcccgctggccgccttcgccgttcgccgttcgcctccggtgagttcgagttccccctttgactggccggtctcttgaagcttcagtttccgttgcgtattgctttttttttggttcctgatgagtctagactctagagcagcgtcccatcttcagattgcttgctgtactctttcgtgctccactactagttttctgaatgatacgcggtacattctttgttttgtttctccgatttattattcttttttttggattctaataaatctctgctatttgcttgcttcccctctcgcccaatgtctgatagggaaggaaatgaggtgagccaggtcgcgcggcactttccagcaagcttccgaagccttgtgattcggctgtagcaggcttctagccatggaggacgagcgaaaagctccgagctttctcgatgcgccgcccaaggatatcccaatcgccaccgccaagccgctcaccatccggaccagcgccgccgcgtccggatgcggcggctccgaccgctcctgccccatcttgccggccatctccatcacgccgcacctctactcgccgtcgccgccgtcgtccgcgttcgtgtccgcgctgcagtccccgtacatctcgccccgggttctcgacccgccgcctcctcctcctcctccgccggagccggcgcctcagccgcgccaggaagtcaggaccaccgccggcgccagcgccagcaccaccgcggcgccgtcgccgacgtcgtgctccaacggctcccactcggaggatatcgacgcgtcccgcacgccgccgtccgagcgctacgactacagcggcgtcgacgcggccaagatttccgacggcagcggctgcggcggcggcggcggcgctgggctcctgccgccgcgcgcgtcgttctcgttccccgtgccgcgggtgtccttcaccaggggctcggtcgcgtcgccgtcctccaacgccaagctccgcagctgcgacgtgtacatcggctaccacggcagcggcggcctctccaggttctgcaagtggctcaagtcggagctcgagttgcagggcatcgcctcgttcgtcgccgaccgcgccaagtactcggattcgcagagccatgaggttgccgaccggattatttgctccgtcgcgtttggcgtcgtggtggccaccgtgtcgagctttctcaacccgttcagcctcgaggagatcagattcttcgctcagaagaagaacctggtgcccatactgttcgacaccgagccggcagagatcgccgggcttttcgatggtagactggaggataaggaagcgaaggaggcgttcgaagggctgatgcggtgccacgaattcaagctcgaggcgaacgagagcgattcaagaggctgtgtgtcgaggacagtcacactgcttcggtccaagcttgggcggaagaacatcgccgagaaggagagcgaagcctctgatggcctgccttttccgcgcaaccggcattttgtgggaagggagaaggagctgagcgagatcgaaggcatgctctttggttcgaccgccgcgggtatccaggaagtggattgcccgagggcttccagtacaaatgagagatcgagcggcgtatctgatggatttgctgatgaggacagtgacaccgcgaggaaatctaatgccaggtacatcagtttggagatgcgcaagtgcaaggaacccacgcttgaggcttggattgacccagtgatcgagttaccatctggtaaaagcagaagcctgcagaggcagagatcaaggcacaggaggtcaaggtttcggtgcaacagcaagggctatagcggcggcgccaacatagtctgcatcaatggttctccgggcattggcaagactgagctggcattggagtttgcttgcaggtactcacagaggtacaagatggtgctgtggattggaggcgaagctcggtatctgaggcaaaacatactcaatgtatccatgaatctgggactggatatcagtgctgaggctgagaaggagaggggcaggatcaggagcttcgaggaacaggagttcgacgcgttccagcgggtgaagagggagctgttccgcgacgtgccctatctgctcataatcgacaatctcgagagcgagagggattggtgggaaggcaaggacctccatgacttcattccaaggaacaccggagcaacacatgtcatcgtgacaacacgtcttccacgcgtgatgaacctcgagccgatgcagctgccgcagctctcgtacatcgatgcgatggccttgatacaggggaagagaaagaaggactatctgcctgaagaagccgaagtcctcaggaagttcgatgagcggttaggcaggctgagctttggcctgtgggttgtcggttcgctgctttctgagctcatgatcgctccttcaactctgtttgaggctgttgatcgaatatcgctgaacgagaatctgttccccattggcgccaacgacgatggattctgccgcaacaattctttcttggtgaaggtcttggtcttctgctttgctctgatggaccgagcaaaaggaggaagccttacgtcaaggatggtcatcgctggttcttggttagctccaactcctgtatcgtccacgctactagctgcaaccgcgagcaagctaccgatgaaaggcagtggtatgcacctgtttggtgaatctctcaggactgcatttctatgtggcacacattgtttcctagctccaaacgggcggaaggctgaggtggagtcggcgctcttgcttgtcaaccttgggttggcaaggaaggcaaacaggcatcctggttgctggatccagttccatcctatcacgcagctcttcggcaagatcaggggaggtttggtgcctacgactgcagcagtgaatggagtgatgaggactggaaacccctcggtatactctgaccacttgtgggctagcgcgttcctcgtgtttggtttcaagtccgagccgcccgccgtccagcttaaggcggtcgacatggtcctcttcatcaagaagacggcgctgcccctcgcggtcgactccttcatgtcgttctcgcggtgcggctcggctctggagctgctcaaggtgtgcacgaacgtcctggaggaggtggagaagtcgtacgcgtcgcggatgcaggactggagccgcgggtcgctgtgctggaggaagaagctgcagccgaaccaccgcgtcgacgagctcgtctggcaggaggtgacgctgctcaaggcgacgctgctggagacgagggcgaagctgctgctccgcggcgggctgttcgacacgggcgaggagctgtgcaggacctgcatcagcatccggactgtcatgctcggccacggccacgcccagacgctagctgctcaggagacgctggcaaagctggtcaggtataggagcaaaatatgagatgagatgatggtgtccaagaccctttgcaagcttcttcccccctgctgtttcagaagttttcacgcccccatttttgttcctgaatctgttatgccaccggctacagttttgttagcgatcatcagtataatagccaaggtccatgatgccatgtgtaacttattttagagcaggtgccatatgtaagtggaggtgttatgtacagtgcagtccatctgctatttggtagaactaccattgagcttcccatgctgaactttcagaattgaagatgttcttccttttgataacttgagtttcagatttggagagcaaagagctgcatcacgccttagagttgctgtagggtgttgggttttctccaaaaaaaagcatgcatctatggtcaaatctgatgccaaacaacaagagcatgtagtctttctgaaatgttttctgtcaccctccatcatcaggtgggcggtacagctatgatatgaacagtcgttttgttaattagtttattaccacttgcggtagtgatttggtgtctgcaggcatgcaagaaaaaaaaaaaaaaaaa

SEQ ID NO: 8476 - DNA, 1041 bp, Zea mays
gcaattcccgcaatacctttaaccatgtcagctggtctattatttggtaatgtgactggtacaattattgtctcagtcggtggaacgctagctgcagcggtggccttccttattgctagatactttgccagagagagaattcttaaattggttgaaggaaataagaagtttctggcaattgataaggcaataggtgaaaatgggtttaaggttgttactttgctacgcttgagtcccctgttacctttctcccttgggaactatctatatggccttacttcagtgaagttcttgccgtatgtcttgggcagttggttgggaatgcttccaggttcatgggcttacgtcagtgccggtgcattcgggcgagctttaatccaagatgagtcggaaattggtttgggaggaaacgaacagctatggacactgggcgttggattattgtttacagccattgctgccgcttatgtaacgaggctcgcaaaggacgcttgaaaggagatcgacgactagaacggtaggattctctaggagaaagggccctctcctctggaaagtgtaaaaggaaacctcggaaaaataccacaaaacaatggtttccaaagaatatgcccgaatcagctcaacagcaggatgacaacccacaagatgaccccggaagaactgaaggtactagtgaaacacagctgatggtggttgggcagcaggagttcgaggatgtggtggttgggcagcaggacttcgagggatgtgaagctgttgaagttgggcagttaaccccacgaaggcacaaaaaaagaccagtaggaaagaagttgacgccgaaaaagaaaaatgtgtagctgtgtgtatttctgaaccagcagtgtgtatgtgtattaactatctcctgttttcagtgaactagatatctgtatgtgatttcagtttgaagctgtaatgtgtagtgaaccagaaatctgtatgtgtttgaagcagtgtgtttctggtgtttgaagcaaaaaaaagaaaaaaaaaactagagggggggcccggtaccca

SEQ ID NO: 8477 - DNA, 1347 bp, Zea mays
gcacgagaccattacctagaacatcctaatcgaaaactctccttcctctctcttctccagcgccttccccctgctccctcttatcgtctccgcgctctaaaatggcctcacactccgccacacagtaaacaaaacgacgggcccactccccgacggctgacgccctcccacggccccttccatgaggcagctgcacctctcgccgcagctctccccctccccggtcctctcctcttacttctcgccgccgccggcggaggcctcgtcctggcggcggcggctgcaccggggacgggccttccaaccgccgctctcctcgctgcgggatcccaacaaggccacgctccgcaaggcctcgtccaacgtccccttccgcctcggcggtggcgggagcggcagccccaaggaccgccgccccgccgacgacgacaaggcggaggaggaggccgagggcgagggcggcgcaggggcactcacggggacgctggtcgcaggagcgctactggttggtttcgtaggggggtttggggcggccggatacgtgtacaaggaccagatcaacaccttcctcacgcagttctcagggttcattgacggctatggtccagccggatatgctctgttcgtacttgtatatgcaggattggaggttctcgctattcccgcaatacctttaaccatgtcagctggtctattatttggtagtgtgaccggtacaattattgtttcaatcagtggaacactagctgcagcggtggccttccttattgctagatacttcgccagagatagaattcttaaattggttgaaggaaataagaagtttctggcaattgataaagcaataggtgaaaatggattcaaggttgtcactttgcttcgtttgagtcccctgttacctttctcccttggtaactatctatatggcctgacttcagtgaagttcttgccatatgtcttgggcagttggttgggaatgcttccaggttcatgggcttacgtcagcgctggtgcattcgggcgagctataattcaagaggagtcggaaattggttggggaggaaatggacagctatggacattgggtgttgggttattgtttacggccatggctgccgcttatgtaacaaggctcgcaaaggatgctgtaaaggagatcgatgactagaatagtaggattctctagtagaaagggccctctggagtctgatagtatactagcacatcgtacatcactggcacctttggtgcaatcaaatctaatagaaattcagagcaattttctgagtgaatttgcgcccttgatgtggtgccgattctcattgatcacaaaattcctatcccctt

SEQ ID NO: 8478 - DNA, 5409 bp, Zea mays
  misc_feature (5087)..(5087): n is a, c, g, or t
  misc_feature (5269)..(5269): n is a, c, g, or t
catacaccgatcaattcaacccaaaagttgaagtttataagtgaagtttcataattcacttatattatattcaaacacttccagccctattgagtcctccctaaccgaacaagctcttaatacatacaactaaaaactagttgtagtagtaatccaaaccggtaaaaaaacgtagaatttgaagactgtatctccatccatcatccggcaatttagtactggtactcttcagccagcaaggttcagtagcatatagatagatgcccaacaatctagccttctcaaatccatgcattcttttggaccagcggcgcggtttgataatcataggaacttttctgtccgccattattaccgtttcctcattcttcaatcatttcgatcgtggcagccgcgcgaggacagaaaaaagtatatttcccttcagcactggcaaagcaaagcaaagagaagagaagaggaggtggtggtggtggcaccgtggcagcagcagcagctcgagtgctcgacaaggcagtcaaagagaaagcccattccacccgtttccgctgtcctcctccctccattccaaattccattccatgtaaggttcatttctccctgcaccaccaacaacaggcgcacacatgcatgccgcatggccgcatgggccagcgctcttcagtagcatgctttgcattgctgccttgctggtgctggcttctgctcagcgctctccttcctctcctcctgcactgcactgcactgcacacacacacagcagtacagcacggtcccatatctattctcttgtttaccgcccccaacacgcctcgaaagccgtgcaagtgcgttttgcgttcctccacaaacatgcttcccattgtccatgcttccacaaggctccccctcaagctgccattgttaaacccatcgttttccttccttcccctctctgcccttgcagcagccatgtgagtgggggacttgggggggtggggggggggggctttgttgtatataagcaaccactcgtgctccccggccactgcttgcttcctctactactctcctccctcttggctcttgcagtgcaggcctctcctccgatccctcccacggtctcaccccaccgcctcgaccacacagctagcttaattagcttgcccctcctcacgctctcctcgcccgaatggggttcacggcgagctataggcggagtagctggccaatgtgcggcggcgacagaggaaaggtgcggctgcggctcgatggaaggcagcacacgcacaggtaggagaagggcgggcgtgcgaccgagcgtgcaccattggctcccactgcctgtcggctggaactcttctgctcgctcgacccatgagctgagcgcgagggaggaaagacgacgacgcagatggttcgagctagcttccgtggggaattgaggcttgatggtccgagatatatatataaatatctcttaggtatcttaactagcatgcagctgcttgtactaatctagattttcctagctagctacatcattttcatcttcttctcccccctttcttctcttctcgttctcccctgcgcttctttgttactgccattctgagaggacgcgcgtccaaacgggatgctcttgtctggctacctcctcctgctgctgctgcagtggcagtgccaaggcatctccgagttgtcctctaagtgatgtaataacaattaatattgttagaggcactatattaagtttggaatgctacattctgcaatgcctgtagtctctctgaactttgcagtttgccctctctgttccctgttgttagagaacttaattctcagctggacgcgccagcacgtactactagactagcacatgttggtttcttctcttcgtcgaacgggctgtagtcgtctgccatgttcttggtcgatggtatctcgttcgttcatgtgtcggtcggctctcagattcattcagatacagaggtgtgttctggatgcaggcatttcctcaagaaaatggtttggcattcacgttcagttggagctgcagacttgcagagcggctgtgaaagactgagatctttcgcagctacagaggtgttttctagcgagcgtcgtcgttttagaaagactctctttttcaagaagtaatagaagaggaagaaaaggaaaagggaaacaaaaaaaaactaagctgcggtattattaccttgcaccccacagacaggccacagaaagccgtcagagcagctcagacctcagacttctgaatcctggacggtcgagacacacctagtataggcaatgcgtgtagcgacggcaatccgtctggtcgccagtcgggggatgggctcaaggcgagtggcgctccatgcctgtatgctgccagcatgcaagcgtgaagagagagagagagagaggcggcatataggtcacacagtagactgtattgcagaccacgcgctagctataggcgagaaccgagacgacggccgacgacaggaacgcaggtagacaggggccgccccgggaggcaaggcaattggcatggcaaggcaacggcaccgcgcggcgctttagcgctctggctactgtggctgcgtcgccgcgctttgtcgttgcctcctccgaactctggcggttaatggcttgcgcagggaatattcagcggctgcgcaggggcctgccgcgctgcccctgcctctgcctcggctcgtgcatgcatgcaatggcgtcgcccgtgctctcccctcctctcctcatcctgcctgccgctttacgctttcgcttttaatcgctgtgacagcgctcgctcgcctcaccgtcaccgttgctgccgctggtggagtagatggatgggagcagcagccatctgccacagcccacaggcctgttgctactctgtccggcctttctgcactgtccgcctgcctacagcttccatggctcaccatgctttggcccgtcgatcgacctctccatggaacctgtgtaaaaaacgcgtgctgccccctgttggggccacaatgagacacgtacggaggtgtggaaatgccatggaactggactacgcgcccggccatgcacacgctgacacgcaggagaattaaagaagcgttccgtggaatgggaactgccgatttgatttgactgcggatcgacgcacctcgcgtgtgctggccggccgggagacatggacgacgtgcgcggccgatggaggggagggatcgagactgacgcttgcttgacaccactagcccacggagcgacggccggccaggacaggacccaagcttagagacgatgcacggccgatggagaaagatcgatactgactgactgacgcttgagaccacggagcgacggccattcttcgtgatccgcgacggcgcaaggcgtgttgtttggaagctagcgtccctgtccatataccctactacgtactctacctagtacagtcctagtagcgtgccagcagcatacggcggtggtgcttgccgacggtttgtcgatgtatagatccgtgcatgctctctctctcactcgctctagttttacgtgctctcactgttcagttgtacagcctttgaccgtgaattcccttttcctatccggtaatgaaatgcacatgtgcacctatatatgtgtacaaagtatggtatgaaatagggagtcagctaaataatgacggatcagtaaactcccgttcaagttcaagcggaagcagagcatcccatgcatttgcatatgccgttgctgctggcagagagcgtacgtacagtacattacatcctgcgctgccgctacattgtccctgctcctgctcctgaatacagtacagagccctctccgctccaggaaccgccgccgtcgggggactctagctgctagctggatagccgatagcctacacactgtgacactgtgttggcgctgttcagaccccgagtgtgtcctgtcctgtgcagtgctgtactccgtatcccaggaaagatcctgcggtgcgtgcgtgctagtatgcatgggcgcaagggtcaacggtttacacgggcaaggctctaatggagaaacaggaaggtcaccgggtgccgcagcaaatgccgcccagcaggccgtggagcacttgggctgcctgccgggacagggaccgggaccggatggggaagctgcctggctgctggctgctggctccgcccccccccccgccgcctgcagtcctcaaccgtgatcgatctgacgatctccgatatatgtatatatatatatatatagagagtcggaggtcagctggagacgtagatttgttcctttttgttttgttttcgcgagaaagacacggttaaaatactcaaaatactactacttaaaatggaacgggcgacgtaggtagaagagaaccaaggcaactgtccattcgtcggggtgagtttattttttcttttgaaaaaaacgctggaagacagagagagagagcgcgcgtcggcatggatgggacgcgggcggcagtggacagtgggtggcagcgcggacacgacacgacgtgtgatccgcgagatgctggcgccagtcacagccgcaggagcatgccattgccatcacaggtgcgctgcgcgacgggacgggacgggacgggacggcgggccggcggctggctgctctgccatgccgcgggccgcgccacacctcgccaggcgcgcgcgcgcgtgcggtgggcggggcagagccgagggaccggcacgcccgcgtgctgtcacgatcgagtaggtgggcggtgggcgggggcgcccgcgtgctgtcacgtacgacaactcgacgagtacagtagtcagcaccacgatcgagtatatagaagagagaagaggctgcctgcctgccggccgcggcggcggcgcgcgctccgctgggcgttgccagcaagctacggctgccgtctgcgggaggtcgaggcctgcctctgcctctgcctctccctctccctgcacccagcagtccaccatgctccgggcatcgctgtgacttggctgcaggcagcttattttcatttcactggtcgccgctcctctgacggggagcatcaggcaggaagccggtgccgtacnagacccatccaagcgataggagaactcacgacgtaattggttaacaaaaaattttacagattaaaatatataaagcaacaaagtcgttgtagtatagtggtgagtattcccgcctgtcacgcgggtgacccgggttcgatccccggcaacggcgattatttttttgacagttgttgccttantggactgggccgacatcttgccttttctgacagttgctttactgtgctgctggactgagaaggcagggccgacttatcgcacagttaaaatccaacgactgcgatcacgacgcgcaccaaacgtcatctctttttttttt

SEQ ID NO: 8479 - DNA, 5710 bp, Zea mays
  misc_feature (2499)..(2499): n is a, c, g, or t
ctgcagtgcagccagatgaaaacctacacatgggacgtgcagtgatctgcgatagcatgaaactcacgcagagcttgcaggccagctaataatgtattaatgccttgactggtcatgggaacggagaaaaggtagctgctttattagctcttgtctaggagtggatgagcgtgccgattagatcaagaagacgagacgttgatgttgaccgaaacctcacgtactcctacgctgtagtactaggaattaaacactggtaggtgaggctgtttcaattcaatgccctcgcagtcgcagctggttaatgcctctgcccgccggcgtctggagtctgccatggctctgggcaacccactaccagggttggccatttacaggattaccctttactgctgtctgcatccctgttgactgtttacgcgttctcttggccacattgctcgcgtagccatatatacacgtttattatatatctatatatattatgtacggtgtccatagtatactactgctgggtgctggccaatgtagacaacatgtagtggctgactgacaactacttgactgctacaggaatccaagcgctcagactcactcttactggagaccactatatggtttacctgtggcacatgcaaactctccaggggcattctcgggcaatgctttgtggccccacatgtcccagcttcatattcggtgctcgacgcacgcctgaccctgccagagtgccacctgccacggacacggagggagggaggtgtgccatcagcgcgcagcatcctccagccgatagcctctcactgcctcacttcagcctcggacctgaacagacctcaggaaaggggagacctggaacgaccgtcgagctagagcggctgcgcgctgcgccgagagctggggagtggggactggggaccgaattgaaggcaagaaagtagaaacgaaccaccacaggcggcgcggcaatggatgagcgcggggagaaggaggaggagcacggagtagtggaggaggagacggcggcggttgtgctcaaggaggtggaggtggagatggagatggtcggcggctctgaagaagcctcggcggcgccgctcctcctcgcgcacccgtgctcgctgctgcagctcctgctccgcgcctgcgccggctgcctggtgcgcctgctgcacggccactgcagcgacggcgccaacgacgacccaaaagctgctgccgacgacgacgacgctgcgcctgaagctgctgctgctgcggcggcggcggcgggcgatggcggcgacaaggcagccaccgtaagtgtcgttcgagaccaccgcttgatatatttgtcggtcgtacacgtaacgtacgtacggtaaccggtcggatcgatcatcgtgtaaacatgcatgcaaacctttgcagtacttgtacatgcaggaggtgtgggcagtgaggaggaggccgacgacgcccggccgtccgagagaaggttccggtggcttcggcgcgagccaccactagctagctagctctctagcgcgacgccgctgcaacgtacgtacggtgaccctagcttgttcgcttgcgcgtgatcagagtgcgtagcttcttgtaagttgtaacttacttggtactcgtactagatttcgaaagtaacgtcgttaattagtaagtagtactagtacgtgagtgtggtttatgttatatgttctgtagcttcaatgcaaagaagactgtgtgcatgtgtttgaggattattgtttcgactttcgccgaatgattccaggtagatgcggtagtatgtgattcacacgtcttatttcttggcagcgatccgaatgaaatcaccttggggccgggggcaggtcgggtgtttttattgaaacgaaaaggacgacgggaggcgaaaataaagcatacccgatcgagagggcagaaacgacagcgccaaccttgcactgcactggcgtcttggcagttggcacaacccatgcatgaccgaaactacttctgatgaaccacacgcgcgcgtgcacagctgcgcaggacgtacgcgaggacgacgaccaagtacatacgtgtgccccggtccggctatatattatcatatggcatgtcatgtggtttgcgacatacgctatatatcctaacctctagtccacacaagctcacaagctcgtgaaaccacgagggtcgactttaatatcatttataacacactatccacttttgggaccgatgatacttatttctgatagccctttaggaacatagacgatccccaaccgcgagacttttgtatgtactttttcctcactctcatgtgcaccccgagagaacttctcggtcgatcatttgtttcaagattgctctggaccaaccacacttaaccaaaaggttttttcgagatatgctttcgaaaaagaagatgcactttgttggtttgagtagccaaccatcgcactttgatgagtgtgtgtgggctaggtgtatgtggacatagtgtacatngcgcaagtgggccagtggtgatattgcatggcatatatgccaacactagaagcacagacatggcgagagccgggagggaaggatcctggcttcaagttgatcgacggggacgtcgatcttctaaaggggtggattgtgatgactcggcccatggtactcctaccaacaaggtgatccttttttcggaagctcctctccaaaaaaacatccaagttaaacgtgttttacttggagcaatttaggaatggtgactgatcggaaagtgttttcctagtgcacatgagtgagtacagagcgtgcagaaaagaccaatgttgatatgtgggacaatctaaacctataaaactgtcatgaatgacgaccgccaggtcaagataggtagtgtgttacatgttgcattgcatagaaaagaccaatattgatatgtggagcagtctaaacctataaagctatcgtgaatgacgacccgcctgcaggcccgaggtagctaaggtgttacacgttgcattgcatatagctagctgtagagtgtaaacctcacttttcgagattagattagtgtaggacatatgaaactacacatttaatttaaccctctcttctaccattctacctatacacataaattgaaaaaggcaataatactgcattccggagtgctcctcccacgcacatggatagtttgttagacatgcaggtgggttcaattcgggaaagctgatgatctcatgttctgagctgcatctcttcttttttttcgagacaaaactgttggcgaacgaagtggcttgactgttgacttgagtgcatcgtcaggtcaggaatccaaacatattctcgtgcactgcagtatttcctgtgcgctagcttgtacattccggttcgttcaactctctaccagtaccagtcccaggggcattccggacaatgctttgtggcgctcgcatgtcccattattcccgtcgtatataggcaaccatttggtgctcgacggcgccgtgtgccacctgctggctgctgccacggatgggagtcacaaatgttcccatgaacacatcatcggcatcctctcggtctcgtctcaggagcctccctgccggaaactaaagagtagtgtcacttacgagttagagacaccgtccccactccgctctccagaaactcccccgtcgtctagctaggcctaggcgcctagccacctcccaggaatggatcagcgcgtctcccaggaatcgtcgtcggatcgtcggcgcaagcgcaaagacgtcgcggcggcggtgccggagggcgtccacggagagtccacggacaacggcgggtacgacgatactgatgagaccgcgggtgtgctgaccaaggagcagcaggcggtggatgtggtcgaagaacaagcctcggcgccgctccagctcctgctccgcgcctgcgccggctgcctggtgggccttctgcgcggctaccgcagcgacccgaagccggccgccgccgccgctgctgcttctgtggccgcagaatcgccgcaggaaggagacaagccgtttggcagcgtaagtgttcgaggccaccgcttgattatttctccgtgctgtaacccgtagatggatgtgcaaccgttgcggtgtctgtacgtgcaggaggaggtgggcactcaggtgttggcggcgacgaggacgccgccgtggccgccgtgccctcctgaagaaggttccggtggcaatggaggcagccacaactagctagctagctactaggcatgcaaacgtacggccggtgatctctcttcggcttcgtcgcacgcttgtccgatgaacagacagctcctacgtacgtactacggagtatttcggtggcccaatcaggttgtaagtagagagaggtgcttaggttattagtagtattttttaataaataagtgtgtgtgtgtggctctgaggtttacgtgcttctccagatctctgaactccgaaacctagcagcgatgagccgatgattaaatgttaccggaacgacgatactagctttcagtaatttttgacgctacgactacgagaacgtgatatatttattcttcaggaaacgaaatgttcccggaacacgtttcgaaacggggccattggtatgtcaaggctaatttagaagtcacaaaatcagagtgaattagaggggctaaaatacctttcttattgaattttgaataagaataataaggagattttagcctctctagccttctccggttttttactcctaaactagcccttagattgttttcccaccccttttcccatgctgcctactgcacacaccgggtggagtgattaagtgaagaaaagaaaagaaaagaattgagcataggccgggtcattctgatttctgagcaaacgcgcgcgacacatgcatgccggaggcacaacgccgtatcttccgtaagcatagctatttatatcacgtgtgacatttgaaaaagacgaacgaataatagtcatttatatcatgtgggacattttaaaggaaacaagcatcttctaaaatagcatcttgtcacctatttatgtttggtttaaggagtcccccggtcccagatgagttctttgtactaccagtgctatttgtggacttacgaggacgaggggatgaggtgacgatgcatcggtttattttattttattatacaaaccaaacaaaacaagctgaagaggtggcacctgcacgaagcgtttccgtactgcaaaacagatgggaaagaaggcgcggcgggccgagccgggcatcggcacgtagcagtccgtgggtcgcctgcgtggtaccttcagcccgcttctgggccttccgtcacaaacctagcccacaccctccaccgatgcttcccgtcgtctgctagcaatggtggaaggtctgttggctttcagcgttttacatagacgcgccatccaacaaaggttttaaggcatccacgaaagtcgtccgacaaggaatttctctcacgagtgttaatagggatggcagtgactaaggtagctaaaagacgtacaaagttatactcatactcactatagaaaaaatgtgccatgctcatacccaccactactcattatggatacaaaattacgccatatatatacccaccacgggtagtgggtatccatcagttattcatactcactgacattacagtagacatgatcaattgaatcgtaaacaaaatttgaaa

SEQ ID NO: 8480 - DNA, 951 bp, Zea mays
agcctctcactgcctcacttcagccttggacctgaacagacctcaggaaaggggagaccctgcaaagagcgtcgagctagagcggctgcgcgctgcgccgagagctagtcactgggggaccgaatcgaaggcaaattagaaacgaaccaccacaggcggcgcggcaatggatgagcgcggggagaaggatgaggaggagcacggagtagcggaggaggagatggcggcggttgtgctcaaggaggtggaggtggagatggtcggcggctctgaagaagcctcggcggcgccgctcctcctcgcgcacccgtgctcggtgctgcagctcctgctccgcgcctgcgccggctgcctggtgcgcctgctgcacggccactgcagcgacggcgacgacgccgacccaaaggccgctgccgacgacgacgacgacgctgcgcctgaagctgcggcggcggcggccgatggcggcgacaaggcagctacctacttgtacatgcaggaggtgtgggcagtgaggaggaggccgacgacgcccggccgtccgagagaaggttccggtggcaatggagggaaccaccactagcgcgacgctgcaacgtacgtacggtgaccctagcttgttcgcttgtgcgtgatcagagtgcgtagcttcttgtaagttgtaacttacttggtactagatttcgaaagtaacgttgttaattagtactcctccgtttcttttttgttgtcgctggatagttcaattttgcactatctagcgacaattaaaacgaaacggagtgagtaagtagtactagtacgtgagtgtggtttatgttatatgttctgtatcttcaatgcaaagaagactgtgcatgtggaagtgttttgtacccttgctagttaaatgtgttcaagacacaggcagtattattcgtcgcatgcgctgggcgggcgtggttatatttt

SEQ ID NO: 8481 - DNA, 2055 bp, Zea mays
ctgcagcggctacagaaattgaactgaccgaagccaattttttaaatttaattattttgtagaaaatactaccaacatttatatctttagctaagattgttaaaatactatattcactaattaatacaacaatattttaatatcataagtatcatttttatataaacttaagcaaaattaaaattatttgaaaagtgaaagtgggaatcgcatgacccggagcaccggccgaagcaggccggaaacccagcccgagaaaggaggaagaaaaactagaaaccctagcgatgctgcagatccgcctgagcaagattggctcgtcggactccggcggtgccgccgctagcacggcagctggcgccggcgcccccgccgcggttggggcggctgcggcgctcggcggcagcatcctggaatcggtcaccgtggcatgccccgaccacctcgtgatcgcggacctccccgtcgcgaagagcctcggcgccgtcacggcctccgctgccgccgccacgcgcgccatcggccgtcgctcccgtcgcccgctcggggagcgcgtccacatctgttcccgctgcgagttccccatcgccatctacggccgcctcatcccttgtgacccggcccccgccgggtcctgggcacgaagcgattctagctgctatctttgtgatgagcgcattcagaagatacaaagtgtgaaaatgatggaggggattttcatctgtgctgcaccaatgtgtctcaaatcgttccttaagaaagcagattttgagttccatgtgcctgatgtccatgccaacctcctccaaactaatctagagaaggaagaagaacgcaatgagtcagatgctcctaacatcccctgtgcttctgcaggggatactcaaagacaatctcaaatgcctgaaatgtctactgcacgtgctcctcctccaaggccaggtgtttcacaagatcgtgaagaacgctcccgctaccaccagtccagggagcaaacaccactgaggcctccacccctttcaaaaccaccgttccatggtcgccattcttacccaccaggggatactcaggccgagaacaatccacctcaaggattcgaccggccatacaactgggcttctcaatcacgtcaggagagcccaggtgcggtgactccacttcgccaagaatctgaccacagtactcaggacaggcagcaattgatggctaatgcaccttttatgttcccgccgattcctcctcaccagggaaactttatgatgcctatgaatatgaatcagcctttgatctccaacgcaccattcaattaccctctccagcaagatggaaaccctcagtacttttctgcccctttccagatgccgccgctaccagatactggatcagaccaaggttccatgtcaagtgtccagcctccagttggccctatgagcttccctgaggggcttcagcgcccatgggctatggggatgatgggtaatccatttcacccgatggcccttggtcagggaatggttgatggtgcgggtgatcctcagggtggtggtggccttgccttcatgcaagctggttttgggggcatgcctgatggctccatgaatacaggcatgcccgatagaggtgatggaaggggtgttcgagcacagatgcccacgccaatgcaaatgcagatgtcacttcccccacctccgcctacacaacctccatcaggctcgcagcaaacatttaacaggacttgatatattttgttttgcacgaatcgatggttcctctcaaaattccatgtcaattcattgaggaaactgtaattttatcgtctttggcatgtaacctgtgagaactagatggctcagttctattccctggtttgataggagcctgtgtattatgctgtaactgtcctgtttgaatgaagtgttcccaagttacgaaattttagttcagggtgattggttgtactaccgttcacaaatatttgaacatatgacgtcgttcgtcttattcagaatatttatttgaaaatataaaatttcaagttaaaaaaaaaaaaaaaaa

SEQ ID NO: 8482 - DNA, 1133 bp, Zea mays
ctgcagcggctacagaaattgaactgaccgaagccaattttttaaatttaattattttgtagaaaatactaccaacatttatatctttagctaagattgtcaaaatactatattccctaattaatacaacaatattttaatatcataagtatcatttttatataaacttaagcaaaattaaaattatttgaaaagtgaaagtgggaatcgcatgacccggagcaccggccgaaacccagcccgagaaaggaggaagaaaaactagaaaccctagcgatgctgcagatccgcctgagcaagattggctcgtcggactccggcggtgccgccgctagcacggcagctggcgccggcgcccccgccgcggttggggcggctgcggcgctcggcggcagcatcctggaatcggtcaccgtggcatgccccgaccacctcgtgatcgcggacctccccgtcgcgaagagcctcggcgccgtcacggcctccgctgccgccgccacgcgcgccatcggccgtcgctcccgtcgcccgctcggggagcgcgtccacatctgctcccgctgcgagttccccatcgccatctacggccgcctcgtacggacttgctaagcccttttcttttatgcggctatcaaacctcgaacatgttccgctcgtgttgctgctaaggaaattagaggtttagttaaccgcgtgtgttgttgagccatttaccaccacaaaccctactattcctctgttgatagcataagtgaaaatggagcagcggatgtgcatcatttttgttttatgcgcctgtgtttagactgttggacaaaaataccgatacttattgtagtagctcagcgggaatggctattgcctcagtgttctagcgattccattgtaaggagtgccaatgttatctcgttctgtttctggcagacagtcaagggaagctaagatctactggttagcgattgaatgaaggcagtattgccgttctcttacaatgctagtacatctatttgactatttgttttaatggaccacacaggatttgctttttggtgatactgacctaaggaatggataaatagactactcacagtttcattcaattgcgtcatgaaataatattttggcttcggggg

SEQ ID NO: 8483 - DNA, 991 bp, Zea mays
  misc_feature (927)..(927): n is a, c, g, or t
  misc_feature (946)..(946): n is a, c, g, or t
tcgaggccgggccgggggggtacctcgaggccggccggaaacccagcccgagaaaggaggaagaaaaactagaaaccctagcgatgctgcagatccgcctgagcaagattggctcgtcggactccggcggtgccgccgctagcacggcagctggcgccggcgcccccgccgcggttggggcggctgcggcgctcggcggcagcatcctggaatcggtcaccgtggcatgccccgaccacctcgtgatcgcggacctccccgtcgcgaagagcctcggtgccgtcacggcctccgctgccgccgccacgcgcgccatcggccgtcgctcccgtcgcccgctcggggagcgcgtccacatctgctcccgctgcgagttccccatcgccatctacggccgcctcatcccttgtgaacatgccttctgtttatcctgtgcaagaagcgattctagctgctatctttgtgatgagcgcattcagaagatacaaagtgtgaaaatgatggaggggattttcatctgtgctgcaccaatgtgtctcaaatcgttccttaagaaagcagattttgagttccatgtgcctgatgtccatgccaacctcctccaaactaatctagagaaggaagaagaacgcaatgagtcagatgctcctaacatcccctgtgcttctgcaggggatactcaaagacaatctcaaatgcctgaaatgtctactgcacgtgctcctcctccaaggccaggtgtttcacaagatcgtgaagaacgctcccgctaccaccagtccagggagcaaacaccactgaggcctccacccctttcaaaaccaccgttccatggtcgccattcttacccaccaggggatactcaggccgagaacaatccacctcaaggattcgaccggccatacaactgggcttctcaatcacgtnaggagagcccaggtgcggngactccacttcgccaagaatctgaccacagtactcaggacaggca

SEQ ID NO: 8484 - DNA, 880 bp, Zea mays
  misc_feature (2)..(2): n is a, c, g, or t
gnagaaatggagagttgcagttgacattaagattggatccggcgcgtggggacagtggcagatttctggaaaaccttgcactcatgcaatagctctatttgggaaacttagaaaccttaacattgaggactttgtggatgactactattcaattgagaggttcaaaatggcttatcagtttgtggtcgctccgatgggtgacaagactcaatggccaaaatttgaccctgggtttaaaatggttcctccaaagctagaaaggcctgctggtagaccaagaaagaaaagaatcaaggctagtggagaggcaggaaaaagaggcccatatcagtgcaaaaggtgttttcagtttggacatatagagaagggttgtactgctactcaagctgaattagaacaagagcttccaccacctcatccaaagaaaccaaaaaaacaaagaaaatccaaatctgaagctgttgaagtctctatggttgatgtcgagccatctcaaaccgacggtgttccaaaagtgatgtctagcccaggtgtaacaacaagaagcatgtcttctgcttctccaactagtccaggtcctacaacaaggaggaaggcatccatctcaccaggaggaattaatcggaggctcattattagctagatatagtagttgtcattctctattttgtgtgtgggcatggctgtgcaactattttgtgtaactatttttccgctatgcaacactatgtctgatggtggtgcttctatattctgaattgcaagaactcatttaaatgttgcagttatggtactgaaatggcatcaaaattatatatatatatatatatatatatatattgtgtccaaatgtaattgaaatggaggttggactacaact

SEQ ID NO: 8485 - DNA, 6083 bp, Zea mays
acaagcaagaagaagggacgagaggcttccactacttggatatctcaaaaaggtaaggatgttgtaaaagaggatcctactttgggcgcgaagacgttacaaaaaagattggagagacactacaacattcaattggcgtgctcgcggccgtggtccgcggggaagtctgcgatggaagatattcatgggacttgggaggagagcttcgaaatgctatggagattcaaagcagcactagaaaattcatgccaaggaaccattattgagattgattgcaagaagattgatgggcaaatgcatttctctaggatgtttgtggcaattagagcatgtgttgatggatttctaactgggtgcaggccttaccttggggttgattctactcacttaactgggaaatataaagggcagttagccacagcaactgcaattgatgggcacaattggatgtatccagttgcatatgggatatttggcaaggagacaaattccaattgggcatggtttatggcacaactaaaaagagcaattgggaattcccctggattaacaatccacactgatgcttgtaaaggattagcctatgctgtgaacaaggttttcaaaggtgatgtggaacaccgtgagtgttttaggcacctaatggctaatttcaggaaaaaaatcaagggtgatgtgctgaagtatatgtggccttgtgcatgggcatgtacagatcatatgtatgatacactaatggagaaaattgcagcatctagtcctaaagcaattcactttctaaacaataaccacaagctaaaatggagtagatctaaattctccaaagaatgcaaggttgattatgtgaacaataacatctcagaatgcttcaacaattggattaaagattacaaagatctcccagtcgctgatctaatggataagattagggagaaaattatggagaagatttatacaaggcaagagatagccaatcgaatggaagggcgtatcctacaaagtgtgatacatgagttgaacatgaagagcagaggattgcactatgaaatcgtgaagagtggactgttgtcagctgagatatcaggaataacaaaagaagggaagaattggagagttgcagctgacattaagaaaagaacttgtggatgtggacagtggcagatttctggaaaaccttgcactcatgcaatagctctatttgggaaacttagaaaccttaacattgaggactttgtggatgactactattcaattgagaggttcaaaatggcttatcagtttgtggtcgctccgatgggtgacaagactcaatggccaaaatttgaccctgggtttaaaatggttcctccaaagctagaaaggcctgctggtagaccaagaaagaaaagaatcaaggctagtggagaggcaggaaaaagaggcccatatcagtgcaaaaggtgttttcagtttggacatatagagaagggttgtactgctactcaagctgaattagaacaagagcttccaccacctcatccaaagaaaccaaaaaaacaaaggtactgtaatacaacatgttccttgtgtagtgcattatttcccatgtctaacccatgttgtacctcctagaaaatccaaatctgaagctgttgaagtctctatggttgatgtcgagccatctcaaaccgacggtgttccaaaagtgatgtctagcccaggtgtaacaacaagaagcatgtcttctgcttctccaactagtccaggtcctacaacaaggaggaaggcatccatctcaccaggaggaattaatcggaggctcattattagctagatatagtagttgtcattctctattttgtgtgtgggcatggctgtgcaactattttgtgtaactattttgccgctatgcaacactatgtctgatggtggtgcttctatattctgaattgcaagaactcatttaaatgttgcagttatggtactgaaatggcgtcaaaattatatatatatggccccttgggcctatattgtgtccaaatgtaattgaaatggaggttggactacaactatattgctgctcaaatctatttctcagcaaagggcataatggtcagagttaacattcacttaacagaaaggaacggaaatggtaaggttcaaagaagttcaatcttttagtggtacatatcaatagatgattcttttaatggtatatatctaaagatggggtcttttaatggtatggatctaattttccctgatttttatgattaatcatgttttatatgtcaacaccataatgttaatttatgaaattaaaatgattaaaaatgcttatatttctaacatccgtaacatgtaaatctatctcgggcaatatcagcatgtcccgcaaattcaaggaacacagcgcagtttcgagaatttccttccatgaactgaacttgtgcgtgttaccgtgatatgcggtgtgttttacaagttgacagacgaaaccgcgatgcctggaggtccatggtgccaccgtggaaaagacagatcaaacattcaaaggctccacagaactagattccaggttcgtcggacgcatccatggtggcctataagcgcagattgcatcgtcaacgtcgccttcagtcgtaccctcagcctcatcaagctcattggcagcctgatgaagatacgtacatatgcaagagagatggcaagattagttatcacaatttgcgaagtcatgtttaacaagttaagaagaaaccgacgtacctggactggtcgatgcctgaaagttggaagaaaccgggccttgcagtactcgttgaaaaggatgttgagcacaagcaagggaactgtggccaaggaggctcctggcttcgacttgagcccaaacagtcctatcatggtgacttgcatgagcgctattgataggaatatgtagtggtgaattttgggccagtactgcccgcatgtgtcgtatgtgatctcataaacatcttccatctgcataacataaattgatattttgatcaagtcatactgattgatacatctgaaatcacagagcaggaaggataggagagctgtgcgaacagattacctggttgatgtacactgcgtaaccgagcaggaagtacaccagaaggatcgggagcagaaggggcgcaaccacagcgtacaccactccgatcaatattgcgatggaaaccacgggcacgactcggaagtaagggaagccatacagatatggttcctcgctgtgtccaattgaacgcgcctttaaaaactgccatatcaacagaccgaactgaaggacctccaaggagaaccctgacatgccgttggtcaagatgtacgtgatgaagaaatccgactgcacaccacaaaaggaaggaaagcagacagagtaaaacgctgtttcaagaaagcaagaacgcgatgcacatgaaccttggtcacctgcgcagaaacagcgctcgcgagacggttggggatgttcttggggtgcgtgaaggactctccgatctggtcgagcagagagcccgagagaacgctgaggaagaacacgtttccgagcaagaagtagaagaccatgtcgcaggccctgatctccctctggctgctggcgacgcagccttcgaacgaggccatgccgagcatcgcggaaggaaccaggtagatgaagccgttcaggatcatgcccggaaggtacccggtcaccacggagttcaagccaggtctgcaaggcaatcgacagatccacgttacagcagagcagcacagccacgattggatttggatcccaggtctctggaactcacatgagctgcacagctcgcgccggcgggaaccacctcttcatcttctcgaactgcgctatcccctgcacggccgttacggggatggtgaagaacaccgtcagcaagaccgcggcagcgaagactccgagcctgtacgtagccatgcgccagaacgggatggacaggttcttccatatcgtgtccgttggttcgggcgcgtaggttgtgaccagcgacagtggattggcgagctgctgcgtctccgcagcttgggcagcctccaaccgggatttgaacgacacaaaggctacaggtacctcctaagagttaaaactgatatgaattaaacctttttttatggaaataccagtattgtctgtttggcacaagcaaatggagtaaatgacacaccatcgttaccttttgtttaagcatattttcacactgtaggaggcggatagtatcttgcacatttttcagtttctcttcatggttgtgaatgcctgttgcatccgatgtaaacttgctccagatccgtcccaagagactacatttactggtctcccttttcctctgtatccgtttctcaatggaggacgccagcttctgtaatgatgattacatgactagccaataaagaaaaacactatcacgctaagtctgttttgactgaaaaaaaaaatcaactgccatataaatttctgcataatgctaggaaaatttgcgacaaacagtagcatcgaaacttcgatgttcataattccactagtgcactgtccagaaaatatgatcacattttatgacaaacagtagcatcaaaaactctattttagtttccatatttagcaatttagagactaaaatggaataaaatgaaaggactaaaaatcagttcctagaaaccaaacaccccctaagtcggtcgcagatcagaatcatggtccttgtctactcacctgcaatgcctcaatgtttcctatgtcatgtacgatttggtatgatcggtatgtccgataatgctttgagaagaagtgatccacataacacccgtaagccccatggtctggacatgttggaattcctcgcaccaaaacggtgtattgatcatatcttttgtagtgatgcttcaagtgctcaattcttctcatagtaatttctctgtattcctgcttcaaattaaatggaagatgtcaatgacaccatccagattatccatgcgtcaacatgtagcttcaactaatgatgaactgacacttgtctaaccaaatcaccaaatcgcctactccctccgcccacgtgatttagatgttttggatttgttctaagtcaaactattcgaactttgaccaataatatatatatatatatatatatatatatatatataattaaactattttaaactaaaagaattatatgttatgatagttcaagttataatgaatctagtaactatactttaatgttgtaaaatcttatgaaacatctgatataaccgatcaaagttgatagtaattgacctaggacaaacccaaaatgactaattcatgcggacggagggagtaatgagctttatagttgatgtgcacaaggctacacttttcagagatggatataactgatagaaaataaaacaaatccttggtttagggattacagagcaataatctgctttgagattccaattactggcataacaattagatacatgacaaccctaatcccatgccaccatattactgttttccttaatttaataaaaacagaaactgcagggttttccattttttctgtatgaagaatagaataggtatacatgctaacaacaaggagattggttaagcattgttgggccttaagcatgataataacagtaccttacaagaaaaaaaactcacaagtgggttgattaaaatgctttcaaaccactaaccttatgaagcaaatataccacatacaaggatataaagcaaaggcatgaataatgcacccaaagcctgccatgcacaacataaactatttcagttacaaaatcaacaccattcccacttgctaggcaatacctgtcaagctctgattttcccaatttactaacatggttctagctacattagaaacggtacaattacatcagcataaattaaagcaccatttcatataatcagagagtaatttacagtggcctgctttctctctctctctctctctctctctctctctctctatatatatatatatatatatatatatatatatgtcacgtgattgcttccgagaagacatccagcggaaccttcaagcgag

SEQ ID NO: 8486 - DNA, 1040 bp, Zea mays
ccggccgggacgtccgcgaactcccctgcttctctggatttcctttcgctgcccccccggcgcgccacccacccacccaaactcctcgtgcgcctcgtggattcgtgggtcgcgactcgcgaccagacgacaaacgtcgagaggggccgatcgtgatcgagcagcgatgtcgacgtcgcggaggcggacactgctcaaggtcatcgtccttggcgacagcggggtcgggaagacgtcgctgatgaaccaatatgtccacaaaaagttcagtcagcagtacaaagctacaatcggtgcagatttcgtcacaaaggaggttctgatcgaagacaggctagtcacgttgcagatatgggacaccgcggggcaggagagattccagagtcttggggttgcattctacagaggggccgattgctgtgtgctcgtctatgatgttaactctaacaggtcatttgatacactcaatacatggcatgatgaattcctcaaccaagctagcccatcagatcctaaaacttttcccttcatcttactcggtaacaagattgatgtagatggtggaaaaagcagagtggtttctgataagaaagcaatggagtggtgtgcttctaaaggcaatatcccttattttgaaacttctgcaaaagaggactacaatgttgacaatgctttcctgactgttgccaagcttgctctagagcatgagcgcgatcaggacatttacttccagagtgttgcggatcctgtccctgagactgagcagagaagcggatgtgcatgctagtagttagtcatcatccttgtcccttccagatcttgcttattgattgcggcatactttttctgcgatgccgagcaggcattctttccatttttcgcaatgtacactaatgttccaaccgtccaacactgttcttctatccagctgtatgatagttactgagcatggtttttttttttgtacgcggtctactgatttggtggccagccaattcttggtttgggcaataagaatacactggtttagacttttcagg

SEQ ID NO: 8487 - DNA, 4419 bp, Zea mays
cctcgaggccggccgggaccatctctgctcgctcgcccgctcgcggctcgtcgtccgccagacgcccagaccgccgcctccaaaagtcccagcaccgtgccaccgtctgctcgcgcgctcctcctccgtgcgcaaccgcatcacgcggcggcatggttgactgcccgcggctgcttctgccgccccctcgcgtcgctgccgctcaatacacgcgctgcgccgctggatgttggtcgaacccgggacgcgctcccttctccgtttctttcagccacctccgccgctggtggagctacgcttctgtgcgatcctcgtcctctggggccggaagccagtcaagcgttgcggatgaaccagaggctgcagaatgggccttgcaggatttctacattttgcggaaggatgttgagttggctcttgagcgtgtcaatgaagtcaggcagtctgccggtttgcaacagctcgaggaggatatcgcttcgcttgagaacaagtccagtgatagttccttatgggatgatccttccaaggcacaggggatacttgtttctctgacagaggtcaaagacaaagtgaagcttctcaacgatttcaagttacagattgaagaagcagagactattgtgaagcttacagaagaattagattctatagatactggtcttcttgaggaggcctcaaagattataaaggcattaaataaggcattagacaactttgagatgacacagcttctttctggaccatatgataaggaaggtgctgtaattaatatttctgctggcgctggtggcactgacgctcaggattgggctgacatgttactaaggatgtatgtaagatggggagagaagcagcgttataagacacgagtagttgagaaatcacctggtgaagaggccggtataaaatcagcaactgttgaactagagggaagatatgcttatggctatctctctggcgagaaagggacacacaggattgtccgtcaatcaccatttaatgctaaagggcttcggcagacaagctttgctggtgttgaggttatgcctcttctaccagaggaatccatggctgtggacatacctgaagaggacctggagataagcttcacaagagctggaggtaaaggaggccagaacgtgaacaaggtggaaacggctgttcgcatggttcatattccaactggaattgcagttcgttgctcagaggagaggagccagctggccaacaaaataaaggccctcagccggctcaaagcgaagctgctggtgatcgccctggagcagcgtgcatcagaaatcaagcagatccgtggagacattgtgaaggcagagtgggggcagcagatacgcaactacgtcttccacccctacaagctcgtcaaggatgtcaggacagggtgtgagacgtcggacatcactggcgtaatggatggagagctagatccctttatcagagcataccttaagtacaagctaactgcggcagctaccagctgattttgttggggagcatagcgatgagtgatacttacatccattgtattatgttgtagtatgagtttttcatctctctctctctcttgatttagtataatttcatagcactagcaatctagcattgtatttattgatctaggaatcgaagtggaaacatgggttttgcttcgagttctacaataagagtttgatcgaattgcatgacttgataaagacctcttgctagttccataaattgtattgaaatgaatatacgggttcttgttggtatgagatgtttgttatgttccgtttgtttccttttattttttatgaattgaaatcttactaataaaatagactattttttttagaatatgacattccaccactttctaaagttatcatataagactatctcaaattcatgagatgagagatagaaattaattctatagatttacatgttatttttccaatgtacaacttatatcacactcttctacttttttcgttataacataaatgtagtatataactatctctctcatatgatttaggataatatataaatatattacatatataaatatatgaacttaattagttttgtctaaattataattattaaaatgaaatttaattctagcgaaacaaattgggccttatagaaaaaatttaggatttggttcatatccataccaaatcatcacccctataattacaacatgctatcatatttttttgttccagttattgcaggcaaatgagcttttacattcttatgaaggaaacatccttagtcaacggccatggagtcggcataaccccggcttggaagttggaaagcatgattccatgaaaatttcaggaatctcaaacagcatcacgatccatcgctgggtttttaaatatgcttcgtctcgtacaaagattaatctgctaagttatcaggaacccaaaacacatccaagcaggagccatcgcatgcttcagccattgatagcgtcattctgattggtgtatcggagatccagcctgtccttgcgacatggtgaaagcagagcggttgcaaccgagcaggtctctgcttttgacgtcttccttcacactctggaagaacgagaaagcgcgcggcattgttggaatgctgaacatcatctgaattgaaagtaggtcaatctaaatcaaaaaaaatccgtaattgaacagattcaaaaaaaatctctaattaagcacgccacgcatttttgtccggtaacaggatcaaaaaaacttattaaatttgccatcatagaactccaccgctacacctacttgttcaacactatatttaaatttatataacaagattttgtctctttgggtttcttcgtgacattctgcattaaccattaagcgtttctttaggagctaaacttacatccatctatatttctaaaaaaaatcttgtgttttccatttccacatttgaaacggacatgaatataacgtgtataggataagatgaaagataacttccatttcactactgcaggcttgcaaacacacactaattcatcccaaatttgatggtttaactctattgtgatgacaatactctaggggaggttcttaaaaaatagccctatgccagaatgaaaaaatctcgacacctcttatttgactttttaaccgttctctttttatagggctaaaaacaaattactttttttttggcttttagctctatattatagggtggatctcgaaaaataagaaagatctccctccaagccatacatatgacttttatctttcccatcacctcaactatgcacctcatcttctaattccttccattcaaccaaagaatttcataggatgattcttaaatctaaatcagctaattttctttaataacacatgctcatgttgttatttctcgatttcaaaacgttgcaaagagaacgctaggctcgtagctgcagccaggatcagctctggcccatctatcactatacaacttaacctaaagaaggttgcaacggatcgaggtgcacattttgtgtgttctcgggcccttgctatggtttctctagctccggtcatcatggttgtaccttagctctcaaaaccatggtgcaaggccccactttaatgttagcatcgagcaccatgtcatctactaaaacaacgccatgaagcataggacatgggcctcgattgcagctccttgctccaatgcttcccgctatgttccttgcatcccatgttgctgacatggattacccgttcgagacctggtgcatggaactctccccctcacttcacaaagtggtctagccacaatttttttgccctcatcttcgggaaaagtacgatgggatgatcaatcacactaagttcgtctagatctacactactgccatcctcgttgttggggcgatgaagagatcatggtgaatttttttcatgtggctctggttagcttggtccgatcatgacttataaacctcctcaagacctccatctagtcttggcaagaattctgtcgctagttcgggtccaggttcgagagcacatactcctgctcgtttcaaagtttgatctccatgttatccaatagcaacctagtgagtccttgaacaccttttgtacaatgttttttgctaggttcgaaacactattcttcgtgtctccaccgcctctattgtcatcgccttctagtaggacatccacgataaaaagatactcgagaagttggccacccgcaacatccaggatgttagagagctagtctctcttgtggacaagtgtgcttggggtgctaagggtagagtatgtcaatgcttcctgtaagacacaattagggatgcacaaccttaggacctcccaaaccaagccttaaaaagggaaaaagaagagcagggtatcgagggtcccccaagtttgtgct

SEQ ID NO: 8488 - DNA, 3833 bp, Zea mays
  misc_feature (219)..(219): n is a, c, g, or t
  misc_feature (947)..(947): n is a, c, g, or t
  misc_feature (1072)..(1072): n is a, c, g, or t
gattgaagattgttgaatgatgcggtgtcacttacagttaggggttgttgcagcaaggctggcaaggtgtcatagtctatttcattctcctagatgaccttttggtggcgatctatcctaaagtgccagaggtaccactttcccatcaactcgtgcttgtgagcttgttgtcagtggaactcctcttcccacttcttaattcatatagtattctttaanaagaaattcctcatgctcagttgtaggagcgactccttccctgcatcgttccggacgattagtgtcctaggccggatggtccacgatggcgcatggtcctcttcctcctcacggagacctagatgtcgcccctaagggagagagatcttgggattgtcttggggacctgcaagccatcaagacaaataaagttgaagatctttagaggacgttcctaaacgtaatggttgaactagatcttgcccctgggtggggtaagattctagggtcgtcttgtagtcggcaggccatgcaaaacggatctaaacgatgtagagtcaaatagaagtgcaggtggatatacgtaaagctacaactaaggttatgttatatctactgatagggcagaaatgataaagaaaagataaataaaataatagattgattcgattgtaatatgttcgtgggttgtcaatcggccgtacccctttatatttataagggatgaggtctgaacatgttcataggcgagatccaatagatctctacgaataggttaggataaccacacatgttataagtattctcgctcatacttatctagtcgcgaaggcgtggactgtctgtccgaccgtgcctaggtgtcaagatgctcaacataaccattctgttttaaactactcttaccatttcagtcttgatcaaaatgttgtttctcgtagttggtagcacttgtggctggaagtggnacgaacaaatggctagctgctcccgtcgttggtagcaactactactatcgttttcggcagtgcactggcatacttatgacctttgtccccacgtgatcgacagtagaaccttcttcatcggtgcngatcgattcattgtctgtatcacgtcgaatatatacatatccaaataaagcctctcgaaggcccgccgggctatatatcattgggtgcgcggagccgggccggggagcacacacatcctctaagtgctatctaatctacaatctaccaccagacactgtcgtcagtcgtccctcatcaaccgcgcgcgcgcgacttcaagcatcagactaccataatcatggctccgccgccggcaatgcagagcccaggagagctaaacgacggcgcctacgacgcgccgcacatcctattcatcccgagcgccggcataggacacctgacccccgtcttccgcgtcatcgccggcttctcgagccggggcatcgacgtctccgtcgtgaccgtgctgcccaccgtgtctgccgccgagactgactacttcaacggcctcttcgcagattaccccgccgtccgccgcgtcgacatgcacctattgccgctggacgcctccgaattcacgagagaggacccgttcttcctccggtgggaggccctgcgccgctccgtccacctcctccgccccatcatcaccgacgccgcgccgcgcatcacggccatcatcaccgacatcaccctgacctcctgcgtcatccccatcgccaaggagctggacgtcccgtgccacgttctcttccccacagccgccaccatgctctcgctcaacgcctactaccccgtctatctcgagaagctcaagggtggaccggagccaggcgtgatcggcgacgccgtcgacatccccggcgtgttccgcgtcccgcgctccgccctcccgccggcgctcctcgacgtgaacaagctcttcacgaagcagttcatcgacaacggcagagcgatcgtcaaagccgacggcgtcctcgtcaacacgttcgacgccgtggagccggcaccgctggcagccctgagaggcggcaagatcgtccccgggtacccgccggtgtacaccatcggcccactcaagtcgcacgccacgaaagcgggcgacaagccaggtgacgcgttgcttgacgaatggctaggtaagcagcgagcgcgatctgtggtgtacgtggcgttcggcaaccgcagcgctgccaggctggaccagatccgggagatcgccgccgggctggaggacagtggctatcctttcctgtgggtgctcaagaccacgaaggtggaccgggaggacgacgccgagctggcggaggtgcttggagacggataccttgagcgcgtgaaagggcgcggcatcgtgaccaaggggtgggtggagcaggaggagctgctgaaacacccggctgtgggcatgttcgtgagccacggcgggtggaactcggcgctggaggcgtcgtccgccggcgtgccgctgctggtgtggccgcagctcggcgaccaccgcgtgaacgcgatggcggcagtgagggcaggcatcggggcgtgggcggagcactggagctgggacggggaggacacgctggtgaccaggcaggagatcgccgacaaggtgaaggaggttatggccgacgggaagttgagggcgagcgtggcggtggcccgcgaggaggccgcaaaggccgtcgcggagggcggcacgagttaccgtaacatgcatgacttcatcgccaagcttaagggaggagcttgaggcttgaggagatgatgttacgaacgcaacaatcatgcactgcacgtccattcccaccattccgacgagtgaagtgactgctgttacactcagccgtaccactttggttctgggttttcatttcatgttcatgtgtcttctactactatatacaagcatattcagtgtcttatgtgaactaaagatgatttgaaatggagtcaaataatatatatgtaattagagtaaaatgcatctgtggtctttaaacaaaaaaaaaaaaaacaggccggccaacttattggtcggcctatcaaaaccggatttagcccatccgaatgacaccgacgtagatgctcaaactccatttcgatcggatgcgccgaccaacttacaatacccgttttttctggttttaagagtttaggaacctaagtgacacaacatgtcaattttgaggactacaaatgcattttactcaagtaattatatggccaccactgctaaactagctcgccaagatggggtacatgagaaagaagatggtgcaaccatccaagccgataccatataggaaaacagacaatttttaggaaacacaaaataggcatgacaatatttattattttcggtggctagctatggttgttgaacataagtgaatgttatttttgtctactagagcccgccgtcgaaaataaatgttgtcagacctatttttgatggccgctctaaagccaccaacaataataaagccatcgaaaattaatagatgtttgcaggaaaccagaatttcctcctatttcacattcattcacatttacatattcatatcatgtacgacaacattcaatcacatacatacacacattatgcctaatttcttccattcacattcaatcacatataccatcacaatcaatatagccgcattacttccattcatcaataatatattatgtaccgttttattcattcaacaacattgtaacattatattcatcaacattttaagtacaatgcaagtgaatataagtctcatctagataaaacaaggttctatagctaattagggtttttcgagttgtgccctctactgccgaaattgaatacgt

SEQ ID NO: 8489 - DNA, 1859 bp, Zea mays
  misc_feature (1245)..(1245): n is a, c, g, or t
ccggccgcattgggcccctcggggccggccgggacacacatcctctaagtgctatctaatctacaatctaccaccagacactgtcgtcagtcgtccctcatcaaccgcgcgcgcgcgacttcaagcatcagactaccataatcatggctccgccgccggcaatgcagaacccaggagagctaaacgacggcgcctacgacgcgccgcacatcctattcatcccgagcgccggcataggacacctgacccccgtcttccgcgtcatcgccggcttctcgagccggggcatcgacgtctccgtcgtgaccgtgctgcccaccgtgtctgccgccgagactgactacttcaacggcctcttcgcggactaccccgccgtccgccgcgtcgacatgcacctattgccgctggacgcctccgaattcacgagagaggacccgttcttcctccggtgggaggccctgcgccgctccgttcacctcctccgccccatcatcaccaacgccgcgccgcgcatcacggccatcatcaccgacatcaccctgacctcctgcgtcatccccatcgccaaggagctggacgtcccgtgccacgtcctcttccccacagccgccaccatgctctcgctcaacgcctactaccccgtctatctcgagaagctcaagggtggaccggagccgggcgtgatcggcgacgccgtcgacatccccggcgtgttccgcgtcccgcgctccgccctcccgccggcgctcctcgacgtgaacaagctcttcacgaagcagttcatcgacaacggcagagcgatcgtcgaagccgacggcgtcctcgtcaacacgttcgacgccgtggagccggcaccgctggcagccctgagaggcggcaagatcgtccccgggtacccgccggtgtacaccatcggcccactcaagtcgcacgccacgaaagcgggcgacaagccaggtgacgcgttgcttgacgaatggctaggtaagcagcgagcgcgatctgtggtgtacgtggcgttcggcaaccgcagcgctgccaggctggaccagatccgggagatcgccgccgggctggaggacagtggctatcctttcctgtgggtgctcaagaccacgaaggtggaccgggaggacgacgccgagctggcggaggtgcttggagacggataccttgagcgcgtgaaagagcgcggcatcgtgaccaaggggtgggtggagcaggaggagctgctcaaccacccgngctgtgggcatgttcgtgagccacggcgggtggaactcggcgctggaggcgtcgtccgccggcgtgccgctgctggtgtggccgcagctcggcgaccaccgcgtgaacgcgatggcggcagtgagggcaggcatcggggcgtgggcggagcactggagctgggacggggaggacacgctggtgaccaggcaggagatcgccgacaaggtgaaggaggttatggccgatgagaagttgagggcgggcgtggcggtggcccgcgaggaggccgcaaaggccgtcgcggagggcggcacgagttaccgtaacatgcatgacttcatcgctaagctcaagggaggagcttgaggcttgaggagatgatgttacgttcattcccaccattccgacgagtgaagtggctgctgttacactcagccgtaccactttggttccgggttttcatttcatgttcatgtgtcttctactgctatatacaagcatattcagtgtcttatgtgaactaaagatgatttgaaatggagtcaaataatatatatgtaattaaagtcaaatgcatctgtggtctttaaagtttgcgcattgtgtgtcaaaaaaagcggccaaaagcggcc

SEQ ID NO: 8490 - DNA, 1927 bp, Zea mays
ccacgcgttcggcaaaagcggcccagagtttgaatgggcaacttgagattgctggaagagtaatcaaggtttcagctgtgacagaccaagcaggcatgcaagttagtggagctacgggagatttggatgatgaagaagctggaggcttggcactgaatgccagttccagagctcttctaatgcagaaattggaccgcagcggcattacgaccaggtacctttttggggttgattgcataataataattctgacattttgataagtataggtctttaaaaaactatttagtatagcaccgatatttggagtatatttatttatttgttaattaattggtaacagagctgcacatttgattactgaggtgctgaatggactattcctccataatttgttttttttgtggcgctgcagagacttcatttcattttagaattccattatcttgcttgcttgtatgagtgccatcatttgtacccaaatctctcattattgacctctactatattatcgtcaggattcaaccaccactacagcaacactgtttccatatatatctagcttatcaaggtcgttctccatggacctcctccagttctttggtgtaaagtggtttggctgaaatattttgtttactgcagttctagtatttagtgccagttgcattgattgcaaatttcaggatggcgaattgatgatgtttgaaagtggacataagagaggaatcttgttacaatgcccttaccattttgatgcagatttcaatgattggctccataagaaacttgagttaaattttgttatagtagatgtacccttttatgtgtagcttactcactggacacgccaaccttttgtgttcctgcagtttgactggtgggacgggcattgctggtttgactactccagtggcaataccaactgtatctgtccttggtgctgccccagctgcagcccctcttctgcaccctacagtgcctggtcttgcaattcccggggcaactcttccaattactaccccatctattgatttggctccacctagtcaatgcctattgctcaagaatatgtttgatccagctttggagacagatcctgatttcgatttggacatcagagatgatgttcaggaggaatgttccaagtttggtcaattaaaacatatttttgtagacaaaagtactgccggttttgtgtacctgcggtttgatagtataacagccgctatgagcgcacagaaagcactccatggaagatggttcgcagggaagatgatcacagcaacttttatgaccccacaacagtatgaaatgaagttcccgagctagtgaacagatgcatgattaatatggacgtagttgcttgggctcggtgggtgctggcatttctatattttagcgttttgagcttgtgtcaacttattactggaggtaattataaaaaaaactagtggaggaaaatttagtggaagctagtgtatcgggaaatggctaacgaaaaatggtgaaagaaagagtttccttgccctgtgggttagtgctcgaattgaaactgtactgtgtaatggagtttctccctgaagtgctagtactaatacctaaaatgatggaagaaagagttgacttgcgttgcgcttgttgatttgattatactcgtccgtaccctttgcattattgtttggagatgcttgtcacagtttttaagtgatgtacattaattgtgtgtttggttgagtagagtagaatgaagcggctctacttctatcttttggatgtttgttttttaacaaaaaaaaaaggagcgggacggctactatagtttacatataaaaatttactataaatagttgaaatgctctcgcttcaccaaaatgattggatgcaagcgctatcttccctctcctcccttctaaactcatagtaatct

SEQ ID NO: 8491 - DNA, 1420 bp, Zea mays
aaaagggagacgaaagctcaaaaggtccccccgcttcctgtggtccacgcacgcacgcaggcggcggtggtgcccatggcttcgtggctgttgctccccttctcctccttcccgtggcctcccccgcccccaccaggctcctcctccggccgcggcggcggcggcggcggcggggatggcggcggagacggcggcgattggaggccgaccgtcgtcgcagccttcgcaggcgtgcaagtcggccgcgctctccgccgccgcttcgccggcctcctccgctcaccggaggtgcgacatcttgatgccttgccgaaaatgggtagcttttggtttgaaggatcagaatcgcttgcaacattccacattcttggcgcgataggcaatgtgttctctgcaccttatgtttgcggctctgctctgttcagtgggaacgggtcagggggtagatacatcagtaacgggaagttgttgtccagacggcctcgtggaatcgattccaagaagaggctctggactaacgtccttcttgctcttaatgtcctggcttatgtcgctcaggtagcatcacaaggaaagcttcttatgtggggagccaagatcaacagtctgattgatagagggcaattttggcgtttggcaacatcatctctacttcatgcaaatctcacccaccttgcattcaattgtttctctttgaactctattgggcccatggttgaaatgttaagtggtcctagaagatatctagctgtttatttcagttcggcgctggcaggttcactgatgagctaccgttgtagtgcgtcacctgctgttggtgcgtcaggtgccatttttggattggttggcgcctatgcggtttatatgtggaggcatagaagattttttgggaattctagggagagtttagaacatattgggcgtgtggttgtcctgaatatgggtatgggcctcctttcaaggggaattgataactggggccatctgggaggcttgcttgggggagttgccatggcatggttcctaggtccggcatggcaatatcagtacgtggcaaaggatggtagagcggttttcaaagacagggctccagtcctccgactgataaaggggtagacctgtgggtattcgtggaaatagcgtggaagaggatgaaaaggggtgaagattcagacatgcgccgagcaaagggagtggcgaaaaaacaattaggccctctttggaatgaaagaatttcagagaaatcatacatgaatcagttcatttttcatagaaaaaacacatgaaccttaacatgtaactagttttggtgtcgaaacatttcactgcagagctaattgctgaggaaacacacacgagaatcatattgctttgttcggatcgtgccaaatgttaaatcttcaaagctaaaacgagttgt

SEQ ID NO: 8492 - DNA, 1827 bp, Zea mays
agaaccactggtgccgctaactagtggtcctgcctcgctcagagaccgtttttgcagcagtgatgaagattacctcaggaaattcaccaaaaccagacctcggcctatttgaacctcacctgggacagccggctgcctgcctgaggcctgagctgcctccatatttgcattcttcaccctcgcttcacgtcaccaccattgccatccaagaacaaattaagcgggacactggaaacaaagagagacatgggccttcgcggcggagctcttgccctgcttctgctcctgttcgtccacggaggccagcgagcagcagaggccggcggggacgcgttcgtgagggtccagggcacccgcttcgtgcaggacggcaagccgttcttcgccaacgggttcaacgcctactggctcatgacattcggcgccgaccccgcgcggaggggcaaggtcacctcggcgctcagccaggccgccggcgccggcctctccgtggccaggacgtgggcgttcagcgacggcggcggcggcggcggcagcgcgctgcagtactctcccggccgctacaacgagaacaccttccaggggctggatttcgtgctgtctgaggcaaggaagcatgggattaagatgattctgagcctcgtgaacaattacgacagctttggagggaggaagcagtacgtgcagtgggcgagggagcgggggcagaccattggatctgacgatgagttcttcactaacccctttgtaaagggcatctacaagaaccatatcaaggccgttctgacgagggtgaacacgatcaccggcgtggcatacaaggacgacccgacgatcatggcgtgggagctgatgaacgagccgcgttgccagtccgacgtgtcgggccacgccatccagtcgtggatcacggagatggcggcgcacgtgaagtccatcgacgggaaccacctgctggaggccggcctggagggcttctacggcgcgtcgtcggcccgcaggtccgcgaacccgtcggggtaccaggtgggcaccgacttcatcgccaacaaccgggcgcccgggatcgacttcgccaccgtgcactcgtacccggaccagtggctgggcggcctggacgcgcaggcgcagctgcggttcctgggcgcctggctcgacgcccacatcgccgacgcgcgggcggtgctgcgcaagccgctgctggtggccgagttcggcgagtcgcgccacgacccgggctacagcggcggccaacgcgacgcggtgttcggcacggtgtacgccagggtctacgactcggcgcgcgccggaggccccgcggcgggcgcgctcttctggcagctcctggcggaggggatggactcctacggggacggctacgaggtcgtcctcccgcaggcgccgtccaccgccggagtcatcgccacgcagagccggaggctgcagggcctcgccagggcgttcgtgcgcgcgcgcaaggcccaccaggggaaggcgggcaagggcgctaagggtggcggcaactgaaagtggggtgaaacgtgtgtggcgagatcaagaagagtgtgtgtgtgtatgcgtcgatgtctcctcgagatgatttgaagattcatccgggagccaagagttacttctacatactatctagcgttgtcctccatgttttattatttagaggacttgcgtttagttcctgtgtggatcacgatagtcgagatgagcgaagttatatgcaaaagtcgtggactcgtggggggagcaactctacaatctcgagacctttgttggtttgttcgcctctgattaaagactaaagacagttattcg

SEQ ID NO: 8493 - DNA, 955 bp, Zea mays
cattgggtacctcgaggccggcccgccctggtggcccctttagggcctcctctcccttttggcgaatcattccttctcgccgataagcagcagctcatcacctgaaggagagcagcccggaggagggggagcaagcagcagccgtccgtggaagaagatgtcgtacctgctgccgcatctgcactcggggtgggcggtggaccaggccatcctcgccgaggaggagcgcctcgtcatcatccgcttcggccatgactgggacgagacctgcatgcagatggatgaagtgctggcagcagtagctgagaccataaagaactttgcggtcatctaccttgttgacatcacagaggtccctgatttcaacaccatgtatgagctgtacgacccttcgacagtgatgttcttcttccggaacaagcacatcatgattgatctcgggactggaaacaacaacaagatcaactgggccctgaaggacaagcaagagttcatcgacattgtggagaccgtatacaggggcgcccggaaaggccgtggtctggtgattgctccaaaggactactccaccaagtaccgttactaagaaggcaggcattccccttatgcaatctattggggatgtttacacggacagttagtccgacaggtgatccctaactgtatcttggcataccctagtaattcaagttgctggctggagtgatgcttatccatgtcttggcatgccatagtgaacatgtaaacctgtgatttgaggtgattattcgagtgtaaagaaaccaggattgcgttcgcctatgactatgtgtctagttgtctacttaataagaaacagttattggtttggaatatcggaactgaaacaatggctttcctttcggtatttctattatcacctaccctgctttgctacgttttttatatattagtactctgcgttgttaccactgct

SEQ ID NO: 8494 - DNA, 1812 bp, Zea mays
gtagcgtttagcatcagagcatctccaacaatgtctcaaactggtgcctcatattgaaatatgagactctacacaagaaaaattactcgaacagtgcctcatttcttaaaatttggtcaaaaaattgtagggcaccctctcaagtgcctcaaatatactacactgtagtgggctgccctataatctagatttgaggctttactgttggagcggaatgttttgttggtgccctaaattctataaaatatactcatttttaaattatagggcattttataggttacgttgttggagatgatctcactaacctccttggctagtaccaataaagtgtaagatggtgttatctttggttttattttgttctcaggggatattgtagtaagtctctccttccccccctggtaaatcaaagcttttattccacatagggatttaaataaacttgcagctaacttcctttgtttggaagccttctgtgatgaaactgaagtgccagtaaggcagtaccttgctagtaagttatgaactggtgcaattgtttgtactttttcttttcttgcttgcggtagtctctccttttagcttgaggtatgtggaaacaatagagagttaggtgtgttttaggggtatatactgcataagagaaatttgaatggcagcagctcactgatttatgtttgtcatgtgtggtcctcatgttgattgatgaggagacataagtactcaaggtttgcagattgcgtcacaatgttgccagtttactacttggctgattcaattataaagaacaaactgttgtttagtggcctgggttgtactataacatgtcatgttacatttcatttcttttttactgccatacaatatttgttatgtttaaatttggaacagaagtggttagcatgttttatttgttaggtaacatacactgtccaatcgttgcaagcttgatttttactatttatggctcagtgaaattgaagtgaagtagccatctgatcttttcatcagtgttttctgaaaatcatgttcgttgcccttgccctttttaaaattctcacttggtcatatgatttggttccacgccgaggtggagcgcctcgtcatcatccgcttcggccatgactgggacgagacctgcatgcagatggatgaagtgctggcagcagtagctgagaccataaagaactttgcggtcatctaccttgttgacatcacagaggtccctgatttcaacaccatgtatgagctgtacgacccttcgacagtgatgttcttcttccggaacaagcacatcatgattgatctcgggactggaaacaacaacaagatcaactgggccctgaaggacaagcaagagttcatcgacattgtggagaccgtatacaggggcgcccggaaaggccgtggtctggtgattgctccaaaggactactccaccaagtaccgttactaagaaggcaggcattccccttatgcaatctattggggatgtttacacggacagttagtccgacaggtgatccctaactgtatcttggcataccctagtaattcaagttgctggctggagtgatgcttatccatgtcttggcatgccatagtgaacatgtaaacctgtgatttgaggtgattattcgagtgtaaagaaaccaggattgcgttcgcctatgactatgtgtctagttgtctacttaataagaaacagttattggtttggaatatcggaactgagacaatggtttcctttcggtatttctattatcaactaccctgctttgctgcgttttttatatattaaaagcggcc

SEQ ID NO: 8495 - DNA, 2586 bp, Zea mays
cttgctgatggcaaatatcagctcgttcacaaacccctctggcatcatgtctggcccggcccgcgctcacccaatgtcattaggcccatcaaccaaatagcactccattcgatgctacgcgtctgtagtagtgatgtgtagttactacaacgggttttcgtgcctatgattcgcggtaatcaccaacattttattttgtttttttttatgcgcttgtgaaggccggcaaataaagccggtggaagggcaccgcaagggatcgtgctctgctcactctctccaagaccaaatgacatgcgttgcgttgcgttgcttgctagcaacttgatatattcttgctgccatgccaatcgtcggtgctgatcctaatcatcctgtctaagctcagacgacgacacatcgagggatgcccctcgccggagccgcgacggccgcgaacctgccacgactcgccccctacgcccaagtaccagcccgcccaccacgctgtcttcgccactcggcatcgccgacgtggcggccctcgccgacgccgacgccgacgccaagagcgtctccccgcccgcatggccggacgacgacgacgacgacgtcgccgggagggacgactgggtccaccatctcccgccccttgacatgcacatgccgccgctcggcctcggcgccgcagaggcctgggagccccacgcgcaacctccgggtccgggcggcctcaccctctcgcacgcccagcagacccacgacagcaccttcctcggctggtttattgccgacgacgtcgccatgtcgggcgtcatggacgaccacaactcccactcggtacttcatgacctcgaccacataccctcttcctccgtgccgccgccgcagttccagcctctcgcgccccacgtgcactacccgcccaagctgcaccaccaccaaaaccccgtggtgcccgcgtcgcctcccaagcacacgctcctgaaacccaagccggaggcgccggggaccgacgacgcttccacggcggtggaccagctcgccgaggccgccaagcttgccgaagccggagacgttttcggcgcccgcgagatactggcgcggctcaactacctgctcccgcccggcgccgcgacggcgacgccactgctccgctccgccttctacttcaaggaggctctgcgcgctgccctgtccaccaccgcctccgcaaccgccgccgccgccgccgcgccggtggacgtgctcctaaagctcggtgcctacaaggacttctccgagctctgccccgtgctccagttcgcgcacttcacctgcgtccaggccatgctcgacgagctgggtggcgctgcctgcatccacgtgctggacttggacatcggcgtcggcgagcagtgggcgtcgctcatgcaggagctggccagccgccgcccgggcgccgcgctcaaggtcaccgcattggtgtccgcggcgtcgcaccacccgctggagctgcagctcgtccacgagaacctgtccaacttcgcggccgagacccgcgtcccgttccagctggccttcttcaacctcgacgccatggaccccgcggagctcctcgctaccgccgccggcgacgccgtcgccgtccacctcccggccggctccgtgcacgcccccgcggtgccgtccgtccttcacctcgtcaggcggcttggcgccaagcttgtcgtctccgtggaccgcagctgtgaccgcggcgagctgcccttcgccgcgcacttccagtcctgcgtgttcctgctcgagtccctggacgccgtcggcacgggccccgacatcaccgccaagatcgagcgcttcttgatccagccgaggatcgagaggtgcctggcggagaggtaccgcgccgcggcggcgggcgacaagacgccgccctggcgggcaatgctcgtgtcggccggcttcgtgccggtgcaggcaagcagcttggcggaggcgcaggcggaggcgttgctcaagaaggtgcccgtgcggggcttccgcgtcgagaagcgcgccggctcgctcgtcctgcattggcaacgcggggagctgctctccgtgtccgcctggagatgctagcaccttactgctgctcaatctgccattgtttaaggatcctgatatatgtatcttagatagaatccacaagtctgctcatgctttgtacaatcaaatgggggttatatggtgtatgaaatgttcccttcactcaggcattggatgcttgttttttctgtgaagttcatgatcatgagattcagaactatgaaatggaaattaagttccctctttttcttttgttcatatataatgtatatatttcctaaagaaaaaaaaaaatctttgttgaacataattcacaaagaaaacagggagcctttaatggtcaggaaacacaaaatgggaacccattcaaaagctaaaaatgtcatgaaatttcgttatgctacttggctgcatgcctgcatgtctcataggctgtaattgacttttagactgtatccagtaactttcctattccacctcctactactctgtaagcagtgcattctacatatgtgttttgcacgaccatatgtacgg

SEQ ID NO: 8496 - DNA, 1229 bp, Zea mays
ttttttttttttttttttttttttttttttttttttttttttttttttttttttttttttattcgtgtttttttttttttggtttgagacattgcagtagcaattttaattaataaaaatgttggcaatttgcatttggtcaaatccatccagatacaacaggatgcagtgaagcgcatgagcacaagtctaacacgggatgcaatgcaagcaaagggcgtaatagtagtcgcggcctctagggtggcagcgggttattattcttggcagcgaacgcggtgacgaactggcagcgcaacgtttgttgtcgtcatcatctttcctcgtcgccggtctcagaactcgacgcccttgaagaccttgcgcacctgctcgagcgtgacgaagagcacaacggtgaagggcccctggcgcatcacggtggggatgaaccccttgtacagcgccatgggtccctccgacctgacggtcttgagggcgcagtcgacggcgccggcgtagggcgggggcgcgccgggcgccaccttcatgttcatcatcctcgtcttgacgacgtcgacggggttggacgcggcggcggcgacgatgccggcggtgaagctggcggccacgtgcgtggcgagcccgtcggcgcccgggccgcggcgcgccaggatggcctccttggcctggtcgtacgtggccagctgcgacgccgtgacgatcatggcgcggttgacggtgagcgaggacccgcgccagaggctgcgcacgccctcgtcgcgcgccatccggccgatggcgtcgccgacgccgcggtagttccggcgctccgcgaggggcaggcgcccgtccgcctgcatccgcaccatggccacgtcggccgggttgcccacggcggcgccgacgccgccggcgacgaggccggccaagatcttgcggtgcagcgggaggacgccgccgttctcccgggcccacctggtcttgaggatgtcgtacagccccatccgcgtggtggagtagagcgtctgccgcagcatggtggcggacacccccgagaagaggcccgcggcgccctcggaccgcaggatctgcgcgccgacggccagcggcccgggcttccgcggtggcgccgggatgtcgtggtggtggtggtgcgggagcgcgacggcgtggcccccggcgtggaaggcgagcgccgggcgcagcgccggctgcggcgccacggcggccgccgcctccccctgcag

SEQ ID NO: 8497 - DNA, 1912 bp, Zea mays
ctccgcccctgggtgctgagtgctgactcgctcccgtgcttctgctagccatcgttggccgcccccgccgcgccaatggcgacgaggcgcgagctgtccctcgcgctgctgtgcgtgtgcctcgcggcctgcgcgctggcccccggccccgcggacgccagcaagatggtcggggtgtacgagctcaggaagggggatttctccgtcaggctcaccaactggggcgccagggtgatgtccgtcgtcctcccagatcgcaaagggaatttggctgatgtcgtccttggcagagacaccgtcgctgaatacgtcaacgatacctcttacttcgggccgataacggggcgcatagcacagcgagttgcccggggccggttcgtcctcgacggcaaggtctaccacatgcacaggaacgacggcaggaacacgatccacggcggcgacagagggttcagccggagcatctggacggtgaaggagtacgtcgccggcggcgaatcgccgcacatgaccttctactaccgcagcttcgacggagagcaaggcctgccggggaacgtggacgcgtacgtgacgtaccgcgtgtcgggcgcctacacgctgggcgtgcacatgaacgcgacggcgctggacagggcgacgccggtgggcctgctgctgcacgtgtactggaacctgggcggggagggcagcggcgacgtgctgggccacacgctccggatccgcgcgtcgcggcacgccgtgctggacgacgagctcctgccgtcgtcggggcgcgtggagcccgtggccggcacgcccctggacttccgcgcgcccgcggcgatcggctcgcgcatccgccgggtcgtcgtcatggggggccgcgccgtcgggtacgacaccaactacgtcgtcgacggcgaagggatgcggccggtggcgcaggcccgggaccccgcgtccggccgggcgctggagctgtgggccaaccagcccaccctgcagctctacacggggaactccctcaaccgcaccgccggcaagggcggcagggtgtacgacaggtacgctggcttctgcctcgagaccatgggctacgtggacgccgtcaaccaccccgagttcccgtcgctgacactcaggcccggacaggtgtacaggcacgacatgctctacaagttctccttctaggtgcgtcgtcgttaggtttgatgaagtgtgcgtaattaagcacgaggaagtcatgtcatgcgtccgttggttttgatcggaagaaaaagactatgcatgctattattttaatttgcttccgacgagcagcagggcagggcaggcagacaggcgttcgatcttcgtcttcagttcgtcggcggtgaggtccgcaccgtgccgctagtagtagtagcctttgcatcagcaccttttggaggcgtcgtcggggtgtgggccttctccctcgccaggtcggctttggcctctgaaccctgctgcaagcagacagggtacgtacacaacaagattgtggacgtacgtatcatcagtgacgcatggcacacaacaacaccaagctgcaattgccatatgtaattggtggtgtgtgtgagtcgtcgttcaggtttgatgatcatgcatgtacgggtgtaccagctgtacctcggtgaaaatcttcaagacctcttctggggacttggtttccaagatcgtcaaagcttgcttctgcaccaaattaaacgagtcaaaccctggtaaatctagtaaatagatgcttgttccaagaagccaagaggagtcaaacccgtagtagttaatacatgcgcccaaaagaaacccaacgagtcaacaatcaatactagtatttactgcactgctgaagacgatgcagtacaaatggcatacatgcccatggaagttttgactgctttttactgca

SEQ ID NO: 8498 - DNA, 597 bp, Zea mays
cttattctgaggtggccgaagagttcaaggtcaagtatattttcactcatattgcggcgatggaactcaaggagggagctgtagctttgtggttgcattcattgaaccccagaaattatccagatttccgttacatggaaactgctgagcacaatgctggtgctgaagttgagagtattgctgctggtgcagagcccaaggttggggctgaagttgagaatactgaagaagtacagatgccaagcgccaatttaagtgagtaatcaattttgccaaggggcatgcaaaaccgaagaaaatatctgtttgtcatgttactgagagggacctccggccctcagacatttccaatgagatatcataatatagagaatgaagactcatatgttctccaatggaatatggacatcaagaggttaatgtgcatcactttatgccatcatgatcccaatgttaatcttctgaaataagaacctataggtctatattagtcttatatctgaacttcattaattgcttccagacaattgtttgacaaatggcatttggaaatgttccagcaagtttttgtttgctgaaattattatgggattccct

SEQ ID NO: 8499 - DNA, 3259 bp, Zea mays
  misc_feature (3206)..(3241): n is a, c, g, or t
cgaccatatggatgatctgctagccatagcctaagaaagcaaccttagaattaatagggacccttgtaaggacatgtgtcccatcaatagccccaatacggtcctagattatataactagaacattttaagttatttaatttacctaagaaagttaaggattatgggttaactacccaaccatgaaaagaggttaactaacatgtttgttggctagtgaggtcacaggactccgtgtaaaaagccacatgtggcttgggtacaaaactacaaacaagaccaacagagggaagaaaacaatatgagaggtagagcattttcatcaagctaatagtccacttttggattcgtcgtgtttggcttagatgcatgtgtagtcaaacatgtgagattcacattacactagtctgattgacctttaaccacacatgcaaacacacctttgacacacatgttttgtagattaccctgtttttagaattatttcgtttttccctatttatcttaggatcaatttggtagagcccgctccatgattttatagctctgagacttgaatctccatactccgctagagtgattttgagtgggtttttagcaagggtaaatctatctaacaaaaacaaagcgatttctaagggattagaccgaagtgtgaataaagtgatttctaacagaaagttgtaagaagatttatatataatagatatttcacttaggacatctgcaatggtcgtcttaaatacctagctgatagaagaataaaaatagtaatttatttcatcactagtatttggttccagacataatacattcagtttcttaaaatacttgaaatcttctcatatttttaactatgtagcaaagagattgaatctagctagtcattgggacacccttagcccataccataaggcatatcttttacggtgtcggaagctcccttcatttctttcacctccgattcgattccttgtcccctcttgatccgagccgccaccaaaccctaactatctaaaacccccgtctcgctgtccgatggccgccgcctcgccgccgccctccccaccccacgcaaagcgccccaagatgtcctcctcctccgacccggaagccgatgctgagcccacctcggcctccgccgccgttgagggcgccgatcctgcgcagcgtcgtcccaggtacaagcgccgcaaggtcgccatccttctcgggtactgcggcgcggggtatcagggcatgcagaagaatccgggcgcgcgcaccatcgagggggacctcgaggaggcgctctaccaggcgggcgccgtgcccgaggccgaccggtccgcgccgcgccgttacgattgggcacgtgctgcgcgcaccgacaagggcgtcagcgccgcggcgcaggtggtgtccgggcgcttctacgtcgacccgccgggcttcatcgatcgcttgaacgcgcagctcgcgccgcagatccgcgcctacggctacgtgcgcgttaccaactcattcaacgcgaaaaagttctgcgaccgccggaggtacctgtatctgctccccgtatttgctcttgaccccagcgcacacccggaccgcgaggccgtcatggcgagcatggggagtgggagcgagcttaccaagtgcctggagtgctccgagagaggcaggaagattcctggtgtcatgggccgggaggggaaactgcccagccccgggcagaatggtgttgatgctcccgtggagggaagtagccatgacgaatctggaacacttggggatgcaaaatgtgaccatacaagttcagatggtaataacccatttgcccatggggaagttggatcgaacagcaaggagaagcctgatttaccggtctctggtgatggaactgaagttgcaaatgcaaagatgggatcaaatggcgacggtgctgttgtatcatcaggtactgggtggaaatcaagtcttgtaattctaatctgtgttggctagtgttgattagatttttgttctgatctgaatagttcagctgatgcagatatttatattgggaacgaggagaagaaacttgagcctgcagccactgaaaataaagctcaaggtatggaatctgagaagatcaatggagaagagaaactgccaactaagagtaccttttcttacactgatgaagtgaaggagaggttcaacaggattctcaagtactatattgggacacacaatttccataacttcactacaagaaccaaggcagaggatcctgcagcaaaaagatttatcatttcctttgctgctgaccgtgttgtcagcctggatgggattgattttgtcaggtgtgaagttgttggacagagtttcatgctccatcagatccggaagatgattggtcttgctgtagctgtgatgaggaactgtgcacctgaatcaatttatgatgtcgcttttcgcaagtatgaatcttataagcttttaggtattaagcaatccatataacatatgtttgcacgcttacgccatgtgtgttgcagggatgtcaatcttaatgtgcctactgcacctgaggtcggactgtacctagatgaatgtatgttcacatcatacaacaagaaatggaaggattcacatgaggcagtttccatggaaccttattctgaggaggccgaagagttcaaggtcaagtatattttcactcatattgcggcgatggaacacaaggagggagctgtagctttgtggttgcattcattgaaccacagaaattatccagatttccgttacatggaaactgccgagcacaatgctggtgctgaagttgagagtattgctgctggtgcagagcccaaggttggagctgaagttgagaatactgaagaagtacagatgccaagcgacaatctaagtgagtaataaattttgccaaggggcatgcaaaactgaagaaaatatctgtttgtcgtgttactgagagggacctcaaacatttctaatgagatatcgtaatatagagaatgaaaactcatatgttctccaatggaatatgaacatcaagaggttaatgtgcatcactttatgccatcatgatccctatgttaatcttctgaaataagaacctataggtctatattagtcttatatctgaacttcattaattgcttccagacaattgtatgacaaatggcacgcggaaatgtttctgcgattctctattttctcgtnnnnnnnnnnnnnnnnnnnnnnnnnnnnnnnnnnnnaaaaaaaaaaaaaaaaaa

SEQ ID NO: 8500 - DNA, 2269 bp, Zea mays
gtgtcggaagctcccttcatttctttcacctccgattcgattccttgtcccctcttgatccgagccgccaccaaaccctaactatctaaaacccccgtctcgctgtccgatggccgccgcctcgccgccgccctccccaccccacgcaaagcgccccaagatgtcctcctcctccgacccggaagccgatgctgagcccacctcggcctccgccgccgttgagggcgccgatcctgcgcagcgtcgtcccaggtacaagcgccgcaaggtcgccatccttctcgggtactgcggcgcggggtatcagggcatgcagaagaatccgggcgcgcgcaccatcaagggggacctcgaggaggcgctctaccaggcgggcgccgtgcccgaggccgaccggtccgcgccgcgccgttacgattgggcacgtgctgcgcgcaccgacaagggcgtcagcgccgcggcgcaggtggtgtccgggcgcttctacgtcgacccgccgggcttcatcgatcgcttgaacgcgcagctcgcgccgcagatccgcgcctacggctacgtgcgcgttaccaactcattcaacgcgaaaaagttctgcgaccgccggaggtacctgtatctgctccccgtatttgctcttgaccccagcgcacacccggaccgcgaggccgtcatggcgagcatggggagtgggagcgagcttaccaagtgcctggagtgctccgagagaggcaggaagattcctggtgtcatgggccgggatgggaaactgcccagccccgggcagaatggtgttgatgctcccgtggagggaagtagccatgacgaatctggaacacttggggatgcaaaatgtgaccatacaagttcagatggtggtaacccatttgcccatggggaagttcgatccggcaccacggagaagcctgatttgccggtccctggtgatggaactgaagttgcaaatgctgagatgggatcaaatggcgacggtgctgttgtatcatcagatatttatattgggaacgaggagaagaaacttgagcctgcagccactgaaaataaagctcaaggtatggaatctgagaagatcaatggagaagagaaactgccaactaagactaccttttcttacactgatgaagtgaaggagaggttcaacaggattctcaagtactatattgggacacacaatttccataacttcactacaagaaccaaggcagaggatcctgcagcaaaaagatttatcatttcctttgctgctgaccgtgttgtcagcctggatgggattgattttgtcaggtgtgaagttgttggacagagtttcatgctccatcagatccggaagatgattggtcttgctgtagctgtgatgaggaactgtgcacctgaatcaatttatgatgtcgcctttcgcaaggatgtcaatcttaatgtgcctactgcacctgaggtcggactgtacctagatgaatgtatgttcacatcatacaacaagaaatggaaggattcacatgaggcagtttccatggaaccttattctgaggaggccgaagagttcaaggtcaagtatattttcactcatattgcggcgatggaacacaaggagggagctgtagctttgtggttgcattcattgaaccacagaaattatccagatttccgttacatggaaactgccgagcacaatgctggtgctgaagttgagagtattgctgctggtgcagagcccaaggttggagctgaagttgagaatactgaagaagtacagatgccaagcgacaatctaagtgagtaataaattttgccaaggggcatgcaaaactgaagaaaatatctgtttgtcgtgttactgagagggacctcaaacatttctaatgagatatcgtaatatagagaatgaagactcatatgttctccaatggaatatgaacatcaagaggttaatgtgcatcactttatgccatcatgatccctatgttaatcttctgaaataagaacctagaggtctatattagtcttatatctgaacttcattaattgcttccagacaattgtatgacaaatggcactcggaaatgtttcagcaatgtttttgtttgctgaaattattatgggattcactattttctcgtatctacaatataggtttattttcttgcactttttttttcttttggtaatagctgtatatcacttagactgccatagtgcgtcaaatttcattgcagcataatatctattgatattgctagtaaaaaaaacaaaa

SEQ ID NO: 8501 - DNA, 3701 bp, Zea mays
tgcagagctaccacaactccatggtacggaggctccgggagattaaggattgctggaagggccgtgaggggtacagccttgatgagaggctgaggatgttggacacgatgaaggcaaagcagcagcaccaacaacaacagcagagaaaagctctagatttcacgaggcgggctgggtcggagactgattcagagagcaggggatctggggaacaggtcttagctcgacccaagcacgataagagtaggcagaagaaggcagggaagttagtgaaggagaagtcgaaggggctgctgcgggtgggtacaccgaaaggagtggatgaggatgacatgggagggtctggccgtgatgctgtggtggcactctctgagctttctcgtcgagggtatgattctggcacatatagagggaagcttcacaggagcatagatggcctttactcggagttggaggaccttggatatgaaagggattcgtcaagacctcggtttccgaggctgcttcccaagccagtgaagaaggaattgtctacgagctgtgatgtcaatctgtatgcaaataactacagtgataaccatactgcatctccttactactacagcaggaatctcagtgctaatcagggagtcaccttagcagcagcatatgatcctccatattttgataccagaaggaatgcaaggtacttggagagagactgggtgcaaggtggaaaaggtgtgcacattaacgctttaatgggtgatgagatgaacttgccagctggtaatcacactggtaactcagatgactggcagaaggggcaatctgcaggtgattacaggagcaggaaagatcaagctggctatggtctgaaggttaagtcctataaaagtattgagaaagaggttaatgatgcccgtgttggttctgaccctagaagcaagatatcacaagcgaaggtggcaggtaaatccagtagacaactagataggactggccagaagcactggagcaatgctgtctatggtcaaagtgacgagacagaatctgattcatcagaaaagtttgaagatggcagggaagcacattatctcgagcggaagccagagcgtcaccattctgggtatcatagaccagcacatggtgccaaaaaatcaaacaagcttgctaaagtggccaaaatgaactatcctactgctgatgcagatttagaaccttcccagagcaaaggattcaaagggaaggtttcagagactggttatttacatgatgtggatgtgatgatgacaggacagattagtgatgtcatgaaacctctagcagcaagtggtgaaaggaaacgcaaaggggtggcaaatttggacatgcgtgtttatgataactctgatctgcatgaagtcaatgaagatgcaaatgactctttcaggttggcggaatatgaaaggcttgccagtagatcaggccatgcagtccaagattctaatggtggttatggtggtactgaaagaaccagctctagctccaaaaaagcaaaaggaagagtcgaagttcctagcctggatgagcatggtgagcatttgtcatctggcccaaaggttgttgagaacactggtggatccaagaagaaaagcaaaaagaagccagagagcagcaccacagatgcagttattttagcagaaccagctgttgctgtacctgaaaataatgtgatagctgcagagcctgagaaggttgagaagcccaagaagaagtatgtaccgataacaccaacgatccatactggtttttcattctctgttgtacatcttttaactgccgtaaagaaggctatggtcactcctgctgaagatactcctccagccacagcgacacaaccggatggagaggagggcaaaaagtggttcaacagtggagagcgcagcaaaacgccccatcaagaacaaagtgcaacagatcaaactgaacaggtccttgagggtgcaaatgccagtgctgtagaacagactgtaccaatcaatacaccagcgcttactgttcaagagattgtcaatcgaattagagcaaatcctggagatcctaggatacttgaaacacaggagcccctccaggatttagttcgaggagtattaaaagtactttcatctagaacagctcctctaggcgcaaagggctggaaagcactagttgcctatgagaagtcaaacaaaagttggttctgggttggtccagcaccttctgtttcatcatatgatgaccccgatgaagaaacctctgctgaagcatggagtataccacacaagatgctcgttaagttggtcgacgcattttctaattggctgaaaagtggtcaggaaacccttaagcagataggttccctcccaccacctccaccgccaaatcctgcaaacttggatctgaaggaaaggttcaaggagcttaaagcgcagaagagtctgaacacaataagcccgagctcagatgaagcgaggacatatttccagcgtgaggaatttctgaggtactcaatacctgatagagcattctgctacaccgctgctgacggggagaagtctatagttgcacccttgagaagaggaggtggaaagccaacagcgaaagcgaggggccaccccatgctcttacctgacaggccgccgcacgtcaccatcctgtgtctcgtaagggatgccgcgtctaggttgcctgcaaggactggaaccagagccgacgtctgcacactgctcagagattcacagtacctaaaccatgaagaagccaacaaagaggccgcaattaatcaagtcgtcagtggagctctcgaccgtctgcattacgagcgcgacccttgcgttctgtatgacaacgacaaaaagctgtggacctatctgcacaggggcagggaggaggaggatttcgaggacgacggcacgtcgtctacaaagaaatggaagaggccaaggagggatgtctccgatgctgcagagccaggtgcagcgaatgatgatatcgacgacgatggcgctggcacccctccatcaaacaatgtgaaaaaacagaagacaacattgtcaggagaagctgccaacgatgagggaaatcatccgactcagaatccggcttctggtggcctggaaggtgattctgatctcaatgctgttccgtcttcaaaattttttgaagaaccatgtggagatgcctacattgatgcaagaccagatgacggtggcccaaattcagtagatgcgaaaccgggcagcacagctgacgacaacacggcactccctgggaacaccggcatggacgctaccaccccaccatgaataaagaacgtatcatggttcaatcagctagagatttgctgaagggtcagcgtaggtaacttgtgcagaaaccgtatctcatctgcgttgttcttatcgctacagttggctagtattaggagagtttgattcatttttagtgttgcttctcttcccctcgaagctgacagtaatgtaaactagaaatgctaagatgggggtttttcagcatacctcgttctgttttatagtgaagttgccatgttatactttcagcgggattatattatcaccatcttatagttctttttttttacatgcgattatcttagggtggcctgtgggtatattgtttgtaaacaggcaactttcttccagatgttgattaccgattgttcttatgtgtgatgtgggttc

SEQ ID NO: 8502 - DNA, 3203 bp, Zea mays
ctcgaggccggccgggcttaatatttgattcatcgatgcaaccagctattcctacaaatgaaactgcaaatggggcgtcatccaaaaatatatccatttcacatactgtttcatctggtgtagttcttcccagtccagcaccttctattgtttcttctccaacagcagttgtgaatgatggaaaacagaaggctgtttctagctctaagtgtggcaccacatcacaaaagccaagaaaaagaaagaaagcttcagtaagtccagaacagcaacctgtcattgcttctcctcagctcaaaatggacatgccggagagctcactagtccccccccccccccccccatttgccttatccggtagcaagcttgttcctaagacgggtgagattgcctctgaacctaactaccaggtcactggtggtatggatagtgagcaaagaatcatcttttcagaaaagatccgttgtgcagtagaacaatcaactgcacaggctaaaggtgcaagccttgactcaatggaggcagttaagcacaaggaaggcgtatggagcaatctatccacaatctcaagaaacaagttatctccagaggtcgaagagaagcttacctcagttgcagcagctgctgaagcagcagtttctgttgcaaaggcagctgcagaagctgccaagatggcgtcagaggctgcattgcaggcgaaaataatggcagaggaaactcttagctcttttacatctgtaatgtccatgcatcacgaagttggtcaatctgatgtcattagtagtccactgatcttgtcaagttcaacaccagcatcatccctgaaaattaaggacaagagtcatgccccaggttccatcatttctgtggcacgggaggctgctagaaagagggttgaagaggcatctgcagctgcaaaacgtgctgaaaacttggatgccatattgaaagctgcagagcttgccgcggaggctgtgttcagggcaggaaccattattggaatgggagaaccactaccttttaccctaagagagcttttggaagcagggccaaatggctattggaagtctgcaagtgtaaggaataaatctggaagtggtaatgataatctagtaacagaaacattggaggtagatgcacctgctaaccctagcaaatctggcagaaagcgtggtcggaaacctaaatatgatcaagcactaccgaattcagagccattttcaaactgcaaagaattacagccatatggaatacactcaggacatggggttgtaggaaatgttcctgtcactgtgccaatggatggtaccaatgttacatcaccaataagcattgtctggaatggcattgaaaagggatctgcagttgaggttttatctgacaaggttgggtttggagtagcttggttttctgctaaggttattgatataaatgaaaataatgcttttgtcagctatgacaaccacaatggaactggtcctcgtgaagaatgggtgccattgagacaagagggggataagccgcctcagatacgtcttgcacaccctgctaccctctccaaattcaaaactaggaaacggcgcagggaaacagcaggcagttgtttatgggtcattggagatcatgtagacgcatgggtcaataattgctgttggcgagagggagttatttctcagaattatgagactgacgagacgaaatatgttgtacatttttcagttggaggtggtggtgaatccttagtagttgatgcttggagtcttcgtccatcacgtgtttggaaagatgttcaatggatagagtggtcccgtgcaagagaaaggaaatccaagtctaataagggcgattcacctcttgagaaacgccaaaagacagacttgcttcaagcaggtggcaatctatctgttgttgacgaaacgggaggatcttcaaaggacaagaatacaaacaatgcaaaaaaatcggatgaactaaagacattgtctttgtctcagggggaaattgttttcaacattgggaagagtgtagttgagaacaaatctgatgctcttgcattcaaacggcctggattacagaaagaaggatcaaaggttgtctatggtgttccaaaacatggaaagaagaagtttatggaagtaagcaaacattattacgcaggccagtttgacaagatttctgagggtaatgcatctaacagatttgtgaaacatctggtgacgcaattgccaagggaacgtgaaaatgattccaaagttgatcctattagaggaaggagagtgggtgagacgaggtctagattacctaaacctacgaagtctcagagcgttcgagctagcagtgctcctggaaatgattccttccccatgcatgttcagaatacttgtgtttctcaaaggagttttggttttgcgggaagttcgacaagcacttccaacaatgaaaagtccacttcagaaaaaaataatcctgcgcttggtgtgggctttagaactgaagttccttctgtttctgaactgcaaactgcatctactgttcctactaatcgagctaaaaagaaatacattcccactgttagcaacataaacagaagtatactcaatacctctgaaaaggcaaattctgattctggtgaaccccgaaggactacttctgattctaccgaacccagacggtctaacaggcgaattcaaccaacttcaaggttgctagagggattgcaaagttccctcataatctctaaagttcctggcgagaaggttcctaggagcaattacaaaagtgcatcgtcaagagggagagctcaatctcatggttgagtgaaggcaccacatagctaccttttgtgggatacctctcgttgtacatagctgcagccttctagtacggaagcaggataggattggagtaggaagtcttcattggagcacaaggattcggatgtattataaactagcttaagtgaattctgttaaccttttcttttacttgcctgaatcagacttttccgtgttgtagaatagtcattaatatcgtagaaacctccttttagtatgtgtgggtacaccgggaaagaaattgggtgtggtttaaatttatccgataatttaacatgtgctgtagcctgtgaaagacaatttggtttgccagcgtcgtttgatcattcattccttttctaaaaaaaaaaaaaaaaaaaaaaagggaaa

SEQ ID NO: 8503 - DNA, 1746 bp, Zea mays
gatctggtcctcatgaagaatgggtgccattgcgacaaccccgcgtccggccgcctcagatacgtcttgcgcaccctgctaccctctcaaaattcaaaactaggaaacgactcagggaaacagcaggaagttgtttatgggttatcggagatcatgtagacgcttgggtcaacaatagctgttggcgagagggagttatttctcagaattatgagactgatgagacgaaatatgatgtacatttttcagttggaggtggtggtgagtccttagtagttgatgcttggagccttcgtccatcgcgtgtttggaaagatggtcaatgggtagagtggtcccgtgcaagagaaaggaaatccaaatctaataagggcgattcacctcctgagaaacgccaaagaatcgacttgcttcaaactggtggcaatctatctgttcttggcgaagtggggggttcttcgaaggacaataatataaacaatgcaaaaaacccggaggaattaaagccattgtctttgtctcagggggaaattgttttcaacattgggaaaagtgtagttgagaataaatctgattctcttgcattcagacgtcctggactacaaaaagaaggatcaaaggtcgtctatggtgttccaaaacatggaaagaagaagaagtttatggaagtaagcaaacattatgatgcaggccaatctgacaagatttctgagggcaattcatctaacagattcgtgaaacatctgatgccacaattgccaaggccacgtgaaaatgcttccaaagttgaccctattagaggaaggagagtaggtgaaacaaggtctagattacctaaacctacgaagtcccacaatgttggagctagcagtgttcctggaaaggattccttgcctatgcaaatgcatgttccaaattctggtgtttctgaaaggagttctagttttgcaggaagttcgacaagcacttccaacaatgagaagcccacttcagaaaataataatccggtgcttggtgtgggccttagaactgaagtttcttctggtcctgaactgcaaactgcatctactgttcctagttccaagccaaatgtatccactactaatcgagctaaaaggaaatatgttcccactgtcagtaacacaaacagaggtatactaaaaacctctgaaaagtcgagttctgattctgctgagccccgaaggactacttctgattctgctgaacctagacgatctaacaggcgaattcaaccaacttcaaggttactagagggcttgcaaagttccctcgtaatctcgaaagttcctggcgagaaggttcctaggagcaattacaaaagtgcatcctcaagagggagaactcaagctcatgggtgagtgaaggcaccacatagctcatagctgcttttggtgggacagctctcgtgtacatagctgtagccgtccagtatggaaggaggatagggttggagtaggaagtctttattggagcgcaaggattcagatgtattataaactagcttaagtgcattgtgttaaccttttcttttacttgctcgaattatacttttccgtgttgtagaatacctggaaatatccttttagtatgtgtggatacaccgggaaagaaattgggtgccgtttaaattcatccgataatttaacgtgagtctgaacgtcaatttgactcgctactaaaatttgaaaaaaaaaaaaaaaaaaaaaaaaaaaaactcgagggggg

SEQ ID NO: 8504 - DNA, 2038 bp, Zea mays
gatgctatgaacttgagaactaggcaagttgtgtcagaaacatattctattcacaagctttcagagttaccgttggattttcagaaccttgggagctcagatgatccaagtccagattggagccactttccaatgttcgaaattaatcaaaagattgacagtattgtcaaccgtaaacgaaggtctccacctctggatctaaatgtgtctgcatcccatgtgatggccctatcgtcacaagaatacatgatgcactcacatcaaacagctgatgagacatggatacgtgcaaacctgcagaaggctttgcatctcgtgtagaagatcatgctggcttcaattcagatcctccagggccaaagttaaaagggcaattattggataccatgtcatgttcttgcagcaaggatgacaacaactcagcagattgtctaatagatgagcagcacacaagccactattttgcaaactcaaagcatgaactaccctctgtatctaacaaaaagaagttcaagtttgcaggaaacaaccacaatcgaattgttgcaagtgcgtcccacgatctgaagacaaaaagatctgctgtccataaacaacaaagtgctgcagaggcagtgttctgtgcaccagtacttgatagtgagtttcagaatgaacctataactatttccaacatcgacaagaaggatggtgaaaattttcatgatatgtataaatgtcttggcaaggctgtttcgtgtcctttgttaccttatgagcatcgtcatctgaatacacagagaacggaatctgcaggaaatttgaaagtctgcacgcttcctgatcatcaaactgcaaataaattgacagaaaagagtcatggtgagctgctgacatatggaccaaagtcaaaggaaatgtatacaggttcttgtaaccaaagaaggtcttatttctttgaaaagttaacgattccttccaaatcacaaagtgcatatcctaaaaattctgcgtcttcaggaaaatctagcgactttggagtttgtatgtatggcaccaatattggcagtcagttattcagagcacagaatcaatcttcagctaagactgaaacattgcacagcgatactctcattgggtccaaatccccagcaggtgaggtctaccatctatccaatcacgcgccacggtgatcctggtgtggcatctcgcgacgacgctactagaggcgagtggcggcaagaacgacccgctgccacccaccggcgaggcagccctgatgctgtctaggtactgcgcgtatctcgtggcctacgagccgaggctcctgccggatgatccggcgtggacggagaaggcgtatcgtgacatcaaacgcgagctcgccggcttcttccagggctgctgcacctgcagcgtggcgcggcttactccccgccatggccaccacctccgtcgccgcctcctctccccatccccatctgtcccgcccccgccggcggaactccagcgccacctccagaacctcgatccggggctgcctcctgcccatccgatgctcgtccgcctcgtcgtcgcaaccgccggcaaccggcggcgaggagggagagtcggggcgccggcggctgtcgaagcagtcgtcgtgggaggacagagatgtggagggggacgactacctctaccgcctcgggaaggaggctgacaacttgaacatcaccgttggcgcacggtccggcatcgtcgacgaactcttcgtcggaaacttcctcgggaaagactgtacgtgctctgaaaccagatcggctctcctacagtccactgattccatgaagcgccgtgaatcgcaaaaatactaaatcgacatacctgcatttgataagaataaagaacaatgtttgctcagcttagttcagtgtactgtttaaacatattgatatgcttggaaacaaaatcaaagggacgagttaaaagattttgatagcttggggtgcaacgtggttgcagcggatatcgtgttcgactaccggcagaaggcaactagaacgttcgagtacctgca

SEQ ID NO: 8505 - DNA, 1302 bp, Zea mays
  misc_feature (7)..(7): n is a, c, g, or t
tatgatnccttcagaggtggaaaaccaacttcattgctaaagctatgaccaaactagatgcctcaagtgttgatcgcgacaggatatcggcatttgataaggtttcttcattgggactgattggactaggagtaatgggtcttgctgaagcttgtggtatagctgttcaatcaatattaactgttggtggtgtgggaggtgttgctactgcttttgctgctagagatgttcttggtaacattcttagtgggttctccttgcaattttctaagccattctcagttaacgactacataaaggcgggatcaatagaaggcaaggtggttgaaataggactcacttctacttcattgatcaatccagaaaagctccctgtcatagtacccaactctttgttctccagtcagatgatagttaacagatcacgagctaattggcgagctagtgtgacaaagattcctatacgaattgaggatattgagaaggttccttctgcatcagaggatataaagactatgttaaggtctaatcaaaatgtgtccttggatagtgatgttccttactgctatctctcgagattggaaagttcatatggagagctcaccattggatgcaacctaaaaaacatgagaaaagatgagtggctatctgcccaacaagaaattcttttgggagctgctaggattatcaaatcacatggcattgaactgggaagcaccatgcagtgctgttaattcacgcttctggcacttttaagtaggataaataccgttagcctgcagaagtgcagaacttcatacagatgctacctagccgttttgttcttcaacgttttatgtcttcagaccatggacacccactaccaatactattctgttactgccgttttctttggaactaaggtctagtttccttttgtggtcgtcccttttggttggtgcttggatccgtttctgggagcttctttgtctatgtatactggtgaacgtttgcgccgcgcccacgcctgccctgtggtctgtggatgagccctgagcgttttattggtcaattctgtgaaatactaggtatatacccgtgcgttgctacggaatcactgaaaggaaatgcatacgacctcgtagggtggctgcaatgttagttgcaaagagagtggcagaagagtttggttgtcggctgggagaggaagttggttatgctatccgtttcgaggactgtgcaggtccggacacagtgattaagtacatgactgatggtatgcttctgcgtgaaataattgttgatgagaccctttcccagtaa

SEQ ID NO: 8506 - DNA, 2466 bp, Zea mays
tactgtacatgtgtcacccttgttttcttcccattacaatattgtgattagttactgcagaaggaatacagtagcagttatgtcaggactatgaattttgactcctttatagcaatatgggcaaaatgcaaaaatagtggttatgcacgctgactgctctgtttaactattcctattacctttttttactaaagtagataatacttatatttgtttaacattactgaaattatcttgtgtttcttatactttaggtgttgctactgcttttgctgctagagatgttcttggtaacattcttagtgggttctccttgcaattttctaagccattctcagttaacgactacataaaggtgccctcatatttttttggtgttttttatttgacacttgctgaaacgatggactagtaagttgtaaatttcattcatttcacttgcggacagtgtagaactatggataaaatactcaattcttgtttcgttatagatgttggtaacaataacaagatgatttgtaccgtgactcgcaagtactgtgagattctcaagcaattacttgtgtgatagtggagtaaaaagatgtgttgtaatttgtaaaggatgagaaaagaagcattgtgtgaaagggcctctagctgagtcggttaggtgatctgaatagcactctttaggtcctgggttcgcctccccttgggcctgaatttcaggccgaggttaagaaaagtcactagctggttcctttggtcggcatgggtgaactgacctatggtggacgccccggggggtatatggggttggttgtgtgggttgagcgtcaaagcacgggtcaaggcccaaaccatagtgggtggcatccccatgtatgaggggaccaactttcgtggcttttctcggacgggctccggtggagctcttagtgaaataccgtgggggtggtctttcccccaccagtcgagtttttttagaaagggaggaatgttactaatcactagaaggatatcctgatttcaggacaaaacactgctcattgctagcatgtgctcgtcttaaacagatgtactttgcttggaggattatgtaaactgcaattcagttcttattgtgataaagcacagtagtaagcatccaaactgaaaattcaaaaggatgtctcacctaatggatgcccactgatggttattaagtggttttataagaagagaacatagatgtggggaactgttcaaatagctatgagtatacaggatgccatatgcttttcataaattgctagtttggttaatgcttctcatgtatttatgctttgagtacatgttagtctatgtgcacgagaaatttcaagaaacaccatccttccctcttgtgtttgcaaacaataataaatggtcaatttggactggtgatacttatcttacatccctttttagattcttactatgttctatagttgtagtcccgcgccattctcagttaacgactacataaaggcggggtcaatagaaggcaaggtggttgaaataggactcacttctacttcattgatcaatccagaaaagctccctgtcatagtacccaactctttgttctccagtcagatgatagttaacagatcacgagctaattggcgagctagtgtgacaaagattcctattcgaattgaggatattgagaaggttccttctgcatcagaggagataaagactatgttaaggtctaatcaaaatgtgtcctttgatagtgatgttccttactgctatctctcgagattggaaagttcatatggagagctcaccattggatgcaacctaaaaaacatgagaaaagatgagtggctatctgcccaacaagaaattcttttgggagctgctaggattatcaaatcacatggcattgaactgggaagcaccatgcagtgctgttaattcacgcttccggcacttttaagtagggtaaataccgttagcctgcagaagtgcagaacttcatacagacgctacctagccgttttgttcttcaacgttttatgtcttcagaccatggacacccactaccaatactattctgttactgccgttttctttggaactaaggtctagtttccttttgtggtcgtcccttttggttggtgcttggatccgtttctgggagcttctttgtctatgtatactggtgaacgtttgcgccgcgcccacgcctgccctgtggatgagccctgagcgttttattggtcaattctgtgaaatattgggttttatcctcgaaattctagtgttttacgtagtactcgattaactagactaataggtgaccatcttgaagcaattcgtgtttgacactgaacattcctgaggacttggacttgcatgccccaggatagattccaccgctgttttaccatgctgaacgtaagagtactgacaggctgccatgatcagcatgtttctacaaaaaaaaaaaaaaaa

SEQ ID NO: 8507 - DNA, 1099 bp, Zea mays
ccactccagcccgcccggagcgatcgacctctgaactacgcagcggaaaaatcccatcaaaaaacaaggggaaaaaacaacacagcatgaactgcttgaagaactcgcgttctgtcctctcgcgactccttcgccacaggccccacgtagccgcgccaccgccgccgacgccggcgacggcgccgcagccaccggcttcacggtactactactacgcctcccgcgtcaagccagccgtctcccgaccgccgccgcccagttgccgagatctaggcactactacacatccccgcggcggcagcaggtcgtccacttcaaccgccgccgcggcgggtcccggtggtaccacgaccagcggaagctcacggcggcggtcttaatcagcggcggcggggcggtcgcgttctacttcggccatttggagaccgtgccctacaccaaccgctcccacctcgtcgtcctctcgccgaagttcgagcgccagctcggcgagtcccagtttgcccagctcaagaaggagttcgggcccaagatcctgccaccgctccaccccgacagcatccgtgtccgcctcatcgcctcggagatcgtccgcgccgtccaccgtggcatctccgtccaacagcgccacgacgccttctacggagaggacgcctcgtatgggtatggcggcatcgccgacgacctctccatcaagaaccgcgacgccgacgctgctgcagcgctgcttggtgcttcccccggcaagaacgccagtgctgccgtggccgctcagcgagatgacgagctcctggatgacaggtgggtgaccgagagtcggagccgaggtaaggcacgtggggcgcaaccgcagacgggtcacctggacggggttaactgggaggtgatcgttgtcaaagatgacctcgtcaatgcattttgcctgcctggtggcaagattgtagtcttcactggattgcttaacaaattcagggccgatgctgaggttgccactgttgttgggcatgaggttgggcatgctattgcgaggcactccgctgagcagatcactaagaacctctgggtggcaatcctgcagattgtcatcctgcagtttatt

SEQ ID NO: 8508 - DNA, 1915 bp, Zea mays
ctgtcattctcttcattctctcgagtctagttttcactgcgctttaacagttactagccctctctaacaggtcaactattaactgatgacatatgcagtcactttcttttgaattccccctccccaaaacagtaaataaattaataaataccatgatagaaaggagagttagagtagctacgaatatgatgggaggcaccaacccaacccagcccagcccaggacaaaaacatcactggggacgaaaacatcaggcggggacaaaatccttttccctcgttttttagagattataaaagcacggaaccagcaaggaaaatggcgcgcggggcccacgacggcgacgggccagccgatgaacctgcaccgaatccgcacccgcccccaagcccaaccggagcgccgagtggtgtcgccgcggccgccgctcccctccactcgcttcccgcgcggggcccgcccgtcgccagctgtcgcggtccacaagaccacaacaatggaaagagcgggcgcgcctccagctcggcgccctgacgtgtaccgctctttcgcggcccccccgcggcgccacgggaggccgagcaacccacgcccaccgacgtgtggggtcaggatgccgaccggcgttgccttcgcgcgggccccgtgcctgccacggcgtacatggtgtaggagcaggggtatgtcgataaatacacctggagtggagaccccatggagtaggaataggagcaggagatagcgcgggcggggaggggaaggagacaagtgaactcagagaagaactagcgcggcgggcgagcattgcaagccgagctgcaggggcccggagcggagaccggaggagggagacgtcgcttgcgatgtcaccggcagcatccgccgccgaaaccgccgtcgtcgtcgtcgtcgcaagcgtcccgagccagcagcagagcagccaccgcgccgcggcgccgtccgtcccgtcgtcctacgccgtctgggagaaggagcggtaaggcggctgcagctttacgacgtcgtcgtcgtcgtctgccacctgcctactgctgctgctgctgcaagggaaggaaaaaggaacggaaagggggaaggcatggaggtggaggcggccaagtgcgagtgctgcgggttcacggaggagtgcacgccggcgtacatcgcggctgtgcgcgcccagtacctgggccgctgggtctgcggcctctgcgccgaggcggtgggcgacgagatccggcgcgaggggaccatcaccacggccgaggcgctcgaccgccacgtcgcgttcgcgcgcgcgccgcgctcccggagggcgcccgcggaggacgacctcgtggcggccgtggcgcggctgctccgccgctgcctcgactcgccgcccgcgtcgcctgcgccgccgccacagagccggaaggtggccgcagggcccggctgccccgatggagccgacgcttgaagctgcttgcttaattggcggcaatgattggggggttggttcagctgctggtggattaattagttgtactagtacaagaataaacctccagtggcataatatgatggtacaagtgcatgtgtaggtcgccttcccggagaataattcgtgccggtatcatttgacgagagagggggcaaatcacgctccgtgtgtgatcgagcatgaagctattgttaagcatatcactcattggagtacatcaggacaaacactgttccattagttctgcatattcaggttgtaagaatattgtattggagtagtcaagtgctatcttcttgaattcaattcaatcgaagtaatttgatacaattgtgtccaaggaggcggccgaccatgtaacttgctcattgtgtttaggatatttcgtacctttttatcggtgttgggacccgaggggctaaccaaccagtg

SEQ ID NO: 8509 - DNA, 1592 bp, Zea mays
cgggtattactcctctggctgcagcattaagattattattcacaaagaatgcaatgaattggtttgctcacccttatttggcgttcctaatgtttgtccctacttcattgattggtctattgctgccaaggcttacatgggggctatcggagcaagcacacttttggggtgcttttgggttgtattctttaataactatggtctacacactagctgggctgagtggaggttttctaacatttttcatttccatgtccatgcttcttggacgatttatctctagaatcattaggaagcagtggagccaacaatcgcctaggtcgttggttgcgtatgtgctgcctatgaccccatgtctcctttacggtctttactatggtggattccttatccagttcctgattgaaaagatgggcatgatgggatctcttccaaaaccatatggatattttgtgcctgatgttattgttggagctgtagttggattagtggttggttggtgttttggtcctctatcacctgttgctagtcgttggttgtcgaagacttcaattatccatggcttcctgcaaattacagtggttgctttggctatctcatcccaactgtttccttacagcactggagcaccaaaaagagttgttcttcaacatacttttgttacagatgctaataatatcgtggattcaagctatggtttctctgtggttgattctaactcattggagttccttttcaacaatgcacctgaggccgccaaatggctgaaggataactctgagttgtcctttgaagaaaaatatcggtctgatagaagctcatggttggctttgtatcctgtcccattcttgttctctggaagtttaaaattccaggcacaaactgaagagattaaaaagtactaccagcatttccctcagttagctgttcaggagatctgggataacaatggacagcgaagggtgcatctcaaacttgcacttggttccttatcagaaatttggacctctgtgctcaatattactgggccactatcaaattggtccttcgctgataacatgctcccagctcctcaaactgtaagtggtgggccaccatcatatatttgtcgactcagtggaaagagcgatgtggattggtctttctggttggaggcaaactcttctgaaagtctgagagtcgatgtcgcagtacttgatcagtaccttgttgatagtacaaagaaactcaagagcctcttcccaagttgggcagacttgacagccttcacaacatttttctcaacgtatcatttatgaggaggtcaagtatttgatgcccaacaagtgtaaatcattttctctttgtagccctacgtttcggggctatatgtggttttgtcaccatgatcagctggacctgagccccgaggctggtgtttgtaaaatctttgtaagcgtgccttgatgtattcatgaatcacacaagattgtaagaatctcaagtcagtcataaattttttaccacttagtcattcacgattgacggtatggcatcactgatcattcgggttcttagttaaaaaattctaaaaagaaatgttgcattgacgt

SEQ ID NO: 8510 - DNA, 6754 bp, Zea mays
tccccggcgatcctttagtttcgacctgcagccctaactgttgcacagagaaggttgactttatctcttccatttttgcgtgtattgtctactatgtttattgccatttaattttatccattaaaatatattcggttctcttgatataatgatctatagttgtgttctcatgcagagcttgctaaattatgttctttattgtttatagtggatggtcaatggggaagtctgcattggaatatttgctttgaggagcatcaagaaggtagggctagaaagagtgagggttggtttgcttcatttatagtcccagtgaattatacataatgcataatgacactggtcaactgtcagtgtgtaatgggtatgttctgttcttgtaatatagggtgaagaattgacatttgattacaattatgttcgtgtatctggtgctgctcctcaaaaatgcttctgtggtactgccaaatgtcggggttacctgggtggagacatatcaattgtcgataccatcatcacccaagatgatacagaagcagatcattttgaacaaatggttgttgacaaagactccaaggagttgctgggtccaaatgagtctgattctgatggtagccacccaaatatttcagaacctgaattttctatccaaggggaagatttacatgattgctcagctgcaaaagtagaattagatctgcttgaaggaactagaggaacctcattagaaactagtgagcctgaacatcccttggaagcatggagcccaccagaagatgaagatgtcattcgtacgcctgtgcatgtgtcacggacatttgaaagttctctgcagaagttctcagtacatgacactcagtcatcagatcttttgcgtaagactgcaaattcaatggaaggatcaaaggctccaaatataacaaacggatcgacacttggttctgatttcaggggcaatctggtgcctactttcagacctgctgagagaaaaaacttaaaacaacataaaaatcagaaacgacaaccgtcttctccaattgacaatgaacatattttgggaggtactattttgcctcatgctttcctcttcccactttgaaatgtgatggtcttagtggtctctccttggtatttgtagttgaagggacactgaacagcctactggatgtggacggtggtatcagcaagcgaaaggtatgaaaccatcattatcctctttattatacataatctagattctagagtaccaggttggcaggttcgcacacaagatcctttttgtgaaagttgtggatgattcttattatgatgcaattttcgtatgctgaccacaaaaccattcccaattggatctgattctatgctatgaaagtttggaaggcacatatggctttagaagattataagccttcgattcattggagttatcattctgcatttctatgttctaactagtcaacacatcttctggatcaggatgctacaaagggatacttgaagctgctcgttgtgactgcagcagaagatggtagtgctgggggcacatccaaaaggtttgatcaccatatgaattgtgatgcaaggtttcctctcctaaaatatgctaatttctttctatctatttcagtctgagggatctttcgttgattcttgaggcacttctaaaaacaaaatcacattcggttctgttggatatcatcaataagaacggtaatacatcctagcattccttcaactctctgtatgaaagttcttcaggcaccaactaagaactttttgttctattttgtggcaggactgcaaatgcttcataatatattgaagcagagtagaggcatcttccaccggagacctattatacggaagcttctgaaggtctgcacttcattctctaataaaatgttaccagctaccataatattcacatcctgtttggttttcagttgacatccttttattttcacataactccctctagtcacaaataagtgtcattttggacagcgacatggtttctgaagtacaaaatagcacaaatatagtgcagctttaatattttgaaattacttttgaaagaaaaatctgaccataccatttcaaaaattcattgaaaatatttgaagagaaatcaatggtcaaagtttaatcattttgacctggaaccataaattacattatttattggaggtattacatcataatcagggtgatatcacctgaacctggggttactgtgcatgatattggcatcttccttcaggtacttgaatttctagctcagaaaggaattttgacatctgaacatataaatggaggtcctcggtttgctggagtcgaaaggttacattatttaaacttatttttccagtgttatttggtactgattgaagggttttatattcagtttgtttctaggtagtaggtaccattactttttttttgtttttatttgtgtaatgcctttttgacgtgaaagggcttctagcgtaatggttaaggcttccaagtaacatctctaggtcctgggtttgatccccctcgggggcgaatttctagcttggttaaaaagatccgcttgctgtgccccgaccgctcccggtttacgttctgcgcgctaccctccggctgggctgttgcagtgcgggcggtgacggcccgctagtgatgggggcagggttcgggggttttctcggtcgggaccatgtttcgtctcttcttaatttaataccggaagggcggtctttccttccccgaccgagttttttaatgcctttttgacctgaactagcatgtggtcttctctaagcgaaatgaaatccttatctcagtacaaatgacattcttgcttgttactttgtggttccttaacttctaatttattctcttgttacgcgataggacagttttcaaattgtcattgtttactaaactaagccttggtcagtgcaataacagtgcatgacaatttagccttgatctagaaataactcctacttatgttccttgaagctttaatcacagttcactttttctataacttcatatggaacttgtactgcgccctctgagacttgatgctgagtttaacaagacattcagacattcaggtaatgtgaataccatgctaatgcagtctttcagctttatggtttggaaatatgtgcatagtttcttatttggtagacttaaaacacaaaggttatgcctggagttaggcttccacatatttcgccactgaaatggccattacatttgttggaaagctagttaaagcaggacaggttatgttctgtacactgaccatgtgagagtcttgatttgctaaaacttgttggcttgttgccttagactaaagtactaagggcatgtttggttgtatacctatggtgccaaaatctgccatatattttctgtacttgcttaatgttaggcgctcaaaatctgtgccacattttggcatgcctaagggcatcttgctacacttttacaagtaattgacaagtgggacctacacagcaggagaaaaatcctgccacaactgtagctacaaaccaaacacacgcctaactcggtcaaatctgtttaaaccttaggtgtaggaaactgtggcaagtgagacaacaaactaaatcggccctaagtacgaaagtgtggaaaaaacacaagtcgattacaaacgattgtttttttgcaaagtgagtcatggtaacgttaggttgcacctggaaacttaatgtccacttattaatttggaaaacaccacctgtagaatgataacacaaatcacatggatgaattttggaataacgttatggagctgtgctgttatatttctttggtgagttgcaaatggcgcagtttttgtttccacttctattctggatacatggatgtctagtatgattccttggtagtttcctgtagaccaattcattatggaaaaacatgaaaacttttgatagtttcaaaaggaagtatatcactataagcggtgaatgtacaacataattaccatacttggcatgggcagttaaatttaaacctcaacatgctcttgtgttcctataagccacttccacaaccagcaattacataccaagcactgcttttccatgaagcggcatgtgtctatgattttgcagttgtgaccctaagaaattatctgggaactgctggtgacttctcatatcttttttttgtactttagttttttaatgaaattttcatttgatttttatctgtatgcgtgtaatccttaacatgtcaatcaatctgtcaagcctaaaatactctgctttctcctcgtggccggctcggcagattgctcggagcttccgtgatagatggatcccccctaataatgcaaggagtgaaccaacagaatatccacatacatcaacatttgtgcatgatatccagggaaccaatacagtctggagttctgctaggaggaaacgcaagagccgctgggactatcaacctgacgagcattataagatgccgggactaaaaatccaaaaagtttgttctggacatggtgaatttgatgttcagtttggctttatgaaaaataagttaaagaggaatcagggcgcaaacaactatcataatgatgttcttggcatggggagttcaacagagggtgaagatgatgaagcccctcctcctgggtttgagtcccagctggaccgtcggcctgcacaactttcaataggcagcgaggttgctccaggactttgcatggagaggtaccaatctagcttgagtatttcatatggggttcctgtaactcttgttcagcactttggaacccctgaatctgaaggaggccaatgccataaaaaatggaaagttgcacctggcgtgccttttagtccttttccaccattgcctccctatccgcgagggaatccttgcccctccacttcgtcttcccagatgtttcagcatgatggaacaccccaagttaaacataacaattctggacaacggggaaggatcatgggccgagatgggagagtgcataggtcatggagaaatgagtcaagaacaaaatggcaataccatcatcaaggaaggagattttcgagcactcatcatagatttgaaagatccgaacctgcaagacctcaatagtgattaagggttcagggcagtgattggtaccaaccttgcagtttttgaacctcaagtagtggtggtatacatggtaattcctgcttgtcagaagtgtaacagaaactgtgtcaggctttaacgatgtttaaagagtgtaaatttcagttcattgggggtagagcgtatgctgcacataggccattttccagtgcagtgttactaattaatttggtcattgtttctctctctcccaatgagtatttttcataggaacatttttttatttgatttaatcctttttacaggtgataaggataaccaagtttagcgacaatcctctgtagtctcgtttggttctttgccttttttccccttttgctttctcagtaaagcttctattttggcagtgtttatgtgtttgtttccttagctgcagcacgttattttcactccaataggtaagtcggattttttgggatcttgcacatggccttttgaatctgttcaatttcttggagtgctcctaatttttagtcctattgctttttacatttcgatgcctcctgaacttaatcttatgatataactgaagttgattcctaatcattgccctcttctactaaacgggcacacatatgaactagcactttgctacaggaattcccaggtaagttgtcctgaatccaaatctgatcacatttcccctgaatgtctcattatataagttgcatcatgcaatactggaacacgatttgctagcgttacgtggtgatatctgaccaaatctgctaatgtctcatgttttcttgacggaatttgaaaaagttatgaccttagcgtcattttgtgacatctgcccagatttgctcatgtctcgtgtttttttgttggaatttgaaacagctacttcaaagaaatcaggcagtttggtacttgggcgcgtatatggttggttttggaaatgttgagggtttgacaccttactcgctggaatttgaaagttgtgagattagtttatttgatatctgggggtcctatatctgtataccgtaacccttgcactccaaccaatttattattattattattttctgcgcgggatgagcttgttcggttaaatgttgtcgagaatgtggccatgcttctttatatgtttctgatttaattttgtcaatgaaatgtctgatgcgaagcttgctactcagctacatgcgacggtgcagactgcagacgtgctagactgctagtagattcctgtcctagaagcttgtaatccttgcggtcgaaagcgctcgacatattttattttacacggtcttctatctttaatcactttttccttttgaaatacttcataggtcggtctcagcgataatttcacctgcatttaatatttagcacataaacattttttatgtcatgattttttttaaaaaaagataaaaacaatttccatcttgatataaattacaaaattatttgcatataaaattaggtaataattttttttattgtaaatggtggttttatctatattttatctcgttctatatgacgtgccagtcttaaaaataacgacataaactttcgttaaaattggccttacagggtcatctgtgcttatctttgtcactca

SEQ ID NO: 8511 - DNA, 1990 bp, Zea mays
gtacccttcgagggccggccaattattaaacaaaagcagttgtctcgataccaaaaccgcgtatctcaccccgcctccttttcttcgcgtcccccgcctcgatccgatcggggacgggtcgaggggcaggggaatgtcgtcgtcgtctgcgtcatcttcggcggcggcgcaccaccagcagcattaccggcggcagacaggagggagcggtctcgtgccgctcgccgcgctcatcaaggaggaggcccgcacggagcgccaatccatagccggcggcgaaagcaggatctccgcgcgcgacgatgacgcggcaggagtaggaagctccggcgtaggaggggaggcggcggaggcggcggtggagtcgcggctggagcgcccgctgctgcgctatgggtgcgccgctcagtgcaaaaagggcgaggacttctttttgctcagaacggactgtcttcgtcccgccatctccgtctcctcctcggcctccccgcaccccatcttcgccgtattcgctatacttgatggccataatggtaacgcagccgcaatatacacaagggacaatttgctcaaccatgtccttagtgctatgccacgggggctgtccagggaggagtggttgcacatgttgccccgagcactggttgcagggtttgttaagacggacaaggagttccagagcaaagggcaaacttctggcaccaccgctacatttgtgataattgatgggtggactatcactgttgcctctgttggtgattctcgctgtattttagatgctcagggtggggctgtttctttgcttactgtggatcacagactagaagaaaatgttgaggagagggagcgcgttacagcaagtggaggtgaagttggaagactcagtgttgttggtggagcagagattggtccgctacgatgctggcctggaggtctatgcttatcaagatccattggagatatcgatgttggcgaatttattgtccctgttccatatgtgaagcaagtgaagttgtcaaatgctggaggaagacttattattgcttcagatggcatttgggatgcattatcctcagaagccgctgctaagtcttgcagaggtttgcctgctgagcttgccgcaaagcaagttgttaaggaggcactcaggacaagagggctaaaggatgatacaacttgcattgttgttgacataatcccacctggtcaaacaatacggcctctgtctcctcctaaaaagacgagcaagctgaagtcttttatttttagaaagaaagcgaaggacccttctcagaagttgactaaacagcattcagctgttggtatcgttgaagagatatttgaagaaggttcagcgatgctatcagaaaggttaggtcctgatttggatggcaggagaacctcaagcctgtttacatgtgccatctgccagttagacctggagccaagtgaaggcatttcggtgcatgctggatcgatcttctcttcgacctccaggccatgggaaggcccattcctctgctcggactgccgtgagaagaaggatgccatggaaggcaaacggcccagtggcgtcaaggttctgtagtatacagcaaccgatccttgtagctgcccgaaaaatcccacccttcttatttccttttctcgtgaggaccctttcaaagttttacaatttgtttcctttaaattcggatgattttaggatgcgtcttattttgcgaggaaatagccaactatgtaagtagctgttggcaaaaggaaatgtgaagcgagcgaatagggcatcccttcatttttctttctctcttccattcggaatggatgaatagggttgccttcaatttttgttctcttccattcggaatggacagacagtaactcagctcacgagtaatgacagctaacatattctttatttgtaactatcggtgcattgggcaatggaatatttactgcgtaaaaaaaaaaaaaaaaaactcgagcccgg

SEQ ID NO: 8512 - DNA, 1035 bp, Zea mays
  misc_feature (33)..(33): n is a, c, g, or t
cattgggtacctcgaggccggccgggtgttctnattaccaacacgaagacagggctgtgggatgttaatcttaatggaaaggcaatggtgctgtggaaacctgtggggagagttttcaccgttttgacaaatatcttaatttttcaaatccacacattgctcggaactttgatccagttgccgctgcctcggccgttgggatccacatctttgatctgagggagtggaagaagaaagatattactgcggatctaccacaaatggcaaaatatgaatgaagacagggtcctttggaagcttgggacacttccgcctggcctcttgaccttctataagttgacgcacccactggacaagtcatggcatgttcttggattaggatacaacccaagcattgaccgttcagagatagacaatgctgctgtggttcattacaatgggaacatgaagccatggctggagctagcaatgaccaagtaccgaccatattggaccaagtatatcaagtatgatcacccttacatccgtggatgcaacttgagtgagtagatagtcgtgctgaaaaactgacagatgaggaagagcttattggacagaagtgttccactaccatgtccttgcggtgcgttattcgactcagcaaagtggtactacctcaagctcttgattgctttcctcccctcctctcccaagaaaaattcaccggtggctgttctgacgagtgatgtattattatagcgatgcgttttttaattcaattattagtaatatgcatttatattttccgtcaaaattagcaggagaaaaacttataaaatggatttgtggggctggtgtcgcgtgctgcttagaggtatgcctagagaatcgagtgttgccggaattggatccttttttgtatcagacgataaagtgggagtacaagccaaagcggaaggcatgaatcgaatggattacaggtttaaccctgagtcctgaccaatgtgaaactattttacctacagtatcaagaaatgctgggtacccggttttggt

SEQ ID NO: 8513 - DNA, 6358 bp, Zea mays
gcgcccacgcccacgtccacgtagcctccggtccgatttgcatctcctcttcagagcccccgttttatttttgtgtcgacgcgaggtgtttaattctgcgtcgcttgtgcgatgagtgcctaaattgagtggagcttggtgggatttgtctggattttgggcttgatgcgctccagccgtactctgacgcgacttttatttagtacccgctgcgctgttgcttgattttttcgtttggatggaaactgtgtcggtggaacattggtgctctaaggaaacgaacctagtcactctcgggattgcaggaattattatcccctggcgctcaggtattatcggattgcacgaactgttattccttatatgttgctgttgctaagttgtaggtgtatataggataagtgggtagcgataggttaacgttgtcgaaattgaagtgcatgcatacaacagtgagctaacaaaactataatgcaactgtataatggatggtcataagcatgctgaacaacgacggcattgccattgttggctgaaatgtagtattatctatgaaaaacaatgcatatggttccacattattttgttgttaggtgtaagaacaatgtactactccctctgttccaaaatgtctgtcgatttagtttgctcctaagtcaaggctctctaaccttgaccaagtttatagaaaaaatacatcaaaatctacagcattaaattagtttaattaagatcatcataaaatatgtcttggcagtctataaatttgatggtctatattttaatatctttttatctgaatttgctcaaagttagagagatttgacttaggaccaaactaaaacggcatacattttggaatgaagggaatacatttttgtgaattaaaacactgcactttctgaatgcattgtttcccctgaagtaggtaagcattgacatattctgcttgcctgcagatcgcaagggtaagaatggcaatcaggtacttaccaaccctaaaaaggtttcaattgcttaatgagcataatttttgatgatttattttaccttttgaattgtcttgcaggaagcagcagcaatgaagaacctcaaatctattttgcctaaggaggtcagaacgtcttgtgaccaaccctgcaagggtttcaattgcttaatgaaaaatacttttcacattgcacatatgctccttaggttaaactaccttagatgctaacttctctcatcatactaatactaagtccagatgttctacttttcaattgtgtgtgttatacaccaaactgtatcaatgcatggcccatgtcataatgtggtgaatgaaccctagatttagacctcattaatcacctgttttttatatcattcatggcaagttggcaactattgttatttccctgtgttatgtagttatcagttatagaaaatattattcccagcctagtctgtttgactaaccttgttccactattctggtgtgttttctgaattcgatgttcttccatttcctatttttttgttttctgtttcctttctattctctttcatttgtttgggtccaaacttttcatttgatctttcatcttcttaatttaatggcaggcagtcctgccggtctggagaaaatatttttaattatttagcttattggctactggatgtactattgcagtctgtttgttgtatgtttgtgttaattcagtaactagtattcataatgttggctgtgtttgaaacagccattaatattttttatgcatccttatttttttttgtgtttggccatttttttcgtcttcaggtgtttgatgctataactgctagtcaacaagaatcaggcacattgagtgttgatttttttaggaatcatgcatctccctcttggaaaactgatgatctagtcaccgagaagagcatggatgtcaatgacaatgctaaagctgaaaatagtttgctagaacattctgtgccatcaaatagatcacccaaagatccaggtactgaatacacataaatatcaaaaagctattattgcttctctgcttatgcaagccataaataaagtgtttttttaatgtagatgaacatcaagttgacaaagcagcaaaagtagctcgaagggtaacaatactattttttgtcaattcaccttgttctggtctctgttgatacacatttctcacgtctttttttacttgcctgtatactgtagaaacttagggagaaaaggcgtgagaagagagcaatggatttggttcataaagatgatgaagcacgtattaagctggaaaatgctgccattgagcgatcaaaagctgtcgattctgctgtgcttggaaaatacagcatatggcgaaaagagaatgagaatgagaattcagactctacagttaggctgatgagggaccaaattattatggctcgtgtctattctacgcttgctaaatcaaagaacaagaacgatctatatcaaaaactgcagactcgaatcagagaaagccagcgggctgttggagaggctaatgctgatgctgacctgcatcacagcgcaccagaaaaaatcagagcaatgggtcaagttttatcaaaggctagagaagaactttatgattgtacggcaatcactcagagaataagggctatgcttcagtcagctgatgaacaggtcaggagcttgaagaagcagagtacatttcttagccagttggctgcaaagacaattccaaacagcattcactgcttgtctatgcgtttaacaattgattactatatcctgccccttgaggaacggaaattcccaaggagtgaaaatttagaaaacccaaatctctatcactatgcacttttctctgataatgttttggcagcctctgttgttgtgaactcaaccataatgaatgctaaggaaccagagaaacatgttttccatcttgtgactgacaagttaaactttggagccatgaacatgtggtttctgctgaacccacctggcaaggccaccatccatgttgagaatgtggacgaatttaagtggttgaactcatcatactgtcctgtgttgcggcaacttgagtctgctgccatgaaagagtactatttcaaagctgatcgtcccaccactctctcagcaggttcttcgaacctaaagtatcggaaccccaagtacctctctatgctgaaccacttgaggttctatctcccagaggtctatccaaagttggataagatactcttcctcgacgatgacatagttgtgcagaaagatttaacagggctgtgggatgttgatcttaatggaaaggtcaatggtgctgtggaaacctgtggggagagttttcaccgttttgacaaatatcttaatttttcaaatccacacattgctcggaactttgatccaaatgcatgtggctgggcttatgggatgaacatctttgatctgagggagtggaagaagaaagatattactgggatctaccacaaatggcaaaatatggtgagcattcaattcttgacactgaattgcatgatttacaaagaactgacaaatatgtacattcttagttaaactcatcatatctcacatattcctcctgctgttctgttctgtccttttagaatgaagacagggtcctttggaagcttgggacacttccgcctggcctcttgaccttctataagttgacgcacccgcgggtctcgtcatggcatgttcttggattaggatacaacccaagcattgaccgttcagagatagacaatgctgctgtggttcattacaatgggaacatgaagccatggctggagctagcaatgaccaagtaccgaccatattggaccaagtatatcaagtatgatcacccttacatccgtggatgcaacttgagtgagtagatagtcgtgctgaaaaactgacagatgaggaagagcttattggacagaagtgttccactaccatgtccttgcggtgcgttattcgactcagcaaagtggtactacctcaagctcttgattgctttcctcccctcctctcccaagaaaaattcaccggtggctgttctgacgagtgatgtattattatagcgatgcgttttttaattcaattattagtaatatgcatttatattttccgtcaaaattagcaggagaaaaacttataaaatggatttgtggggctggtgtcgcgtgctgcttagaggtatgcctagagaatcgagtgttgccggaattggatcctttttttgtatcagacgataaagtgggagtacaagccaaagcggaaggcatgaatcgaatggattacaggtttaaccctgagtcctgaccaatgtgaaactattttacctacagtatcaagaaatgctggtgtccgttttatgataactgatctcgtagctaatcttgtgtttctcggtcacgtgttacatggtgctagcgcctgagagattggattagtcaatttatttcacaaactatgacattttcttctagcaaaaaactagaaaacaaataaactatttatttacaactacattgttactacgtgtattattacctctatcataaagagatatagaacctaggtttaaatctatctactagccgaacaactaagctagaaaaataaaacacacaatttgagaaatttgtaattttgtcacactcagttttggcttttggctccatgttattatgccaccatgtgtctataattggtgggaccatatgtgtctataatttgtgggtctgatgacatattgacgaataccataaatgataatggcaaaattgctaatagctccacaactaaggtgtacatagtaaatgtagaagttaagaggtcgatagagatacaaagtttccttaatatctcttatatttttacgggtatcaagaagcgtgcaagcttctttctagtttttgttggagtctctcataaggatgcttatatgagggctaagctttccatcgggtaactctagacttgatcataggctactcgaggcaaccaacccgacccgctcgaaataacatgactcgaccaatgcgacgggcagacatcggccaaaatttttgaaccgcaacgatccacgggctgggtacgtaccatgatttttaacctaaaactcgacccaacctgacactatgcacgggtcgggcgcgggccgtgtcaaacgactcccgacccgacccaatgtttgaacaggtctaggtaactctatgaatagatctgagtcttctccatgtgcaagtgagtctcctgaacaatctatctctaatcgctctccactatcttcactattgagttttttttcaaaacatcgctggcctttccagtacatgatgatagccacaccgcactataaacttagttgatataatcttgcaagactacaaactcctctaatacaactataattgtgtgcaagcatcaaggggcaaggggtattctagccccactcaaacattaggcgtaaacctagagcaaacactatgagtagtggtctataatctaaacattttagaagacacatgcactaatcattatgtgattttttagtacttggatttctagagccactaaagatgagtttcgactctcttgatatgctcatcatatccatatctcaaatagtcggttggggtggtatatatagcccctaaatctaaaactagtcgttggaagtgatatagaattacaacacactcatcacatatctaatgtgtccatgtcagctagccattggcaactaatggagattgagcgtatggtgcattatggctctctctagttgtgttgcaaccctctttgagtaccttgtccagtgctttgtgtatctagtattcaccaaacatgtttggtgccttgtggacttcctcaaacagattacaatcctccctaattactatgttcaatgccatatccggtgcttcatttggacatgtatagagcctgacatctggtttggttgtagttgctcttctttgacacaatgcttctcgtacccggtggtatcaggtgcatcacagacacatccaataatgttgagctgcatgttcttcgttgtttctttgtgcatctttatttgagcttcttccatcttatgccttggactctgcatgtactttaggtgtttattatgtattctaacatcttgcttgaggtgttgataatatagaacaccattttttcttagtccaagtccacttgtgcatcctttgaactatatccaaaatactagcaaataatgttggtctaaatgattatattgatcatcaaacactgaaaacatactttaaatgggcatcagttaattttccttataatctccttttggtgattgatgacaacacgacc

SEQ ID NO: 8514 - DNA, 1330 bp, Zea mays
cctcgaggccggccggggcgacgacctgattcactactccgctacgccgcattcggatccggccctgagcctttcccgatcccgcccgcttccctgcaccgctcggcacgatccgcccccgctccccgctcccggctccacgaccggtccgccgtcgagctcccggcgcttctgcggccggcgccatggcgaccggcggcggcaacgagcagccgccagcggaggccgagccgctggagctcgtgctgttccaggtcgccgagtgctacgtctacctgataccaccgaggaaaacgtctgcctcctacagggcggatgagtggaacgtcaacaaatgggcatgggaaggggcgcttaaggttgtcagcaagggagaggaatgcatcattaaactggaagataaaaaaacaggggagctttatgctagggcatttctcagagagggtgaaccacatccggtggaacctgtaattgacagtagcagatattttgtactacgtgttgaagagaatatagatgggcgtcagcgccatgctttcataggtttaggcttccgggaaagacctgaagcatatgacttccaagctgccctacatgatcatatgaaatatttaaacaagaagaaggcggctgaagagatgattcagcattatgagaagcaatcttcagtggattacagcctcaaagaaggggagacattggttcttcagcttaaaaataaggaaacaggcaccaagacaaaatcgacattttttgagcaaggcctaaacaagctctccgttaacgaaaagacaagcgccaaggaggcccccgtctcccttaaactcccaccaccaccaccttcgcctgtctcaccgacggattctggagtcgctgcctcgcctttcaaagcagaatttcctccccaagagcaaccacctgctgaacccgtcagcagaaccagcgctctcccctccaaaggcgaacctgctccagagctaccggctgctgcagagaagatgaaggagcaagaatccgtggatgaagacttcggggacttccaggctgccgggtgatatcatgtatcttgtacatacatcatgttaccgagactttttttttctttctttctatttttggttttcaatcagctgtggcttctgccggcactctgttcctgtatagagagcttccatctcataacctacatacaaatacatggacaaacgttgtacccttttcttcgagtttccatctcataacacctacgagggaggaggaagaatgaaagcaagaggagctacctcctccatcctttgggggtgtttggtccctgattaaagttgagttc

SEQ ID NO: 8515 - DNA, 1985 bp, Zea mays
aggggcgcccgcgcagatgagaaaggtgccccctctgaaaactttggcaacgaggatggtgagggagggaagctgatttggtggatgggaagagggcggatggggcaacagtggtttttgtggtgtgcaggagagtgacaggcagcacgacatgcagggtggagggtggcatagcagtggtggtgaaggacaggaacgtcgtcgccccgtactttggcatcccataggggaaacccttgtgcaaacgcctgctggtgctcttgggatgacatgcgggtggtgaaattggctagctacgtggcgatgtcctccaagactttcatcgtggcgtcgacgaccgacgatggtggggtcggtggctacttcttggagccatcgtcacccgacatttctaataccagattgataggatctaggattataccgtgactgtaggttgtacgggtaggagattgatggtcgggacgtgttcatgtgtacccctagcagtggataggagctgtggtcgcgcacagggagcaagcgagcgggggagatagacgtgggagattaccctttaggtcaggcaagataattgttttgattagattgatacaccttctctccttatagagagaggcttacttgatccctaagcaagcaatctttaatttaatggaaacctcctaacaagaatcaatcatgattctattttttatgaaaacaatgcaaaatatctaaggaaaatcttgagtatttcgcccctaactgcacgcgtggcctagccattgacgcggctccagtgcctataggtgacgccggtcataacaacaatactcaagagattcattgcttcagctgcacaccatatggatccttcattccctgcagcttgtaaaaccttgtttagtttaggaaacactccattgataaaactagaccaatcctaaaaggaataggtggctttattatatcagtattaagaagaaaataagcactcaaattcacctctaggacttgaacctaagtgttgtgggcgttcacaccctcaaccagctaggctcagcttccttgtctctttcgtgggctctatgatattacttattccataatattgtgctcagtggttagcttgagtcatggcacttggcacttaatttgaattggtgtggccacttcagtctcatgctgggtaatatattagcataacaaatcttaccatgaacttcagatgggcgtcagcgccatgctttcataggtttaggcttccgggaaagacctgaagcatatgacttccaagctgccctacatgatcatatgaaatatttaaacaagaagaaggccgctgaagagatgattcagcattatgagaagcaatcttcagtggattacagcctcaaagaaggggagacattggttcttcagcttaaaaataaggaaacaggcaccaagacaaaatcgacattttttgagcaaggcctaaacaagctctccgttaacgaaaagacaagcgccaaggaggcccccgtctcccttaaactcccaccaccaccaccttcgcctgtctcaccgacggattctggagtcgctgcctcgcctttcaaagcagaatttcctccccaagagcaaccacctgctgaacccgtcagcagaaccagcgctctcccctccaaaggcgaacctgctccagagctaccagctgctgcagagaagatggaggagcaagaaaccgtggatgaagacttcggggacttccaggctgccgggtgatatcatgtatcttgtacatacatcatgttaccgagactttttttctttctttctttctatttttggttttcaatcagttgtggcttctgccggcactctgttcctgtatagagagcttccatctcataacctacatacaaatacatggacaaacgttgtacccaaaaaaaaaaaataaaaatataataaatgtaaaaaaaataaagttaaaaaatattgaatataaatgacttatg

SEQ ID NO: 8516 - DNA, 2928 bp, Zea mays
ttatcaatgttgacacatcactattggtttgtgatctgacctgggagtgaaaaataaactaaataggaacactatcgcataaaaagtaaaaaagaaacaaaagataaaccaatcgctgagcctaatatatggatactactgttatatgacctcgttgtaatcaactaaaaggttttttttttttttttgccttaataattcttaacaagtaagatgattacattatgtaatttctataatcttacactatattattagtacaaacttgtgtcattgaaattctagcctgatttatagtcttttttgtgctcaaaaccttttaaaatgagtcggtgggtcttttggttgaccaaaaaaaaatctagtttctctatcataaaaaaaagaattattcgtacatgcattggcatccctatgcatgcgagaaatggaaagacgattgatcagaacgaagaaaatcctaaccctagcctgcaatgtgatgactcggctgccatttttgctgcttcagcttcacaggtggagacgttgacagcggcatcatccccctgtaggtcggcattgacgtctacattggcgttcatgtccatcgccttcatgtcgatgccaatgccggcattcatatccaccgtcttgatgtcaatgtcaacctcggcgttcacgtctgccaccggctgcaggtcctgccggatgtcaaaggcgtcgacgagtgacgccgcctttatctcgaaataatctttgtggtcaatttggcaattcatgtcgaggtgctgatgatgccttatttccccatccccagctgccggagccagatccactttctcggcggcggcacaactatcgtcaaaatcgaattgttgcatgttgtcgaggttgatgtctatggtaggcttgctacttgcatcgtcgctggcggtggcatcgtaatagaagtagtcgaagagctgctgctgttgctgctcaccgtgatgatcatcggtggggctgtggcctccaccgtggcggtggacgacctcgtcggtttgaaggatggcggtgtgagcttcgtgattcacgtagagtgcgtcaacgacttcttgctgctcgttggggagaagcggctggttggaggacgtgacgtcgaggtcagccatgccaccgccttgctgttgcggtgccatcacggtggttgtcgtggtagcctggcggcagaacgccaagtggtggagcacggcggtgagctcggcagtatcgatctcgagctggcgctccagactgaggacgaggcggtagcagccaccgacgggatcctgcgcgcgcatgtcggactggtagatgagcgtgcccatggcgtcggcgcagagttccggcttgagcttcttcagcgttttgaggatgttgctgacaccgaagagacggtgggcgttgaggaagcgccgctgctggtcggcagggaagtagggcgcgagcgggcagtccgggctgcacttgcgacgctggtacttgcacgccgcgcacgcctggttcgtgctcccgctgccgctgccgccgccaccgcctgtgcctccggtggtggtgctgctgcgtggggagctgctcgccgaatgatggcaggagcgcgcgttgatggggttctggtttgaggagggcgttgtgattacagcagaggtccccgtggctgtggcggtaatatgcagttgggaagcggatacggtggaggtcattctctcgccgcgcgcccgatcgtggagggtggcggcaatggcgatcgtcgggctaccaccaccgaggacgggggcgtcggtggagggctggccccggcgccgtcgtaggaataggagaggcgctgcgggctgtccgctccattaattagcttccgtcagcttcgtgatgcctattaaaagacaggatccatgcatgagtctgtggacctgtcatgcctgaagggaagatgggagttgtctgaaacggtcacggagggtgatcagtcaccccgagcatccggccacatgttacgttttaacaaaccaaattaatgtttgttttgcatgcttatagtcactaggggcgcataaagagcggacattttccatgttaactgcttgtgcgaaatggtgtctctgttcctagagttcatattcagaggcggtgggtcgagccatatcggtcagtacaaagcgattagccaaaatgggcgtcttaaattgttctccttttgttaatgcaaccacaaagacagtcccgctaaaatatttgtctcttcctattatttgagttcatgacataaaattgaagaactccaaatatattttgacacttcaaatatctcaaataaaaacaactacaaagctagctgtaaatcacgtttagtagagactgttaaaagtatgcatgtgtctttaaatagtgatgtctaaaattatagactataaattataaacctaagaactttaacaaacaaaattttgccctccaaaatagttctaaataaaaaataataattttaaagatgtaccatgtcaacgggctcaatattttttatataattttgtcttcatagaacttcacataaaaagttataatttaggcagctaattctgaaggcggtgttgtcttcattatcattatagaggggacacttctagcaaacccacctctaaaaataaatatttataaccaaagttatcttaggacttccaaatttgttaattggttaatagagttcaacgatttaatacaactgtctcctataattgatgattaattaatacatgtgttgtgctaatatattcatatctcaccaactaagatcataaggtttatcaaaggactgacaacaagataaggagatgggttagcccatgtactgctaataagaaaacacggaacaaggtggagtggctttcacggcaagcgaaccgacctaatcggctaaaaaaagacaagctt

SEQ ID NO: 8517 - DNA, 5895 bp, Zea mays
  misc_feature (3285)..(3285): n is a, c, g, or t
  misc_feature (3294)..(3294): n is a, c, g, or t
  misc_feature (5880)..(5880): n is a, c, g, or t
cggggcgtccatgtgcccagcactaccgccttattgactaccccttctattttactattagcatatagctcgtgctaacgctacgtttctgggaagaggtggacgacgacggtggcgacgcgaggggaggggttgacgtcagtggggacgatgagagaggagggtcgaggaattattcaaataatattgtctattagatttaagtgagtaagggagatgtggttattaacgatcagaaccgttggttttatgatgtgttaagtatgaatgcaatttatttgattgatatagtgaagattatgagtgtgtgagttatttagttggatgagtttgcaaaatttaaactaatgaattatatagtgatatacatagataataaatattgggtttgggccccaggccgtcacctcggtcgcatggcctcagggccgcccctgaacgagatggacgacctggacgtgtcgccggccggcggctccagttcttgcgaccggtgctctcctcttgctatctccatgcatggtttttattggttggtgccccgtccgatcatgcacgggtacgtaattatactacgacacgcatgcaggcggatcgatatgcttcaaggcgggcctgatgatccgagtatcgtcgttagcgcagtactgaggcagtgagcacgacgtaccgtccgacgtacgtccagtacgtgcttgttggaatcggaatgctgatgcatggtgcgaaattgcggattggactcgtcgtcgtatcgaccatgaagtccgtccgtgcggctgcaggggcctatgaaactgcatgcgcactggacggcggagaggatcggccgtgccgtaccggccgccgccgccggccggtcgtcttaaccggaaaagagaaagcggcggcggcgtgggtcggatcaatggaaccaggtactcttcactggtagtacatgcgtgcgtgcgggggagccaacatgatgacgaggtaacgtcgacggcgaaacccgtgagcgcgcggaaagaaaaccgccgctgagacacatcaaagggaggcacatgaaaaggagtagagggcacaggacaaccgaacacgatccgacactagacatagtcacataggtcaggtacggatggtgctaaatagcccacgacttgatcttgatctgacctgaatacgagccgacccaatgtttcatcaggtctaatcacaactcacatatgcaaggtaccagagatacacacgaacatgctccggcaattcatgtatgtggctggatctcgcacttcattgcacgcgttcccattatcgatctcagacaaggtctggtccctctgcctctccacgcgtacgtgcgtgtgtatgtgtcactgatatgtatatactcttattaatgtattacactattacagtagatctgactactcatcgtccgaaaaaactaaccacaaataatcctggtaccgtacctaacaacctacctttgctgggtcgtcctcgccaactgacacactgctactatatatacgtgcttgattgaccaccatgcatgataaacctagcttttttccccatcagctatgatagtacgtggtattattccaaaaagctacccacgcgtgcgtgcgtgtccctccagggaccgtcgggtcagcaaagtaaacaagaaaatggtgccccccctcccatatccacgcctttgtgaggtggccgagaacaatgggataggagtagcgcatatactctcgaccacatcatgctttcaatcagttgtgctggtggcgcgcgggcgcggcatggagacggacggccggccatagagaaagaacggtcggccggcgtatccgtccatacatatcccacaagtgtagctcgggttcagaaaagacatcggtgggacggagagtggtgcctatctttaatttacctgtcatttctgtcaaagcaaagcaatccatcgatgggtggcgagtgaccggcccattctgaagtcgatccagcaacagcaattggcgcctccactaccacttggtccgtcgatagagacgggtgtgatgaagatgaaggcgtaggtcgatgcatgcatgcatggcctaatactatttgcacgaattgcttgcttgctgttgctgccttcttcttttgcgggagatagataagtttagctagagctatatagctgcctgcagggagctagtagtagtgtgtgtagtgtgtggatatgatgcaggtgaaacgggatgggcaggtgcaggtgatatggtatctctgcatggatgatggatcaagtcggtgcagtgatactcccctagctagccctctagaggcctgcctacaagcaaggttaataatatagtctataacggatttttataatgttaccatatagactatagctaacagaaaacaatgccacacatctttattacttgatgcaacttccgtacaaaataactaaataaattatatagagaggtctcccatggcgacttttctttgccgagtaacagacggaactcgacaaagtcaagtctttgccgagtgcccaacataaaagtactcggcaaaaaaagttgttgctgatgtacagttcgccgagacttttttgccgagagttcacagtcggcaaagactttgtcgagtgttttctggacactcgacagagaagttgtgtccggtagtgaatgaagtcatccatatggaaaaggttccccggggtgcagggccaaaaagcttagcataataactagtagcatgttcgagcatatattcatctccttcaatcctttggccattgtcgtcaaagaagaggatagcacttttctttttccttccacttgcaattctataaccgtcttataaaatttgtctttttagtttatataatgtataacaaaaaagaaaaaaaaacatatataatgctctctttactttccataaaagatatcaaaccttactttccaaaaaaaacgcatgctcaagagttggatttttttttggcggtaaacggctatatatatatgtaggcatggtagtcagactctcagaatttttctaaaacatagcaatgtccacagctagctacagctggagcgctagctagctagctgttatttcttatccaagtcgtgtgtacgttgtgcgtgatatacagtcagatgattttgaaagacagtaacagcatccgatacggcagaccgtaccgtcgtctccgagtcaccgaccagaaatactgctgcagggcatccctccagggccctcgtggcgcattattcagatggttgaaaggctgctgtggangagccattngcagagacgataaacacatatacatcgatcgatgtataccgtgatgcactacggaacaagcagcagcaaattggccgggatcggttcatcccttttggaatgtgatgcatgcatagtgcaatgtgtgccatgcatatatgcatgtcgttacactgtactgtgattgatactccttcgattccagccttttaattcgtaaaatgtaaccttttaggttgctaaacgattgtaattactaggaaaatgtaattcatacgtagttaatctgatattgcttaattttttagtactgttagtaattttttatatatcaatcaaacctgaacttgtttgaacttaacaaaaaaaaaaaaacaaaactaccttgcaagaaggaagtactcacccatcgtcttcaatttctttttctttttattattcattttcgtgtgtgtgtgctgcaggcagttacaacagtcccataaatttccccgctaaagatagctaagaatgaacaggacgtgtgcatagatggagcccagcatactatacgtacgtactacctaatcccaatcatatgcttgctcctaataatccgccgcctaacacaccacccaccactgttcctctagtactttgctaataccacgaccaaaatgcaaggcaagctgctggctagattatccattctgccagcagtttcatcacaaccatgcatatcatgcatgcatggcatgcgcagctagctgcaatctgcatgcgaatgcgttcgaggctctcggttcggtcgcacacggctcttcatgatccctcctccctcttccgctgtgcgcgagcgaaacagctgacgtcctgacgcgaacacacacgcggacacgcccgcccgccgaacaatcctgtgccgccgttgggcgctttcgtcgcacgccgcagctagatagagacccggccgaacaaaacgaacgaatgcccggacgcaaacctggagccgatcgatccaggcaagagccgtgtgtgcgtggctccgtacgtctgccccgccgcgtcaacgtcggcgtcgtggacgggcggcgcaagccatcatatcggatggatggcgcagccagctcacgccacccctgggttgcgagacgatatgatccatcgaccgatcgatcatcctctctggtccaatccaaccatatatccgcccggccggaagcgtcaatccggccggcgcgagctataaataccgcggctcggtcgcccccacgcgtccgccgacgcgtgagcgcacgcaccatcgtcctgccgatcgatcgcagccagccagtcttgctgagagacgaactgaagcctgaagtgaaccgatcgatcgatcgatcgagcgagcgagctcccatgaaggcgttgattctggcggcggtgctgctgctgcagcacgggggagccgcgagcgccggcggcaacttctaccaggacgtggacatcacctggggcgacggccgcggcaagatcctcgacaacggccagctcctgacgctgtccatggacaggtcctccggctcgggcttccagtccaaggcccagtacctctacggccgcttcgacatgcagctcaagctcgtcccgggggactccgccggcaccgtcgccaccttctatctttcgtcgcagggttcgcagcacgacgagatcgacttcgagttcctggggaacgcgagcggggagccgtacacggtgcacacgaacgtgtacagccaggggaagggcgggcgggagcagcagttccggatgtggttcgaccccacggcggccttccacgcctactccgtgctgtggaaccccgcccacgtcgtcttctacgtggacggcgtccccatccgggagttccggcgccgcggcgacgggaccgtgccgttcccgacgtcgcagccgatgcgggtgtacgccagcgtgtgggacgcggaggagtgggccacgcagggggggcgcgtccggaccgactggtccaaggcgcccttcgtcgcgtcgtaccgcgggtacgccgccgccgggtgcaccgcgccggacgccgccgcctgcgcgcgctccaacggcgcatggatgtcgcaggagctcgacagcgccggccaggagcagctccgccgggcgcaggccagctacatgatctacaactactgcaccgataagtaccggttcccgcagggcccgccgcccgagtgctcgtcgccggccaagtagtagatgagtagaattgatcggatacagagagcaatcaattaattaaatcgacccgtcgcttggtttttggtttacacattgtactacggcataagttcggcggatatatgtatacgtagacggctagacgccatgcatgtgtcttggcatgtatcgtattcgtatatatcgtaattcgtatgtacctcagtatacctgcatcgtacatttacatgcatatatatctccctatatataaatatatatggttttattacacgggaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaangggggggggcccttt

SEQ ID NO: 8518 - DNA, 1383 bp, Zea mays
ccggccgggatctggccacccgagcacggccaaaaaggcgctcgcccagcgcttcaccagatagagcaacacagctcagctcagctcagcctcggaccagcagccggcgtgcggagctgcggtgcggcgtcgtgcgtgcgccagaacaggatgctgcccgccgggtgcggcctcctctcgtgcctccgcctcgacaagcagggcgacgcgggccgaaccgacccccgcgtcgcggacgagcccgccgcgtcgctcggcaagggcagcgggtcgtcggccaggcggttcgcgtgggccgagatcgagtccgtcacggcgggcttctcctcccgcgtcatcggccagggcggcttcagcaccgtctacctggcctgcctctcctcctcccgcctcggcgccgtcaaggtgcagcgcagcagcgagcgcctccaccgcgccttccgccaggagctccacgtgctcctctcgctccgccacccgcacatcgtccgcctgctcggctactgcgacgaacgagaggaaggcgtgttggtctttgagtacgcaccgaacggcgacctccacgagaggctccacggcagcggcaaggcgccgctcccgtgggcgcgccgcatggcggtggcgttccaggtggccatggcgctggagcacctccacgagagccgcgacccggcggtgatccacggcgacgtgaaggcctccaacgtgctgctggacgccagcctcgacgccaagctctgcgacctgggcttcgcgcacgtgggcttctcggccgcgctccagccgccggaggccagcggggccagggccagggcgtcgtcggcgccgcgcgccgtcgtcatgggctccccgggctacgtggacccgcacttcctccgctccggcgtcgccacccaagaagggcgacgtgtacagcttcggcgtgctgctgctcgagctcctcacggggagggaggccatatgcgccgacacggggcgccggctcgccgccgcggtgggtcctacgctcggcgaaggaagagtagcggaggcagtggaccggaggctcggagacgagtacgacacgcacgaggcggccaccgtggcggcgcttgcgctgcggtgcatcggcgacggccccgggacgcggccctccatggtggaggtggttcgcgagctccaggagaagacgaccgcgctgatctcggccgctggatgcaaacctgccggcaagatgggttcctgagctgtattgtcggccgaagaagaccgtaaataccattagctttgtttagagagagtagaaggtgaaggtaatgtttttttatttattttacttatataagtttcttgatgtagtggattagtagtagttgaatcggattacatagaaaaatttccgtg

SEQ ID NO: 8519 - DNA, 1039 bp, Zea mays
cattgggtacctcgaggccggccgggatcgccgctcatctaagctcgcctctcctctcattctctcgtgctctccacccgtttcccgcaaaaccctagctctgcgacatgcaccgcggcggcgatcgctccggcggcccctcgagcggcggagaccgctctggagcccggttccagcggggtccctcccgctggtctggcagcagcggcggcggattagggggtagcccgcccaatcgctactcctcccgcggcgcggcagatggaggtggtggagggggcggtggcgggaggttccacccttaccgtggttcttccgactattctagcggcggtggagggtacagaggcggtagtggcgttggtaacgacttcggcgaccagaggcaacgttacggcggcggcactagaggcggaggccgtggggatttccaagatcatgatagtagaagtaactatgtcaaactttttgtcggatctgttccgaggacagcgactgaagaagacgttcgtcctttatttgaggaacatggagatgttcttgaagttgctctaattaaggataggaagaccggtgaacaacaaggtatgctatgtctttgtttttcttgtattatcacaattgagtatctcttttgttttcaggtttctgagaggttataggagcaacaaggttgcatcttctctcagttagattggcggttgttgattttcatttcctgcgcttccattctgtccgtctcctgtggattcagtagaagactagaatggacgcgactaactgcccgccgattactggaacctaactagccacaacttcactgctacacaaggcagcaaatttggtaccaacagctgtgtttagatgatattgaccttctggatgtcctgtagttctagagcaatgagcttgtagtttcacctttgcatctgtgtgccttgattttgttgcaagaacttatataatcttataatgaattaatacaaaaaaaaaaaaaaaagcctttcaaaaaaaaaaaaaaaaaaaaaaaaaaaaaaga

SEQ ID NO: 8520 - DNA, 2160 bp, Zea mays
cggcacgacagaagacgttcgtcctttatttgaggaacatggagatgttcttgaagttgctctaattaaggataggaagaccggtgaacaacaaggttgttgtttcgttaaatatgctacttctgaggaggcggagagggccatcaggggtctgcacaacccccaccctccgcccggcgcccggggccctattcaagttagatatgctgatggtgaaagggaacgacatggggccatcgagcacaaattatttgttgcgtccctcaataagcaagcaactccaaaggagattgaagagatatttgccccatatggtcatgtggaagatgtttacattatgagagatagcgtgaagcagagccgaggttgtggctttgtcaaattctcatcaaaagaggcagcagtggaagctatgaatgcccttagtgggacttacacaatgagggggtgcgagcaaccattaatcattagatttgctgatcctaagaggcctagacctggagaatcaaggggtcgccctgcatttggaggtcctggtttcagtcctcgatcggatgcagcacttgttatcaggccaacagccaatcttgatgaatctaggggtcagcatatgcttcctgaatcttggcgtccatcaagtccaaggccaatggcacctaaccaatataataattttggatctgacaaccccttggcacttagtggtggcactgtaacatcagcagatactgctacttttcggcctccgatgttccctggaaatggctccttgtcaaatcagacggctgtgccaacttcgtcacacatgggcatgaacactcccatggtacaagaacaccatctacgaggccaacagatcccatccctgcaaaagccacctggtccaccacagaattttgctgtacaactgcagaatgcacagccaggacagcctctgcaggggcatattccacagattgggcagcttcaggccccacaatccacgggacctgtttcatttggccagaatatttcatctatgcaattacctggtcaacctcctgcatcacagccattgatgcaacggaatgcttctctaggtgctttacatgcccctccatctggacagtccaatccaatgcaagctgtccctggccagcagcaacttcccaccagtgttgctccccaaatgcttcagcagtcgatgcagcagatgccttcacaagcgccacagttgctgcttcaacagcaggcagctttgcagtctagttatcagtcttcacagcaggcgatttatcagcttcagcaacagctacaactaatgcagcagcagtctaacctaaatcagcaaccctctgcgcaggttggttcatctgcagtttcttcaacatgtaactggacagagcatacctcccctgaaggttttaagtactactacaatagcattactcgtgagagtaagtgggaaaagcctgaagagtatgtgctgtatgagcaacagcagcagaaactgcttttgcttcaacagcaccaacagaatatcgctgtacagcaactgcagtcaccgccacagggtcaatcacttccatccatgcaaccgattcaacagcttccccaggcacaaggacaaacacaaatgcatatgaaacagcaggaattaaattattctcaatttcaggcagctggttccattgatcccaacaggattcaacagggcattccagctgcgcaagaacgtgcttggaaaaattaagtctgcaggtcgcaataataaagcgctagtcaaagactggggaagtgtacaagcccttgtgctgcccaatttcagtgcctgcacagcctttcgccaacgctgatgagtgtaactccggatttagatttagactgatacgtagatggtagatcccgtatgtgtacattgttgcaacttaggtcatgtactcgtgtatatttttcagcgtgctgccgtgctggtgtccgtacctagttggtagatgtcgtcacttgtgttttatttacgactgtggcatgatttgttatgttcggcattacgtgtgacgctctggttcttcttcgtgtgctgtgttgataggggttaggaggaactcatgttgactcgctggccatttctcagagtaagcggacatttgactcgcgaagcccgtaggggagggggggggg

SEQ ID NO: 8521 - DNA, 3925 bp, Zea mays
  misc_feature (2045)..(2045): n is a, c, g, or t
cgactggctcgtcggcgggacagagtggtcccgcgcagatggcgcagtccacctactccactcctccttgtcaccacaccaggcggatgatcctatgctccgcgcccttcccctgcccgtcgggtgccccgtggtcagtgtgtctgactaccgccaccgcccgcgcgcgtgggagctctgctgcctgtgtcggagtggccatggcttccctaggaacggacaagcccagctggcaactgccctccaccaagtacgacttctctacgatgctcactgacgtggcccgcatcggcgtcatggtgacagttgcgagcaagcctgcatctacctcattggatgcccacgtggtgttcgatgaaacggcgcaaagctggaacttcattttcacggagtacgctgcagcagctggacatcatcatcgctcacttgtatggcaagtagcggaggattactcccattacgattttctgctccaactccccatatactgcccccatgccaactttccgtgatgtcattgatgttcctctggtggtcagaagatggcacaggtttagatcgtcagtgcgaaaggaactaggaattgcagatgatgttaaggtggtcattttcaactttgaaggacaacctatgagatgggaacaaaagacaatatggttgcgtgacggttggctatgtttgggcctccaagatactgctggtgagaggcattgctttttgttcaagcagcctccatggccaccacccatgcagtttgtgatactggctaatggcgttcaagtcagaccaattccatggccacccccatctcgtaattatttcaggactatgcaatgccaatctgaagaggactgtgctagagtagcacaatgccttacaccagctgaagcagctttgcttgaagaggccgttaatatgaagggtgacttcgtccaagaggaacaactagcaagcaggtatgtgccatcctggcctctgaacaagtctggtgcacattatcttgcggtcctagagcctgatctgaaggcaaagttgaagtacactttgtggagaaaatgtcagtttgtgttgtgtttggcagacgaccaaagaggcttgggttttggtcatgtggttcaatttgatgcggttgcatgccttctagcgattggcatggctttcataatgttctcatggagtgaaaactatggagacccatctgaaagtaagcacttgatggccctgttcaaagttgcagctaaggaaattgctgcggatgtgaggattgcattaccgggagctatacagtcgctgtttgagtgcttgttgtacacatttctcttcctgtggactccagcattgagttcaaatgcagggtaccaaagtgagatgttgcagatattgtcaaggatcaccccttctatgtttgcaatatggctcagttcaaattcatatgatgcacattattctcatatgaatttaatggcatgcatgactctggtctgtctcagttgcttcggtaacatgctaattcccgcgatgcaatctgtcagctatatggtgctcgcactctacatattcgggtaccatacacatctccaggttgttgtccctgttctcatagttcgtgtcgctgctttgtacaaggtaactggagattgcttgctgttcagttatacctggataatccaacagaaaaatcacctgatctgtcttgatgcacttcgtggtagctacttacttagtttcaaggaggtggttctgatttgggtttggggcatctggatatctattttctttgcacaagttgacttgttcaggtggtgtccgagaaaattcagacttgagcagattaatagctctcaattgccctgctgacagtgccaacgcaatggtgcttctaatgtaccatggtgcacccagtacgtatcttccttatgatgcaatcgtcatggtgcaacctttattagcctaagaccaactccagcagactccctctccgtatccgtatttagcacggccaatagtttctctctcctctccgtatccgtccccgtttccagcanactccgtatttgcactccgcatgcagtctatgacagctggggcccgcgagcagccgcgaacgcatgcagtcaactgcggagaggagagagaaaccgtggaaaaggggagtgcaggtacagggcgtgcgttttagggagacagatacggagactactagactgatgaatagtgtgctccgctgtgcaaaaaagggatacggagccgcatgtggagtgctgctggagttggtctaagtagctaatggacaacgctatatacctatgaaggtgtctaaaaccagtgaccctcgacttcaaagctggttgtctcaattcaaagtctttactgatcaggaccaatattatttccgatcgcgacggtcttcaaaagcactttttggcaacaactattcagtgttgtatgtgatcgcgacagtattgctaaaaaatgttgaatttatcattccatggtaggaagaccatatggaaaagtgttgtatgtgattgagcttaagtggaaaaaataattttaattctaatctcttaccatttctttgtcaaatattgatattactcttgaaagttcctccagatcatgatagtagaagtaactatgtcaaactttttgtcggatatgttccgaggacagcgactgaagaagacgtgagcattacttccatgctactatcttgtcttcttgcgtagtgatttttattttttctagcatcttttatttgaactttattctggacacgatttcatttgtacttatggtgtgttatcattgtttatcaccgtgcacaaaacaaactagaagcttctaactaagaccctgtttggatcctgtacggtccaaagttggctaaagttaaggactaaaactttagaccacttcagttcacttgtgtggtttaaaggttttgtgaggttggctaaactttagataacacttagacctgtttggagcctcaagagctaatgtgaccatgggatccaagcagggcctaagttcttgaaggtagcttatataagataaaagattcaaaagcttttttgtcatataatgttcatagatatataaatttgagtgaattattggatttttaggattcagtcaaagcggcatcaagacaatcatttcttacaccttttcttgtcagttccagccaccaattgtgatcattgtatcagttactttcttattggctaacaagttgattgttgaataaatctagtcaaatatgcatttttctgtgcttgtgatgctttatttttctattatttatatttttgtattggtcagtttgtgacacattcttgtgtcttcaggttcgtcctttatttgaggaacatggagatgttcttgaagttgctctaattaaggataggaagaccggtgaacaacaaggtatgctatgtctttgtttttcttgtattatcacaattgagtatctcttttgttttcaggtttctgagaggttataggagcaacaaggttgcatcttctctcagttagattggcggttgttgattttcatttcctgcgcttccattctgtccgtctcctgtggattcagtagaagactagaatggacgcgactaactgcccgctgattactggaacctaactagccacaacttcactgctacacaaggcagcaaatttggtaccaacagctgtgtttagatgatattgaccttctggatgtcctgtagttctagaacaatgagcttgtagtttcacctttgcatctgtgtgccttgattttgttgcaagaacttatataatcttataatgaattaatacaaaattctcatcctctgcctttcatggtttaagatttattatccatgtaatcatgaattgcatatgatgtgggattccttaatgtaagcgattg

SEQ ID NO: 8522 - DNA, 2531 bp, Zea mays
attgggtacctcgaggccggccgggatactactgctcatcccggcctccccgtccgcgatcccatattccccttcccatcccatcccttccgcatcgtccccgaacgacgcagacggacgcaaggcacggcgccgacatctcccccgaggcccgagggcccagacatgaaggccctgggcgcgcacgccgccgacctgctccgaggcccgcacctactccgcgccgccatcttcgctttcgccgttgcgctcgccttcttcgttggctaccactggcccaacgcctccccgcgccttgtcttcttctcgtccgacgcctcctcgtcgtctcccaggccgtcctcccgctctccttccgtcgtgctctcccctaactctaacgtctccttcgacccatccctgatccctatccccagcaccccgcctgcttcttctactcccaatgcctggtccccgccctcactaccaccgccgacatcggcgccgccgcctcccctcccccctcctccaccaccagcgcgcctcggcatcgtcggcgaggacggcgctatgcaggacgacttcgacatcggcaacgtcggcgccaacgacactgatctggccaccgacgagaccgcgccgcaggagcctagagacgtgggcgccagcggtggaccacctagggtgcggattgagaggttcccggtctgccccgagagcatgagggagtacataccctgcctcgacaacgaggatgatatcaagcggctgccctcgacggagcgcggggagcggtttgagcggcactgccctgccaaggacaagggtctcagctgcctcgtgccggcgcccaacgggtacaaggcgcccatcccctggcctcggagcagagacgaggtctggtttagcaacgtgcctcacacaagattgattgatgacaaaggaggacagaattggatcaccaaggtcaaagataaattcagatttcctggaggcggaactcaattcattcatggagcaaatcaatacctagaccagatctcccagatggtaccaaatgttgcatttggatctcatactagagttgtcttggatgttggctgcggagtagcaagttttggtgcatatttactttcacgtgatgtcctgacattgtccatagctccaaaagatgttcatgaaaatcagattcagtttgctcttgaacgtggtgtgcctgcaatggcagcagcatttgcaacgcgccggttgttatatccaagccaagcgtttgatgtaatacattgctcacgctgccgaataaattggacccgtgatgatggtatcctgctcctggaggttaatagattgcttagagctggaggctactttgcttgggcagcccaacctgtttataagcatgaagaggcccaacaagaggcatggaaagagatggagaacctcactgcccgactttgctgggagtttgtgaagaaagagggatacatcgctatgtggaggaaacccttaaataactcttgctacattaaccgaggtcctgaaggaaaacctccactttgtgatgctgatgataacccggatgatgtctggtatgttggtctgaaagcatgtattagtcggcttccagagaatggcgaagcaccaactcctgttcaatggcctgcacgcttaatggagccaccaaagaggcttcaaggcgtcgaaatggatgcctactcatcaaagaatgagcttttcaaagcagaaacaaaattttgggacgacataattgacggttatatccgtatctttaagtggaggaagttcaaagtccggaatgtaatggacatgagggctggatttggagggtttgcagctgctttgatccgccagaaactggattggtgggtgatgaatgttgttcctattagtgagccaaatacactacctgtaatttttgatcgggggcttcttggagtagctcatgactggtgtgaaccctttgatacataccctaggacgtacgatctacttcatgcatctggtcttttctcaaaggagcagaacaggtgtaatatctctagcatcttgctggagatggaccggatactcagaccaggtggtaaagcatatattcgtgaccggaaagaagttatacaggagatcaaagaaataacgaatgccatggggtggcgtggtactatacgtgacactgccgaaggcgcgtacgccagtaggaaggttttgatgtgcgacaagcctatggcgcgttaggcgatcaggtgaagacaagcaggggtaattttaggtacttttgcaactgaaaagagctgctgtcgggactgacatttgtgctgtagatagggtaggtcaaggactaatttgtaactatttgattgatcatccatttgtaaaatgatgatctgtgtagtttctgacatgtgccaatttcttttgttgaaacattgtcatggaaaccctacaaaagtgggggaaatacgaagagaccgttttaaactcgggatctagtgtagctcagtaagatagttgttagtttgttatcactgcactat

SEQ ID NO: 8523 - DNA, 2444 bp, Zea mays
cattgggacctcgagccggcggggccgcccgccccgccaaaatcccaaaccctgcctcgtcgtcgcaccgcctccactcgtcccggatcaaccacctcctcggtccgcaaccacaaccacacccgccctcccgctcgccgcagccagaaccagctccaacccaaccagaaccagctcgccccggccgccgcgaccgtcccccctcatcgactcgaggcaacgaagcggccggatgggagcagcagcctgaccctgacgcgatgagcccgcccgccatgctgctgcccgtctgctccgccgcgcccagctgctcccccctctgcccggtgacggcctcgcacgtcgtcgcgcgggtggcgcggagggtggacgtcggcgccgcgctcaggtcctacgccgactcgctcgtcgcgcaggtgcccgaccgcccgccgctcgccgactcctccatactctccccctacatcgccgcgccggacgacatcgcgcgagccttcggcgcccccgcctccgagctcccgccgctccccagcgccgaccccagccctgggctatgttgcacgggcaccgaccagccgctggcggcagtcgcggacctggccgcaactgccgtggtcaactcggctcccaccgacgccgcggagcgggccctgtcggacgcgccgttccccagcacgttcccgtctgacgcgtccgaggtcgaggactccgtggccaggctcatcgataaggtcggcaagcaggtcttccaggcggaggacgcgctcaccgaggcctacgacaagctgaggctgtccgcgtacgacgcgctcggtgcgtggaggaagacggtgcgcgacgcgataggtgggctcaaggcgtcggtcgacgccggtaagcagcaggccgccggaggggtcacggatgcttcgggcgcgttgcacgagaaggtggccggagctgggactgtggctgttgatgttctcaggaaggcgattgttgcagcagaggattcactgggcagtgctgccacattcgttgtgtattcttatgggtcggcgaaggagtctctaccaccaaatgttagagatctgttgagctcgtctgaggagaaagctagtctagtcttgagaccaatcggaaatgctctgcaacaggtctatgtagttgttgaaggtgttgagaagaatgttggtttggatccaagtgatcctattgttcaattggcagttgtgcttggaggttcagtgacaatagggacaacgtactggctcttcacatacagtggctattctggagacttgtcacctgaatcagcgtttgacttattgaaaaacgatgacaaagccgtactcattgatgttcggcctgaggatttgagggaaaaagatggtgttcctgatctacgcctcggggctaggtctaaatatgcaagtgtagcttcgcctgagatcaaagatccagtaaagagtatgctcaaagatgaaagagagtttgatgatgctttactggcagttgtcatccgaaacttgaaattggtgaagggcgattcaaaagtcatagttatggattctaatggagctcgatcaaaagccattgctaggttactgaagaagctcggtgtgcagcgaccttaccttgttaaaggtggtttccaagcatggtcaaagaaccttcgtgtcaaagaactgaaacctgagactgcattaacgtcaataaatgaggatgttgaggaaatcctagaacaaataaagcccaccccaactcttgtgtttggatctcttctgggcctctcagcactttcctatgctttactggaatgggagatgactttgcaatacatagctgttttaagcgttgggctgactatctacttgcgattctctacatatgaggactccgaggatttggagaaagacctaaagctgttgctgtctccagtaagagtaggcgcagacgccttgtcatgggcagctaagaagatagagccaaacaaggtgggcctgccaacgtctccttccacgacggcggtgaaagaccgggttcttcaggccgcggcgaagcacgagtcgcagccatcggatgccgacgagtcgtcggtccaaacagccgaggcatgacacgcgccgaaagcttgggagccagtcgagcggtcccgccgaatcctcaataagagcactcggtgggcgctccctggtaatttgtgaagtccatgtcgtttatgatgtaaagcactgtaaagcggttgtaaattaattgcgtgagcagcatctgtaagttgacatcaacttggttggttgtgtgtgtgtagattatagagaaagaggtgtcaatgtaacgttaattcctgagcctgtctgcgatcttgcccgtctggtactgctactctgcttgcttgcttgtttggcacgcgatcaaggtgaattaagtaaaaatggtccgtggtccaagtccaaaaaaaaaaa

SEQ ID NO: 8524 - DNA, 2305 bp, Zea mays
ggtggcaaaagaactactaaatggtatcctttaatctattgatgataaaaataggtgctaaataaagggcctttgctatcaagcggtttgaagctcttctagagtgaaaataaaaggaaagcatcttctttctaattataactagctctatgtcacagtggtaaggaggaaataagcaaaactctaggccttgagtttaaataccagcattgcacacgcgtatatttcacgcgaaaatcatattggttgaagccactaaccgataataatgagtcgtcctttagtaccataggtaatcttgataagctataataccaaatttatgctgaagtagttggtgaccccatagtagacactagttcatgggctggtttcctataatgtttagtatgcctttttcgaggtctactgtagcttatattttttcaatcaaacagctagctagagttccggagtgctattaacgggagcctatatatggagacgttttgcacccatgaggctcacaacaacttagcataacaaaagcccttgcccacgccatgacgctcagcaagaagcaaggcgcaggcactgatcagcaggccttgctggatgctcagctgcagctctggcaccacaccatcgcttttgtcaagtccatggcgctcaaggccgccgtagacctccgcatagcggacgccatccacctgcacggcggctcagccaccctctcgcagatagtcaccaaggtcacactccacccgtccaagataccatgcctgcgacgcctcatgcgcgtgctcactctcaccggcgtcttcagcgtcaactccggcgccgttgtcgacgagcccgtttacgggctcacgccggcgtctcgccttctggtcggcccggggctgaaccagaccccgttcctgaccttgatgctcagcactttcttcgtgtcctccttcctcggcctcgacgagtggttccagcacgagacgggtccgtccccgttcgagctggccaatggccgggacatatggaccctgtccggccacgacgcgagcttcggcaagctcttcgacgacgggatggtcgcggacagcggtttcatcatggacgtcgtggtcaaggagtgcggcgacgtgttccgaggggtcggctccctcgtcgacgtcgccggcgggctcggtggtgccacccaaaccatcgcgaaggctttcccggacgtggcgtgcagcgtgctggacctctcacacgtcgtcgccaatgctcccaccgacaccaccgtgaagtacatcgccggcgacatgttcgagagcattccgtcggcaaacgttgtcttcctcaaggtatagtacgcccatgtatataatcgtgctctcggtcaggatcatgatgatattaattgtgactatatgagtcacctccatttatttggttccttcgttccagtggattctgcatgactggggtgatgccgaatgcgtgaagatactgaagaactgcaagaaggctatagcgtctcaagaagaagggaaggtagtgatactggatatggttgttggagcagggtcatccgacgagaagcatgtggagacgcaaatcgtattcgatctctttatgatgtttatcaatggcactgagcgagatgagacggagtggaagaagatcattttcgaagccgggtttagccgttacaagatcatacctgttctcggtgttcggtcgataatcgaggtctacccataaaaatctatgcaactcaagtatactgtatgcgtgaataatctgcgagtgaaatcaaaactaggtgtgaagaagtgagtatactgtatgcacgcgtgaataaatctgcgtgtgaaaaactaggtatgatgaagtgttgtgccatgtgcttgctttatttagttgctaaatgtatcgcatgtactcttgtctgttctaaattataataaaatgtaaaagctttgagcctttttaaagataaactaacagtttatatgtaaatgtctaacaaaagtcatatacgtaaaaaaagacgtcttataatttgaattgaaatggagagagtatctatatttcttatataatccaccagtgttaaaacatcattaagtacacataacaaattacatctagccaaattctatcgttgaaaccgacgcttcagatcacttcatttacctcctctcttttaatcaatcgcattccgcggtcagtgtttttttggatcaaccctcatccctcacctgcatctagccccacagcccccgccaacatcccatccccgagatcaccctcacacgcctcgtctggacgattaacgccgcca

SEQ ID NO: 8525 - DNA, 1694 bp, Zea mays
ctgcgagtcgattccgtcacccgcgcagggcggacggcgggaacaacaacttagcataacaaaagcccttgcccacgccatgacgctcagcaagaagcaaggcgcaggcactgatcagcaggccttgctggatgctcagctgcagctctggcaccacaccatcgcttttgtcaagtccatggcgctcaaggccgccgtagacctccgcatagcggacgccatccacctgcacggcggctcagccaccctctcgcagatagtcaccaaggtcacactccacccgtccaagataccatgcctgcgacgcctcatgcgcgtgctcactctcaccggcgtcttcagcgtcaacaccggcgccgttgtcgacgagcccgtttacgggctcacgccggcgtctcgccttctggtcggcccggggctgaaccagaccccgttcctgaccttgatgctcagcactttcttcgtgtcctccttcctcggcctcgacgagtggttccagcacgagacgggtccgtccccgttcgagctggccaatggccgggacatatggaccctgtccggccacgacgcgagcttcggcaagctcttcgacgacgggatggtcgcggacagcggtttcatcatggacgtcgtggtcaaggagtgcggcgacgtgttccgaggggtcggctccctcgtcgacgtcgccggcgggctcggtggtgccacccagaccatcgcgaaggctttcccggacgtggcgtgcagcgtgctggacctcccacacgtcgtcgccaatgctcccaccgacaccaccgtgaagtacatcgccggcgacatgttcgagagcattccgtcggcaaacgttgtcttcctcaagtggattctgcatgactggggtgatgccgaatgcgtgaagatactgaagaactgcaagaaggctatatcatctcaagaagaagggaaggtagtgatactggatatggttgttggagcagggtcatccgacgagaagcatgtggagacgcaaatcgtattcgatctctttatgatgtttatcaatggcactgagcgagatgagacggagtggaagaagatcattttcgaagccgggtttagccgttacaagatcatacctgttctcggtgttcggtcgataatcgaggtctacccataaaaatctatgcaactcaagtatactgcatgcgtgaataatctgcgtgtgaaatcaaaactaggtgtgaacaagtgagtataaaaaatgcacgcgtgaataaatctgcgtgtggcggggctgggctgcaacgccgcaaactccattggagtggtgcctcctgtggcggaatgatcgcttctccccccttggctgtccgtggcggggctctctgccgtcacaactgtagtcgatctgttgccggtctatggtctgtaatgtcaaccagttgtctctttaagtctgctgtcaggtcgtgcctgtctttgtgctccttaggtcggtgttgtgtgtgcccctctgccgttgtcgtcgtgtgctctttggtgttctgtttgttcagtcatgagtccagtttgtaaaagttgtaatgttgtcgtcgtgtgctctttggtgttctgtttgttcagtcatgagtccagtttgtaaaagttgtaatgtgctatcgtggaacgtccgtggcttaggcgatccggataaatgcactatcgttcgtgatgct

SEQ ID NO: 8526 - DNA, 1389 bp, Zea mays
gcactagaattaataattagctaataaaattagttatagttagccaataaaattagttgagatataaacaccctactaatagttgaactattaattatttttagtaaattaattaatagttagataggtatttgttatctagttaattctactaataatttttagccagctaactatcaattctagttaattatactaataatttttagccagctaagcattcaaacaccctaataatgtattctgataatgtatttaaacacctcttaaaaaacttgcaatagtgaggcgaaaaggaaagcatcgctgaaacgagatcctcgccgtttcgcgaacaaatcggtgactgtctcctgctatctccccctttccgccacttcgctccgctcccatgcctcctgccccctctcgccgtggaggcaccccaaaccctagcccctgaaaccctagatcctcctcccctgttccgatggcgggggccgcggcgtccccagcggcgggccacgtggtggagcggttccggtcgcgactgcgcgaggaagcgggcggcggcgagccgggcgccgccgcggtcgtgcacgtgtacgcggaggcgctccgtgagctaaccttcaactgcaagccggtcatcaccgagctcaccatcatcgcgggccagcacgccacgctcgccgccgggggaatcgccgacgccatctgcgcccgcgtcgccgaggtcgttctgctacttctgctctcctatcaggggtgttactcttaatttgtcattaaggtggcccgccttacgatttctggggcataaggaagcttgggcttggagcgtcgagtagtctgggcgcttttgccgtgtagtcactagggtttgaggattggtgtgcttgttgtgaaacgtggattgctgtgcttggttttgaaatgtgagaaatcccataaaaggggcggaaaaaaaaaaaaaaacaagttttcctaggttttacaaaagcttcagcctgtacaagatcattcctttttgtaagaagcgttgtgcatacagtttagtatgtttgctctggttgctgtttacagctttggtagcatatttagggggtgtttgaatgcacaagagctaataggtagttggctaaaaaattgctattgaaattagctagctaaatattagctaatttgctaaaagtagctaatagctgaattattagctagagtgtttagacgtctttagctaattttagcagctgactattagctctagtacattcaaacacccctttcctggggtgtagaacctttgtggaactttgtggattaattggtgcttgccattttagggggtgtttggtttgtagggactaatttttagtccctacattttattccactttagttacaaaa

SEQ ID NO: 8527 - DNA, 994 bp, Zea mays
  misc_feature (9)..(9): n is a, c, g, or t
actcaccanacacctttcctcctcccccctgaccccggcccattcaggttattatcctctctctctctctctctcttctttcttggtatccttctgttttgttttcctccacaaacctctttcaattccaccatagacgacgacgaagacagcgccgataagatctcgccttcacaacgacgagcggagggtacgtacttggagatccaagaagctaagaaatgtcagcccagtttgcatccgagcatgcttgctatgtcaactgcaactattgcaacactatcctggtggtgaatgtgccaagcagttgttcctacaacgtggtgactgttaaatgtgggcattgtacaatggtgctgtccatggatctcagtcccttccatcagcaggcacgcactgtcccagacaaccaggttgtccagaacagagggtttcaatataacaatttcgggagctacgagcaagcctcgtcaagaaatctacgaacgcctcccatgtatccagtgtcaaacaatctgccacaagtgccaccaatacgaccctcagagaagagacagcgtgttccatcagcatacaacagattcatcaaggaagaaatacaaaggataaagacgagcaacccagagattagccacagggaagcattcagtgctgcagcaaagaattgggctcatctccctcggctccatttcggcctcagcgtcgctgacggcggcggcggcagcaactagggaagacgatgattacggatcgagctcttcgccttacacatatatatatgcagtgtgctatgtcgtgcttggattttgtaagccttattaagttttttgacaacctgtgttttcagacctgttgcgtacttgcatgcatgaatcctgcattgcgtgcagtaattaacatgtttgatgctatatatgatatatgcatgcatggtgtacaacattactaaataaatggaaaatatttgttcaaaaaaaaaaaaaaaaaagcggcc

SEQ ID NO: 8528 - DNA, 967 bp, Zea mays
cccccgaggttggccgagagaggaaattgggctcacgccctccctaatcctccctggttcctttgggacccccgggcccggccgggatcatatcgcttgctggctttgctttcttccttcctccctctagatctcgccttcacaacaacgacgaacagcgggtacgtacttggagatccaagaagctaagaaatgtcagcccagtttgcatccgagcatgcttgctatgtcaactgcaactattgcaacactatcctggtggtgaatgtgccaagcagttgttcctacaacgtggtgactgttaaatgtgggcattgtacaatggtgctgtccatggatctcagtcccttccatcagcaggcacgcactgtcccagacaaccaggttgtccagaacagagggtttcaatataacaattttgggagctacgagcaagcctcgtcaagaaatctacgaacgcctcccatgtatccagtgtcaaacaatctgccacaagtgccaccaatacgaccctcagagaagagacagcgtgttccatcagcatacaacagattcatcaaggaagaaatacaaaggataaagacgagcaacccagagattagccacagggaagcattcagtgctgcagcaaagaattgggctcatctccctcggctccatttcggcctcagcgtcgctgacggcggcggcggcagcaactagggaagacgatgattacggatcgagctcttcgccttacacatatatatatgcagtgtgctatgtcgtgcttggattttgtaagccttattaagttttttgacaacctgtgttttcagacctgttgcgtacttgcatgcatgaatcctgcattgcgtgcagtaattaacatgtttgatgctatatatgatatatgcatgcatggtgtacaacattactaaataaatggaaaatatttgttcaaaaaaaaaaaaaaaaaaagccgcca

SEQ ID NO: 8529 - DNA, 839 bp, Zea mays
cgggcggcccattcaggttattatcctctctctctctctctctcttctttcttggtatccttctgttttgttttcctccacaaacctctttcaattcaaccatagacgacgacgaagacagcgccgagaagatctcgccttcacaacaacgacgaacagcgggtacgtacttggagatccaagaagctaagaaatgtcagcccagtttgcatccgagcatgcttgctatgtcaactgcaactattgcaacactatcctggtggtgaatgtgccaagcagttgttcctacaacgtggtgactgttaaatgtgggcattgtacaatggtgctgtccatggatctcagtcccttccatcagcaggcacgcactgtcccagacaaccaggttgtccagaacagagggtttcagtataacaattttgggagctacgagcaagcctcgtcaagaaatctacgaacgcctcccatgtatccagtgtcaaacaatcagccacaagtgccaccaatacgaccctcagagaagagacagcgtgttccatcagcatacaacagattcatcaaggaagaaatacaaaggataaagacgagcaacccagagattagccacagggaagcattcagtgctgcagcaaagaattggggctcatctccctcggctccatttcggcctcagcgtcgctgacggcggcggcggcagcaactagggaagacgatgattacggatcgagctcttcgccttacacacacatatataatatatatatatatatatatatatatatatatatatatatatatatatatatatatatatatatatatatatatatatatatgca

SEQ ID NO: 8530 - DNA, 3053 bp, Zea mays
  misc_feature (2067)..(2067): n is a, c, g, or t
  misc_feature (2076)..(2076): n is a, c, g, or t
cattgggtacctcgaggccggccgggccctctcctccctgtcgtcattctcctgtttattgtaggcctgtagcgcagtcgcttgtcgcttgggctttcttccaaaggtggtgggcacagaaaagcctgacagtccaggccacagtacacaaactggtcgattcgggtcagctagagttcataaatggtgggtggtgtatgcatgatgaagctgttgtgcattacattgacatgattgatcagaccacacttggccaccgggtgatcaagaaacaattcaaaaagattccgagagctggctggcaaatcgatcctttcggtcattctgcagttcaagcttatttgcttggagcagagcttggtttcgattccgtgcattttgcaagaatcgattaccaagatagggcaacccggaaagcaaataagggcctagaagttatatggcgtggctcaagacctgttggttcatcatcacagatcttcacgaatgtatttccagtccattatagcgcaccagttggcttcagcttcgaagttttggctgaaaatgtcatacccgttcaggatgacatgtcgctgtttgactacaatgtccaagaacgtgtagatgattttgttgctgcagccttagcacaggcaaacgttacacgtacagaccacataatgtggaccatggggggatgattttaactaccagtacgctgaatcctggttccggaatatggacaaacttatccaacatgtgaacaaggacggcagagtgcatgcgttgtattctactccgtctatctacacagatgctaagcatgcatcgaatgaatcttggccagtaaaatacgacgactatttcccctacgctgattcaacgaatgcatactggactgggtactttacgagccgtccaactttcaagcgatatgttcgagtacacagcggatactacttggctgcacgtcagatagagtttttggtgggcggtaggagctccttgggattgttcacttccagcttggaagatgcgatggggattgcccagcatcacgatgcagtctcaggtactgcgaaacagcacacgactgatgactacgcgaaacggcttgcgctgggagcagcaaaggttgaaaaaggtgtaaacaccgctctggcttgtctgaccagctccaacgggacatgtggatcctctgttgtaaaatttagtcagtgttcacttctcaatataagctactgcccttcgaccgaggaagcaatttcatcaacaaagcgtttagttgtagttgtttacaatcctcttggatgggaacgtagtgacttcataagagttcctgtcaatgatcgaaacctagttgtaaaaggctctgatggaaatattgttgagtcacagctagttgaggttgataatgtgacgagaaatttaagaaagttttatgtgaaggcttatcttggaatcacaacacacaaggcccctaagtattggctactatttcaagcttctgtaccaccaatgggctggaattcctacttcatttcaaaatcaactggagcaggatacaacagtactgagcatgtctcggacgtggtttccccaagtaacagcacgattgaagttggaccaggacatctaaagatgtccttctcaaaagcatctggacaactcaataggatattcaattccatctcaggagtggatttaccagttcaacaaagctttctttggtacagatcaagtgagggtgatgcctcagactcccaggcatctggagcatatatatttcgaccagatggtaatacaccgactacggcctcatcctcggtgccactgaaagttatccgtggaccactggttgacgaagtgcatcagcaattcagctcatggatttatcagataacacgactctacaaaaacaaggagcatgctgaagttgaatacacgattgggccgatccctgtcgatgatgatgtagggaaggaggtcatcacacggctgacagcaaatatggtcacaaaccggccgttccgtccggactccgggggaagggatttcctcaaaagggtgagtaaactacagggnaggactggnaatcttcaagtaactcaaccagttgcaggaaattactatccggtgaacctaggagtgtatgtagcagatgaaaaatatgagctatctgtgcttgtggaccgtgctgtcggagcatcaagcattcaggatggtcagctagagattatgctacacaggcgtttacttaaggatgatggcaggggtgtcggagagccacttgacgaggtggtttgcgtggatcaagattgccaagggcttacggccaggggcaattactacgtcaatgtcgagaagctagggcatggagctcactggcgacgtacatatggccagcaagtctactcaccctttctccttgctttcactcatgaggatgagaccagctcgaaatcctacagcgtggccaaagctggtatgatgaatgccaactacagccttcctgataatgtcgccattgttactttgcagaatctagatgatggtaccacactactccgcttggcccatctctttcaagctgctgaggacccgagatattccaaggtggcaaaggttgatctgaaaaaggtgttcggaaagagaactatcaaggaattgacggagactagcctctccgcgaaccaaaagaagtcagacatgaagaagctcagctggagggtcattgggaacactgaaactggtcctgccgcagtaaaaggtggcccagttgacagtagggctctagtcgttgaactaggacccatggagatacgcaccttcttgctgaaattttagtggcagttgttcttttgtttgtaaacaaacaatagtccatagagtaatttctaccttttcattaacgtgcccaaatcttagttcaaataggatcaaatacttgggcaatggaggtgcacacccacaccaagtttgttcatgtaataatagctacatgtcgggaaaaaaaaaaggaacggttgtggtgcttttcaaaaaaaaaaaaaaaaaaaaaaaaaaaaaaa

SEQ ID NO: 8531 - DNA, 3458 bp, Zea mays
gcacgagaccattacctagaacatcctaatcaaaagcagccaggtctctctgtccgccgaagtcctccctcgtcgcgagagacgagtcgcgttcctgttcgccgcccccgccgcccatctcccaatccggactcaggagatcgactcctcctctcggttgaggttgaaggggaaggaactagaaggctactcaagggatggctgaggatgcttctcacggggccagcagctcgactgtgatacctgctgatggtccagagtctaccatcgagatcaacatcaagaccctggattcacaagtccacaaacttcgcgtggataagaatgcgcctgtttccgttctaaaagagaaggttgttgaagcgactggagttccattggatcagcagcgcttgatttttcgaggaagagtcttgaaggatgaccacctcctatcagaataccatttggaggatgggtatacattgcatctggttgctcggcgtgcagcagagggccagacttcttctggggcttctgaaggaaacacaaatgctaatgtaaacgttactggaaatggaggattgttggatgatatttccaggagtgttcgggatcttctgggttccttaggtgttgcaatgtctggtggtgtcactaacacggcattttcggttcctttgactagcacaccagaagggcccaataatgtgcctggaagaactcagccaatgaacccagcacaacctggattctcagttctaaatcatcaaatacaagtaacacaacttcatccgccaggagctattcctcgcaatatgattattccagattctttgacaactctttcggagtacatggatcgcattgacagagtactacagaataatggtgttccaccatccagagattcagaaagccagcaacaaccaacagtggatgatgctaatgccaacccaagatatccaagtgctgatgttttggcttcagttattgagagagcccaacaacttcttggtggcagtgcagcttctgctctttcacgcattgcacaacgtattcggcaagatggtgggactgcagatgcatctcttcgtcgtgagatccaaactgaatcggttcagctaggaatttcgatgcaacatttgggtgctatgttctttgagcttggtcggacgatgatgatgcttcgcacagggcaatctccttctgaggcttttgtaaattctgggcctgctgtttatataaactccacaggaccaaacccaatcatggttcagccatcttttcaaaacacccctccttttggtgtatctaatataccagttctgggtggaatttctggtgcttttggtattgttgatccttctcgacatatgaatatcccaagtaacggtgcatctgcaacaagtggttcagctgctggtactaccaccggttctgaaggagctatccacgggaaccgccaagatgcggcaagaactcaaggaggtaacccaccaggtttcctggctgcaacacgtggattgccaaccagaacagttgttgctgctgttccagcacggtcctcaggcgaggctccaaaccatatctttagtgttatcctacctgttcaagtgaggggtcaagttgtagtgcctaatcagtcctctcaaggttctcaaacagcagtgggcaatggagctcaaggaaattcaacatctgctattccacaagcttctgttggtggtgtttctggtgttcctcttatagcggcacaggtagccaatgcattggcaaatgcaccaagccaggtttctttatctacacaaagtgcagcagatcagggatttcacctgactacagacaacagagctgatgttctgagttcatcaacaccagccactacaccacagaatggtccctcaggtacttccggttccagtttgccatctcaagacaggaatactttaaatgttcccagtcttgatagtatacaacagcatccacaattgggagatacttgtgcagatacagctgacttatcaggagacgccacagccatcagtactcatgatgctccttcgaacccatcagttgacagttctgtgctgaagaacaaatcctcggatgaagtaggttcacagaccactgagccttctgcaagtggcagtgctgaaccattaggtcttggtggaggtctgattccaattccaaagaggcggagcaaagcagtaaagccatctgggagcacaactgatcctagtagggatttgtcctcagtcagccaaaaccaagatcctatttcagtagcccagcagtttctggaaggttttgcttcccgaaatactaatggtagcagaagcaacaccctctcctctggtcctccatcttctgtgccacaggctactgaagttcctccgagaagacagggtggtggacaacctgatattggcagcatgatatctggtatgctcaacaacccagttttcagcaacatgttgtcgaatgtggcaacacaggcagggggctctagtgctgatttgaagagcgtgatggaaggattacaaagccctgctattgtagatacgataagcaatatcgtgcagaatgtggatgagcaagacctgggggccatgtttggttcaggcagaggacaaggtggcatggatttgtcaaggatgttgcagcaaatgatgcccgttgtatcccaggctcttggtggtgcaggggggcgttctgctggtgcaaatggtggacagcataggtcgcggcctcagcgcattgacggtgaaggaaatgcaccagccagcagttctcagattgatctccatgaagctcgtcaaagcattgaacagcatgaatccccagagaatatcttccgcgctgtccttgaaactgctgctcaggcccatggtgaagataacagcattcagggcatggtcgaagaacttgccactgatcaagagcttgccgatgactacatgaaacttttgatggaacaagttcggcagaggatacagtcagagtcgcagtcggggagccagccttgaaggattgggcggcagggtcgtgtagccagccattcgctctgcgatatttatctatgggaaagaacagaaccaaagctgttgtctgggcgttttcatgattaggtgcccggtgtacatgtggcgttgtaattttccgagataatgtatctgcagcagcatatctcgtactctggttagaactgtttttttttacgaattttgctagaggtacatacaacgagttttaaaggtggtgacgtctgaatttcgtggaattgacaatgacatgtctgtatgattggtgtcgcaactctccagttcggaaatttgttagcacaggttgtccttgttcctggcatgtgtttcaccttttagccattaaataccattttggttcatgtaaggtagtaaccttgtgcactgggtccggttataaatgattccttaagggcaaaaaaaaaaaaaaaa

SEQ ID NO: 8532 - DNA, 1188 bp, Zea mays
agccctcgcggccggccgggggggccaaaaaaaaaatctccaactcgtcacttcgcttccccacttctccattccattgcggttctgcgagcccctacctccctgtggtgcttggccatggcggactaccacttcgtgtataaggacgtggagggggcgagcacagagtgggacgacatccagcgccgcctcgggaacttgcccccgaagccggagcccttcaagccgccgcccttcgccccgaaggttgacgccgacgagcagcccaagtccaaggaatggcttgacgtgcgcgagcccgaagagctcgaggaactagaggacgatctggatgacgaccgcttcctcgagaagtacaggaagatgaggctcgcagagctgagggaagccgcaaaagccgcgcgatttggtactatacttcccatcactggctccgacttcgtgcgggaggtatcgcaggcacaatcagatgtttgggttgtggtcttcctctacaaggatgggatacctgaatgtggattgcttcagaattgtttggaagaattggctactaggtatccagcgacgaagtttgttaaaattatctccacagactgcatccccaactacccagataggaatgttcctacaatactggtgtataacaacagtgctgtcaaagggacttatgttggtttgcagaagtttggtggaaagagatgcacacctgaatctgttgcgttagccctttgccagtcagacccggtactgaatgatgggcatggtggcagcgattcatctcggggcaatgtcttcgaaggtgttcgcaggaagttcatagagaaggttgtggcccagcatgaagagcgggaagaagaggacagtgactaagctaatacttgtgtttgttttccgcagctggcggatccaatttggttccaatgtttactgatcttatgtgatttttgtgggtgaaatttgccagagttttctgatacctggctgtgcggctgaagtttttgaaagttcacgggtcttattgcctacctttcagctgtaacacagctccattattatattgttaagagatcagagatgattagtgcacttgtataattgcatgagaaaaaatccagccaaactttgaatccacagtatttcactatcttgaacatttcccaaaaaaaaaaaaaaaaaaaaaaagcggcc

SEQ ID NO: 8533 - DNA, 1193 bp, Zea mays
gtatggtagagggccctggaagcgggggccgaacgtcaggcgtgcttctgttcgctctagtgactagtcccttctcttccccacgactctccattcgccggttttgcgcatcccctccctccctccatctctctctgcgttcctggtgctcggccatggcggactaccacttcgtgtacaaggacgttgagggggcgagcacgcagtgggacgacatccagcgccgcctcgggaacctgcccccgaagtcggagcccttcaagccgccgcccttcgcccccaaggtcgacgccggcgagcagcccaagtccaaggaatggctcgacgagcgcgaggccgaagagctcgaggaactcgaggacgaccttgatgacgaccgcttcctcgagcagtacaggaagatgaggcttgccgagctgagggaggccgcaaaagccgcgcgatttggtagtatagttcccatcactggctcggacttcgtgcgggaggtgtctcaggcaccatcagaagtttgggttgtggtcttcctctacaaggatgggatacctgaatgtggattgcttcagaattgtttggaggaattggctacaagatacccagcgacaaagtttgttaaaattatctccacggactgcatccccaactacccagataggaatgttcctacaatactggtgtataacaacagtgctgtcaaagggacttatgttggtttgcagaagtttggtggaaagagatgcacacctgaatctgttgcattagccctttgccagtcagacccggtactgaatgatgggcatggtggcagcttcatctcgggacaatgtcatagaaggtgttcgcaggaagttcatcgagaaggttgtagcccagcatgaagagcgggaagaagaggatagtgactaagcgtatattgtttgtgtttgttttcctcagctggcagatccaatttggttccaacgttcactgatcttatgtgattttgtgggtgaaatttgccagggttttctgattacctggttgtgcgggtgaagcttttaacagtttatggatcatattgcattacagttagagatgtctgtgtgggtcagcaaaatcttggtgttagtaaccttttgagctgtaacataacttctttatcttatttaagagatcaaagatgattagtgcacttatatagttgcaaaaaaaaa

SEQ ID NO: 8534 - DNA, 1081 bp, Zea mays
aggaagaacctaggactatatacacacaacagatacgaatcgaaaagcgccgaggaaagaataaacggcgagccgcccggcgggccggcgttaaacccagaagcctcctcgtcctctctctgactctctctcaccctctccctccctccctcggggtcgcggttgcttcctcgcggccgattcgtatcttccgcggcagcagggagggtacggtactcctccggccggcgggaggagaagaggagcttcgagatgggggcgtccctcgcttccgcgggcttggtgaactacccgcttgtcgcggcgctcctcgcgttcgctctcgcgcagtcctccaagttcttcaccacctggtacaaagaaggtcggtgggatgccagacaacttatagcttctggcgggatgccatcatcccactcagctacagtgacagcactttcagtggcagtgggaatccaagaaggctttcgtagtgcaacatttgcaactgcactagtctttgcatgtgtggttatgcatgatgcttttggagttcggttacatgccggaaagcaggcagaggtgctgaatcaaattgtctatgagctgccagaggaacacccattatcagagacaaagccactgcgtgaaatccttggacatactgttcctcaggtcgtggccggttgcatccttggaatcctcatggctgtcgttatgcttttggctctcgggaggtcttagtcaagtgttgttcaccctatatctcgctggtgatggctacaaagcataaaaacatgatctccccatggttctggctgtccaagtgttcgatagtacaaagttctaaccgaatttagatctggactgtaggtttcaggttgtagctcgagttggttgctgtaaatctgaaagggtcacttttaattccaaccacggtgtaatggaagctttgttatacaatcagcagcggtaagatcattttgcggatcagtatggtcgataccatgccgtcgcatttgctttaaaaaaaaaaaataaaaatcagcaagcctttttgcctcttccagaaaaaaaagaaaaaaaaaaaaaaaaagcggcc

SEQ ID NO: 8535 - DNA, 972 bp, Zea mays
  misc_feature (951)..(951): n is a, c, g, or t
  misc_feature (954)..(954): n is a, c, g, or t
  misc_feature (964)..(966): n is a, c, g, or t
  misc_feature (970)..(972): n is a, c, g, or t
ccctcgaggcttgccggctggccgggcataaacccaaacctcctcgtcctctgtcagactaccactctctccctcgcggactcgcggttgattcctcgcggcggattcgcatcttccgcgtcagggacagggagagtactccgtcggacggttggaggagaacagggagaggagctctgagatggagacggccgcctcggcagcgcgcctggtgaactacccgctcgtcgcggcgcttctcgcgttcgccgtcgcgcagtcctccaagttcttcaccacctggtacaaagatggccggtgggatgccagacagtttatagcttctggagggatgccatcatcccactcagctacagtgacagcactcgcagtggctgtggcgatacaagaaggctttcatagtgcaacctttgcaactgcactagtctttgcatgcgtggttatgcatgatgcttttggagttcggttacatgccggaaagcaggcagaggtgctgaatcaaattgtctatgagctaccagaagaacacccattatcagagacaaagccattgcgtgaaatccttggacatactgttcctcaggttgtggccggttgcatccttggagttctcatggctgccgttatgcacctgtctctcgggagttcttagtcaactgttgttcatggatgtcatgacagatgatcacctaatgtctcgctggtgatggctataaagcatgaagcatgatctccgcatggatctggttgtccaagtgtttggtagtacgaagttctaaccgatttagttctggacagtaggatataggttgtgtagcttgaatcggttactgtaaatctgaaaggttttgctttcaactccaactaccaatcacggtgtaatggaagctttgttatacaatcaacagcagtaaattcattctgaggtaacgatcggtatagttgataaanaanaaaaaaaaannnaaannn

SEQ ID NO: 8536 - DNA, 1372 bp, Zea mays
tgttacacttatggtgaactaaggaccgctactgaaaattttagttctgctaatcttcttggtgaagggggatatggatcagtttataagaaaaattcaccttctggcagggtaaattagttgatggcagtgtggtggcaattaaacaactatctgaaacatctcgccaagggaagaaggaattcgtagctgaaatagaaactatttcccgagtgcagcaccgtaatcgtgtgaagttgtttggtttttgccttgagggaaataaaccacttttggtttatgagtacatggagagtggaagccttgataaagcattgtttggaaatggaagattgaacttgaattggtcaacacgatataaaatatgcttggggaattcaagaggcttagcttatctccacgaagagtctagcatccgcattgtgcatagggacataaaggccagcaatgtattacttgatgccactttgaaccctaagattttggatttcgggctcgccaaactttatgacgataaaaagacacacgttagcacaaaagttgctggtacatttggctatctttcacctgagtacgccatgagaggtcacatgactgagaaagttgatatttttgcttttggtgtggtcatgttggagattattgctggaaggccgaactatgatggtaagcttgaccaagacatggcttatcttttagaatgggtctggcaactttacgaggaagaccatccgctggacattgcggatcccaagctcacagaattcgatagtgtcgagttgctccgtgccatccgcatcgccctcctctgcatccagagctcacctcgtcaaaggccatccatgtcgagagtggtgtcaatgctcacaggagacagcgaggcgcctgaggcagtgtccaagcctagctatgttgccgaatggcagagcaacactgaagggacgtcaagctcagtgtccacagcagaggctgtgtccgtggctccattcctaaaccccgttgtggacgatggccggtgatgatggccatcgctaagatcatcttatgtcaagcactcaagccacagattgttttcttggagatccacctttaaaggccccattatttaggttgaatgtggatgacagatttatgttgttgactggatgagatgtcctagggtttcctcacgttgtagaatacaactctcacaagtataagaatctaggaacatattccttcgatgtaacatacctcttttgtttaatctgttttgtaagagaaaccagaagaacaccttgtatttcggttgatattttgaaacccacagccaattgaatgctgggtgtgtaggcatatatatgaccaataggttgattgtaagctttactac

SEQ ID NO: 8537 - DNA, 3254 bp, Zea mays
gtgaatgagcgcagcctggatcccgagcgacgcagaaaatggccgtatgtgccgggcttggccgaggccggtgtcttgcactcaccgggcctggctcaaatctccgtccaggtaaccaaacaacacgggcccgagttattctgtatcccatgggccatgcacgcgcatacacagggaaccaaacagacggataataaagcgaggtgtcaagccttgctgttgatgacacaacaaaaaagccaccaactgcactttagccagccgggaaggatccaggggcaaaaccgggaaatcctccaagctgaggtaggcaggaggaactttcctctctctctctgtctctctctctctctctcttcttccaccgcgcggccgcgttcgctgcctgcgccaccacaccattggcgacggcacgcgccctccctcccttccagggaagcctcctcgctcgcttcgggggcgtctccgcggccatatcttcctctttctgctcggctttctcgtcaccgcccccctcctcgccgtccactggtgccgagccggcgcgggtggagatccgttcgctttggatcgacttcttcgtgtttgggtagggacctccacccctcacacctgatcgcctttgttctagctgttcattttgtaccgggggaccattttttgctttgactgcgggtgggcaataccatccgaatccttcccaccatctccattctgttactcgcggatttgtttgctgcgtggtgccatgtgaatctgagccactccgattagtctgttgactctgttcctatccttcagcgctcgagattaatcgaactaagatgcggctacagtttatttttctagaattttgggtccgactgatctgtggccgtgtgatcttacgggcagtttgtctcctttttttttgggcgatgtgatcttcttgtgttttattactgattagtcggcttgaatcttgcaggttgaagccgctcgatttgctcaccagaaattcagattttcgagtggaattcgcttaatatagcaatgcactagggtttactgtgcaccactaggctactgcctctgctattaggaagccgacatctgttgtttccgaagtctttcaagtctctgttgggtggcgttgctattgtgggtgtgataacatgataaagcaatttcttggacgtctccccaagaagccatccaaatctggagacatggggacctcgagccggcccagcccctcggtgtcgcaccagccattgggtccgagagctggagacagggccaccaacttgagtagccatccaccggttatctccagctctgggctcagttatgggagtggcatgcatgtcggcaatgcatacacgaaggcacacgtgaacggtgattcggccgcttcagcatttcggtcgttgccgagcttcaaggacgtgcccaacacagagaaacagaacttgtttaatgagaagttgaacttgtgctgcgcccaatttgacttcaccgatccaacaaagaacataaaggagaaggagataaagaggcaaactttggtggagctcgttgactatattgcctcggccagtgggaaattttctgaggcaagcatgcaagagatcacaaaaatggtttctgcaaacctgttcaggacgctgagtactcctcctagagacaacaaagtggatggctttgatgtggatgaggaggagcctgtcatggaccctgcatggccacacttgcagattgtctatgagttgttcttgagattcattcagtctcaagagacagacgccaagttggctaaacggtacattgatcattcgtttgttctgaggctacttgacctctttgattcagaagaccctagggagagagagtacctcaagatgatacttcaccgtgtctatggaaagttcatggttcatcggccctatattcggaaagccattaacaacattttctatcagttcatctatgaaactgaaaaacacaatggaatcgcagagttattggagattttgggaagtatcatcaatgggtttgcattgccacttaaggaagagcataaattgttccttgttcgagctttaattccacttcacaagccaaagtgcatcgcgatgtatcatcagcaattatcttactgtatcacccagtttgtcgaaaaagattgcaaacttgcagatacagttatcagaggcctgctaaaatattggccaatcactaatagctccaaggaggtgctgtttctgggggagttggaagagatattggaagctacgcaacctgcagagtttcagaaatgcatggtccctctcttccgccagatcgcacgttgcctgaatagctcacactttcaggttgctgagcgggcgctatttttgtggaataacgaccacatcgagagtctgatcaaacaaaacagcagggttatattgcctatcatctttcctgcactggagagaaatgccagtgggcactggaaccaagctgtgcaaagcctcactctaaacgtccgaaaactgttctctgacaatgaccctggactattcacggagagtctgcggaaatacgaggaagagaaagcgagagagaaggaggttaagtcgaagcaagaggccacatggagacgccttgaagagatggcatcagcgaaagcgacaagcggcgcggcagttctcgtctctcgacccttatcccggcagtcttcggctgtgtagcgaattttcatgtggtggtcgtgagaacattgtacaggattgagttgtatatacgaggtatattaaggtgggcaaattgacaaatgatatcgtcggagaagccagccagatgggttacagggctaggcacacatcattttcttggtcccgaatctgggcttctgctaagatctacagctggtcgcggtatcatcattatgtttatccttgtcaggagttggctatgattcaattgttttcacctgctggtcctgcagtcttgccatgcatgggtatctgtttctggagacaaaaaatcggtggaagtcgatagaacttagagcctggaaacgagtcgtgctgttgttcttggagtctggaattgttgcgtttctttctagtacaattcatgtgttgtcatcattagaagttaaatcctttgtgctcatcatcatcatacgtatgtggatccaattataaatgcctgataaatggttaagggttcacgatgaagatgacatggattcgtcaaaaaaaacattctaatatgtataataaaaa

SEQ ID NO: 8538 - DNA, 2323 bp, Zea mays
cggacgaaagccgtgcctgcgcagacttattttgacggaggagatttaatggctgttctcagaggctaagattgattttgagtctataccaaggacgtcgtgtgaatttctaaatcgtcgaatctctccctatccttccatttctaaacgtattacattgtaaagcacgagaggtgaggagatttaatacgtttcatagtgacaaaaattaccagtgctagtcggcagcccgcggccacgacgtctactcgcatcccaatctccgtcgtcccccgcggccccgcctcactccttccgccgcactccacctccacatcgccgcccacacccgaccgcgtggccggcctcatgtgggagcgcggcaggccgccccgcaagccgcgcccgtccccaatcctcgtgccgccgccaccgtcgtcgccgcctccccgcctgaacctcctcctcccgagatccctcctcgcgctcgccgcgcgcgccatgccgtcgcgccgcccctccccggtcctcctcctcctcctcgcgctctcgctcgccctcctcttccttctcctctccccttccttcccctccacctcccgcttctctcgctccctcagctctggctccgctttcgcctcctcatctccggcgtcaacctccgccccgcctgcacccgtcaagatctacctgtacgacctgccggccaagtttacctacggcgtcgtccgtagctacaaggctgcgcgtgcgacatctggctccgcgaacgccgctgctactctgcccgacgagcaactgcggtacccgggacaccagcactcggcggagtggtggctcttcaaggacctgctccgacgcaggccgcaggaccgccccgtggcacgcgtggacgacccgagcgacgccgacctcttctacgtgcccttcttctcctctctcagccttgttgtcaaccccatccgctctccgctggcagcaaacgcctctggggcggggacagcgtacagcgacgaggccttgcaagaggagttgctagagtggctggagcggcaactttactggcagcgccacaggggggagggatcacgttttcatctgccaggatcccaatgccctttacagggtggtcgatcggatcagcaatgccgtactcctggtttctgatttcggcaggttgcgcagcgaccaggcatctctcgtcaaggatgtcatcctgccctactcacatcgaatcaactccttcaagggtgaggtcggggtggatggtcgcccctctttgctgttcttcatgggcaataggtaccgcaaggaggtaactcctgaattctggaagaaacatgatgaatctaatctgaccggggcattggtcaattgcgtttataaggggagcatatatgctgtagaatgtagattatagacaaccaagtgaaggcgcccctttggaacttgtagttttctagtgtgcccaagcacaacattcttaattgacactctccctccatcctaaaatgaatgtaattctagatttgaaccaagtcatttttttagtaagtttgactaagtttatataaaatagtatcaacatatgcctccaaataggtttgctatggaaatgtatttcataattagtctaatgatacttatttggcgtcataagtatttgtaactttttttgcacaaatttggtcaaactttaaattatttgactccttgaaaaagcaagaattgcactctttttgggacggaggaagtattatctaaatggcattacattaatggtgttcccagcgtccgattatcttgtataaaaaggaagcttagaagaaaacagagttaggatgcctttttcttttgcctaataaagagagagctttacgaattactcaagaaagaaatacaatctgcagcaactagatgctcgacacacactggacaattattgcaatctgcagtatgaaacatccattttgctagctgggtgagctcgtgagtaactgaattctgctccttttgtgtgcttgaggagagataggcatgtgcgtctagagaggacctatccctgactgcgaattggacaccccaaccctcaagaaggcacacttgggtcagattgcaccaacatcatcaagcacctgatcaaactaactgctcagagacccagctatagctttgttatccaggaagcactagaagtagcagatatactcccagtagttaggatgcaattgtgcccgttttgaacttgttttgatctatggcaagttctgaaccggatgcccaaggaaacttgaactaggaaaattggtttcaacggaaacatatacaaactgaagcaattttt

SEQ ID NO: 8539 - DNA, 2820 bp, Zea mays
cccacgcgtccgcccacgcgtccgcccacgcgtccggtgccgccgccaccgtcgtcgccgcctccccgcctgaacgctcctcctcccgagatccctcctcgcgctcgccgcgcgcgccatgccgtcgcgccgcccctccccggtcctcctcctcctcctcgcgctctcgctcgccctcctcttccttctcctctccccttccttcccctccacctcccgcttctctcgctccctcagctctggctccgctttcgcctcctcatctccggcgtcaacctccgcctcgcctgcacccgtcaagatctacctgtacgacctgccggccaagtttacctacggcgtcgtccgtagctacaaggctgcgcgtgcgacatctggctccgcgaacgccgctgctactctgcccgacgagcaactgcggtacccgggacaccagcactcggcggagtggtggctcttcaaggacctgctccgacgcaggccgcaggaccgccccgtggcacgcgtggacgacccgagcgacgccgacctcttctacgtgcccttcttctcctctctcagccttgttgtcaaccccatccgctctccgctggcagcaaacgcctctggggcggggacagcgtacagcgacgaggccttgcaagaggagttgctagagtggctggagcggcaactttactggcagcgccacagggggagggatcacgttttcatctgccaggatcccaatgccctttacagggtggtcgatcggatcagcaatgccgtactcctggtttctgatttcggcaggttgcgcagcgaccaggcatctctcgtcaaggatgtcatcctgccctactcacatcgaatcaactccttcaagggtgaggtcggggtggatggtcgcccctctttgctgttcttcatgggcacattatgaatattgtagggagggaaggttcgtgatgcactttttcagattcttgaaaacgaggatgatgtaaccataaaacatggaacacaatcgagggagagtcggcgtgaagctacacaaggaatgcactcatctaaattttgcctgcatcctgccggagatactccctcagcatgcagattatttgatgcacttgtcagtctgtgtgttcctgttatagccagtgattacattgaacttccattcgaagatattatagactacaataaaatatcaatatttgttgggacaagcaaagcagtacagcctggatacttaacttcaactcttcgaagaatcagttcagagaggattctggagtaccagagggaaataaaaaaggtcagacattactttgagtacgaggatccgaatggaccagtgaatgagatttggcgccaagtatcccttaaagcaccactgataaagttgttgactaaccgcgacaaacggttgcttgaaagaggcaccaatggaacagattgttcgtgcatctgctctacaactccaactgacataactgcggccagttaaacaagatggaactcatcggcctacaagctctgtgcctatttcctgtgatcacattgcctgaattttttaggttgtacagttccatgtaaaacgagattaccagccactatttttgaacagtaaatttactaattaccacaatccttgagttttcactagatttgtataggaggagcggatagtcaggaaccttacagtgccctttttgtattgtaagttacattagctattttttgttgtcggcagttcgctgccctagtttttcgacctacataagcatcaatccccgtgccagtgcgtggacccagttatttgtgtgattgtgtcgattgattcttttgtagcacagtagcaggcggtacaggtccatccagattcagggcatgtttggatcataggatctcaatatggaatttataagcgtttggtttgaagaattatgtcactttagatgaggcgatgcgtaataattccattcattgatttgataaaatgccttatttttgtatcaatactaattgttagagcgtgcatataaccacctaaaacaatctaaaaacattcttttacactatagattgttgttcatatagtaaagtttaaatataaggatgatgataggtaagcgattggttgcattgtagacttaggcttcgaattaaagccaacagttcatattgctgcagctgcaatctatagagacaaaacattgtataaacagtagaagtcatttcagattaaaatcaaatgaacaagatgtgcattgttgacagagtgaagtttaaatatgagaattgtgatatgtaaactgttgaagatagtcttagcttgtgagaaatgattagctcattctattccataaatcaaacaaaacaatgtgatgagcgaaaaaatgatggatcatcttattacttgaaccaaccccgtattactcaaatttggtaaaaatgaatttcgtattactcaaatttggtggattgaaataattgatgttcaagaaaaaaaattagtgcgtgatactttcttgcttcagacttctaacaatatttttttctttttcttctaaaaaacaatattttggattaaaaataatagccttttttattccgctagtgtcaacattagactgacctttaagagctagtttggtaactcaattttcccaaaagaaaataaactaatttctctttagaaaatgaaaatcccttagaaaaacttgttgccaaactagttctaatagagtacttcaaaagatatcatctaccatggacttaaagtaatggaaattcaagtccatacatcctcagttacaagtggatgccatccatata

SEQ ID NO: 8540 - DNA, 677 bp, Zea mays
  misc_feature (568)..(568): n is a, c, g, or t
  misc_feature (640)..(640): n is a, c, g, or t
cgtcttaatctcctttttccaaatcctttcatacaatgatctcataaattcttcaggtaggtccttcccatcatcgataccacgattgtttctaatgaaatcttctggtgacatcttatttttgaccattgggttatgtgcatcagtgttaagcattatgactgaataagccagaacataagctgtatctgcactggaaaaggcctttggattacatttgcagtaacgctctgcaaacttttccataatccgatcaatcttctgagcttctccaggcaacctgaagccttggaggaaagctctaattgcttcatcaaactccagtctttgaaaatcaaatgagtccacatatgcatgcatgactttcagcgataaatcttccctttcacctaaataatcaccaatcatagtcttgttcaagccagaagcactttttaggaacgcagctatctcctctggtgtctcccccaccttgcttgcattaacaaggaactcaatccccttcttcggcttccgattaaacaaatagataccctcctgaagctctatcttgtaagctcgacgttgntccaatgatgctgcctctgaattccatttcgatactcagaatgtgaatcagatgcttcactagactcatctncattggtatctgcctgcggaagctcattgccatcatc

SEQ ID NO: 8541 - DNA, 1208 bp, Zea mays
cggggaacaccttatgttagaaaaggttggctggtccgtcaagttattctatacttgatatttactggtctccaaggattcattattgagcaatacataaatcctattgttgtgaactctcaacatccattgatgggaggattactgaatgctgtagagactgttttgaagctctcattaccaaatgtctacctgtggctttgcatgttttattgccttttccatctgtggttaaacatacttgctgagattcttcgatttggtgaccgagaattctacaaagactggtggaatgcaaagacaattgatgagtactggagaaaatggaacatgcctgtgcataaatggattgttcgtcatatatattttccttgcatgcgaaatggtatatcaaaggaagttgctgtttttatatcgttctttgtttctgctgtacttcatgagttatgtgttgctgttccctgccacatactcaagttctgggcttttttaggaatcatgcttcagattcccctcatcatattgacatcatacctcaaaaataaattcagtgacacaatggttggcaatatgatcttttggttttttttctgcatatacgggcagccaatgtgtgttctattgtattaccatgatgtgatgaaccggactgagaaggcaaaataaccatctgtagatcgtttttggtgtttcatttcttccatcatggaaactgaaagcaataatccgtgcacactcagtaaaacagcatcgtgtcttccagtttttttgttggaatctatcctagatctttattatgtgtatggtggataacctcatgtcaccatcgtatctgtatataataagcctaaatcagctgacgttctgtatgtaaattagtaaatgtaatgactaattggtgcccccctttctgcactaccagatctacttcttttctcgtaatatttagtattaaaacaatcacaccacacattctacttctgcctggtgatgatgttatataacatttggtagctatcacgagcggaatctaagcatgtctgtaatctgatatgtagatctgtgatgccctctcacttcgtttgattttgaatataaggattcgtttggatgcaattttgagttttatgagagtactattcttttgtaaaatacattggttttggagcatcatgaattgtttggatggaataaacgttatagttttg

SEQ ID NO: 8542 - DNA, 787 bp, Zea mays
gcaggaacatggcttcccagtagaagggcagatagcttggttcctttgcatcttctgaagatgaattggtgtatgccaaattatctgttttggcaaacacacggaaggcatctataattggtcggtagccagtacaacgacataaatttcctgcaaggcagtcttcaatctggtcttcagtgggaggctgtttgctagatctcagcagtgcatacatagacatcacaaaaccaggggtgcaaaatccacattgtgaaccatgtgccttggctaaacattcctgaactgggtgcaaacctcgctgacgatctccaattccctcaactgtgattatatgcattccttccacggaataaagtggagccaagcatgcattgattgcaaaatgcagtgatttctttgtaattcggtcatagcaagagaccatgacagtgcaagctccacaaccaccttcaccacatccaagctttgtccctcgaaggccaatatctctaaggtactgaagcagggtgaggtgggcgaggccgtccgggagcacgcggcggacgccgttgacgtagatgaccgcctcgtcggaccactcctcctccgccgctgctgggtcctccgccggcacccgcgtgagcgatcccatcagattccgggtggggaagaagcacggctaggcccgcgagagaacctgcagggagcaataggttccgcctgcggaggtccagaggtcggacgcgcgcttggggctctgcctcccccaagtgtggtggactgcacggcaccctcgtgccgaatt

SEQ ID NO: 8543 - DNA, 2424 bp, Zea mays
  misc_feature (2397)..(2397): n is a, c, g, or t
gtcccccccccccccccccgcccgcgctgcaggtggggcgcagcccattgaagacattgctaataaggtattgaagatggatggtgggagtgctgagaagattgctggaggtgaagatgaagggactacatctccagtcccagagaaggttcaagtaggccattctccacagtacaaggttgagcgcaagttggggaaaggtggttttgggcaagtatatgttggcagaaggatttctgggggaacagagcgcactggacctgatgcttacgaggttgctttgaaatttgagcaccgaaacagcaagggctgcaattatggccctccatatgagtggcaagtttatagtgctctgaacgggtgttatggtgtaccatgggttcattacaaaggtcgacaaggagattattatgttctggtgatggatattctagggcccagcctttgggatgtctggaattcatttgggcagtcgatgacacctaatatggttgcttgcattgctgtagaggcaatttctatacttgagaaacttcatgcaaaagggtttgttcatggagacgttaaacccgagaattttctacttggccagcctggatcccctgacgagaaaaaactttttctgattgatcttgggttagcatctagatggaaggaatcagggtcatctggacaacatgttgaatatgatcagaaaccagatattttcagaggtacaataagatacgctagtgtccatgcacatttaggacgtactggtagcagaagggatgatctggaatcattagcatatacattgatatttcttcttagaggaaggttgccgtggcaaggttatcagggcgagaacaagagttttcttgtttgcaagaagaaaatggctacctctccagatctattatgctgtttttgcccaactccattcaaacttttcctggagactgtgacaaacatgaaatttgatgaagaaccaaattactcaaagcttatttcccttttcgatgaattgattgagccccagcatttgaggcctattagaattgatggtgcattgaaggctggacaaaaacgtggaagattacatgtaaatccagaagaagatgagcaaccgaagaagaaagttcgacttggaagcccagcaaatcagtggatttcagtttataatgctagaaggcccatgaagcagagataccattacaatgtagcagatgccaggcttcatcaacacatagagaagggtaatgaagatggattgttcattagttcagtagcatcttcagccaatctttgggctctcattatggatgcagggactggtttcacatcccaagtatatgaactgtcacccatattccttcataaggattggattatggagcagtgggaaaataactactacatcagtgccatagctggtgcaatgaatgggagttccttggtggtcatgtcaaaaggaactccttacactcagcagtcttacaaagttagtgaatcattcccctacaagtggatcaacaagaaatggaaagaaggttttcatgttacatcaatgacaactgcaggaagccgctggggtgtagttatgtcaaggaactctggatactctgaacaggtagtggagttggattttctttatcctagtgaaggtattcaccgacgatgggagaacggatatagaataacttctacagcagctactggcgatcaagctgctttcatattgagtatacctaaaagaaagttaatggatgagacacaagaaactcttagaacatctgcttttccaagcaaccatgtgaaggagaaatgggccaagaacctttacattgcttcaatatgctatggccggacagtgtcatgaggcttgctcggctgcatccctagttgggaagagcatgttctgatgagtatatattgggaaaaaagcagcaatctttgttgctgctctctattactctctgtatgtgtaggtaacccgttcaagatgaagcaccttacagtggccagagtaggagctcaagaaagaaccgagaggaaggtggaaagcaatcggccaataagcagacgaggagtatgtgatctggctagtagcgggtacaggcgctaatggcgtcaaatgttttgtatcagcatgttttgcttttgcttcgctcctgaccgctgtgcaaagagtagacagcttgtttctttcggaggcaagtcatctgagaaccatcgtgtatagcgtatgatgtcattgtattttctttagtggaggccaagttccatctttccggaactcccaaaatgctaagttattatgcgaggaaacaagtgtactgataaaatcggtgtatcaattccattattcgacaattctcacctgcattaattaatgcaatgctgcattacttatcnctcgagggggggcccggtacccaattg

SEQ ID NO: 8544 - DNA, 2203 bp, Zea mays
gaggccggccggggggcggtcccgctcggcctcgccggggccaccacaccagagcaggaactagcaagccagccagccattgccgaccggagcgatggctaccatggcgaggtcaggtgccgtgaggctctgctgctgcacctccgctcttcttatgctctgctgcttcctcctcccaggcgccctcgccgaggagcgcttctacgagttcgtcgtccaggggacgccagtgaagaggctgtgcaagacccaggagatcatcacggtgaacgggcagttcccggggccgacgatcgaggtgtacagcggcgacacgctggcggtcagggccgtgaacctggccaggtacaacgtgaccctccactggcacggcctccggcagctgcggaacgggtgggcggacgggccggagttcgtgacgcagtgccccatccgccccggcggcagctacacgtaccgcttcaccgtccaggggcaggagggcacgctgtggtggcacgcgcacagctcctggctccgcgccaccgtgcacggcgcgctcatcatccaccccaggaggggcgtcccctaccctttccccaagccacacaccgaggcccccgtcatcctagcggagtggtggaggagggaccccatcgccgtgctccgccagtccatgatcaccggcgcgccacccaacgtctccgacgccctcctcatcaacggccagccgggagacttgctcccgtgctccagccaagagacgagcatcatccccgtggtcgccggcgagacgagcctgctgcgcatcatcaacgcggccatgaacaccgagctcttcgtcagcctcgccggccacaggatgaccgtggtcgccgcggacgccatgtacaccaagcccttcgagaccgacgtcgtcctcctcggccccggccagaccaccgacgtcctcgtcactgcccacgcagccccgggacgatactacctcgccgcgcgcgcctacgcttcggcccagggcgttcccttcgacaacaccaccgccaccgccatcttccagtacaagaacgcccccggctgccccaccacctccggggcaggggctggagccggtgccggcagcaccttcagcggcccagtaggccggtcctctaggtcctccggctacctcggccgcgcagggccgcagccgatgctcccgttcctgccggcgttcaacgacacgaacacggcgaccgccttctcgaacaggctccggagcccagtgccggtgaaggtgcccggcccggtgacccaggaggtgttcaccaccgtggggttcgggctcttcaactgccgccccggcccgttctgccagggccccaacaacacccggttcggcgcgagcatgaacaacgtgtcgttccagctccccgacaccgtctccctgctgcaggcgcactaccaccacatccccggcgtgttcaccgacgacttcccggcgctcccgcccgtgttcttcgacttcacctcgcagaacgtcccgcgcgcgctgtggcagcccgtcaagggcacccgcctgtaccgcgtcaggtacggcgccgtggtgcagatcgtgttccaggacacgggcatcttcgccgccgaggagcaccccatgcacatccacggctaccacttctacgtgctggccacggggttcggcaactacgacccgcgccgcgacgccgccaggttcaacctggtggacccgcccagccgcaacaccatcggagtgcccgtcggcggctgggccgtcgtgcgcttcgtggccgacaaccccggggtgtggctcgtgcactgccacatcgacgcgcacctcacgggagggctcgccatggctctgctggtggaggacggcgagtccgagctcgaggccaccgtggcgccgccgctcgacttgcccatctgcgtgctgtagagatttttcagtttgttgctggcgtgcgtcactacgtggagttacagggaggctgtgtcctgtgtgcatcgttctgtgtgtttgcatcggtagttgggcatttgcattcttggatttccatttgaatttgcaaaggaaaaggggaagtaaagtagtatatgactgaatacggatcacgctcatcggctttatttccgcaatgggctttcttgagactactatgtgacctgggccttccaaattagagtcagaggcctatttgagtgtttactactttcaatatacatg

SEQ ID NO: 8545 - DNA, 1055 bp, Zea mays
  misc_feature (1033)..(1033): n is a, c, g, or t
  misc_feature (1037)..(1037): n is a, c, g, or t
  misc_feature (1055)..(1055): n is a, c, g, or t
ttcgcgaccccggccccggccgggatcgcaaactcggaaaccttgagaggaaagccaccagcagcaagcgaagaccaccagcagcagcgcagcggcgacgtgtttcgctctcgccatggcgtcgtcgtcctcgtcccggctgctgctcctcctcctcccgtgcctcgcgctcacgctgctcggcgcggcagacgccgaagtgcaccaccacgagttcgttatccaagagacgccggtgaagaggctgtgcaagacgcacaacatcatcacggtgaacgggcagtacccggggccgacgctggaggtcagggagggtgacacgctcgtcatcaacgtcgtcaaccgggcgcagtacaacgccaccatccactggcacggcatccggcagataaggactgggtgggcggacgggccggagttcgtgacgcagtgccccatcaggcccggcggcagctacaagtaccggttcaccatccaggggcaggagggcacgctgtggtggcacgcgcacagctcctggctcagggccaccgtctacggcgcgctcatcatccgccccagggagaacaagacctacccattcgccaagccctcgcgagaagtccccgtcatcctcggtgagtggtgggatgcgaacccgatcgacgtcatccgggaggcgcagaggaccggcggcggtcccaacgtctccgacgcgttcaccatcaacggccagcccggcgacctgtacaaatgctccaacaaagagactacggccaatcccggtgaaggccggcgagacggcgctgctgcggttcatcaacgccgcgctcaaccacgagctgttcgtcaccatcgcgcagcacaagatgacggtcgtcgccaccgacgcgtcctacaccaagcccttcaccacctcggtgctcatgctcgcgccgggccagaccaccgacgtcctcgtcaccatggaccagccgcccacccgctactacgtcgccgcgcgcgcctacgtctccggccagaacgtggccttcgacaacaccaccaccacggncgtnctcgagtacgactgcggn

SEQ ID NO: 8546 - DNA, 909 bp, Zea mays
ggatcgttggcgcctccctgccccgttgggacctcgaggccggccgggaccaccagagcagcaactagcaagccagccagccagccagccattgccgaccggagcgatggctaccatggcgaggtcaggtgccgtgaagctctgctgctgcacctccgctcttcttctgctctgctgcttcctcctcccaggcgccctcgccgaggagcgcttctacgagttcgtcgtccgggggacgccagtgaagaggctgtgcaagacccaggagatcatcacggtgaacgggcagttcccggggccgacgatcgaggtgtacagcggcgacacgctggcggtcagggccgtgaacctggccaggtacaacgtgaccctccactggcacggcctccggcagctgcggaacgggtgggcggacgggccggagttcgtgacgcagtgccccatccgccccggcggcagctacacgtaccgcttcaccgtcgaggggcaggagggcacgctgtggtggcacgcgcacagctcctggctccgcgccaccgtgcacggcgcgctcatcatccaccccaggaggggcgtcccctaccctttccccaagccacacaccgaggcccccgtcatcctagcggagtggtggaggagggaccccatcgccgtgctccgccagtccatgatcaccggcgcgccacccaacgtctccgacgccctcctcatcaacggccagccgggagacttgctcccgtgctccagccaagagacgagcatcatccccggtggtcgccggcgagacgagcctgctgcgcatcatcaacgcggccatgaacaccgagctcttcgtcagcctcgccggccacaaggatgacccgtggtcgccgcggacgcctggacacccagccttcgagacgacgtcgt

SEQ ID NO: 8547 - DNA, 1091 bp, Zea mays
  misc_feature (898)..(898): n is a, c, g, or t
ttgggaccctcgaggccggccgggatcgccaactcggagaccttgagaggaaagccatcgcgcgctagggcctagggcagggcacgagcaaaggccctcccgcgggttccattggagcgcgagcgaacggcgccgacgcggcaacacacgttagctttattcgctatggcatcgccatcgtcgtcgtcctggctgctgctgctgctctcgtgcctcgcgcttgccctgctcgcggcggacgccgaagtgcaccaccatgagttcgttgtccaagagacgccagtgaagaggctgtgcaagacgcacaacgtcatcacggtgaacgggcagtacccggggccgacgctggaggtcagggagggcgacacgctggtgatcaacgtcgtcaaccgggcgcagtacaacgtcaccatccactggcacggcatccggcagatgagaaccgggtgggcggacgggccggagttcgtgacgcagtgccccatcaggcccggcggcagctacaagtaccggttcaccatcgaggggcaggagggcacgctgtggtggcacgcgcacagctcctggctcagggcaaccgtctacggcgcgctcatcatccgccccagggagaacaggacctaccccttcgccaagccctcgcgcgaagtccccgtcatcccttgggggagtggtgggacgcgaacccgatcgacgtcatccgggaggcgcagaggacgggcggcgcccccaacgtctccgacgcgttcaccatcaacggccagcccggcgacctgtacaaatgctcccagaaagagactacggccatcccgggtgaagcccggcgagacggcgcttctgcggttcatcaacgccgcgctcaaccacgagctgttcgtcaccatcgcgcagcacaggnatggacggtggtcgccaccgacgcgtcctacaccaagcccttcaccacctcggtgctcatggtcgcgccgggacagaccaccgacgtcctcgtcaccatggaccaggcgcccgcccggtactacgtcgccgcgcgcgcctacgtctccgggcagaacgtggcgttcgacacaccaccaccacggcgggcgtcg

SEQ ID NO: 8548 - DNA, 968 bp, Zea mays
  misc_feature (918)..(918): n is a, c, g, or t
  misc_feature (938)..(938): n is a, c, g, or t
ctcgaggccggccgggccgggatccgacccgcgtgtaggtgtagcactctccatcctcattgctaactgctcgattctcctcctacccttgtgccgcccgctttgcagtaccgcacagccgacactgcagtgaggaacttgaacagaggaagaagcccggctgagcgctctctcgtctagctagctgcgctgcggcgatgaagatgcatcgcttcgctctgcgtggcctggggtttctcgtcctgtggatgctgcattgcggaagcgagctcgccgcggcggtgcctccagatggctggtacgattactccgcctacaccgactgcagaggccagccggagccggcgctgtacaacggaggcattctcaagttcggcagcagcagcagcggcggcggcgatccggacgggtaccgcacgacggagaccggcgtcttctccccggcgttcgtggtgtacaacctcaacaagaccaccatgtacaccttctcatgctgggtgaagctggaaggcgcgtactcggctctgatcaccgcgaggctggcgccggacaacaccggcgccaggtgcatcgccacggtggttgccaggagcgactgctgggccttcgtcaagggcggattcgtcctggactggccgacgcagacctcggtcatcttctttcagaatgctgacaagacgcccatgaagatcaccgtggcgagcgggtcgctgcagccgttcaccacggaccagtgggcgatgcaccagcaggataccatccggaagaggaggaagcgcgtggcgaccatccacgtggccgacccgcagggcgccccgcgtggtgggcgcgttccgtgtcggtgcagcagacggccaaggacttcccccgatcggtccggcgatcgcgtcccacatccttgggaaacaggcgtaccangcagtggttcgtggaccggntcaacgcggcggtgttcgaggacgagctca

SEQ ID NO: 8549 - DNA, 1529 bp, Zea mays
cctcgaggccggccgcgcttcccggatgcaataatttttttccgcaaaagccaggattcctctgctcttcctgtttagggtttccccctctctctgctcctgccggatgcgatggcgattccgccgcggactccttccccgccgccatcgtggtcgcgctctgtaaccgagaccgttcgggggtcccaccagttcaccgtacggggctactccctcgccaagggcatgggccccggccgctacctcgccagcgacgtcttcgccgtcggaggataccactgggccgtctacctctaccccgacggcaagaacgccgaggacaactccaactacgtctccgttttcgtcgccctcgcttccgacggcatcgacgtccgagccctcttcgagctcaccctcctcgaccagtccggccgcggctgccacaaggttcactcgcactttgaccgctcgctcaagttcggcccatacaccctcaagtacaggggatccatgtggggttacaagcgcttctacaaaagaacactcttggaagaatctgatttcttaaagaatgattgcctagtgatgaactgcacagtaggtgttgtcaagaaccgtatagaaacaccaaaggacatccagattcatgttccacgatcagacatgggccgctgcttcaaggagctcctcagccgctgcattggatgtgacataacattcgaagtgcgagatgagaaagtcagggcacacaagtggattcttgctgctcgctccccagtatttaaagcccagttctttggtcctattggaaagcctgacctgcacacggttgttgtggaggatgtggaacctgttgtcttcaaggcaatggtgaacttcatttacgctgatgaactccccagcattcctgagctagctgggtctgcctcaacgtggacatcaacagtagtagtacagcatttgttggcagcagctgatagatatggactggtccgtctgcgtatcctgtgtgaatcaaagctctgtgatgaactgactcctgaaactgtcgcaacaactttagcccttgctgaacagcaccattgtgctgagctgaagtctgcatgtctaaagttcattgctttgcgaggaaatttgggagctgttatggagacggaaggctttgattacctggaggatacatgcccgtccctactatctgacttgttagctactgtggcagtcgtggacgacgatcttgcatcccttaaccgaaaaaggggagtcagcgggaaccaagtcatggctctagtgggaagcgttgaaaggcgcacccggaggaagctttagtagctggcttccctagagggagactgtagttgacaacgatttgatttggacgctggtagctgtgaataatatcgtatccagatgattttttttttttttttgcagaagcagaagttgtaaattttttgaattgaatgcctttttttttcctgtttgggaccaaaaattacgtaaagttctagcttttatactgttttcaatactctaaattgtcccct

SEQ ID NO: 8550 - DNA, 660 bp, Zea mays
agcggctacgttgcacatgaataaactggagagggaggaaagcttggtgtcggcattcgcattcttcgataaggatgggagtggcttcataacaatcgatgagctctcgcaagcatgcggacagttcggcctttctgatgttcatcttgaggacatgatcaaagatgtggaccagaacaatgatggacagattgattatagtgaatttgctgccatgatgagaaagggcaacactggtggagcagggaggcgaaccatgaggaacagcttgcatgtgaatcttggtgaactcttgaagcctgccgagacctagtttttttaccagaggattctgctttccagatgctcccatctgaagtttagcgtgcatcgtcagctttcacggattgattagacttgatcccagtaccagtgccacgaaaaaagcggttatttttttttcaggggtactagtatttaggggaaagagcattctgtggcacccagggacaaatcctaggtgctgaagctgacatgttatgctactacggagtcccgttgtcttgtcacgattgttgttgatgatttcaggtttgtaccattactgatttttggtgtcagtgtaaaaatgtgctggtgccccataaggtaggccctaggtctgtgtttgaagcatcgaca

SEQ ID NO: 8551 - DNA, 2653 bp, Zea mays
attgggtacctcgaggccggccccgtctccccctctcctccgccactaaccaaggaggcgaagacgataaccaccgacgtgccttcctccccacatgccctagcgatccgttctcatttgcagacccaatccaagcccagagcaatcaccaagcctggcagattagatttccaccctcacatggaggaaaaatccaaccttcgcatgtgacctctatttaaatccccgcaagaatcgatcaatcaatccaaaagggtgcaggaaaacagagcaatcccgttgcttagcgtgttcgccttgccgttggcgtctcttctccgttcctcggcacgcgtaggcccataaacctccgctaaagctcctttgtcgcgcccatttcgtcagccatttcccagattccccataggcgagggttcccgggctgagatccaatcttttcagttgttcggtttcaatcggtgtaaattcctccagaaagaaacctagaatcgcccccccatagttggaaaaggtttccatttctgaccggttgtcgagcctggctacgttttgccgagcaaaggcagggcgtccgttcggttacggttcttgatccggcgagggaccgccgctgccgaaggcaatgcagccggacccgcaaggcccgggcagggggaaggcgggcggcgccaatgcgcacccgcggctgccgccgccggtgacggcggggtcggctgggcggccggcgtcggtgctgccgcacaagacggacaacgtgcgcgaccactaccgcatcgggaagaagctggggcaggggcagttcggcaccacgtaccagtgcgtgggcaaggcggacggcggcgagtacgcgtgcaagtccatccccaagcgcaagctgctgtgccgcgaggactacgaggacgtgtggcgcgagatccagatcatgcaccacctctccgagcaccccaacgtcgtccgcatccgcggcgcgtacgaggacgcgctcttcgtccacctcgtcatggagctctgcgccggcggcgagctcttcgaccgcatcgtcgccaagggccactacaccgggcgcgccgccgcgcagctcatcaagacgattgtcggggtggtgcaggggtgccactcgcttggcgtcatgcaccgggacctgaaaccggagaacttcctcttcgcgagcacccctgaggatgccccgctcaaggccactgattttgggctttccgtgttctacaagcccggtgataaattttctgacgttgttgggagcccctattatgttgcccctgaggtgcttcaaaaatgttatggcccagaatctgatgtatggagtgctggagtgattttgtacattttgctatgtggtgtacccccattttgggcagagagtgaagcagggatcttcaggcagattttgcgaggcaaacttgatttggaatctgaaccatggccaagtatctctgatagtgctaaggatttagtccgtaagatgcttatccgcgatcctacaaagaggttcactgctcatgaggttttatgtcatccatggattgttgatgatgctgtcgcacctgataagcctattgattctgctgttttgtcaaggctgaaaaacttttctgcaatgaacaagctcaagaagatggcattgagggtgattgctgaaagtctatctgaggaggagattgggggtttgaaggagttgttcaaaatggcatcgagactgacattacagcgggaacgatcacttatcaaaatgaactgaaggatggtctgaaaagggttggctcggacctgatggaacctgaaatccaggctttaatggatgcagctgatatcgacaacagcggaaccattgactatggagagttcttagcggctacgttgcacatgaataaactggagagggaggaaagcttggtgtcggcgtttgccttcttcgataaggacgggagtggcttcataacgatcgacgagctctcacaagcatgcgaacagttcggtctttctgatgtccatctcgaggatatgatcaaagatgtggaccaaaacaatgacggtcagattgattatagtgagtttgccgcgatgatgagaaagggcaatgctggcggagcaggacggcggaccatgaggaacagcttgcatgtgaatcttggcgagctcctgaagcccaccgagacctagttttttttaaccagaggatcctgcttcccagatgcgccccatctgaaacttaccgtgtgcctcatccgctttcacagatcgattagttgatctctagtagcagcgccaaaagcagtttaagattttctcagtggtactagtagtgaggggaaaatagcatcctgtggtgccagtgagagattttaggcgctgaagacgacgtgctatgctactccggagtcctgttgtcttcttcttcttcttgttgttgttgatttcaggtttgtactattactgatctttgttgtaaaatgcgctgttgtcccatgaggtaggcacctaggtctcctccatttgaattatatcaaacggatctgtaaacacgttctcatgcatgaaaccatttcttaatgatgatttattgtgtgattttttcccaaaacaaaagttgttaccactgcttaagggcgagaaaaaaaaaaaaaaaaaaaaaaaa

SEQ ID NO: 8552 - DNA, 2390 bp, Zea mays
attgggtacctcgaggccggccgggatcaaaaggtagatatttgagctttcatcgtctcctcgccgcccgcccccgtaattcctataaaaaaatatgggtggagccatcacccacgcccccaagctccccgggacgccggatagatagaagaggctaacctttacctcccgcttgctccccccttttattttggcaggattgcacatcttccccaagtaacacctgacaaagggcgaggagagcatagatttcttctttcccttgccgttgccgcttccgtttctcgcttccattcctctctgctcgtgggtttgtcgaagataaacctcgcataaagcttcgttcgtcggcttttggtatcaatcggcagggctcccccgtttcctctctccaagatcttccccccttttcttctgtctccaacccgcggaaatccttggaggagttgcggaaatttgtagcaagaggttttcctttccagctttcctgctgcggcggcctccgcacggtttttgatccggggagcgcacctggggcgcgccaatgcagccggacccgagcgggaacgccaatgcgaagacgaaactgccgcagctggtgacggcgccggctccgtcgtcggggcgtccggcgtccgtgcttccgtacaagacggcgaacgtgcgggaccactaccgcatcggcaagaaactggggcaggggcagttcggcaccacgtaccagtgcgtgggcaaggcggacggcgctgagtacgcatgcaagtccatccccaagcgcaagctgctgtgccgggaggactacgaggacgtctaccgcgagatccagatcatgcaccacctctccgagcaccccaacgtcgtccgcatccgcggcgcctacgaggacgcgctcttcgtgcacatcgtcatggagctctgcgccggcggcgagctcttcgaccgcatcgtcgccaagggccactacagtgagcgcgcggctgcgaagctcatcaagaccattgtcggggtcgtggagggatgtcactcgctcggcgtcatgcaccgggacctcaagccggagaattttctctttgccagcaccgccgaggaagccccactcaaggccactgacttcgggctttccatgttctacaagcccggtgataaattctctgatgtcgttggaagtccatactatgttgcaccagaggtgcttcagaaatgctatggtccagaagctgatgtgtggagcgcaggagtaattctgtacattttgctttgtggtgtgcccccattttgggcagaaactgaggctggaatcttcaggcagattctgcgaggcaaacttgattttgaatctgaaccctggcctagtatttctgatagtgctaaggatctggtctgcaatatgcttacacgggatcctaaaaagagatttagtgctcatgaggttctctgtcacgcatggattgttgacgatgccgtggcacctgataagcctattgattctgctgttctctcaaggctgaagcatttttcggcaatgaacaagctcaagaagatggcattaagggttattgctgaaagcctgtctgaggaagagattggaggcctcaaggagttgttcaagatgattgatactgacagtagtgggactataacatttgatgagctgaaagatggcttgaaaagggtaggctctgaattaacagagaacgaaatccaggctctaatggaagcagctgatattgataacagcggaaccatcgactacggcgaattcattgcagctacgttgcacatgaacaaactggagagggaggaaaacttggtttcagcattctcgttttttgacaaagatggaagtggctttataaccatcgatgagctgtcacaagcatgtcgcgaatttggtctcgatgacctccacctcgaggatatgattaaagatgttgaccagaacaatgatggccaaatcgactacagcgagttcacggcgatgatgaggaagggcaatgctggtgcaacaggaaggagaaccatgaggaacagcttgcacttgaatctcggcgaactcttgaatcccagcaaaacctagcgcgttactggaaggccttgtcaggtacattcccatggcatctgaagtttttggatgcgttgtcgatctgctggcctattctgagatgttgagtggttatcctgtggtattactaagatgctggacaattttcgtagtgctggtggtatcagctagagaagagggatggctggcacaatgtggctactatcgccaactgcttttgtatgtgtaactatcgatgtagattgactatggtctaaacatcagtttagttgatatttcgttctctaaaaaaaaaaaaaaaaaaaaattacaaaactcgagggggggg

SEQ ID NO: 8553 - DNA, 2991 bp, Zea mays
tgctaggatgaatagaagtggtgagaatgtttatgatgaccacgtgtttaagtttgtcaaacgctttttcaaagtccaaattttaggatgatcatttcttttttggactgtttgcataaatgtatgtatccaaaagagcaagccactcaatccataacgatttatgtgaatgagctcaccctctacagttggccaacagtttggttagaagtttcacgagcgaattcaagagtgagattataatcactacctcaataacaataaaggtgtcttatttcataggacaatgtgggacccatttatgctttgcaaatcatactgtttccaataattatagttggtcactatacacggtttttagcagacatggactcttgcgtattttccaatttacaaaaggaaaaatattaaaaaatagtaataaaaaagggaaaaaaaacaatggagacatcgtcgtcgtctccttcctccctccttcctggtcgcccatggattattccatagatacgacctagctgcgctgctacagcccccgcatttcccttcccccaatcctctcctccacgaacacgccctcccttttgcccgttcccagcctcgaacggcaaatcaaaaggcagatatttgagcttttggtcatcgtctccacgccccattggtagccgcctctgaaattcctataaaaaaagatatatgggtggagacatcacccacgccgccaagatcctgtcttcttgcgcggccagctcgtagctccacgccggatagatagaagaggccaacctttcctccccgcttgctccccttttctttcggcaggatggcacatcttcccccacgtgacacctgagaaagtgagagcacagatttcttcttccccttgctgctgccgtttctcgtttccgttcctctctgctcgtgggtttctcatagataaacctcgcataaagcttcgttccctcggctcttggtcccaatcagcagggctcctccgcttacccgtccaatttctccccacccctgttcttctgcctccaacccgcgggaatccttgaggagttgcaggaatttgtagggagaggctcctttcctgctgcggaggccgtcgtacggttcttgatccggggagcacacctggggcgcgccaatgcagccggacccgagcgggaacaccaatgcgaaggcgaagctgccgttgatggctccggcgccgtcgtcggggcgcccggcgtccgtgctgccgtacaagacggcgaacgtgcgggaccactatcgcatcggcaagaagctggggcaggggcagttcggcaccacgtaccactgtgtgggcaaggccgacggcgccgagtacgcgtgcaagtccattcccaagcgcaagctgctgtgccgggaggactacgaggacgtgtaccgcgagatccagatcatgcaccacctctccgagcaccccaacgtcgtccgcatccgcggcgcctatgaggacgcgctcttcgtgcacattgtcatggagctatgcgccggcggcgagctcttcgaccgcatcgtcgccaaaggccactacagtgagcgcgcggcagcgaacctcatcaagaccatttgtcggggtcggtggagggatgccactcgctcggggtcatgcaccgggacctcaagccggagaactttctctttgccagcaccgctgaggaagccccactcaaggccactgactttgggctgtccatgttctacaagcccggtgataaattctctgatgtcgttggaagcccttattatgttgcaccagaggtacttcagaaatgttatggtccagaagctgatgtgtggagcgcaggggtaattctgtacattttgctttgtggtgtccctccattttgggcagaaactgagtctggaatcttcaggcagattatgcgagccaaacttgattttgaatctgaaccctggcccagtatttctgatagcgctaaggatctggtccgcaatatgcttactcgggatcctaaaaagagatttagtgctcatgaggttctctgccacccatggattgttgatgatgccgtggcgcctgataagcctattgattctgctgttctctcaaggctgaagcatttttcggcaatgaacaagctcaagaagatggcattaagggttattgctgaaagcctgtctgaggaagagattggaggcctcaaggagttgttcaagatgattgatactgacaatagtgggactataacatttgatgagctgaaagatggcttaaaaagggtaggctccgaattaacagagaacgaaatccaggctctaatggaagcagctgatattgataacagcggaaccatcgactatggtgaattcatcgcagctactctgcacatgaataagctggagagggaggagaacttggtttcggcattctcattttttgacaaagacggaagtggctttataaccattgatgaactgtcacaagcatgtcgtgaattcggtcttgatgacgtccacctcgaggatatgattaaagatgttgaccagaacaatgatggccaaatcgactacagcgagttcacagcgatgatgaggaagggcaatgctggtgcaacaggaaggagaaccatgaggaacagcttgcacttgaatctcggcgaactcttgaatcccagcaaaacctagcgtgcattggaaggtcttgtcgggtacattcccatggcatatgaagattttggatgcgttgtcgatcggctggcctattctgagatgttgagcggttgtcctgtggtattactaagatgctgaagaattttcctagaagtacaactgccctgcggcatatatgtataactgtcgatgtaatgtagattgaacatggtctaaacattacttccctagaagtacaacttctctgctgtcaagtgtgtgtttagttgatattgaatagcaatttctttctctaatttcattgaaaaaaatttttttgagtcttctaaa

SEQ ID NO: 8554 - DNA, 646 bp, Zea mays
gaaggaggcgaagacgataaccaccgacatgccctagtgatgttcatcttgaggacatgatcaaagatgtggaccagaacaatgatggacagattgattatagtgagtttgctgccatgatgagaaagggcaacactggtggagcagggaggcgaaccatgaggaacagcttgcatgtgaatcttggtgaactcttgaagcctgccgagacctagtttttttaccagaggattctgctttccagatgctcccatctgaagtttagcgtgcatcgtcagctttcacggattgattagacttgatcccagtaccagtgccacgaaaaaagcggttatttttttttcagtggtactagtatttagtggaaagagcattctgtggcacccagtgacaaatcctaggtgctgaagctgacatgttatgctactacggagtcccgttgtcttgtcacgattgttgttgatgatttcaggtttgtacccttactgatttttgttgtcagtgtaaaaatgtgctggtgccccctaaggtaggcccctaggtctgtgtttgaagcatcgacagatttgtaaacatgttcctatgaacctatttctgattgataatttgtcaaaactcatcatttgtcttcaaaaaaaaaaaaaaa

SEQ ID NO: 8555 - DNA, 1397 bp, Zea mays
aacacccattaccatttatgggctcattcggactcagagcatgcgccagatgtgacatacagattgaccacggccgttatctcagttgcatgggagctgtctggcatccggaatgttttcgttgccatgcatgtggtcaacctatatatgactatgagttgtacatgtccgggaatcatccataccataaaacttgctacaaggagcagcttcaccccaaatgtgatgtctgcaaacagttcattcctacaaatatgaatggccttattgaatatagggcacatcctttctgtgtacagaaatactgtccttcacatgaaatggatggtactccgaggtgctgtagttgtgaaagaatggagccaagggaatcaaaatatgtattactggatgatggtcgtaagctctgcctggagtgccttgattccgcagtgatggatacaaacgactgccagcctttgtatcttgaaattcaggaattttacgaaggactgaatatgaaagtggaacagcaggttcctctgcttctggtcgagcgacaagctttgaatgaagccatggaaggagagaaggctggtcaccaccatcttcctgaaacaagaggactatgcttatcagaagaacagactgttagcacgatactgagaccaagaatggctggaaacaaaatgatgggaatgataacagagccatataggctgacacggcgatgtgaagtgactgcaattcttattctgtatggtctcccaagattgttgacaggttcaattttagctcatgagatgatgcatgcatggttgcggcttaaaggataccggacactgagcccagacgtagaagagggcatttgccaagttcttgctcacatgtggatcgagtcagagatcatggccggatcaggcagtagtgccgcatcgtcatcctcaggatcttcgtcatccacatcatcgaaaaagggcgggcggtcccagtttgagcacaggcttggggactttttcaagcatcagatcgagacggatacttccatggcctacggagatggtttcagaactgggaatcgagccgttcttcattacggcttgaagcgcacccttgagcatatccggctaactgggacctttccattttgaagtagcatggattcatattttgggaaagcttatattatatacatgattttcttccagagttccattacaaccaaagagataaattgtaaaaaaacattctttccagaatccagagatataatatctatgaaggccaaaatgaagtattaaatgattgagatcgatggtcagtctgcccaatcattttgtattctgatcaaactctggaatgaaacaatggcaatctttttatatggtgtcagtttcaataaataccagtaccatttt

SEQ ID NO: 8556 - DNA, 2029 bp, Zea mays
ctgtgttgtgccataggggttgatggacagaattggatgtaccctgttgcttatggattctttgaggcagaaacaacagaaaactggacatggttctttcagcagttgcgcaaggctgtgggagatcttcctctactagcattgtgttcagatgctcgcaaaggtctaaaaaatgccatgaacactgttttccctcaagctgaaaaaagggagtgtttcagacacctaatgcagaactacgtgaagcaatttgttggatccgagtacatgtatcctgcagctagagcatataggagggaggtgttcgaccattacttttccgatgtccaagaaattcccaaggtgtctagttggttacatgagcatcatgatagtttgtggtatcgtagtgggtttaatccagccatcaagtgtgactatgttaccaacaacatagcagaagtgttcaacaattggattaaggattggaaagatctgcctgtttgtgacttggctgacaagataaggaaggaaatcatggagttgtttcaaaagaggagggagataggacagaggttgcaaggtcgaatactaccctccgtggtccatatcctccatgtaaggactagaggtttaggtcacttaacagttaagaaagctgacaattacattgcagaggtgagggataataatgatgagcactctaagcacattgtgaatgctcaattgagacaatgttcatgcaacgagtggcagcatacggggaagccatgtcaccatgcccttcgcttaataacaacacagcaatttagagatgttcggatggaagattttgtggatgactactactcagttgataagttcatgaaggcttactccagggtagtggagccaattggtgacaaatctttctggcctacagtgccatttgcaaaagaggtgtgtgcttctattgggaagcgtggagttggccgtcaaaggaaaaacatgattaaagggtgcctagagggaggaagtggtaagaagccaaacgaaaatgaaaatgtcaaaactaagaagatgattcgtgggaagttcaagtgtccaaactgtggtgaattgggacacaggaaagccagctacaaatgtcctttgaatggaacaaaaaaacggaaaaggagagcaaggaaaaatgttactaaaggttggttcccaaaagatgttgaggcatgatgatggtgcatgcactagccacacaaccacccccatgtgatgattgtgatgccagtattgcaaaaatctctccactttcacctcccagacctatctagaggctagtgctggaccagtgtaccctaggagctgggtgccaggtgcggtggcgggcggggcctagcaaagcatgacgctgtaggagggatccagtcatccgatacgtcagcactccggcacagcagtaggcatctcggaagccggcagggccacagggcaccacgcccaaggcttagccgcgcaggcactgagcagccaagtagtcaggcagtcagtgagcagcagcagacggcagcaaggctggaagcgcgaagtacctatataggcatataagtttagttcgaccgggagtttacttctctgttatctgtgacttgcccgaccccgacttgatgtgcattgtagattctcagaaattgattaatgatttaatcacagattttaatcaactcaacacgtcgagaagaatatttttgtgctcatagttttttagttcaagcaatgttaatactagtggtacttccctgagttcatatcaatgcttagtcttgggctcctcagaaatgcaaattctttctttggcttgcaattagaaacaagtgttggactgctgataatctggagaagaggggttgcagcacccaagcagctgccctttgtgtgaccaagaaagggaaacgatacaacacatcatcactacctgtgtttttgcccggcaattctggtttcttatctttgacactcgggatgagtcacctcgctcttagggctgatgagcggtcgtttgaggactggtgga

SEQ ID NO: 8557 - DNA, 684 bp, Zea mays
gcctatctatgtcaagcaatttgctgggtccgaggggatgtttactgcagccagagcctataggagagaggtgttcgaccattacttttctagtgtccaagattttcccagaagtatcccgtcggttagttgagcatcatgacagtttgtggtaccgtagtggttttaatacagccatcaagtgtgactatgttaccaacaacatagcagaggtgttcaacaattggattaaagattggaaagatctaccagtttgtgagttggcagacaagatcagggaggaaatcatggagttgtttcacagaaggaggaggataggacagagactgcaaggtcggatactgccatctgtggttcatatccttcatgccaggactagaggtttaggacacttgacagtgaagaaagtcgacaattatgtcgcagaggtgagggataataatcatgtgcattctaagcacatagtgaatgttgagttgagacaatgttcatgcaacgaatggcagcatacagggaaaccatgtcaccacgcactttgtttaacaacaacacaacaatttaaagatgttcggatagaggattttgtggatgactactactcagtggagaagttcgtgaaggtgtactcaagggtagtagagccaattggtgacaaatctttttggccaaaagtgtcatttgcaa

SEQ ID NO: 8558 - DNA, 1125 bp, Zea mays
actccaggcccaccaaaagaaaagatcacgacgcgacccgctcgctctcgctctcgctctcgggccccagtccgatcgggtcggtgcctacccacccccgcagccccgctggccgccgcacccaggcgaggcaaggcgcgtcgcgaaccacggaaccaaccgcaccgaccgagtcaatcaatccggcgagtggccgagtggggtaggttgtgtgcggcatgacgaccacgcgcgaccgtggcgccggcggcggatcggcgtcgagggtcggtgacggggacgtcgacctgggcgagggctgggactggggcgccatcccgcggctcctctcctccgcctgcctcttcctctgctccggagcgctgttttggttgctgcgataagactgtaaagcaactgggtgaactgtccagaaacttgatcacccaggaccaaataaccattggagagccattttggagcacaaccaccatcgaggttgaaccagcagatctcagcggtgttacttcagtcaatacatctaacttggcctctggaactggtagcagtcataaccttcctggacttggtaataatggacttattctgtgggaacatacaaggcaggagtggactgaaactagaagtctacggctgaaggcgaagcaggttcgtgaaccagtattgagttggaatgcagcatatgagagtctgcttggatcaaataagccatttcctcaacccattcctcttcatgagatggtcgatttccttgtggacatctgggagcaggaggggctgtatgactagcgcaaatgatttcatgggataacatctgggataacacatagttgttcctcaagagaggggaaaaagaatgacatagggggtgtaggcttgggatgaggtgatgagttggcctgtcatacttgtttttgtcaatggaggcctgctgtacttgcagaatacagagctgtggttgtaagcttgtaagaagtcctgatactaatagtggctttgtttaatttgccaaaaaaaaaaaaaaaaggttgagttgtgacaaaagtggattaggcctgctgatgggtttggattgaaatgagtttaaagggctgtgttttcatgtggttgcaaaacacaaacccc

SEQ ID NO: 8559 - DNA, 5423 bp, Zea mays
  misc_feature (5335)..(5336): n is a, c, g, or t
cgctcactgctacttgcatctagcctgctagtctctccttgggtgattgggtccttcagtccttgcaatttcctcccgcactcccggttctcccgcacgctcccctctgcctgtccgtgtcgcttgcttcgcttctgcaaacccctgcccggcggccggggcgagggggcgtgatggtgttcaaggggcgcttcttctcgtcgcgacacaagtcatcggagtcatcttccagcccagacggcagcaacagcccacgcacgcctacctcggccccggcctcggcatccgcggcgtcgccggcgtcgtcgtcgtcgtctagatccgacaagaagaagactaaatcggagactcctaagaagcgcgacaagctcttcggttccgcggccaccgcacccaagagcgccgcatcgtcggcctcgtcaagcccggcgggtgatgggaggaaggggtccgtgccgcatcatagggatgcgggcgtcgggggcgggggtggcgcgtcggcggccgcgctgtcgccgatcctggcgtcctcgctggggctcaaccggatcaagacgagatccgggccgctgccgcaggagggccaacgcatggctgccgtgatcgggagcagcaacctctcgcgcgggcagggccaagcggaaccgtcggctgcctcagccggcgtcggcggtagaaagggcgtcacctcctgggcggatactagtagtagcagccgcggaaaagggaagacgaccgagctgccgatgcgaagtacagctgggacgagcttgggaccagtagggaagagcgctgtaaaaggtaacaattatgtatgctgttttttcttttccaagctagtttagtttagctatcaagtatgggcctggaagctggctattgattttgtcaaagctaggagttaattttttgctgttttgagcttgggaagggatgggggaaaacatgtgagcaaacaatagttgttagttactccctcaaatgcttactaagatgctatgagttgagattgcacaattcgtcttactccgctgtagccgtttacacttgaaacacgtgcaaacgaagcaagtttctagctgtttaaagcgaaatcagcaagctaggagggttatagtttataagtcgagttagcaagtgcttgctctttttgttgcttgaacgcaaggcatttctaatgagcaggctcataaacattgtttctatatatgcatcttattgtatatatgcttcattaagggtacgtttgatttctaaaaatattagtcaaatgctacttctgcagcagagatattgtttgtgtatgcgcatagtaatttctccaattccccttctttttgtctgttatgaaaattatttttgacaactaattggtgggctctccttttggagctttgttctatttttctctctccacaaccttttgtgatacatgggctaatccatctcattcacagctaaacctagtgcacagcggaaccattctggagatttgaggacacctactcacatacctgaggctgcggtagtgatatttctatttttcttcttccctatgactttcatttaagtaaacaatggctaatccatccttacatctttttgcttgcatttttagtgtgcatatgatccgtgtgagacaccaaaggaatccgagtccccacgctttaaagccattatgcaggctactagtgcaccgaggaagagactccctgcagatataaaaagtttttcacacgagctgaactccaaaggggtgcgcccatttccttttttgaaacctcggggcatttacaacttaaaggtaatccgagtccaccgtttgtgtgagacaagggtcattcatacgtcaccttgttttttttactctacccattccagtttcttaaatatttgttaataacaatactttctcctgttatctatgcaggaggtaataaaagttatccatgtgagatttgagaaggcaaaggaagaggtaaattcagatttggcagtttttgcaggagacttggttagcgtaatggaaaagtatgcagactctcatcctgagtggaaagatgccctggaggacttgctaatacttgcacgtacctgctgtgtcatgacacctggggaattctggcttcagtgtgaaggtatagtgcaagatttggatgaccatcgtcaggaactctcaatgggtgtgctgaagaaactatacacccggatgctttttatccttacaagatgcacaaggctgctccagttccacaaagaaagtggttttgctgaggatgaagttgttattgatcagcgtgataagattatacaatctgcagataggcagattttaactcaatcaggtgtgggtgacacaacatccagagccagtaaaagtgaggcaagaaaatcatacagtcaggagcagcataatttgaaatggaagcgtagccaggagataaagcctgttaaccttcttccaccacttgatacggatgttaagaaagtggctgattctccaaccaaagaacgaatatcttcctggaaaccttttccatctcctgttacgaaggtcccaaaagaatctactcctactaaattggaatcacctaataagaaaacagatgcacactctacagttagtagccatgttgaattaagcagtccagttgaatctttaccacaacaacagcttcctgtcaagcatcaacataaaacttcatggggccactggtctgaccagccaaatatttctgaagagggttcaataatgtgtcgcatatgtgaagagtatgttccaacacagtatgtagaagaccattcaagggtctgtgcaattgctgacaggtgcgataaaaaaggtgttagtgttgatgaacgcttaatcagagttgcggaaatgctagaaaagatggtagaatcttattcaccgaaagacctgccaaatgctgcagtcagcccagatgttgcaaaagtttcaagttcaagcatcaatgaagaatctgatggtccctctcctaaactctctgattggtctagaagaggatctgctgatatgcttgactatctccaagagactgataacactatttcattggatgacattaaaaatcttccttcaatgacatgtaagactcgttttggaccaaaatctgatcatggaatggccacatcatccgctggaagtatgactcctaggtctccattaactccaagatcaaatcatatagacatgcttttagctggtaaaaatgcaattaatgagagtggtgatcttccgcagattgtcgaacttgctgatattgcacgatgcatcgcaaatacccctctggatgaagaaagcgcattatcccaaatggttacctgcatagaagatcttcaagaaattgtcaaccgcaggaagcatgaggccctcacagtccagacatttggaacacgcatagaaaaactacacagggagaagtatctgcagctctgtgactcggttgatatggacaaggttgattcaacaagcaccataatggatgaggaagacgacgttgttcgtagcttgcgcgcaagtcctgtccatccaatcaaggatcgcacttcaattgatgactttgaaatcatcaaacctattagccgtggagcatttggacgtgttttcttggccaagaaaagaactacgggagacctttttgctataaaggttcttaggaaggcagatatgattcggaaaaatgctgtcgagagtatattggctgaacgtgatatattgattacagtcaggaacccttttgtggtacggtttttctattcgtttacctcacgggataatttgtatctggtcatggagtacctgaatggaggggacctttactcattactgaggaatttagggtgcctggatgaagacgttgttcgtgtgtatcttgcagaagttgtactagctttggaatatttgcactctatgcacatagtccatagggatctaaagcctgacaacttgttgatagcccatgatggacatattaagttgacagattttgggttgtccaaggttggtttgatcaacagcacagatctgtctggtcctgctgttagtggggcttcactgtatggagatgatgagcctcagatgaatgagctcgaacaaatggatcaccgagcacggagacaaaatcgttctgctgttggaactcctgattatttagcaccagaaatccttttggggacaggacatggttgcagtgcagattggtggtctgttggtgtcattctgtttgagctcattgttggcatacctccattcaatgcagaacaccccgaggcaatttttgaaaatattatgaatcgcaaaataccttggccacatgtcccagaagagatgagttttgatgcacaagatttaattcacagattattgacagaagatcctcatcaacgactaggagcaaatggtgcctcagagggggaggacagcactggcctcaatgagtttgaatctagtgcaaatgtcaattattctttcagcaacttctcgttcaagaatctatcacaacttgcttccatcaactacgatctgctcaccaaaggattgaaggatgatccaccgccaagaacagaaatgtagcagttaatctaaatttggatggactcatttgagtactcagacagtctacaaggtgctcgtgggatgtaggtcttgtacatatcaaagtgtgaggcatggtctgttcctattgaggctgttcctacatctcgcggatccgagtacagttttggtgttgccttgttttcatgactattgccatgccttcatcagtgaaatcacccttgaccaaatttggcattcgacctaggagcgctgtctttttggttcgtctttcctttttttagtcctattatgagccttgggtttacggagattggtcaaggttactgtattcagaatacagctcctgaagacgtaggcgggtttcagagaattgccattctggcatacagttgactctggttcgttaagctggtagcccgctggacttcctgcggccagaactgtccacaacattttgatggccgtggaatatagcattttgcttaatgtgtccagtgaaacagaatcagggccattttaagaagaatattaaccgattgacattataaggatatcaaatggaagcggcgttttatgcaattcaaaattcgatgggcatcgcccagcagtcatattgtgtaacggtttgtccgatgtcatgtcgcttgcaaaatgctgtagtagcactacctgctgtttattaaactcagaactcgaactcttttatagccctcgtggcctaaaacaaaaaaaaaaaaaaaaaaaaaaaaaaannaagggcggcgcgctgctcacagtatacaggcttacggccgcgggcagcgtgcgtcataggtcatagctcgtgtatagtgtcacgtat

SEQ ID NO: 8560 - DNA, 2230 bp, Zea mays
  misc_feature (365)..(365): n is a, c, g, or t
ccaaatggttacctgcatagaagatcttcaagaaattgtcaaccgcaggaagcatgaggccctcacagtccagacatttggaacacgcatagaaaaactacacagggagaagtatctgcagctctgtgactcagttgatatggacaaggttgattcagcaagcaccataatggatgaagaagatgatgttgttcgtagcttgcgcgcaagtcctgtccatccagtcaaggatcgcacttcaattgatgactttgaaatcatgaaacctattagccgtggagcatttggacgtgttttcttggccaagaaaagaactacaggagcgcggccggccggtaaggttcttaggaaggcagacatgattncggaaaaatgctcgtcgagagtatattaggctgaacgtgatatcttgattacagtcaggaacccttttgtggtacgctttttctattcgtttacctcacgggagaatttgtatctggtcatggagtacctgaatggaggggacctttactcattactgaggaatttagggtgcctggatgaagacgttgctcgtgtatatcttgcagaagttgtactagctttggaatatttgcactctatgcacatagtccatagggatctaaagcctgacaacttgttgatagcccatgatggacatattaagttgacagattttgggttgtccaaggttggtttgatcaacagcacagatctgtctggtcctgctgttagtggggcttcactgtatggagatgatgagcctcagatgaatgagctcgaacaaatggatcaccgagcacggagacaaaatcgttctgctgttggaactcctgattatttagcaccagaaatccttttggggacaggacatggttgcagtgcagattggtggtctgttggtgtcattctgtttgagctcattgttggcatacctccattcaatgcagaacaccccgaggcaatttttgaaaatattatgaatcgcaaaataccttggccacatgtcccagaagagatgagttttgatgcacaagatttaattgacagattattgacagaagatcctcatcaacgactaggagcaaatggtgcctcagaggttaaacaacatccatttttcaaagacattagctgggatacccttgctaggcagaaggctgcctttgttccttcctccgatagtgcatttgatactagctacttcaccagtcgctattcttggaatcaatcagatgaaaacatatatgaagcatatgagttagaggactccagtgataatggaagccttagtggaagcagtagttgtgtgagtaaccaagatgacatgggggaggacagcactggcctcaatgagtttgaatctagtgcaaatgtcaattattctttcagcaacttctcgttcaagaatctatcacaacttgcttccatcaactacgatctgctcaccaaaggattgaaggatgatccaccgccaagaacagaaatgtagcagttaatctaaatttggatggactcatttgagtactcagacagtctacaaggtgctcgtgggatgtaggtcttgtacatatcaaagtgtgaggcatggtctgttcctattgaggctgttcctacatctcgcggatccgagtacagttttggtgttgccttgttttcatgactattgccatgccatcatcagtgaaatcacccttgaccaaatttggcattcgacctaggagcgctgtctttttggttcgtctttcctttttttttagtcctattatgagccttgggtttacggagattggtcaaggttactgtattcagaatacagctcctgaagacgtaggcgggtttcagagaattgccattctggcatacagttgactctggttcgttaagctggtagcccgctggacttcctgcggccagaactgtccacaacattttgatggccgtggaatataacattttgcttaatgtgtccagtgtccaacagaatcagggacattttaagaagaatattaaccgattgacattataaggatatcaaatggaagcggcgttttatgcaattcaatattcgatgggcatcgcccagtagtcatattgtgagtatctgtaggctagtcggaatcgtaacggtttgtccgatgtcatgtcgcttgcaaaatgctgtagtagcactacctgctgtttattaaactcagaactcgaactcttttaatagccctcgtagact

SEQ ID NO: 8561 - DNA, 2510 bp, Zea mays
ctgcaggcagctgggattttgtgatgatcaggaacatatttccttcgaagacgcccaaaagtatgttcacctttttgatgcagcactttccagagagcatgttgctgccatggcagcattatttggctgggaattgcctggggaagaccgggctcaaacctgattggagggggtgtaggtcgtgtttcttttgtgtaccctgttataatgcagcctgtttttcttatctggaatgtaaggggcctgaatgacaggtctaggagagacattgttaagtccttggtcctgagcatcaaaccagcggttgtctgtttgcaggaaactaagctaggctctatctcagcctttgacatcctgtctattcttggtgctggttttagtgattttgtttactccccagcgcaaggaaccagaggtggtgttttggtggcttgtagagatggagtctattctgttattgagagtttggtgcatgatttcacagtttcagtcaagttgcaagaggaaggtggtgcccagtggtggttcactggtgtttatgggccacaccacgaccctctcaagctttccttcctccaggagcttagggaggtcagggagacatgcgttggcccttgggtaatagctggagattttaatcagatccacagctcagaagacaagaacaataccaatataaacagggcaatgctgggcagattcaggagacttatccatgacctggagctaaaagaaatcccgttggtaggcaggaaattcacttggtcaaatgagagaaatgtccctacacttgttaaactcgatcatgttttctgtacagccagctgggaggagatccatccggattgtattctccatagcaactcttcagaactctctgaccattgtcccttagctctgcatcttaatgagaatgtcaaagggaagcgaagattccattttgagagtttttggaccaagtttccagattttttggagacggtggctacctcttgggagcagccagttatgatttcttgtcccttggaaagattggctctaaagttgaaaaggcttgcaaaggctttgcagtcgtggagtcataaaaggatcggaaatgttaaatttcagcttagcttggccagggaaattttgcacagacttgagattgctcaagacaatagactgttgtgtggggacgagatatggctgaaaggaaggcttaagcatcactgcctggggcttgcatctctggaaaggacaattgctagacttagatcgcggatcaaatatttgaaagagggagatgccaacacttccttttttcatctacaggcttgctatcggaaaaagcgaaaatttatctctgaattagtgcatggggaccagatcgccacctcgcaagagcaaaagcaggaggtcttgtttgattttttctccaatctgttgggggtagcgaagcagcgtgagttcactctggatttggaggtttgccacagtgctgatgttgaccttggggccttggaccttcccattacagaggaggaggtccgggccactattgctagccttccctcggacaaagccccggggccagacggatatacgggaagattttataaaacttgttggcacataattaaggctgatctgatggcggcagttatcaccctgcaccaaggtaacacacgcaaattgtggatgatgaattctgcgtacctaacacttatccctaagaaagttgatgccaaggcagccggggactacaggccaattagtcttattcacagcttcgccaagttggtatccaaagtcttggctaatcgcttagcaccgcaccttcaaaatttggtggctacaaatcaaagtgcctttgtcaagggtcgttccattcatgataactacatgttggttcagcattctatcaaggcctttcacaggaagaagatcgctggtctgtttctaaagctggatattacaaaagctttcgattcagtgtcctgggcctttctcctagaagttttatcccatcttggcttcgggcctaggtggtgtggtctcgtgtccaacttgttatccacttcttccacacaagtgcttttgaacggagctcctggggattatattcgtcatcggagggggctgcgccaaggcgaccccttatctcctatgcttttcataatcgtgatggatgtgcttagtagcttattcaagcatgctgaggaaagaggattgctgcaggtcgactccaccggacccgcgggttctaggctctcgatttacgcagatgacgtggttctttttgtcaagcctgcagttgatgatcttatttgtgtcaaaatgatcctggattgctttggagaggcctcgggcttagtggtgaatttgcgaaaaagttgtgctatccctctcagttgtgatgatcagactgttcaggacagttgtaacattttgcagtgcaacccggcttcctttccatgcaactatttggggctgcctgtttcggataagaagttagggaggagggacct

SEQ ID NO: 8562 - DNA, 2015 bp, Zea mays
gggtaccctgagccggcccctccaccgccaatggcaggcgccatccgcttacatgacctcactgttacacggctcgagctgcctagctgtggctgtgagccccttctaccttcttggctgtttgctagctagaggccgagaacgaagccagccccgttttctgatccttcgcacagtggcgctgcacgtgcctctctcgatctgtcgccttctcctcttcttcgccgggtccccgctgccggccggggagcacggcgccagatcgaaccacggcctcacatgctcgcgcatatggcgacaatggcagggcgtcttgttgcccggacgtcgtcctcctcggccaagcgccagcggttcagctccgctgttctcctcctcgctctcttccagagctcgtggtgctacgacgacgcggcggcgacgacgacggtggattacggttacaacaacgagcacgaggccgaccgggtggcgttcctccccgggcagccgaggagccctccggtgtcgcagttcgccgggtacgtcaccgtgaacgagcgcaacgggagggcgctcttctactggttcttcgaggcccagacgtcgccggcgcacaagcctctcctactctggctcaatggaggacctggttgctcgtccgttgggtacggagctgcttctgagttggggcctctcagagtcaacagacacggggcagggcttgagttcaacaattttgcgtggaacaaagaggccaacttgctcttcctagagtctcctgctggggttggcttctcctacaccaacacatcatccgacctcaccaaactggatgatgctttcgtagctgaagatgcatacagcttcctagtaaattggctcaaaaggtttccgcagtataggagccacgaattttatatctccggggagagctacgcaggtcactatgtgccacaacttgctgaacttgtctatgacaggaacaagggcaacaccaacacacacatcaaccttaaaggtttcatggtcggtaatccactaactgacgactactacgactcaaaggggctggctgaatatgcttggagccactcagtagtgtcagacgaagtttacgagcgcatcaagaaggtctgcgacttcagggtctcaaactggaccgatgactgcgatacagcgatgagcgccgtgttcagccagtaccaggagatcgacatctacaacatctacgcgcccagatgcaacctccctccgtcgtcagctgcacttgcacttgctgttgacaaggcagtcgtagccaacagacaggaacatttcaggcgaaggatcaggatgttctccggatatgacccgtgctactcttcgaacgcggaaaagtacttcaacgatgcaggtgtgcagacggcattccatgcgaatgccagtggagctcggaaatgggaagtttgcagtgattcaattttgaggtcatacaatttctcggtgctttctgtcttaccaatctactctaagctcatcaaagcaggactgagagtgtggctctacagtggggatgcagatggtagggtcccggtgatcggatcgcggtattgcgtggaagccctgggcctgcctgtcaagacgcagtggcaaccatggtacctgaacaaacaggttgcgggcagatttgtggagtaccatggcatgacgatggtgacgatcagaggagcagggcatttggtgcctctcaacaaacctgcagaagggctcgcactcatcgacacattccttcagggcaaacagcttcccacacacagatgacaagagtacttagggttgtgattgtgatgagggttattgttttcaaaaaaaaaatcaaggattggacaaactatgtgccccacacacacgggctaatcagtaaggatttcatttccagtttctgcataaattgggttggctacaaatagagctgcggtctgaaatacaattttcagcttacataaaaaatattaaatgaataagtatgataaaacctaaaaaaaaaaaaaaaa

SEQ ID NO: 8563 - DNA, 1538 bp, Zea mays
gcccttctcccctcccctcgtgcgttgacaaaaaagaaagtgaagtgaagaatcaaccaacaatggccggcggaatccaccgaccacaatgctgattttgtttgagccatctggactggactggaccctataaaaaacagatcagatctcccccaccctcgcttccccagcctgcaggttgtcgtcgccctcttcctcctccttcgctgttgctgttgctgttgcttccgcttccgccgccgccgccgcggaaatcaaactaatctgatcgagaccacaccgttccagagagatcccccaaacaaaaaaagagcacgggatcgaaatggagctcgacggcaagtacagcaaggaccagagcctcaaatgcgaatgcctcctcttcgacctcgatgacacactatacccgttcaactccggcattgctgccgacataaagaagaacatccaagactatatggtgcacaagctcggcgttgacgaggccataagcttggacctatgcgtcctcctctacaagcagtacggaaccaccatggctggcttgagggctgttgggtaccagtttgattacgatgactaccacagctttgttcatgggaggttgtcttatgacaaaatcaagcctgatcctgtgcttaggaacatcctcctcagcttacccattcgcaaacttgtgttcacaaacggtgacagaacacatgcttcaagggccctcaagaggcttggcattgaggattgtttcgaaggagtcgtgtgctttgagacactgaacccgacatctcctcctcctcctgtcccagctcaggaacttgaaatctttgatctaatgaagcatctggctcatccacagcccgcggtgcagctaccaaaatcacctatcctatgcaaaccgtcaagggaggccatgctgcaggctctcaaggtcgcctccattaatccacagacaactatattgttcgatgacagcttcaggaacattgaagctgcaaagcaaattggaatgtgtactgtcctggttggaacatctgagcggaaaaagggtgctgaccatgccttggaaagcctccacaacatgaaggaagcactgccggagctgtgggaggaagctgagaaggatgaagatgtgaggaattcgagcaaagccggaatcgagacatctgtgatcgcgtaatcttttttgttccttggttacaaatgtagccccttctgttttccttggaggacaacacgaggtggtggtgtatgaaaaaagaggagacctcctcaaggggtgggggggactgactgatactacgaccactgatgttacaccccgtaaactattactatccaataagaatgttttcttcttcaactatctaggatggtcattttgttggtgtttagttaaagcagctatccaatatttttttggatccaaatgtgtatgtcctcgctacttggttcttcatgcttatgaatgtggagtgatgatgtcctgttgccaaaaaaaaaaaaaaaaacttcattatatatgacaacaaatgctttaaatt

SEQ ID NO: 8564 - DNA, 2209 bp, Zea mays
atctatgtatatcccctttgtataaggggtttagtacatatttaccctttatgtaccggtgtatacatatcagcttagtgcctcatattgaataaagtcttactcttaacatatatatccatcttcattaatggagtgcattttctaattctatggttagtaaccactgaatgggtatattatgaaaatatatttcatggggtatctcatgatactaatttcgtgtcatagatactgttgttattttctataaatttagtcaaacttacaaatgtttgacttaagacaactctagaatttgatttatttctgtaactgtgttaaagattatcaactctttggttgtggctgacctgtccttgtacagctgtcttgggccgtttacctggcactactgtgtacaggaatacattgcagtaccctgaggcttatacgtataatgggatagtagtggttcgaattgatgcaccgatctactttgccaacattagctacatcaaagacaggtagattggttggtctgttctcgtcatgtgtaaacacatgaataaattttcatcatttacaaggaaatgttagttctactggtaatcataatcttttgtcaggttgcgtgagtatgagctcaatcttccaagttcaaacaagggacttgatgttggaagggtgtattttgtgatcctcgagatgtcccgtaagactctgattttctaatcgcattgtcagcatcagattgttcccctcggttgtgggcatttcagaaggaaatttatgagcttctcaagggctttctgtatcacttgttaaattgataaaatctttggtcatgcagctgttacatatattgattcgagtgctgttcaagctcttaaagacttgcaccaagaatacaaagcacgccatattcaggtcctttcccatagtcacatttgaaactattgcaccgagaaacttgtacaactgttttcacaagcagcatattctttactgactgcagattgccatagctaacccgaaccggcaagtgtaccttctgttgtcaagatcgggcatcattgacttggtaggagctgggtggtgctttgtgcgagtgcatgacgccgtgcaagtgtgcctacagcacgtgcagaattcatcttcaaatgcgttgaagctacccgtgcaggcatcaggcgtgttgaccgattctgtttcgactcctaaaccagagcagcagcatcaaaagcagcacggcctcttcaaggacctatggaaggcacaggacagtaacgcggatgctggtggtgaggtgcagccactgctccggcaaaaccttgtgtaatactcctacaaaatacggagtacttcctgggatggactcacgccctcgctggcctatacatatacgtgtttatttatttgtctatgttgttgttaacatggtatcgtggtgaacaaaagaaactgaacatgccattgttactgtggtgtggcgttttttgtacacttttgatacctaaatggaactcctatgatttgggtctggaaagggtgtgtgaagatgttttgttccaggttttggagttccgctcccagattggcttgacaagcatgttaattccatgaactctcttccacaaaaccggcacggcccgtggcccgtttgttgtctagaatgagaaaatagccctggcgcatcttatcttactgtagggatggacgtctggcgctcttttgctcgcttgctcaagctgtctcgtttagtgaagaaacatttggattataatttattaccatttctacatacatgtttacaatatcaaaaaatcaactgtgtaatcaatatattcaccacaggtacagaaacaatagcagagggtggcgatagagtaggtgaacttgctagacgcttaacttggccaattcgcaccatgaataagcatttttggtgattttggtttcagacttacaattggatgtattctttcggagacgttcaagagtggatacgtgcatgtctatctgtactgtgacagtcgcaaaaagaaggaactaattaaccctatgctggctgatgtgtatagttatctacctgcactcgatgtgcatgcatgagaagaattgtgagagagacttatcgttttggcgatctttcgtcgtctctgctcaggacttacaaataagccacgatcgataagcatatcccggtgcaacatgtagtagccatgca

SEQ ID NO: 8565 - DNA, 1379 bp, Zea mays
cggacgcgtggggtccaggtctcgctcaccctggccgcgtcgctcgcctacgtctgcctccgcgcgctcctccaccgcgcggggggcctccgccgcctgctccacctcgacagcctccgccgcgactccgaggacgtgcaggcgggctacgccgcgcagctcgcgcgctccttccgcgtcctcgcctgcttcgtgctcccctgcgccctcgccgaggccgcgtacaaggcctactggtaccgcgccgccgcggcctgcgccgtcgaggtcgcctcctgggtgtaccgcgtcgcgctcttcttcatggtctgcgtcctcttccgggtcatctgctacctgcagatcctgcggatggtcgggttcgcgcgcgagttcggcaggttcgccgacgtcgccaccgtgctgcagcaccaccgccggatcagggagcagctcaggaagatcagtcaccggtaccgcaagttcatagtctgcagcctcgtgctcgtctccgccagccagttcgccgcgctactcgccaccaccaggccgcacgccatcgtcaatctcgccaccgcaggcgagctcgcgttgtgctcggtcagccttgtggcgggtctgctgatgtgcctgtacagcgcggcgaagatcacgcacaagacgcaggcgatgacgagcgtggcggcggcgtggcacgcggacgccacggtgcacgccttcgacaacgaccaggagaacccggacccggacctgccgcccaccgcgggctacctggcgcccgccaacgcctaccgcgtggccgccggcgacgagtccggcagcggcggcgacgacgacgacgacagccggagcgagtgctcctcgctcgacgacccaaagtacgtgccgttccaggccaacaacatcagcttccagaagaggcaggcgctggtgacgtacctggagaacaaccgggcggggatcacggtgtacggcttcgtggtggaccgggcgtggctgcacgcgctcttcatgatcgagttctcgctcgtcatgtggctgctcgggaagaccgtcggcatctcctgagctcacgcacacccttctttttgccggctctggctcctgtcaggtgcagagttctcagcggaggattgtacaaagtgagtgcagatacaagatactctgatcatctgatggagatcagaacagctgctttgatttgtaggttcatttgacagctcgtatgttagatatcgcaacttcttagttcgtgtgttttgatttgtgcttgttttttttttcactgcgttgcttcctccggtatgtcggggtttttttttttttttttttgtaactgacgcttcatagacacaagtgatgcacgtgctgtggtgtgctgtgaaatggaatttgcaagg

SEQ ID NO: 8566 - DNA, 3607 bp, Zea mays
  misc_feature (2707)..(2707): n is a, c, g, or t
cactatttatttgttatcgtcagatctttataaaacctaacgagtagatgttcttcctcgtctcgattaatcttgtaatttatatagggtttctatgaattcttttgtattaatataatatatatcgatttagtgttataaatattatttttttataaatttcgtaaacttaaaatagtttgatttagaaatattaaaaaaaaatataccagtgaattcaaacctgatctcagaaacatatgcgcataagggctgtttgagtgtactaggctaaaaatttactagtagaattagttagctacaaatagctagctaactagtaactaatttactaaaaatagctaataactgaaatattagctaggctatttgatgtctctaagactctaactaattttagccactaactattagatctagtatattcaaatatcctctaagtcaccggtagaaaaaaaaacattggcatcaactgccgtggcccgtcatactgctacgctctttccagctttagttactagctaagctgctaagtagaatcgatcccgctgtcactcttccaaatcgacatccgaattccatttctgtaattgacaggcaagtgaaaacatgcagcgacccgtgaacgtgaatgcaagtatctcactcctcaatgaatgcctgcgtcacgtttacaccaggcgaatggctttggacgcattgcaaattctgggaccagccatgtgctgacaggcctctcgtgtgagtttcgcgcgaattgtgtcccaggacagggtggtcacagaataaaatagactgaggtaagtatcaaggtgttgtttgattcacgaaatataacgtaaatatatacttcatccgtttctttttatttgtcgctggatagtataaaattgcactatccagcaataaataaaaagaaacggagggagtataagtttaagttttgattagctagaatagtttctgcaaacaaacaaaacctaaaggaactaacaagagaagttagtaatgggtgaagaagtgaagaatttgaaactcttaacttttttgcttgatttcacagcggcggaattggtccgattctcatagataagatgaaatccgttggcaacagtttgcgtgcgcaaccatgaaacggagagacgcatggttgaggaaagctcctagcgctagccatggccatgctgcccgacataaatggaagttagatcatggaagcattaattaataataagaagaaaatgccacaggcgtacagcgcttgcaaaattgacagctagaaacatttccaaaatcttgagactccagtcagctgcccagctcgtcgatcgcagccagcaacagcaacagccagcaagctaagattcatcatggcttacgaaatctctcggcctccataaatcacccatcacaaacatgctctagcattagcattaccttgcccccgaaacgccagggcggccatcgaaacgcgagagccattcgaggataggtgtaggcagcagcggcaaggaacgcgagggcaacaagaaactgcggctagcgatggcggacacgccgtcgccgtcgccgacggcggccgccggggcggagccggggtccgcgtcgacgccgctgctgcggcggaggggctcgtacacgcggaccgtgtcgcacgcgcgcgacgagctcagcagcttccgctccggcctgcggtggatgtgcgtcgaccactcggacgcctccagccccgccgtgtcctggctcgtcttcgccgcgctcggcgtggccgtccccgccgccgcgcacgcggcggcggcgccgcggcgcgcctacgacacgcaggtgcaggtctcgctcacgctctccgccgcgctggcctacaccaccctctactccctcgtccggcgccacggcctgcgccggctgctctacctcgaccgcctccgccacgactcgcaggacgtccgcgccgggtacatcgtccagctcgcggggtccttccgcctcctcgcctgcttcgtgctcccctgcttcctcgccgacgccgcgtacaaggccttctggtactgcgccaaccgccccttcccgctctggtggtcggccgcggcgtgcgcgctggagatggcgtcgtggatgtaccgcaccgccatgttctgcatggcgtgcgtgctgttccgcaccatatgctacctgcagatcctccgaatgacggggttcgcgcgggacttcggccagtgcgccgacgtcgccgccgtgctgaggcagcaccggcgcatacgcgtccagctccagcggatcagccaccgctaccgaagcttcatactctactctctcatcctcgtcaccgccagccagttcactgcgcttctcgccgccaccagaccccacgcgcgtgtcaacttcgccactgccggcgagctcgcggtgagtgccattaacgatgtgcccctgctgcacatgctgctcagatcgatgttctttcattatcgtcagtcgtcacgtgtacttttgttgcccatgctgatgctatgatgcatacgactgctgctgtagctctgctccatgagcctcgtcacgggactgctcgtctgcctccatagcgcggccaagatcacgcacaagacgcagtcgatcaccagcgtcgccgcggcgtggcacgccgacgccaccatcaacagcctggaccgtgaccaggagaaccccaggacgcccagcaaagcgtgcntgcagcagcaaacgcccacgagtcccttcccgatggcgggcgcgtcgtccggcgaagagtccgacgacgacgagtggcggagcgaggacggcgtggacacctcaaggttcacgcctttccacgccaccaacgtctccttccagaagaggcaggcgctaggtaagcatgcgcacgtgcacgtgctctggatgcgttcagtgttgtgttggtgacacgctgtagctgaccatggcgttttcgcagtgacgtacttggagaacaaccgggcggccatcacggtgttcggtttcgtcgtcgaccggacatggctacacgcgctgtttatgatcgagttctcgctggtaatgtggctgctagggaagacgatcggcatatcttgaggaggagatgcatttacttgtgaatgatacaaccaagaatttatcattctgccctttactgtaaaggtccaagtagattatgtcgttctaaatgtacaaatttgagctcagatagtagtttttttgtttgttgtttgtctgatccccaagaatatcgactctacaaaatttgccttttgacaatctgtttcgtggtaaaaaaaaaaaaaacacacagttcaaaaactaagtttttttctagaatacgaatgtattaatacaagaaagagggagagaaccccgttacaccacacacactgcacacccacactaagtaaaatgcccaccggggcaattgaaaaaatatatacatagtgactgtttaaagataactaagactgatattcacagagtggtttggttctcttctctaggaaaatgacgcctacttgaccagacttagcatgttttggtttgctgactcacttgtcacattttgtctaacttttctgtctaagattagttcttcaatttggacgac

SEQ ID NO: 8567 - DNA, 1251 bp, Zea mays
atctgcgcgcgtctccttcttcagtcgcgcggtcttcttctccccgcacgcaaccgaggtctctccccctggctccctcctctagctccggcgcccggccggatctcccagcgtcgcgcccagctctgcttcctttcccatggcggcctcccttcccctccagctccctcctccagccgagcggttccctggcgcacgcttgcttcctgcgcgtgctcgccggccggagctctctagcgcgctcgcccatgccgcgcgcagccaagctcgccctgcacgtccatctccctgctctagctctgttgccacgcgagctcgccctggctcagatccggcgctcggcgcctgtttctctgcttctctccctgcgcccaaggcttttccagtccgcgccctccttgctgcagctcgccccgcgccccttatgcatgcgcggctgaacgctgtgccgggtactaagcagtgcttcgtgaggcgtcgagcttagctcggtctttgtttctctgcagcgtcgtacacgacaagccgtcgctgctccccaccgcgccgagctgctcacattcctgctcccttcgatcaccgtctgatgaggacatcacttctatacatacaatgaatggaccgataacacgatcgcgtgcacgacagctaaatctctaggtacgttctaccctagtcaattttgttttagagcttacgcttggggccatggatgttttgatgattaggaaccttggaaaggatcagcaaggacttgggaaaggcctaggtgttgaggaggagcagcaagggcgccacaacaggaaggagatcaagtctgactcggctgcgactccatctcggttttcaggaccagtctgcactaaaatcgatgcccaagatgcatccggactccgattgcgacagaattgatatggttggaaagataaggagattatctaaccaacccaactggttccaccataaaattcgtctggaatcaacgggaatcgtcaaaacaagtcagcgttcagaatctgttccggcgttgtgacgtcgtcttttgggcttttgggccatgtatcttcgttgagcccattaggggtgcgtccagggtttgcataaccctagtgtctttattaatagccgccacatccttgttagaggcgggttttgcataagtttagatctgtcaagaacagtcgccgtagatcggtttgtgagaccccaaaaaaaaaaaaaaaactttcatccgtaaaaaaaaaaaaaaaa

SEQ ID NO: 8568 - DNA, 1529 bp, Zea mays
acgagctttgagtgccatggctagtgacgacgacaacagacagtgccacaacctcttcaatatgttcctcatcatcaaggactgccgtatacatacatcattgatggtggtagctgcaacaacttggtgaacattgagttggtcaagaagcttggcttgaccacacgagagcatccccacccttatcacattcaatggtttaacaacaacggtaagttcaaggtaatagaaacaacaagggtgcattttctattggctcttatcatgactttgctgatttcgatgtggtgagtatggatgcttgctctcttttactgggacatccttgggagtttgatactgatgctattcaccatggtagatctagtaaatatactttcatgcataagggaaagaaaattgtgttgcttcctatgactcccactgaaattgtccactttgaacatgagaaaaagactaatgctaagcaaaaaggtgttttgaactctgaaaataagcaacctattaagttaaaaactcctactttgctagccactaaatctgatcttgatgagttacatgcctctgttggactttgctatgccttagtgtgcaaaaatgttttctattccattgatgatacgtctattgctttgccaccggctattgctaaccttttgcaagagtatatggatgtgtttccctctgagataccccctggattaccacctgagttgcctccagattttcgggttagttccacctttaacatttcagatttcaagccatctatgggtgacgaagatgagatcgagtcgaggacgactccaattcaagaggaggaggaggatgaggacatcacttctatacatacaatgaatggaccgatatcacgatctcgtgcacgacagctaaatctccaggtacgttctaccctagccaattgtgtttcagagcttacgcttggggccatggatgttttgatgattaggtaccttggagaggaccagcaaggacttgggaaaggccaaggtgttgaggaggagcagcaagggcggccacaacaggaaggagatcaagtccgactcggctgcgactccatctcgggttccaggaccagtctgcactaaaatggacgcccaggatgcatccggactccgattgcgatggacttgatatggttggaaagataaggagattatctaaccaacccaactggttccaccgtaaaattcatccggagtcaacgggaatcttcgaaacaagtcagtgttcagattctgttttggtgctgcgacaccgtctgttgggccgttgcgccgtgtatcgcgtcgaagcccattaggggcgagtccaggggtcacgcatgccctaatactctatttacagcagctgcagccacattaggttttgggttttgcttagatcaattatgtcatcgaacagtgtcgccgtcatcggtttgtgagaccccatcccataatcaatacaattttggttgtgtttctttccttgttcttgcttgtgttcttgattgcgctgcagggata

SEQ ID NO: 8569 - DNA, 2023 bp, Zea mays
gttcttcactgagattgtgcgtttgcatggtgtgccaaatactattgtttctgatagggatgctaaatttttaagtcatttttggagaactttgtggtttaaattgggaacaaagttgttgttttctactacttgtcatccccaaactgacgggcaaacagaggttgttaatcgcactttatctaccatgttgcgggctattttgaaggataatttgaggttgtgggaggaatgtttgccacatattgagtttgcttataacagatcgattcattccacaaccaagcttagtccatttatggtagtatatggttttaatcctcgtgccccaattgatttgctacctttaccaccttctgaaatagtgaacttggatgctacacaacgttctgaatttattcttaagttacatgaaacaactaagttgcaaattgaaaagatgaatgaaaagtatcgtattgctgctaataaaggtaggaaggaaatgaaattggaacctggtgacttggtgtgggttcatttgagaaaggataggtttcctgatttgagaaagtctaaacttatgccacgagctgcaggtccttataaagttcttgcaaaaattaatgataatgcatatacccttgagttgccgccagattttcgggttagttccacctttaacatttcagatttgaagccatatatgggtgacgaagatgaggccgagtcgaggacgactccaattcaagaggaggaggatgatgaggacatcacttctatatatacaatgaatggaccgataacacgatctcgtgcacgacagctaaatctccaggtacgttctaccctagtcaattgtgtttcagagcttacgcttggggccatggatgttttgatgattaggtaccttggagaggaccagcaaggacttgggaaaggccaaggtgttgaggaggagcagcaagggcgtccacaacaggaaggagatcaagtccgagtcggctgcgactctatctcgggttccaggaccagtctgcactaaaatagacgcccaagatgcatccggactccgattgcgacagactggatatggttggaaagataacgagattatctaaccaacccaactggttccaccctaaaattcatccgtagtcaacgggaatcgtcgaaacaagtcagcgttcagattctgttttggtgctgcgacaccgtctgttgggccgttgggccgtgtatcgcgtcggagcccattaggggcgagtccagggatacgcacgccctaatactctatttattcagcagccgccgccacatttaggtttgggttttgcttagatcaattctgtcatcgaacagtgtcgccgtcatcggcttgtgagaccctcctcccgtaatcaatacaagtttggttgcgtttctttcctgttcttgcttgtgttcttgattgtgcttgcagggataagccttcgtggcgaggtcattcgtgtgtcacgggtgataaccaacggagccgtggtgtagtgattgcgaggaaccgttcgctcggagccttggatcatcaacgtcgagatctccactcaatcaaattatcgtatctcacggaagatcgggccgcgtctactatcaaagcgcctctgagaattcccgaaggtgatgagttcatcttggagtcccctggtgcaccggacactgtccggtggcacaccggacagtccggtgcgccagaccagggtgccttcggttatcccttgctctctttgtttgaacccttttcttggtctttttattggcttagtgtgaacctttggcacctgtataacttataaactagagcaaactagttagtccaattatttgtgttgaggaattcaaccaccaaaatcaattagaaaataggtgtaagcctaattccctttcaatctccccctttttggtgattgatgccaacacaaaccaaagcaagtatagaagtgcataattgaactagtttgcataatgtaagtgcaaaggttacttggaattgagccaatattaatac

SEQ ID NO: 8570 - DNA, 2420 bp, Zea mays
ataaagtccttgcaaaaattaatgataatgcatatacacttgagttgccgccagattttggggttagttccacctttaacatttcagatttgaagccatatatgggtgacgaagatgaggccgagtcgaggacgactccaattcaagaggaggaggatgatgaggacatcacttctatatatacaatgaatggaccgataacacgatctcgtgcacgacagctaaatctccaagtacgttctaccctagtcaattgtgtttcagagcttacgcttggggccatggatgttttgatgattaggtatcttggagaggaccagcaaggacttgggaaagaccaaggtgttgaggaggagcagcaagggcgtccacaacaggaaggagatcaagtccgagtcggctgcgactctatctcgggttccaggactagtctgcactaaaatggacgcccaagatgcatccgaactccgattgcgacggactggatatggtttgaaagataacgagattatctaaccaacccaactggttccaccctaaaattcatcgggagtcaacgggaatcgtcgaaacaagtcagcattcagattctgttttggtgttgcgacaccgtctgttgggccgttgggccgtgtatcgcgtcggagcctattaggggcgagtccagggctacgcacgccctaatactctatttattcagcagccgccgccacatttaggtttgggtttttcttagatcaattctgtcatcgaacagtgtcgccgtcatcggcttgtgagaccccatcccgtaatcaatacaattttggttgcgtttctttcctgttcttgcttgtgttcttgattgcacttgcagggataagccttcgtggcaaggtcattcgtgtgtcacgggtgataaccaacagagccgtggtgtagtgattgcgaggaaccgttcgctcggagccttggatcatcaacgtcgagatctccactcaatcaaattatcgtatctcacggaagatcgggccgcgtctactatcaattggtatcagatttccaggttgcccgtgaggtataattctaccttttagattagttttgttttgtcccatagtccacaaaaatccaaaaaaaattatgatcagtttattccgacctaaaaccatcgccttagcctttgcacaattcagttttagagtccgcagttctgagttcgtgttctagttgagtttggttgctggattagatttgttttggttcagtttgattgtatccatccgcttccatcctacaaaaccgaccctatctacaaaacagatcctatctctacaatcaaccctatccacaaaacaaatcatatctctacaaccgatcctattcacaaaatagatcctatctctacaaccgacaatatccacaaaacatatcctatctctaaaatcgatcatatccacaaaacagatcctatatctaaaccgaccatatccagaaaacaaatcctatctctaagactgaccctgtgctccatagccgtcgcttcagttcctgccgatttgtgcctttgaaaaccataacttgaggtaccttccataaaacgggctcagcttttcgctcggtgctccgtttgagctcaaatttttacagcagattcctgactccattctggggtgacccaaacttgattaggtaccttggagaggaccagcaaggacttgggaaaggccaaggtgttgaggaggagcagcaagggcgtccacaacaggaaggagatcaagtccgagtcggctgcgactctatctcgggttccaggaccagtctgcactaaaatggacgcccaagatgcatccggactccgattgcgacggactggatatggttggaaagataacgagattatctaaccaacccaactggttccaccctaaaattcatccggagtcaacgggaatcgtcgaaacaagtcagcgttcagattctgttttggtgctgcgacaccgtctgttgggctgttgggccgtgtatcgcgtcggagcccattaggggcgagtccagggctacgcacgccctaatactctatttattcagcagccgccgccacatttaggtttgggttttgcttagatcaattctgtcatcgaacagtgtcgccgtcatcggcttgtgagaccccctcccgtaatcaatacaattttggttgcgtttctttccatgttcttgcttgtgttcttgattgcgcttgcagggataagccttcgtggcgaggtcattcgtgtgtcacgggtgataaccatcggagccttggtgtagtgattgcgaggaaccgtttgctcggagccttggatcatcaacgtcgagatctcaactcaatcaaattatcgtatctcacggaagattgggcagtgtctactatcaattggtatcagattttcaggttg

SEQ ID NO: 8571 - DNA, 1967 bp, Zea mays
tggcttcggatagaagcccctgcgcacttcgctagggttctacccctgtaacgcaccgccgccgccgccaagccaccggactgccggtccgcgcccaacgcaccgccgccggaccctctcctcgccgcatctcgtcgtcttcgcaggtacggactactcctccgcgaacttgtccatccccaccgtcttctcctcccactgccgcgtttccttcactgtttcctgtgtcgctatgttgatgaggacatcacttctatacatacaatgaatggaccgataacacgatcgcgtgcacgacagctaaatctccaggtatattctaccctagtcaattgtgttttagagcttacgcttggggccatggatgttttgaggattaggaaccttggagaggaccagcaaggacttggcgaaaggccttaggtgttgaggaggagcagcaagggcgtccacaacaggaaggagatcaagttcgagtcagctgtgactccatctcgggttccaggaccagtctgcactaaaatggacgcccaagatgcatccggactccgattgcgacgggactggatatggttggaaagataacgagattatctaaccaacccaactggttccaccctaaaattcatccggagtcgacgggaatcgtcgaaacaagtcagcgttcagattctgttttggtgctgcgacaccgtctgttgggccgttgggccgtgtatcgcgtcggagcccattaggggcgagtccaggggtcacgcacgccctaatactctatttattcagtagccgccgccacatttaggtttggggttttgcttagatcaattctgtcatcgaacagtgtcgccgtcatcggcttgtgagacccccctcccgtaatcaatacaattttggttgcgtttctttcctgttcttgcttgtgttcttgattgcgcttgcagggataagccttcgtggcgcaggtcattcgtgtgtcacgggtgataaccaacggagccgtggtgtagtgattgcgaggaaccgttcgctcggagccttggatcatcaacgtcgagatctccactcaatcaaattatcgtatctcacggaagatcaggtcgcgtctactatcaaaaggtttccccatcgaccaatttacctaggtgtgataggaactggcctacagtatcataacacccaaaaccacatagagcaatagcagatactgcccaatagtttagggtaagccaggtataaagtaaaccaaactagggtaacctattaggtcccatcaagttaacctgagcatgtcacagtgattaacaggaacattattgggtaaagaagagtgatcaagggcataacttgttagaaatatgccctagagagaatcatagagatgagcatatttctttgtatccatgatatatatatatatatatattgcttaattgaatatccatgaaaggcaccttgtattagttgatgactacatttcacaagtcatggatatggagatgttaaactaataatgtgggtgcatgtatgacatgaggctagaccgacccaacgtgagatattgtaatatagttctctttttgcaacatgtatattgtatccttagacctgagattgtcgcatgttgtcaagatgtgaattggcttacttagggactatcaaatgctactccgtaactaggtagttataaaggtagttttggctttgtcaggaagcatgttgtgaggcatggtcagtcaagatggaatgtgtccctctcttctttagagagatatctctgggcctctcgagtaattggatcaagaaatgtatggtcgtgctagggttaagtgttaaccaatgaaaggattccaattcacagtatcgagaaagagaggtcagcatagagctagaccaaatatcatgagacaaagggaacaacgtgtatgtaatgttgcaatggttcttctaatatgatatttacgtgcgca

SEQ ID NO: 8572 - DNA, 3632 bp, Zea mays
  misc_feature (2060)..(2060): n is a, c, g, or t
  misc_feature (2073)..(2073): n is a, c, g, or t
  misc_feature (2091)..(2091): n is a, c, g, or t
  misc_feature (2123)..(2123): n is a, c, g, or t
  misc_feature (2134)..(2134): n is a, c, g, or t
aacttgtataaaaattagtaagtctacttgttagttctcacttggtcattttaactctaacaattgtcaaagtgttagaataattcaagggtctagaacgcaacaattcttgaagtaattagaagttgaatttactagttgctgttttgggctgcacgtactgtttttgtcgtgttgtaggtttgatgaactaaattatgttttctatagaaaagtcatgtataaaagttgtagataaccttattagcttgcttgtgttaaaatttgacagccataggtctgatagtttaggcgttatgtgtctcacaagtgcaatatcagaatctatccaggttctgtccagattttaaagatttcattgtttgaccaaattaaacacagaatcagctcttagtaattataaataaattgtagtacatttcttaagctttccagcaagtttcggatcactctttgtggtggtctaaatctttagtaatagctgtttgaaataggaggactgaatctgtctaaatctggacagctgcatcttctttgtactgtttgcctttgttaagtattgaaacagcctgcgatgtttataaatgttttgtagaccattttattagctttcaagaaagtcttgaatcgcatgttttagatgtttaaatctcgagttatggccaaaacaagcacgtactgagttgctgtcctaaaactgctagtgtgtagttaattgcttggaattgctttgtttggctaagtagatttaattagttcttgattgatttatacttgtggtcgttacactcaagttagtactgtagtgcgttgccattttgttcacttcacaattgtgtagcatcttatggtcttgcgttagtttttattatgctcatacatatgcatcgtgtatctcatcaggtacactagacatactcgtgaaagacgtgatggtggagacaaacccgaaggcggtgaactgatcaaggggacattctgatgaggacatcacttctatacatacaattaatggaccgataacacgatcgcgtgcacgacagctaaatctccagatacgttctaccctagtcaattgtgttttagagcttacgcttggggccatggatgttttgatgattaggtaccttgaagaggaccagcaaggacttgggaaaggcctaggtgttgaggaggagcagcaagggcagcccacaacaggaaggagatcaagtccgactcggtctgcgactccatctcgggttccaggaccagtctgcactaaaatggacgcccaagatgcatccggactccgattgtgacggacttgatatggttggaaagataacgagattatctaaccaacccaactggttccaccttaaaattcatccggagtcaacgggaatcgtcgaaacaagtcagcgttcagattctgttttggtgctgcgacaccgtctgttgggccgttgggccgtgtatcgcgtcggagcccattaggggcgagtccaggggtcacgcacgccctaatactctatttattcagccgccgccgccacatttaggcttgggttttgcttagatcaattctgtcatcgaacagtatcgccgtcatcggtttgtgagaccccatctcgtaatcaatacaattttggttgcgtttctttcctgttcttgcttgtgttcttgattgcgcttgcagggataagccttcgtggcgaggtcattcgtgtgtcacgggtgataaccaacggagccgtggtgtagtgattgcgaggaaccgttcgctcggagccttggatcatcaacgtcgagatctccactcaatcaagttatcgtatctcacggaagatcgggccacgtctactatcaattggtatcagatttccaggttgcccgtgaggtatattcctatctttagattagttttgtttggtcccatagtccataaaaagccaaaaaaagtacgatcagtttattccgacctaaaaccatcgctttagcctttgcacaattcagttttagagtccgcagttctgagttcgtgttctagttgagtttggttgctggattagatttgnttttggtcagttngagggtgtccacccgctnccatccaataaaacggaccctatccacaaaanagagcggagcnctacaatcgatcatattcacaaaatagatcctatctctacaaccgacaatatccacaaaacatatcctatctctaaaaccgaccatatccacaaaacagatcctatatctaaaccaaccatatccagaaaacaaatcctatctctaaaactgaccctgtgctccatagtcgtcgcttcggatcctgctgatttgtgcctttgaaaaccataacttgagctaccttccataaaacgggcataacttttcgctcggtgctccgtttgagctcaaatttttacagcagattcctgactccattctggggtgacccaaacttggttaggtaccttggagaggaccagcaaggacttgggaaaggccaaggtgttgaggaggagcagcaagggcgtccacaacaggaaggagatcaagtccaagttggctgcgactctatctcgggttccaggaccagtctgtactaaaatggacgcccaaaatgcatccggactccgattgcaacggactagatatggttggaaatataacgagattatctacccggcccccctggttccaccctaaaattcatccggagtcaacaggaatcgtcgaaacaagtcagcgttcagattctgttttggtgctgcgacaccgtctgttgggccgttgggccgtgcatcgcgtcggagcccattaggggcgagtccagggctacgcacgccctaatactctatttattcagccgccgccgccacatttaggtttgggttttgcttagatcaattctgtcatcgaacagtgtcgccgtcatcggcttgtgagaccccctcccgtaatcaatacaattttggttgcgtttctttcctgttcttgcttgtgttcttgattgcgcttgcagggataagccttcgtggcgaggtcattcgtgtgtcacgggtgataaccaacggagccgtggtgtagtgattgcgaggaaccgttcgctcggagccttggatcatcaacgtcgagatctccactcaatcaaattatcgtatctcacggaagatcgggccgcgtctactatcaattggtatcagatttctaggttgcccgtgaggtataattctacctttagattagttttgtttcgtcccatagtccacaaaaagccaaaaaaattacgatcagtttattccgacctaaaaccatcgccttagcctttgcacaattcagttttagagtccgcagttctgagttcgtgttctagttgagtttggttgctggattagatttgttttggttccgtttgattgtgtccatctgcttccatcctacaaaaccgaccctatctacaaaacagatcctatctctacaaccgaccctatccacaaaacagatcctatctctacaaccgatcctatccacaaaacagatcctatctctacaaccgaccctatccacaaaacagatcctatctctaaaaccgaccatatccacaaaacagatcttatatctaaactgaccatatccagaaa

SEQ ID NO: 8573 - DNA, 1051 bp, Zea mays
atgcctatccaggcgcagaacacgccatttgtaaaccaatcctagccgtgcgtcttcaatccaacggaaagttcctccttgtcaatagcaaatcggaggcccaagcgctcccaatctctccgggtccttctctctccgcattctccgtcatggctgagccgacgccgtcgcagtcgccagcgcagacgccgcccccgccgccgacgcagcagactcccgcggcgggtgggctcgaggacatgctggcgtgtgtggcggcgctggaggccgcgctgctgccgtgcctccccgcgcgcgagctccaggccgtcgaccgctccctccagtcctcccaccagattgatgttgagaggcacgcaagggatttcatggaggctgccaagaagctccagtcttatttcatcagcctgcagcgtgaggaaccgccatctgcagaagagatgcttcgaaaggagattacgacaatggaggaagagttgaagagcaagtctgagctcattgccaagcacaagaagttgattgaagggtggcaaaaggaactgaaggagcagctgagcaagcacatcacggagcttgaaagggtgtgaggagtgcgattctgcggtttaccttgtagtgatcatgaacctctaggtgaccaaatgttatgttatgccctataaaactgtgtacatgtgcttagaatctgacgccatggttagcaatcgccttttgttggtttcttaaggttggaagccacgaacaaagcccactttatctatgtttgattgtgtacctttacttaaaaaaaaaaaaaaaaaagcggcccggacgagtctctgccatcataaaacgacatagaatgctattggcttcctgtgtttatgggtaaactttgggtgaactgttggagtcagcctagcgggttatgtgcctactctggatggccgccatgtttgtaagttcctttctatctttactccatttgtgcctggatcagctcgaacagaatcttctcctaacaaatacccagccaagtggcacatacagttgctacgttgaatacacgagc

SEQ ID NO: 8574 - DNA, 1771 bp, Zea mays
ctcacctactcctggattcgatcccatccagcccgtcccgtccctctcccacccttttcagatctgcctgcgagcccccgccacgcacccccatgcccatgcggccatgcccatgaccccccgacgcgaggccactactgccaatggctccctgccgtgaccgagcccatggaggacctcgccccgggggccctcgcactcttcgccgccgtcgctgacttcatagacgactccgctcctgctgccgccggggccgggatgccaccgccggagcccgagtccgcgcccgggagtccctgctccgactgcagcagcgtcgccaccgccgacttcgagggcttcgccgacctcgcctccacgctcgtgctcgacgacctcgtctcccccgcctccgcctccgcctccgccagctcgctccccgcctccgggcccagggccgccaggagcgtcttcgcgctcgactgcgtgccgcgctggggactccactccgtgtgcggccgacggcccgagatggaggacgccgcccgcgtgctcccaaccttcttccacgtcccgctctggatgctcgccggcgacgcgcccgtcgacggcctcgaccgggcatccttccgcctccccgcgcacttcttcgccgtctacgacggccacggcggccttcaggtcgccaactactgccgggacagaatgcacgaggtactggccgaggggctcaccagggcagagcaggccgtgtccgacgctgacttgagtggccttgaccctagtactcacgagcactgggagaaggtctttgtggactgcttcagccgtgttgatgcagaggtgggaggagacgcggcgaccggaaccaagcctgtggctccagacacagtggggtcaacagcggtggttgcgctcgtctgctcatcgcatgtcatcgttgccaactgcggcgactcgagggcggtgctctgccggggcaagcagcccctgccgctgtccgtggaccataaaccaaacagggaagatgagtatgcgaggatcgaggcccaggggggcaaggtcatcaactggaacggataccgagttctcggtgttcttgccatgtcccggtcaattggggacaggtacctgaagccatatataatcccagtccctgaggtcacaattgtcgcccgtgcaaaggatgatgagtgcctaattcttgcaagcgatggcctgtgggatgtaatgtcaaacgaggaggtatgtgatgctgctcgcaagcgcatactgctgtggcacaagaagaacggcgacgtctcagcgtcagcccaaagaagcggtgattcggcagatgaagcagctcaagcagctgctgaatatttgtcgaagctggccctccagaaggggagcaaggacaacattaccgtcattgtagtcgacctcaagtcacatagaaagttcaagagcagaacataaccacggattcggtaagacttggacagtaacaatagacgctagaaaggttgagaaaatgctcctgtttagcctttttttctttttctttcccacaaccatataggctgccacgtttgatcagggtacagattcatacacagatgtaatctggttggagactgggctggctaggtaaggtggtcgattctagggtccaaatcttagaaataacatacatatgtagattccaacaagtagttcactgattgggtttggggcattgtttctgttattaacaggtaaaggtacaatagaaactgccacccctgaactaccaaaaaaaaaaaaaaaa

SEQ ID NO: 8575 - DNA, 3304 bp, Zea mays
cagccattcctctcctccagtcctcctcgcatcactcgactcgactcgactcgctcgctccaccgaccaccgtgcgcccgcgggcggcgcggctttgctccactccactcgcgccggggcggtttccgtcgccgccagggcaccgcccgtgacaccctgatctcccttcacctactcgtggattcgatcccatccagcccgtcccgtccctctcccaccctttccagatctgcctgcgagcccccgccacgcaccctcatgaccaccactaccccccgacgcgcatcacgcgaggggagcgtcactactgctgccgccgccaatggctctctgccctgaccgagcccatggacgacctcaccgtggggggcctcgcgctcttcgccgccgtcgctgacttcatagacgactccgctcccgcgatgccgcagccagcggcggccagcaccgcgcacgagcccgagcccgagcccgggagcccctgctcagtcgccagcgactgcagcagcgtcgccaccgccgacttcgagggatttgccgacctcggctccgcgctcgtgctcgacgacctcgtctcctccgcctccacctccgccagctctgcctccgggcccagggccgccgccgccgctcccgccaggagcgtcttcgcgctcgactgcgtgccgcgctgggggctccagtccgtgtgcggccgccgacccgagatggaggacgccgcccgcgtgctgccaaccttcttccacgtcccgctctggatgctcgccggcgacgcgcccgtcgacggcctcgaccgggcgtccttccgcctccccgcgcacttcttcggcgtctacgacggacacggcggcctccaggttgcgcgcgcgattcgattcaccaccacctgcgtagcactcgattattgctcgagctccctgatcaatgaatcccgctgctgcaggtcgccaactactgccgggagagaatccacgaggtactggcagaggagctcaccaaggcagaggaggccgcgtccgacgctgacctgggtggcctcgaccctaacactcagaagcactgggagaaggcctttgtgggctgcttcagccgtgttgatgcagaggtgggaggagacgcggcgaccgaagccaagcctgtggctccagacaccgtgggctcaacagcggtggttgcgcttgtctgctcatcgcatgtcatcgttgccaactgtggcgactcgcgagcggtgctctgccggggcaagcagcctgtggcgctttccgtggaccataaagtaagccatcatctgttctcggggcaacacttttacttgtttcactcattcattctctttattctgctgggttactagtttgattgtatgatgcattgctcatttgctgttctcgttgtttcagccaaacagggaagatgagtatgcaaggattgaggcccagggtggcaaggtcatcaattggaatggctatcgagtcctcggtgttctcgccatgtcccggtcaattggtacgtgtccctatcctcttcatgtcatgagagcaacgttggtttatgatgccatatacatccacacagtttttcaattcctgaaaaactacagactggttaatcagactacttacagcaacggtacaatatgtagctatcaccacttggaatgttgttggctggtccattctgttcgttgacaaattattattggctatttgatttgttgcagtttcgctttagggatgtatgctttaattttggtagtcaaaaaggttgctagtccgttatggaaacctaatgagttcaactttgattgcgccactggatgaaatggtatggacttgtgttggataacaaacagttgtggtttggaatgtatcgctaactatgcagcgcaggctttaagcctcttccaggcttgtgatggaattatgccattgtgtgcatatcttgacatttgaacgtttcttttcacccacaggagttcacagattcaattaagctatttattacttggacctggactgcttgatcctatgttctataaccatggattccttgcagtcacaggagagcctcagtgtactgttttgatgcctttgtttcagcgttccaatccacttcacttaaagttgactacaaccgatccaaatagacttgtggatgaaaaggttgccatcaaccaactgctcttatgactgcttgtttctcccaacatcagatagaatgatagacaaatgataacgatgatgtaattttgattgattgccaaaagcaggaggtgacattgccggtctatgtgcaggggacagataccctgaagccatatattatcccagtccctgaggtcacaattgtcgcccgtgcaaaagatgatgagtgcctaattattgcaagtgatggcctctgggatgtgatgtcaaacgaggaggtatgtgatgctgctcgcaagcgcatactgctgtggcacaagaagaattcagatgcctcatcgtcagcccaaagaagcggtgattcgccagatgaagcggctcaagcagctgctgagtatttatcgaagctggctctccataaggggagcaaggacaacataaccgtaattgtagtcgacctcaagtcacataggaagatcaagagcagagcataaccgtggattcggtaagacttggacagtagaaatggttgttactacactaggacgctagaaaggtggagaaaaggctcctgttcagtctgctgcacatgtacactggttggcccaacactagtctttttccacaaccatataggctgccacgtttgttcagggactcatacacagatctaatctggttagaaattgggctgacgaggtaaggtaaatctgaaatatatatatatataatatacatatgtagattccaaatagctattactgactgggtttggggcatcgtttctgtttctaacaggtaaaggtacaatagaaaccgccagcattaaactgtacctgtgctacttgtgttttggtatattgatgtctaggagtagcagattagcagtgcaaagaatactacgataccccaagttgtttctgcaacaaatgttatgtgcatgtatatcataaaataagaccatctgtaatatgaattcaattcttggcatccgacgttattaattcagttgattgccaacaggatggttgttttgctgctgagaattacatctcattcggtctgattttgccactcagccacgctgatagctattgaactttgacagtctgacgagatttcggaatccaagctgcatcatccggggggatcctctacag

SEQ ID NO: 8576 - DNA, 3514 bp, Zea mays
  misc_feature (552)..(552): n is a, c, g, or t
  misc_feature (3504)..(3507): n is a, c, g, or t
  misc_feature (3510)..(3513): n is a, c, g, or t
acttcacatgcatgtttctcttcattctatctgtatacatatactattataactatcgagggtatgtttggttggacgtataaggagaaatgaaaggatacgactatattttctatagtgtttggatgagagtcacgtaaggaaaaggtgaacaccggagcaactttttggtggcaatgtggccccaaaaaatcgagagaacggtgtagcccccacctcatctacttttacctcaaaccaaacacaccataaatgtcaatattacaagttatttgggcatgctgaacattcattgcatccccttttctccccttgttgccaaaatttgtcccgataatggggatgtttcttttagcttatgatcagattgtgctcgtcacaattgttgaaaaagatgaaaagaatatgattctgacagctaaacactttacttatcagtctgtttctataagaatatagaatcctcgagtcgttgccaggagaggaattcacggttttctagttcctaaattctataaaacacttcatattttccgcacacaagtcctcacnatatttagattcttatgcagctagttatacacgaattcaaattctatatttaaaaggagtaccaaacaggtccaatgtgtgtaataaaaagaaaaaaaaagattccagtagcagcagtaaagcccattcgtatgtggccctgctccggaccgaaagataaagcccatttgaaatccagctcggcctgctgtcagttcaggagcaggacgagtcgggggcggcgcggcggcaggccgcgaggccggcagcaggctctcgcttcgctctctcgttgtctgtcgagaggaagaagacgaggcgagggacggcagcagtagcagctccagcatcttctagcttcttcattcatgggattcggtctctactaggattaggggtgcttcatttcatccgatccccaacgacttgacctgattctgatctcgacgacgatgcggaagcgggatctgggcatcctgctgctcgccgccttcgccatcttcttctccctccaccacgaaggcgacttctccttccgggagtcctggtaccacctcaccgacgaggacttccccatcaagtacgaggccgaccgcctgcccccgccgctcgtcgccgatctcaacggcgacggcaagcccgaggtcctcctccccacccacgacgccaagatccaggttctccagccgccccacgcccgccacctcaacgatgactccgccttccaggaggcccgtgtcatggccgacatctctctcctccccgacaacgtccgcctcgcctcggggaggcgccccatcgccatggccgtcggcaacgtcgaccgctcctacagacctggcgaggtcaggaagcaggtgctcgtcgtcgtcacctccggatggtcagtcatgtgcttcgaccataacctcaagaagctgtgggagcacaacctccaggacgatttccctcatgccgcccaccaccgcgaggtcgcaatctccataaccaattatactctcaagcatggagatgcaggcctcgtcatcgttggaggaaggatggagatgcagcatcattcagcagatctcttcgatgaatttatgataccagaacacaacatggatgatcgccgtcgaagcgccagtgagaaacagggctctgaggctggcaatgcagacctgcgccattttgccctttatgccttcgctggacgtagtggcgaccgtagatggagccggaagaatgagaacatccagtcacagccatcagatgcttctgtgatgttaccacagcataattacaaactcgacgttcatgccctcaatagtcatcaacctggtcagttcgaatgtcgtgaattcagagaatcaatccttggcatcatgcctcatcattgggataggagagaggatactaccctacaacttgcacattttaggaagcataaaaggaaacaagttaagagaacgcctggaaaggctgttattaatagcgtgaacaagcccattgaacacaatccacctgggaaggatgcttccaatagaatagctagagctcttgggaaggctgcagatatggctaactcaaataaagccaggaaggcacagaggatgcagtatgttccgacaatcactaatcatactcaagtttggtgggttcctaatgttgttgttgtacatgaaaaggaagggatagaggttgtccatctagcttctggacgtacaatatgcaagcttcatttaaatgaaggaggccttcatgcagatattaatggagatggagttctggatcatgtccaggttgttggtggaaatggtattaaagagcagactgtcgtgagtggatcaatggaagtgctgaaaccctgttgggcagtcgctacatccggtgtgccagtgcgggagcaactttttaacgtctctatctgccattacaaccattttaatctgttccatcatggtgacttctcgagaagttttgggaggacatttgatacagctggtttagaggtcgcgactcctatcctggtccagacagacgatgggcataaacacaggagaggaagccatggtgatatcatctttttgacaagccggggagaggtgacatcgtactctcctgggctgctcggccatgatgcggtgtggagatggcaagtatcatcaggggcgacatggtccaaccttccatctccatcgggaatgatggagaacatagtggtgcctaccttgaaggccttctccctacgtgcctatgacccgaaagaggtgatcatcgccggtggtgaccaggaagcggtggtgctctctccttctggtggcatactggccatgatcgagctcccagcgccccccactcacgctcacctcctggaggatttctccggggacggtctcaccgacatgattgtggtaacttccggtggaatatatggattcgtgcagacaaggcagcctggggctcttttcttcagcacgctggtggggtgcctgatagttgtgatcggcgtggtattcgtgtctctgcacctcagttcgtccaatgccgccaaacccagggcttcctcgtctgaatacagatgatgttttgatatgcaaggtcaagagacttttggtactcctatgttctagtagtctatatatttaaccaaatgagaattcgtgttattgtatgataagaattgttcctactagtatatctcatgatatactgatagtgcaatctcgttttttgttgtctaccttggtgttcctagcccccacaaccatttgtacgttggtttttttttaagtttgtttggtcagcaggtcaggcaacaatccagtccatcgaatttgagtacatgatggtcaagattgtttcctggtcgacaagttgcctgcccggctataaacaaaatatgatgtcctagcatgcaaagctcgtcttgtctacagtagaatgtgtaaaatagaagatgcagacaagtttgaaatagaaaatgagatatannnntannnna

SEQ ID NO: 8577 - DNA, 2734 bp, Zea mays
tcttcgaatttgacggatccaccttcctgaaatggcttgggagaagaaagcaatagctaccagaagttaacatgcccctatgtttataatcccagttatgcaaccatggattccatctttagtaggtggaacagcgacaacagtgggaactacagtgtcgatgttgaggctaggttaaccgtcaaagacgaaaatagacatgatcattcgaaactgggggcttccacagggcggagtaatgtgagggcccactggccccccccccccccccgttttagtgctactcatgctgaagacacaaacgatcctctagggatcagatcatactcctctaaggatgttactgatatttgtagccatactgaaatggttcagtgcagcagcaagtcctttcattttaaatcagggaggaggaacataaaatcaagtaaaacaccaagctatgttgatttgactgcgtctaacagagtgagaggttctaataggcacaagaacaatggaaaagatagttcagcagtgtggcagaaagtagaaaggaatgacaagatggtatctaaagcaggccatccgagcgatacacctgttcatgataagggtgcaaatgaagttggtaagaagggtgtacaggaagatccaacaagaattcgggcaaaacataatccgaataagaaagtgtgcaaacagaagccttcaaatggagcagttgaattggagcctgccaaaggagaagatgcattgaactcatgccatacattttctggacctttctacacgaagcaagcaccctttctacgccagcaaagaaactctttttcgaaacaaggttctcagtcattgaaaaactactgtgctcctaggaatggtatccccaaggtggcaaaggattacttgcagcaagaagaattacctatgttggtgctagttcatgccaagaacaccagtgataaatcaagctcatattcaagttcagctgatgaagttggtctaactggagtcagcaacaactatccaactgagggaaatgagagttcacaacctgatattgaggtagcagcgtcagtatcttgcaacttggttccagatttggctccacaagctgcttctgatgatttccacatatcagatcctcactctttacgtcctgaaaacaagggtgcatccaacagtcggagctccaataacttgtgcacagatccttttgctgcagaagcaaaggaagctcgatgtgtgaagctactaacagagaataattcccaagaaccctgtaagtggtattctgctgctggacacttgtcacagaagtgggttcctgttggaaagaaagagacttgcaatgggatctgtttagatgtctcagctaatggtgatgacagcaacttgcctagtgaaaggacttataaactgaacttatctgaacatgctgcagcagataatgcagctgagaccgattacagcaagatgaaagaagtcatcagctatgtttacacagcacagcagcgagtggaagacatccaactttgcattggtaggcctattgctgattttgaaaattttgtttactctgcttctccagttgtgcactgcagctcgtgctctgttggctgtaaatcttgcctgcaagaatgtgtgaaggatggcttatgtttgcatcagactccagatatcactctaagaactgtctggcagtggtacgaagagcctagttgctatggtttggatgtaaaggcacaagatctctggaggtcaaaagccttgtggaatagtcattgtcagtttacaacatattttgtaccatatctatctgctgttcaactcttcagtcaacctaaaagaaccagtggtggaagcattgataaggaatcaatccatagggatgtgacatgtgaaacatctccacagctgaacctgcccccaatatttgcaaagctttttccaaaacaatctgttccagtaaataaaccatctactctgcgtactgaagatgatcaacagtcagcagatggggagctggtatttgaattttttgaatatgaacagccatactcacggcgacaattatttgacaaggtaaatgagctgattgccggtgcgaaaccgtcaaattgccaaatatctggggacccaaagaatctggaggccagcctgcatgatctccatccagcgtcttggtattgtgttgcatggtatcccatataccggatacctgatggaaaattccaggctacattcttgacatatcactctcttggccactggattcgtcggagcagctcagcaggtggggccgctgttttgccagtcatgggcctgcagtcttacaatgccaaggcagagtggtggtttgagatgagcaagtccgaatctgaaggcgggcagtcgcaggccagtgaagcatccgagattctgaaggagagatcgcgcacgctgagtgaggctgcggccgtgttgtccagggccagcgtgctgaagaatgggcagatgagtagaaacagacatccagactacgagttcttcctctcccggagctgatttggaagtgcctcttcgtactcggatttagttaggtttcagtgtatgtatgtgttgttgacactaaagcttattctgcaaccgatgactggaagctgtttgcttagcttagcttagcaatataataataatgctagtcagttctcatccaaaaaaaaaaaaaaaattattgaagtagatcagagatgaaacaggaaggaccacg

SEQ ID NO: 8578 - DNA, 662 bp, Zea mays
cctagacctgattccagccgagagtgacaatctccagtccaaagctctattgcagaccttgaatcttccacaaggggcagtcgtcagtgatggaggcgttcggtgggttcttcgtggacgagaaggcggtgcgagtggagaacatcttccttgagttcctgaagcgattcaaggagtcggatggcgcgggggagccgttctacgaggccgagatggaggctatgcggtcgcgggagtccaccaccatgtacgtagactttgcgcacgtcatgcgcttcaacgacgtcctccagaaggccatctccgaggagtacctcaggtttgaaccatacttatggaatgcatgcaagaggtttgtgttggaacaccgggctggcgagaaccgtgccccaatcatctcagatgatagccccaacaaagatatcaacattgccttctataacatcccgatgcttaaaaaactgagagagcttgggacagccgaaatcggtaagctcacagcagtaatgggtgttgtcacacggacaagtgaagtgcggcctgaactattgcaaggcaccttcaaatgcctcgactgcggcaatgttgtaaagaatgtggagcagcagttcaagtacactgagccaataatatgcgttaatgcaacatgccagaaccgaaca

SEQ ID NO: 8579 - DNA, 1811 bp, Zea mays
  misc_feature (1)..(1): n is a, c, g, or t
naaggattgatggggataatgatgaatcagaaaagatagtgataaatggactgatgaagaaacattgttgctgttggaaggcattgtccggcccggtgacaactgggatgacattgcaggtcatgttggaacaaaatcaaaggcacaatgtatctaccattttattcggttgccagtggaagattgtttgctagagaatgttgagatacccaatgcacccattccatttcgaccacaaagcaatggttatcaatgtttagattccaatggcagcacatcaggagctccagttcaaaatatccaacaaggcaatgagcttccgttcataaattcttctaatccggtcatgtcactggttgcatttttggcctcttcaattggacccagagttgcagcatcatgcgcacatgcagcattatcttttttgactagagacgaggattccagggtgagttcagaaggctcacatgctggtggtctgggcaatggtgcaaatccaaattttcagaaccataatggtgcttcaccatccatttctccaggaaatgttaaatatgctgccatgcttggtctgtcagcagcagcaatgaagtctaagctctttgccgatcaagaagaacgcgaagtgcaaagactaactgctactgtaataaatcatcagttgaagagattggagttgaagctgaagcagtttgcggaagttgagaccttgctcttgaaggaatgtgagcaagtagaaagggttagacacaggatttcagctgaacgcgtcaggatgaggtcagccctattaggtcccaccggaagcggtctaccagggggcagttgtagcactatgccatcaaatccagcaggcatgagccccagaccagtcggtgtgccaggctacatgccacagaccagcatgccagccacatatgccaacaacctgcaggggcatgggaatcctcagatgccgttcttacatcagcggcctcagatgctttcgttcggccctcgcctaccactctcagccatccagactcaaccatcaccacaatcatcaaacatgttcaactctggcatgcccaattcgattgctcctaaccaccatcagttgctgagatcatcctccggaaacaattctagtgcaggataggggaattgtccataagattttttttttctcagcttaggtttgtcaggtgtagcattatgtcatttataaacacatcactgtaattcatttatgtgatgtatgtgtttgtcatataagttttttattaggtcctataaattgtccccatattgctgcgcccttgtgtacctttgttaccaggtcacctcttcccagtgcagggagattcaaatgaacagaatatgttttcatatgtatcccttgagaactcttattgaatatatatgtatgtagttaattcaataaaaaaaaaaaaatgaaggtattttttttttcaaaataaatcaaatgtttaataaactgttaataaaaaatataaaaatttcaatgtagtactctatctcaattataagtcattttaggttaaattagtatgtaaattggatacgagcgtgcaaaaaagatgacccttttaatggagtacgcttgtagatgtcggacgaaatgctcggtggctcgtggttggtttaggtcgtatcggcatgtttgaatatttgtacgagctaagctaacatccaagctcgctttgttaacgctttgttaacgagtcagctcatgagctaaacaagctaccatgttttggcaaaataacactatttgcatatcatttatgtaatgactgataaactacatc

SEQ ID NO: 8580 - DNA, 615 bp, Zea mays
agacaaagcgagcgaatcatcgagttctttggccaagaccttggcagatgctgtacaagttagcagtgctgggcgcgccacaactgtccaggtgagcgctggtgcatctacagatgttgccgccctggtaccagtaccagatgggaacgaggtgtctattgctgaaaccatcacaaagctggtcacgctcatggatttgcccaaggatggttgaggctcctgtgattgggacctgaacgaagatataccacatcggtgggtttctgcttgcagtttttttttctgaacgcaagtgtggctagaatttgcagttttgcttcgtgtaaagtaccgcgtcagtttagcgtgatttgttccagtttttgtaatatttcaattcatgttagtattgatgcgtccgtgcgtcgtcgagatcgtagtattctgtaggaaggaggctactgagtttttgtgcttcctgtaaatatattcatcattctatctctggtgtctgatctatatcatcattgctttgggggtcggtcttattaatataaataaggattatataatcaaaaaaaaaaaaaaaaaaaaaaaaaaaaaaaaaaaaaaaagaaaaaaaaaaaaataagaggg

SEQ ID NO: 8581 - DNA, 1660 bp, Zea mays
  misc_feature (237)..(237): n is a, c, g, or t
aattcggcacgaggcccacgcccccttgctacccgtggccgcgcccaccgggccacaccatcgagaagattcttcccctgccgcgcgtcgctcagccccgatggatcgctggccatgctcggggctcccagtcccaggacggccccaccgatgaggaagccgtacatgcgggagcactcttgcctcatcttcccgcccccgcgcggtcgacgcccgctggcggtcatcaagttcctncggcggcgccttcatcggcgccgtccccgaggtcacctacggctacctgctggagctcctggcgctggagggctttgtggtcgtgtgcgtaccatacaacgtcaccttcgaccacgaggccgccgcgcgggaggtattccagaggttccatgcctgctacgacgcgctgctcgcgtcggggctcccggaggccggcctcagcgccctggacatcgcggagctcccgctctactctgttggccacagcaatggggcactgcttcagctgctagtgggaagctacttctcagaaaggataccagaggctaatgccattgtctcattcaacaataggccggcatcggaggctgtgccttactttgaacagatagggcccctttttaggcaattgatgcctatgatggaggcctcgcctgtttactcggtggccagaaatgcatcaggagatgcatggaaagctctatttgatttagctggaggtcttttacgtgagtatgatcaagaagctacggtatctctgagcaaatttattgatcagttaccatcagtaatgaaccaggttacagaaggtgtgtctgaatttaaaccaacaccacctgaaaaccgtgaattctgcaagaattcctacagtgtacccaatacattattggtcaaattcactgtagatgctattgatgatacagacatagttgaagatgtcctgagaccccgcgttgattcaatcggtggacaaataaagaaggtcatactgtcaggaacacatctaactccatgtatacaggatgtcaaatggcaagttggttcagaatacactccagcagatgccattgcacaaggattgaaatcattggctcttagtgaaacaagagtcctctcaagaactattgctgattggtttacatccctttaaattttgagttattcaatacatccgttgaagtttggagttcttcttacaaaggaatgccttcatcaggtctcaacttcccattttgttgacgcagtccactactgtaatgagatgtaaggatacaatgtattatgtatggcacataagagcagtgcatttttgggctgtgctgagctggtcatgctcacccgcaggccctagccgtactacaaatatctgatcaagattggtggtttggggccttacttggatcgtagttgcaagctataaaaagcatcgaacccaaaagtccaagcagctcgatcctgtttgaggtacggtgccagcaaggttaagttggccaaatctgttgcacgcagacagcccaatgggggtttctgcaggctggcgaaagtaaaggcgtgcgataggaaatctgggaatgttttatattgccacattgtaattccacgttataggcgtatagctcaaatacatttggacggtttggaggtatttcgttggtgtgctggc

SEQ ID NO: 8582 - DNA, 4413 bp, Zea mays
cccttgcgccacgcgccaccggcgagcgggccccacaccccggaccgttccacaccacttgcaccaggcaccaagccctgccccacccagtacgccaatgcctgggaagcaaagcgaagcgcgtgacgagccgcgaattctccacgccgcgtgggcccaccgtacatacggggacacgttgctggcccacagtcactcgcgctcgccgcacgcagcacgccgccggcccaaacggacgcagcccgcttccttcccacgcgctcgtcctcgggccaggtccaatcccagagccttttcccccctttcctcgcggagtgtactcgcgggccccacggtccgccaccccaccccaccccgggccagcgcctgcgcgcgggccccgcccgcgtttctgaccgtttcgcccctgccccggggcctctttttttttttccctcctcggggccccccccgtccccttcctcctcgccgcccgcggcgacctcaccgagaaagagaaatctcgctcgcggtcgcggccaaacggcggggtcgccctcgcctctgcctccgataaatacacgcgctcgctccccctcctccctcgagcccagtcgcgtcgagtcgacgctcactctctctctccacgtccttccctctccacatccagctgcgtatccaccaatcgacagcgacctcctcctccacgcgctccgctccccctccctccctttcccttcccttccctctccctccctccctccttagccgttaagcgtcctcccctccgcaccgcgcggcgaggctcgtcggcgccgtcgaggcccagctgcccctccctacaggaagcgcccgtccgacgccgcgagcacgcgcgcctcctccgctcccgatctctccacgcgtgccggagatcggccgcggcgggctcccgatcccgcccgatctacccccgcgctcccggccgagatgtggggcggcgactccaacgccaagcagatgctcaagtcccggggcggcacgggcgtcgtcggggggttacccgcggccggggacgaggagtcggactacttcccgcccaccccgcgcaaggactactggtggtccacgggcctcctcaagctcgtcaccgccaccgtcatcttcatgggcggcgtcgtgctcggcctctccgtcagcggcagcgtcgcgcgctactactacaacgcctcccacgccgagctcttcttcccggccaccacctacggctgcgacccgcgggaccgggactgcggcatgggcctcgccttcagggccttcgtccacccgccccgcctcgcgcactccatgaccgacgacgagctcttctggcgggcctccctcgtgcctagggccgaggagttcccgttccagcgggtgcccaaggtcgccttcctcttcatggcgcgcggccccatccccttcgcgccgctctgggacaagttcttccgcggacaccaggggctctactccgtctacgtccacaccgtgccggactacaagctcaatgtgtccaagagctccgccttctacggcagacagatccccacgttctaatatttgatttctttcaatgcgaggaggtgtcctgggggatcaattaccttggtggacgctgagaagcgcctgctggccaatgccttgctggatttctcgaatgagcgcttcgtgctgctctcagagagctgcattcccgtgttcaacttcccgacggtctacgagtacctcatcaattcggcgcacagtttcgtcgagtcctacaacatcgacacccctcagtgtgctggccggtacaaccgtcgcatggctccccacatcatggcagatcaatggaggaaagggtcagagtggtttgagcttaaccgcgagctggctgtccagatagtagcggactacaagtactactccatcttcaggaagcactgcaggccatcctgttatccagacgagcattacataccgacttatcttcatctgttccatgggccactcaacgccaacaggactatcacatgggttgattggtcaagaggaggcccgcacccagcaagttatggtgccacagacatcacagaagacttcatccaggccatcaggaataatggtacgcagtgcttttacaactcgaagcccacctctgtctgctacctcttcgcgaggaagttcgctcctaatgctttgccacggctgatgaacctcacctcgaccgtgctggacttctgagccgattctcaccatgcgggcgggcgggcgtcgttgtcagcatctcgctactgaggtatatctatggatgcatgtgccggtcgggaactagagcttctataccctgctagattggagtctgcgacatgtgtctcacaatagatgaatgatcagaggtgggttttggtgtatgcgcctctcgcggatgatgacgcagtgtgggacagtgaaaacagccttttcactcgccctgaagatgatctccgcgagtgatcgacagatggcgccgcctacggagatgacgtttctttcacctcccattcttttttaatatatcatagtcatatgatagaggatgtcttctcttcttcttcttcctcctccctatctatctctactgtattgactcggtcagatactaatttctgtgaatataacttatccatcattgctttaaaaaaaaaaaaaaaaaaaaagatgcctccatatgcttggtagtctgtctctctaaaccttcaagcaacaggttggcatttgttgttctgtcgatgatgctgatgcacaagtatacgggcaaggcaagctagctagggatgcaggcagcagaatatgccatattcttgcagacagtgcacatcatgtacaattgtggctgtcagtcttttccggcaaggggtaaaaagtaggctcctttcttgaaaggcacacatgagcatgcctataccatgctgttgggtttagattcttgatcagttcaaacatgggggatcctgtgttttattcttgcttttttatcagttgaaacagatagccacgaacatgcttgattgccttcatttgacagatgaaccaatattctaagattggctggtgaacatgggggacatgatttaggctggtggagccttgtcatgccctggtgtttgtaatgtataaaacccacgagcaaaggtccctggaccatggtattatagtgggtgggtccctttgtgctctgtatctaatctagccttagtctaatccaggcattagtttatgtgctgctacctgtttgtttacttccacatatatatggttgcagtgcagctagatgccttagggcttgtttgttttgctctcaatccatgtggattgggttagattgagtggatttaaatctcacacaagtcaaaatattttatagtttttttttcaatttcatactattcatattggatagaaataaccgaacaatgccttaggaaaaatctggtgtgttctttcttgtgtgtgtgagagagttctgctgatgctgtagtggtgttttttgattcgtgacgaagagaggtgtggtgtgtctctgagattgggtggaagcgacctgtttgtggtgcttggtgccgtccaagcaaaggcgatttgattctgttgtgacctggcgcgctctggactagaaataagaagtatgggacttgaaagtaatgcgtcctgaactttggatctgtgtgtgtgaattggttggggaaaagaaaggtcttggactagaaacaagaagggatgaaagtgatgcgccatgagttacggatttctgcctctgtgaattggttgagagaaaatgagagagggggtaaatggttcacctttaggcctagtttgagtactctattaatgagtgagattggaatgtgttgagatgtgttgatagagtatttgatctattgaggatttacaccatctctaatcactccaaaacactctaatcccaaagtatcgaaactaggccttagcgtggatttggtaaccagggatcacaggagattgagaggaatttagttcattttcccctcaattctctcctatctcctgtgatcttcttattactaaatcaacccttagcgctggtttggcaacgagagaattggaaaggatcgatagggaggaatcttctcttattctctggtcacgaaattagatcttatcgttcttgcgaatgattttcttgggaaaagaatcccatctttctttttctagccatctaacataaatcaactgtctatgaaaactattttagcagtagtgtaccatagaacatctcgcaaattttacacaaaaataatcgtgaaacatactatttataatatgtgaacatctacaaatctctaatctctatctctaatatattaaatcaccactttctatggttctaaggttccaccgtcgttgttttcctcacat

SEQ ID NO: 8583 - DNA, 2192 bp, Zea mays
aattcggcacgaggagaaatctcgctcgcggtcgcggccaaacggcggggtcgccctcgcctctgcctccgataaatacacgcgctccctccccctcctcccccgagcccagtcgcgtcgagtcgacgctcactctctctctctccacgtccttccctctccacatccagctgcgtatccaccaatcgacagcgacctcctcctccacgcgctccgctccccctccccccctttcccttcccttccctcgccctccctccttagccgctaagcgtcctcccctccgcaccgcgcggcgaggctcgtcggcgccgtcgaggcccagctgcctctcccaacaagaggcgcccgtccgacgccgcgagcacgcgcgcctcctccgctcccgatctctccgcgcgggccggagatcggccgcggcgggctcccgatcccgcccgatctacccccgcccgcccgcgccgcggcgctcccggccgagatgtggggcggcgactccaacgccaagcagatgctcaagtcccggggcggcacgggcgtcgtcggggggttacccgcggccggggacgaggagtcggactacttcccgcccaccccgcgcaaggactactggtggtccacgggcctcctcaagctcgtcaccgccaccgtcctcgtcgccggccgcgtcgtgctcggcctctccgtcagcggcagcgtcgcgcgctactactacaacgcctcccacgccgagctcttcttcccggccaccacctacggctgcgacccgcgggaccgggactgcggcatgggcctcgccttcagggccttcgtccacccgccccgcctcgcgcactccatgaccgacgacgagctcttctggcgggcctccctcgtgcctagggccgaggagttcccgttccagcgggtgcccaaggtcgccttcctcttcatggcgcgcggccccatccccttcgcgccgctctgggacaagttcttccgcggacaccaggggctctactccgtctacgtccacaccgtgccggactacaagctcaatgtgtccaagagctccgccttctacggcagacagatccccagcgaggaggtgtcctggggatcaattaccttggtggatgctgagaagcgcctgctggccaatgccttgctggatttctcgaatgagcgcttcgtgctgctctcagagagctgcattcccgtgttcaacttcccgacggtctacgagtacctcatcaattcggcgcacagtttcgtcgagtcctacaacatcgacacccctcagtgtgctggccggtacaaccgtcgcatggctccccacatcatggcagatcaatggaggaaagggtcagagtggtttgagcttaaccgcgagctggctgtccagatagtagcggactacaagtactactccatcttcaggaagcactgcaggccatcctgttatccagacgagcattacataccgacttatcttcatctgttccatgggccactcaacgccaacaggactatcacatgggttgattggtcaagaggaggcccgcacccagcaagttatggtgccacagacatcacagaagacttcatccaggccatcaggaataatggtacgcagtgcttttacaactcgaagcccacctctgtctgctacctcttcgcgaggaagtttgctcctaatgctttgccacggctgatgaacctcacctcgaccgtgctggacttctgagccggttctcaccatgcgggcgggcgggcatcgttgtcagcatctcgctactgaggtatatctatggatgcatgtgccggtcgggagctagaacttctataccctgctagattggagtctgcgacatgtgtctcacagaatgatcagaggtgggttttggtgtatgcgtctctcgcggatgatgacgctgtgtgggacagtgaaaacagccttttcactcgccctgaagctgatctccgcgagtgatcgacagatggcgccgcctacggagatgacgtttctttcacctcccattcttttttaatatatcatagtcatatgatagaggatgtcttcttctcttcttctccctatctatctactgtattgactcagtcagatactaatttctgtgaatataacttatccatcattgcttttcttccaaaaaaaaaaaaaaaaaaaaaaaaaaaaaggattttaaaaa

SEQ ID NO: 8584 - DNA, 3369 bp, Zea mays
tgtgcggttatggtagatttaactctgctctccggtacaggctgctgatcgcaatccgtctcgtagcgctggggttcttcctgacatggcgtattcggcacccgaacccagaggcggtgtggttgtgggcgctttcggtgacgtgcgaggtctggttcgccttctcctggcttctcgacagcctccccaagctctgccccatccaccgggccgccgacctggatgtccttgccgagcgcttcgagctgcccaccgcccgcaatcccaagggccactccgacctgcccggcatcgacgtcttcgtctccaccgccgacccggagaaggagccgccgctcgtcacagccaacaccatcctctccatcctcgcggccgactacccggtcgagaagctcgcctgctacctctccgacgacggccgcgcgctgctcaccttcgaagcgctcgccgggacagcaagcttcgctcgcacctgggtgccgttctgccgcaagcacggcgttgagccgcgctgcccggaggcctacttcggccagaagagggacttcctcaggaacaaggtgcgtgtggatttcgtccgggagcggcggaaggtgaagccggagtacgacgagttcaaggtcagggtgaactcgctgcccgaggccatccgccggcgctccgacgcctacaacgccggcgaggagctgcgcgccaggagaaggcagcaggaggaggccatggcggccggcaccattcttggagcgttgcctgaggcagcaggggccgtgaaggcgacatggatgtccgacggctcgcagtggcctggcacttggctcacctctgcaccagaccactcccgtggtgatcacgctggcatcattcaggtgattgattgctcgatcagtcgattgatggaaagatttatcaattgcactgttctttagttgttgatttgagatgctgatgtctcgtgtgcctgaaatcgcaggcaatgcttgcgcctccgacatcagagcccgtgctgggcgcggagccggcggagtccggcgggctgatcgacacaacgggcgtggacatccggctgccgatgctggtgtacgtgtcccgcgagaagcgcccggggtacgaccacaacaagaaggccggcgccatgaacgcgctggtgcgcacgagcgccatcatgtccaacgggcccttcatcctcaacctcgactgcgaccactacgtgcacaactcggcggcgctccgtgaggggatgtgcttcatgctcgatcgcggcggcgaccgcgtctgctatgtccagttcccgcagcggttcgagggcatcgaccccaacgaccggtacgccaaccacaacctcgtcttcttcgacgtcgccatgcgcgccatggacgggctgcagggacctatgtacgtcggcaccggctgcgtcttccgccgcaccgcgctgtacgggttcagcccgccgcgcgccacggagcaccacggctggctcgggaggaggaagatcaagctgttgctgaggaagcccaccatgggaaagaagacggacagggagaacaacagcgataaggagatgatgctgccgccgatcgaggacgacgccttccagcagctcgacgacatcgagtcgtccgcgctgctcccgcgacggttcggcagctcggcaacgttcgtggcgtccatccccgtggcagagtaccaggggcggctcctgcaggacacgcccggcgcgcaccagggccgccccgccggcgccctggccgtgcctcgcgagccgcttgacgcggacaccgtcgcggaggccatcagcgtcatctcgtgcttctacgaggacaagacggagtgggggcggcgcatcgggtggatctacgggtcggtgacggaggacgtggtgacggggtaccggatgcacaaccgcgggtggcggtccgtgtactgcgtgacgcggcgcgacgcgttccgcggcacggcgcccatcaacctcaccgaccggctgcaccaggtgctccggtgggcgacggggtccgtggagatcttcttctcccgcaacaacgccctgttcgcgtccccgcggatgaagttcctccagcgcgtggcctacttcaacgtgggcatgtacccgttcacctccatcttcctcctcgtctactgcgtgctcccggccgtctccctcttctccggcaagttcatcgtgcagtcgctcaacgccaccttcctggcgctgctgctcgtcatcaccatcacgctctgcctgctggccctgctggagatcaagtggtccgggatcacgctgcacgagtggtggcgcaacgagcagttctgggtgatcggcgggactagcgcgcacccggcggccgtgctgcagggcctcctcaaggtgatcgccggcgtggacatctccttcacgctgacgtcgaagcccggcaccggcgacgacggcgaggaggacgcgttcgcggagctgtacgaggtgcggtggagcttcttgatggtgccgcccgtgacgatcatgatggtgaacgcggtggcggtagccgtggcgtcggcacgcacgctgtacagcgagttcccgcagtggagcaagctgcttggcggcgccttcttcagcttctgggtgctctgccacctctacccgttcgccaagggcctcctgggccgccgcggccgtgtgccgaccatcgtgttcgtctggtcggggctcatctccatgaccatctcgctgctgtgggtctacatcagccctcctgcgggtgccagggagctcatcggtggtggcggattcagcttcccgtagtagcgagatggataccagcggtaatgttgttatgttagcatgtgttgtctgaactgtatccgaagagaacctacatgaaggtgttcttgcttcatggggtgctgttccttaatagctgtgatggactgtgattcttcagtacctgacgagctactgtcattgtatcaaaattgcaacttgcttaagttgtttatgttttttctaactgtatcgtcacccatacaagtacacatcaggagggattggatgtcaaaattctggtttaggagccgtcagatttgaccaaaatgaagcacaagacataattttcaagtccttgatggtgcttaagtaattcaaattctgcttaagtagtatttgaattctctattccgcgtatttagtatccgaaccatatccgatttattcgtatccgacgcaactcgataattcgtatccgatgtgaatccgaagagtggaaacaaatatcgtaccagtgacaatgatctatttcaaaaccgtgacaatatttcaaactaatttgcctactctgatgctagtcaattccaacagcaaagggactgaataaagtcggaggatgaaaggcacac

SEQ ID NO: 8585 - DNA, 3790 bp, Zea mays
aagtgtcgccgaggcgagcgcccaacgcccacgcgccgtccagatgcaagaacgtgcgacgttttattttgggcaacagacgaatatttgattagtacctggaactgtatgtctgtatctgagcaggaatagtgaacaatctcaaatactttaaagtattttagttatctattttgaaaatgtgcttcgagaaatatactatcggaattcctcaaaagttcaatgtaatactcctccgttctacaatagtattcattttaacacttaatttttatatttatattcaattaaattatgataattttagacatatatatataaaacatagacataaactattgtatgaatctattaattatataaaacgaattttaatttagagtgagtataaagttatgatcgatctttgctatatataatgtattaaacatctcacaggtaactctttatgcatgtgttatagatctggctttagtaggagacgctgcagacctagtatttcagccaaggatataccacaatattttttacactattcattctaactcatgtataatttgctatttcactagttggttgtgctataaatagatctatatatacataggctagattatatgagtgtgtcatgactcacttggcatactccatccaccactgtcttttttaatgacaatatgttactagagacagaaaaaaaaactagtgcaacatggtttgcaaccaggatgtttgtaccccttataaaaaagaggacatgtcccacccacatattcacctgataatgttttagttgttgttctttttttgtgaggggcgtaaacacactgttttgcatcgaggatgcaccaattttttccctcgagacatgccgcaggagggggcgatgatatgtggatgtggttgttgtctctccgttttcagaacacgtctcgtttgcacgagggtgaagctgccacggccgtcgtcgatcctcctcatttcggcactgggccccactcgtcactcaccctttcaggcctccacggcacctcccgacagggactcccctcctactcctgctctcccagcctgcctttacttctcccgaatgctcgaggcctgcaaagctccagcacatccaatcgcacgacactccctgctgctctctgctgagaggtgctagatctcggactcgccgttgatttgattccaagttaaagacagcgagcaatccatagattgaccggtggagagcgagagaaagcgagagagagaagggaattggttggtaggtggagaccggagggagagctcagctcaggagattgatgcttgcatggtgatgcgggcgcgggcgatggggctgagcagcatccggcgggaggtgctggtctccgccgtcttcacggcgctcctcgtggcctccatcctcctcctcccctcgctcctcctaacgggcgctgggcccatcaggtggccgtccctgtccccgtcgaaggatgccggcatcggcgaggaggaggagcagcaggcgcggtaccccgtgacgttcgcgtacctgatctcggcgtcgacgggggacgcgtcccgcgccgcgcggctgctggcggcgctgtaccacccgggcaacagctacctgctgcacctggaccgggaggcccccgcggaggagcaccggcgtctggcggagctggtgtccgggcgcggcgtgtacgcgcgcgcgggcaacgtgtggatcgtgggcaggcccaacctggtaacctaccgtggccccaccatgctgaccaccacgctgcacgccgtcgccgtgctgctccgcctccgccgccgctgggactggttcatcaacctcagcgcctccgactacccgctcgtcacccaggacggtaccctgtgatgcttgcttgcttgcttgctgttggtcgtccactggatggacagactgtttctgaattttgggggttgcagatttgatggaggcgttcgccgggctgcccagggacctcaacttcatccagcacacgagccacctgggctggaagatgtaagaactctctgtcctgccacctgagtttgagtctgagtctgaattcaatagtccaaattcaacagtagagctcgatctgtagaaagaagcgggcgcggccggtgatcctggacacggcgctgtacgaggacgggagggcggagctgatccgcccggtgaacatctccaccaacctcaggaggctgcccacggcattcaagctcttcacaggtactccgtccattttgctgtaaacctttgaaaacccaaggcaatgccccgcacacaccgaacgagtccgaaaacgtgccttgtggtacaacgcaacggaagcatgcttgtgagcaaccgattaggacagcatggcctcgtcaatcggttgttgatcggactaggggagtgtacggtgccgtactactccccgcggcgcctggctgtgctatggtgtgtcctgtcacacagtcgatgccgtgccagtggttgccctcagactttggccgtccttcgattccgatcgagtgacgggtgtgggcgtgagccgacagccgagcccgtgatggacgaattccggtccggtccggcccagaaagaataatcttatctggaatggcgtctagtcaatggagcaggggagggtagcgccgttcacgtacggatcgaccttcactgcaattgattattcccccagatctgtgatccaggcttgtttatgctttggaggctcgccaatccaggcagagaccattgcggttggcaatggcaaagcaaaacacgcacgcatccgcccacccatcctgtcgcgggcgatgacgacgctgtcgcgtgcagggtcggcgtggacgatgctgtcgcgggcgttcgcggagtacgtgacgatggggtgggacgacaacctgccgcggacgctgctgctgtaccacgccaacatcgtctcctcgcccgagttctacttccagacggtggcctgcaactcgcgccggttccgcaacgccacggtcaaccacgacctgcacttcatccgctgggacaccccgcccaagcagcacccgctctacctcaccgccagggactaccgccggatgctgctcagcggggccgccttcgcgcgcaagttcagggacggcgaccccgtgctggaccgcatcgacagggacatcctccgccgccgggaccccgccgcccacttcgcctacggcggctggtgctccgaggccggcgaccaaaacggcggcgccgcgctctgctccaacccgcaggagcccgggaggcgcggggccgtcaagcccggcgccgggtccaggcggctcaaggccatgctcaggaagacgctgtcgccgaggaatttcaggaggcagcagtgtaggtaggggaactgttctgttatgttctgatcaaacaaacaggtcgttgactcaattttgtatgtatagaaaaggcagatctgaaacgcatcaaagcggcccaaagccaattttgttcagttgattcgcacaagtctgaattgaattgtagtagggagatactcctggtggttgatcatctcatacacggaataataatggaaggggcattatgcaaactgtttagttatatggtactaaactgtttagtaatacatagatgctcgtcaatttgttggtgacaaacagcaaagccaatgaggaaaacatttgatttatcacaggaaatagcgaaacgaatagtgcgacctttcaatcgagtccaacattgtcaccatatggagatgaaaaaaaaaatcatttccaagttgttcgtttaccg

SEQ ID NO: 8586 - DNA, 2343 bp, Zea mays
  misc_feature (779)..(779): n is a, c, g, or t
cttttctaatgaaaatggttaaactataatgtttttgaacttatggatttgaggtgttattcgacaacggcttcgttagagtaagagaaactgtaccaaatggttgaagaggaaaaagttttttatatagagagatgacgagccgaagctatttttaacgtagggagaacgaagatattggcccaattccaaaggtcgaccgttgggcacgcccccgaaatcaaatcacatcgcgcacgaaatctgctctccacttccgctttcgaccgttgcatagtctccctccacaaaaacccaaatgctcctccccagcggccagcgcccgggtaacgcaccagtaccactagtccaccacagtctacaccagcgattggcgcggtgaagcagaagcagtagcggacctagcggtacaggtttacagcagccacccccaccccttcgaggacggaaggcgcgaccgcgagatggtgtccaggacgcccacaaagccgcggccgtcgcccaagaccggtaccggcaccggcatcggcagcgtcaccccgccgaagtcgtccccgacgctggtggcccgtcgctgccttgctctccgccgccgtgtttcccccgccaccgccaagcgccgcgggagcccgctcaagtcgctcgcgtctgcgcccacggccgtcgccgcctccttcgaccgctccatccgctcctgccgccgccgcctcctcaagctcttcgcccgcctcgccgtccttggcagctcgcgcaagcgccgcgctgcctccgcggggttncagcgcctccgctcctcctcggctcctccgcctccgcctccgcctctgcctctgccttcgcagaaccccgcggtccgcgcgcagtccgcggcgctgccgccgccgccgtcgccagggaggcggacgctgttcctggacctcgacgagacgctcatccactcccagacggagccgccgccctcgcggttcgacttcaccgtgcgccccgtcataggtggccatgcggtcaccttctacgtcgtcaagcgcccgggtgtcgaggcgttcctccgcgcggcggcggatgccttcgaggtcgtcgtcttcaccgccgggctgcaggagtacgcctccctcgtgctcgaccgcctggatccagacggggaggtgttcgcgcaccgcctctaccgcggcgcctgccgcgacgccggtgacgggacgctcgtcaaggatctggccgccaccggtcgggcgctggaccgcgctgtcatcatcgacgacaatcccaatgcctacgccctgcagccggagaacgccgtcccggtggcgccgttcgtggatgatgacaacgaccaggaactgcagaggatgacggcgttcttggacgtcgctgcggggtacgaagacacccgggacgccatcagatgctacaaggatctcgtcacggcaacctgagccgctatcccttcttaagccagtttcaggtttaatgttagcacatttttctcagattggtctactggttagtgggaaagagaaacattgctgcggaacaggacgtgtggtaaagctttgattttttcaggatcttcctgaacttcaatgcgagtattatgagaccaaattgaattgttacagtagaatgttcaaatctccggttacaagactccttttcattttggatatataatcaatgaattctaccgctttgtgaagcacttttagggagtcagattaaaggtgaacatgagattgcgatgagcatccaagtttcaaaaactttcctgaatttactatgctgctaaaatcaaatcgaaattgccgtatgtgcagatgcttcgaaattatgacatttagttgcccgtacattactatggttaaatgaatatcatgtaggtaaaggtaggctttggttaaatgtaggtaaaggtaggctatgtcatttagttgcccgtacattactatggtctatatatttaaaatatcgctcattggtataacataaaaagctgcacggtgtaatgtagtggtagagaacgaactttggcttctgaaagtcgcttatcccattccgtgtccatcatgggaacaaacaacatttaaggaacaaggattagaacatcttcaagagtcgcaaaatacacttcatgaccagtatttttttaagattgataaaaaatacaatgattctataaggtgcaaacaacaattgttttatttaattgcaatgaccaagattcaaactccagaccttcagatctgatattatattaagttgcatgtacccaccagttaaatcaaaagtttctaccaatagaacaattggattaagtgggcgcccaactcaagccgcgactacatgctc

SEQ ID NO: 8587 - DNA, 578 bp, Zea mays
cggacgcgtgggtaaaacgttaaaagtgcaggcccaagtttcagaagttaaaaatatcatgttaaacaacatagaaaagactttggaccgcggagaaaagttgagtgaactccaagacaagacttctgatctacatagtcaggcccaggagttcaagaaacagggggtgaagattcgtcggaagacatggctgcagaacgtgaaaattaagctggtgattcttggaatccttttgctccttgtgatcatagtctgggtatctgtttgtcaaggctttgactgcaccaagcatgaaacatagtagtaataagaatggtgcagcacgactgtggcagagctgcgatggatgtgagtttgtgctggtgaggtcaagtgtgtacccacatatgctttggctctcaagttcgattccaccagacaagtatcacggtacaaatgtaagtccgagctggtctttgttgcacgccggaggtaggtgtacttgcaatgcaagactagcatgatataaagtgatagcatggttccttctgtactagctgaattcgctagaatctagcataaaatgcatttcaattacc

SEQ ID NO: 8588 - DNA, 1487 bp, Zea mays
cattgggtacctccgagccggccgggcatcgggaccctcggggagagacagagagagagagactgccaacgaggcgaagcagccggccaatctagcatcagcgcgcggggtctgagagcagagcggcagggcgccatggcggcatcggtggcgctgagcagcgggcaccggatgccggcggtggggctgggcgtgtggcggatggagaaggcggacatccgcggcctcatccacacagcgctccgcgtcggctaccgccacctggactgcgccgctgactaccagaacgaagctgaagttggtgacgcgctcgcagaggcattccagaccggactcgtcaagcgggaggacctgttcatcacaaccaagctgtggaactcagaccatgggcatgtgcttgaagcctgcaaggacagcctgaagaagctgcagctagactatctcgacctctacctcatccatttcccagtagccactcggcacaccggagtcggcacgacttctagcgctctgggtgacgatggcgtgctggacatcgacaccactatctccctggaaacgacatggcacgcgatggaagagcttgtttccatggggctggtgcgcagcattggaatcagcaactacgacatcttcctcaccagagactgcctggcctacgccaagataaagccggcggtgaaccagatcgagacgcacccctacttccagcgcgactcacttgtcaagttctgccagaagcacgggatctgcgtgaccgcgcacaccccgctgggtggctccaccgccaacgccgagtggttcgggacggtctcgtgcctggacgaccctgtcatcaagagcttggctgataagtacggcaagacgccggcgcagctcgtcctccgctggggtctgcagcgggacacggtggtgatccccaagacctccaaggtggagaggctgcaggagaactttgacgtcttcggtttcgacatctccggcgaggacatggagaggatgaaggccatcgaccggaagtaccggactaaccagcctgccaagttctggggcatcgacctctatgcttagcttttagttcggttgcgttgcgtcgcgtactcgcgtgctgcgtctctcggcccccccagacaagacagcatcaataatgaggataccctcagacggcatcagtcaaagtcatgaggatctcagacagcatcttccatcacatgtgacggtgtgaggttgatggtagggtttggtatccccacgtgtccctctctctttcagctcagctaatcatcaccatgtagactacgcagtgtttgcctccgattatttactgtttttcttccttacaaaaaaaaaaaaaaaaaaaaaaaaaaggcccctaatttgccgaccatttttttttgcaacgcgcgccttctgcacggttttttattaagaaaaagcaaaatctgaggcggtatataagtctaaaaaaaaaaaaaaaaaaaaaaaaa

SEQ ID NO: 8589 - DNA, 2150 bp, Zea mays
  misc_feature (48)..(48): n is a, c, g, or t
tttcccccccccccctttttaaaaccccccccccttaattttattttnttcccacaaaaaaaaaatttattttttcaaaccccccttcttaaaaatttaacccttaaaaaccccccccccttttttttttttttttttttttttttttttttttttttttttttttttttttttttttttttttttttttttttttttttttttttttttttttttttttttttttttttttttttttttttttttttttttgctactctgattaagcagatgcattacttattgctccataacaaggaacaactgtcgctatgcaaccgactacaagattccagcccagcactttactgaaataaagtttgaaaatacactgtatattggacactgccatcaccatcctcactgtcgttacaaccagcagcatcggctaattcttcctggatttcagttctacaatccgttcctctgtagccttcagagcatcgccgaatttgcttatgatttcttcgacttcattgggagtcatgatcagcgggggtgacagcatgatgctgtccccagccaccctgatgagcatcccacgcttctcgcactccgcgccaaatatcgaaccaacaccccattcagctggaaatggatcatttggagatttgttgtcgacaaattcagttccaagtatcagtcccagaccgcgtatctccccaacaattgggctgcctgagaaggccttgattccctcctggaaccttggagcaattttgttaacgtgttctacaatattcctttccttatatatcttcaaggtttctacagcaacggcacaagaaacaggatgtcccgagtatgtaaagccatgagcaaaagaaccaagtttattgctctgagaatagattacatccgttatttctgggctaacgagaattgctccaattggcatatatgcagaagaaagagccttggctatggaaacaagatctggtttaatattatacatatcacatccaaacattgtccctagtcttccaaatgcagtaatgacctcatccgcaattaacaagatgtcatacttcttcagaactgcctgaatcttctcaaaataggtctttggaggaaggataacaccaccagcgcccatcacaggttcagcaatgaaagcagcaattgtttcaggtccttctttgaggacaagattctccaaattattggcaagtctagttgaaaactcttcttctgtctcatcaggaagacggaatcgccagtagtgagggcagtctgtgtgcaggacaaaaggtgctggtagatcaaacttctgatgaagcgctggcagacctgatagactagctgcaatcaaggttgatccatggtacgattttgagcgagcaataaatttcttcttgtctggccttcccagtgcattattataataccacactagtttaacctgggagtcatttgcttctgaaccactatttgtgaagaacacctttcccatttcccttgcggtgaacatgctgagaatatcatttgcgagatccaatgagggtttggttgtacggttccaaaaggaatggtagaacggtaatttgtttaattgctcagttgccgctttgactagtcgaggctcattaccacctaaagctgtgcaccacagtcctgcaagagcatcaatatacttcttcccattgctgtcatagacataagaaccctctgatctctctataaccaatgggtgtacatcagtgctctgccatcccgctgtgaatggagccagcatgctgtgccccttaaacccattttcttctgtcgcctgaagtgaaggttcagagctgtaatgtctggcagacggctctgataaactgtgccccccttgcaagcttccagcactagcaatgtatttcaccagcttgctaacctgggaggaggcagcactggatttgcggaggccgtttgcgatcatctcgtatcgcctgggttccggttccgccgacctcctcacttcacttcacgggttcttggaagttggaactggggaggaaccgaggaagcaacacgcgagagggacaagctctgggtggtgccggacgacggggacgtgacggaatctttatcccgtccataactgtcgccgccgaaattgcgggcgccaatgg

SEQ ID NO: 8590 - DNA, 734 bp, Zea mays
gagtgtggctagtgttatccacactattagttttcattgagctagcttcatggggcaaacaactgttcattaagtcaataattgacatgtacgtatttatgtaaaagtcggaactcttgtttccatgataaaaaaggtacagtggcagtggccctcgaccagggaacattgtctccacaaagccaaaggtatgctactctgattaagcagatgcattccttattgctccataacaagaaacaactgtcgctatgcaaccgactacaaggttccagcccagcactttactgaaataaagtttgaaaatatactgctgccatcaccatcctcaccgtcgttacaaccagcagcatcggctaattcttcctggatttcagttctccaatccgttcctccgtggccttcagagcatcgccgaatttgcttatgatttcttcgacttcattgggagtcatgatcagcgggggtgacagcatgatgctgtccccagccaccctgatgagcatcccacgcttctcgcactccgcgccaaatatcgaaccaacaccccattcagctggaaatggatcatttggagatttgttgtcgacaaattcagttccaagtatcagtcccagaccgcgtatctccccaacaattgggcttcctgagaaggccttgattccctcctggaaccttggagcagttttgttgctcgagccgaattcgggggtgacgtgcgtgggcgggtgttg

SEQ ID NO: 8591 - DNA, 1403 bp, Zea mays
attttaaactcgcgcccccgcgagagacaaaaaaaaccacaacaagagagagaacaagagagagagagagagacagagagagagagactgccaacgaggcgaagcagccggccaatctagcatccgcgcgcggggtctgagagcagagcggcagggcgccatggcggcatcggtggcgctgagcagcgggcaccggatgccggcggtggggctgggcgtgtggcggatggagaaggcggacatccgcggcctcatccacacagcgctccgcgtcggctaccgccacctggactgcgccgctgactaccagaacgaagctgaagttggtgacgcgctcgcagaggcattccagaccggactcgtcaagcgggaggacctgttcatcacaaccaagctgtggaactcagaccatgggcatgtgcttgaagcctgcaaggacagcctgaagaagctgcagctagactatctcgacctctacctcatccatttcccagtagccactcggcacaccggagtcggcacgacttctagcgctctgggtgacgatggcgtgctggacatcgacaccactatctccctggaaacgacatggcacgcgatggaagagcttgtttccatggggctggtgcgcagcattggaatcagcaactacgacatcttcctcaccagagactgcctggcctacgccaagataaagccggcggtgaaccagatcgagacgcacccctacttccagcgcgactctcttgtcaagttctgccagaagcacgggatctgcgtgaccgcgcacaccccgctgggtggctccaccgccaacgccgagtggttcgggacggtctcgtgcctggacgaccctgtcatcaagagcttggctgacaagtacggcaagacgccggcgcagctcgtcctccgctggggtctgcagcgggacacggtggtgatccccaagacctccaaggtggagaggctgcaggagaactttgacgtcttcggtttcgacatctccggcgaggacatggagaggatgaaggccgtggaccggaagtaccggactaaccagcctgccaagttctggggcatcgacctctatgcttagcttttagttcggttgcgttgcgtcgcccccccccccagacaagacagcatcaataatgaggattccctcagacggcatcagtcaaagtcacgaggatctcagacagcatcttccatcacatgtgacggtgtgaggctgatggtagggtttggtgtctccacgtgtccctctctctttcagctcagcttcatcaccatgtagactacgcagtgtttgcctccgattatttactgtttttcttccttacaaaacaaaaaatatctttactggtaggttgaacaatttgctgacaaaaaaaaaaaaaaaa

SEQ ID NO: 8592 - DNA, 1305 bp, Zea mays
tattgttttctcagtcctccctttttgggattagtttcctgcatgtttgttgaggattctccaaaaggttccacaacgccagtgatgaacataagtatgtagacaaccagagttctgttactgttttttctggaaaaggctctagtgagggcactagaaggcgaaagggaactggtgggagtggcaaccatagtccacaggcaaagcgaactgagtctaatgaaaaacacaacgggtcaattaattcgttgccatgtttgtctctgaggtcagccttcttcagtctctgcacagcttttaagcagccaaatattctgcggcctatggcatggtttttcttttcaaatgttacaattccaaatatcgccgcagttatgttctattatcaaacagaggacctaaatttggaggcatcctttctagggactgcacgtgtgattgggtggttcagtctgatgcttggcacctacacctacaaccgctattttaaacagaagaagctcaggaatattcttgtgtttgctcatgttggtcttgccgtaattaccctactggacattgttttggtgtcacggttacatgttcagtatggaattgccgataagtacatggtgctgtggggttccgcgttggctgatgcaatcaaccagttcaagatgatgccgttcctgatcctgtcaggacagctttgcccacctggaatcgagggcacactgtttgctctcttcatgtcaatcaacaaccttggttcaacactaggctcattcctgggggctgctatggcatcagctttgaacctctccacagcacagtttgacaatcttgctctgggtttgggtgtacagatgatttgtactctcttgccgattgggttcctatctctgattccaaaggaagtcacagggctaacatcataggttgaggtacgggcctgatcatacttgttctattcctgccggaaggtaatggtctgtgctcgaacctcaaatttctgactcacgtaaagcacgcatacttacagctgtgtaccagagagagaggaatatacacatcataggaaggaaattcaagatagttggaaaatagacagttgtgttgacagtatatgtacaagctctgtaccaggacgagagaaaaatagagtgcaatagatctgtaggcaaagattaaaatcacttgatgttgacagatgttgatgttacttgacatgtgtagaaatgagaacaaacatgaaagtgacgttgctaatgaatgaatctgtgcatgtctttttgttttcaccaaaaaaaaaaaaaaaaagggcgg

SEQ ID NO: 8593 - DNA, 1822 bp, Zea mays
  misc_feature (54)..(54): n is a, c, g, or t
cggccgggggaatttaggtgacactatagaagggggatttaggtgacactatangaaaaaaaaaaaaaaaaaaaaaaacattgggtacaccctcgaggccggcagctggaccttctcttcttggtcatgcccttccctcccatcaattcttcaatgctgcgtaatccctactgaaagaggcaccaatcagccattctgcaacttgccttcccgtgcttgcctcactgacatgaactcatcgtctttcttcctctgatccataagatctggccaacaagatcggtggcgcacaggtatcgggtcatcacttggtctctgaattctcaggattggagttgaagaagagcatcatgcttggtgggcagagcgagaccgtcaagtacagggtctttgctggaacatggaacgtgggcggcttggcgccgccggatgacctggacttggaggattggctggacacgaagaacgactcctacgacatctatgttcttgggttccaggagattgtgccgctgaacgcgaggaacgtgcttggccccaagcagaggcgggcggccatgaagtggcagctgctcatcggcgacgcattgaacagcacgaggcatggagctgcaggaatgcatggtcaaggacaggggggcgcgttcaggtgcctcatgagcaagcagatggtcggaatcttcgtgtcggtctggacgaggagcagcctctgccggcacgtccgccaccccggcgtgtgcagcgtcggcgccggcgtcctcggccggctcggcaacaagggcgcggtgtccgtccggttcttgctccacggcacgagcttctgcttcgtctgctgccacctggcctcaggcggcgagaagggcgacgcgctgcgccggaacgccgacgccgcgggcatcctctccaggaccagcttcctcggcttcggcggcgtggcggcagcacccggtgaggtgcccaagaagattcttggccatgaccgcgtggtgttgctcggcgacctcaactaccggatcgccatggacgatgacgaagcacggcagctggtgagggccaggaaatggggcatgctgctggagggcgacgagctgctgctggagctctccagtggccgtcagttccacggctggcacgagggccacgtcaccttcgccccgacctacaagtatcgccgcaactccgaccacctccactggtgcgctgacggcgtcgccgccggccgcgagaagcagcaccgcgcgccggcatggtgcgaccgcatcctctggcgcgggaaggggatgaagcaggtccggtacgagcgctgcggttgctaccggctctccgatcaccgcccggtcagggctttgttccacgccgtgtgcgaactggcggatggctaagctgtaggctagcttgcgtgctttgaatgaaaagcgtttaattaacaaacgagactcttaattttacaaagtgttcaaaaatttcggccagaaatttcacacggaactggttactggttcctgcatcgatgcgctttcaagctggtttgcgcctgattcctatctgctggagaaaattggagcacattttctgttctcggctgaggatatatggaaccaaaggatcattgaccaattaattatctgacaggttattgtccacacctgattcatgtgccggaggcatacaactttgtgcgccgggtcaactcgatgaaaccagtttttcgtggtttcaacaagatgcatgtcttcactatgatattgttattcgcatccatgaaaaagatgtatcaggtgtaaaccaagtttccatataaattttatacaaaccaactaac

SEQ ID NO: 8594 - DNA, 1253 bp, Zea mays
aaaaaaagaagcttgccatttcgctcagggccctgcaacgcgcggcagccccacgcgtccgggcttggcttgggactgggccgcccggccgcgaggaataaactcactcctgccttcatacgtatccaatatccatagccgcggcagtacgtgtatgtggttagctatacgcgacctcagctcgggcgcaagctacaacgccgaccaggcgagaagaagcatcgatagtgtgacgagctaacccaccagcagcaacgtaatccaaatccatggacaaccagccgctgccctactccacaggccagccccctgcccccggaggagccccggtggcgggcatgcctggcgcggccggcctcccacccgtgccgcaccaccacctgctccagcagcagcaggcccagctgcaggcgttctgggcgtaccagcgccaggaggcggagcgcgcgtccgcgtcggacttcaagaaccaccagctgcctctggcccggatcaagaagatcatgaaggccgacgaggacgtgcgcatgatctccgccgaggcgcccgtgctgttcgccaaggcctgcgagctcttcatcctcgagctcactatccgctcctggctccacgccgaggagaacaagcgccgcaccctgcagcgcaacgacgtcgccgcggccatcgcgcgcaccgacgtcttcgatttcctcgtagacatcgtgccccgcgaggaggccaaggaggagcccggcagcgccctcggcttcgcggcgcctgggaccggcgtcgtcggggctggcgccccgggcggggcgccagccgccgggatgccctactactatccgccgatggggcagccggcgccgatgatgccggcctggcatgttccggcctgggacccggcctggcagcaaggggcagcggatgtcgatcagagcggcagcttcagcgaggaaggacaagggtttggagcaggccatggcggcgccgctagcttccctcctgcgcctccgacctccgagtgatcgatcggcgcgtctcttggtcctggcctcctggcttagctacatgtgcatgatgtcaatccttcaatgtgccatgctgtgtatactctacagcaaacgtggtaatggagctgctatgcatatacagaacgaataaggcgtgacgtgtgagaccgtaagagtacgtagtactaatatgtagatgcacgtgacgtgcctattaatcaaaccattaactatgctagttaattaaattagatcctctct

SEQ ID NO: 8595 - DNA, 1136 bp, Zea mays
aaaaaagatgtcgaactccacgatcgatcactgatcgacatcgctgtccgctgcccggcttcctttctctccccatatccatatcagatcctgcggcgaattccttccaactccaggatcgagagcacacgcagatggcgaggcacccgcgcgcgccgctgctccggcgtctgctcctcctggcggccctcgcggcctcctgctcctactacctcctcttcctgcaggcgcaggcctccgtcccgccgcggtacgacgggttcgcctacggcggcggcgccgcgacggcctggaaggacgccgtcctcgtcgaggcctttctcgacccgctctgccccgacagccgcgacgcctggcagccgctgaagctcgccgtcgagcgatacgcgccgcgggtctcactcatcgtccacccgttcccactaccataccacacatatgcattctatgcctgccgcgcgctttacatagctaacaagttgaattcatcatcgacatatccattgctggagctgttcttcaagaaccaggaaaagttctacaattctgccacatcatctctctcgggcccttccgtagctctaggaatgtcgaagatggctgcgcagactgttggtaactcagtatccgagtttctgtcgggcttcagcgatgggaagacagactcggcagcgagagtttcattcaagtacgggtgcacgaggggagtctttggcgcgccgttcttctttgtgaatggcttcctccagcctgggggcggatcgcctatcgactacagcacgtggatcggcatcctggacccccttgtttcccagaacggtgaacggatcgagatgtttacttcgatgtaagtgattgaagtggccttgctacggaggatacggtcgtacagatgtttcgctagtgccgacggcggacaagcaaacagctattatgcaattgcaaactgtgtgtaagctctgcggtggtaaatagcatcccactttgctcgttgtactgttaagctagcagttgtgtgctagctgtatatcgggtaagtatgtgaagctcttatattggagcctgcgatatgttaaacttcgcataatcctatattcacattcgctcttctccttgcttttttttcggccgccacc

SEQ ID NO: 8596 - DNA, 1290 bp, Zea mays
atgtcctgtacctggtcacggagtatgggcggcaacccaaaatcgttacggcccccataacgttcggctgtggacggactcagacgggttcgtttctgggcactgctgcacccaatggtctacttggcctgggcatggacactatatcggccccccctttgctagcaagtcagggagttgctgctgccaattccttctccatgtgcttcgcacaagatggccatggtagaatcaattttggggacactggaagctcagatcagcaggaaaccccgttaaacatgtataaacaaaatccatactacaacataagcatcactggtgctacgtggggagtaaatccattcacaccaagttcaacgctattgttgactctggcacctctttcacagctctctctgatccgatgtacactcaaatcactagcagcttcaactcacaagtccaggataagccaagccagcttgactcttctctgccctttgaattttgctactctataagtccaaaggcttctaccaatcctccgaacataagcttcacggcggaaggtggaagcgtgtttcctgtcaatgatccaataattaccattacggacactgtatctaatccgatggcatattgcttggctgttatgaagagcgaaggtgttaacttaataggggagaattttatgtctgggctgaaggtcgtgtttgatcgagagaggaaggtcttgggctggaaaaactttgattgttacagcgtgagcaactcaagaagcaaccttccagtgaacccaaatccttctggtgttccccctaaacctgccttgggacctaacagctacactcctgaagctaccaagggcgcctcgcccaatggcacccaagtcaatgtcttgcagccttctgcaagtttttcgccgaagctgcgttgcaacagaaacgtcctcgtcgccgctgctctgctgttcctcgtgatcctttgatcacctcaactccccatgacaatcttttcagaaaccaaatcgacagatatgatagattttagttaaacttggtttacgttgtatgtattgagttacgtatagtgtgatagtatcacattcttttggcctgtgtccacagttccagtaggagttaggatagaacacgggatgagtccatagccctttttttttgcacgttcataatgtacctggtggatgtactgtgtacatattagatatgacttcaggatgtattgattttatagaataattgaataacgatgctcgcatacacagatatatatacttcgcattgcttc

SEQ ID NO: 8597 - DNA, 2441 bp, Zea mays
  misc_feature (8)..(8): n is a, c, g, or t
ggccgggnaaaaaaaaaaaaaaaaaaaaaaaaaggtaccctcgagccccgccggcgaaggaaaagatctcgaactccacgatcgatcactgatcgacatcgctgccggttgcccggcttccttctctccccatttccggggcccagatcctgcggcgaattccttccaactccaggatcgagagcacacgcagatggcgaggcacccccgcgcgccgctgctccggcgtctgctcctcctggcggccctcgcggcctcctgctcctactacctcctcttcctgcaggcgcaggcctccgtcccgccgcggtacgacgggttcgcctacggcggcggcgccgcgacggcctggaaggacgccgtcctcgtcgaggcctttctcgacccgctctgccccgacagccgcgacgcctggcagccgctgaagctcgccgtcgagcgatacgcgccgcgggtctcactcatcgtccacccgttcccactaccataccacacatatgcattctatgcctgccgcgcgctttacatagctaacaagttgaattcatcatcgacatatccattgctggagctgttcttcaagaaccaggaaaagttctacaattctgccacatcatctctctcgggcccttccgtagctctaggaatgtcgaagatggctgcgcagactgttggtaactcagtatccgagtttctgtcgggcttcagcgatgggaagacagactcggcagcgagagtttcattcgggtgcacgaggggagtctttggcgcgccgttcttctttgtgaatggcttcctccagcctgggggcggatcgcctatcgactacagcacgtggatcggcatcctggacccccttgtttcccagaacggtgaacggatcgagatgtttacttcgatgtaagtgattgaagtggccttgctacggaggatacggtcgtacagatgtttcgctagtgccgacggcggacaagcaaacagctattatgcaattgcaaactgtgtgtaagctctgcagtggtaaataggcaaatagcatcccactttgctcgttgtactgttaagctagcagttgtgtgctagctagtatatcgggtaagtatgtgaggaagctcttgcattggagcctgcgatatgttaacttcgcatgatcctatattcacattcctcttctccctgctttttcctaactattagcactcctccgccctgtcatttcgtcgactaacgatactatgtttattggcctgtcgtgtcttagtgtacacacatggtcttctgcgttggcgcgttttagatatctgcggccaagtttggtagacgatcaccatcagccaatcacctctgccaagaaccgaagcacattcgaaagttaaaaaaactcaatagtatttggcaacggatcagattcggaacggatattgaaaatatttgtccgcaatcataactgtgggtaaaaatttatatccattctcgtactcatcgtactcatcgggtttcagatatccgttagatatgataggcacaataaattttcaacaatttaatagcataattaatcattttttccccaattcactatagtacaccattaaaactacataagtatatcatattaaatattcattgtacacatagaattcaacaaagttagattttccattttataattttctctatgatttactgtgtgtgtgtttaaagattcactcgaaataaacataaaaggaggaaacttaagtaaccaaccagggagacccatgtgttcgattttaggagacgagggaggaactatgtccgattttatatttgatggagaaaagactgactttatatactttttaattacaaagtgcaatacagatgcttacaacgcacacaagaacatacacatataaaccatatcctacgagcatatttgaagactcgatccacaattcctcgagacgagattcgttactacaaacacgagaacatcgcttaccactaaaactataaagctcttaaattctttaatattcgtttttgcagaaagtcaatcaagaaatcatatgttatagaggttttcagtaaggctcgtgtatataatcgtgtaaaatactaattttacattatagattcaattgtttatcaagtagagtttaaaataggatatcatgatacaacagtgaagtggattcgaaataggccttttcgatcaataaccaatgacacgcactgggctcaaatcgagtccatcaaagtgacccacacagcccatatacctttcgttaacgtccttccggtacaaatcccagccgttaagctgtactctccaaaatctgtccgtcaaaatagaatcccagtgcacaaaaaatcccacgcaacgttcaggggcatttccctaactacaatctacaaaaccctagacgcggtgcaggtcgacactaaaggatcggcgg

SEQ ID NO: 8598 - DNA, 874 bp, Zea mays
  misc_feature (555)..(555): n is a, c, g, or t
  misc_feature (576)..(576): n is a, c, g, or t
  misc_feature (578)..(578): n is a, c, g, or t
  misc_feature (580)..(580): n is a, c, g, or t
  misc_feature (584)..(584): n is a, c, g, or t
  misc_feature (614)..(614): n is a, c, g, or t
  misc_feature (620)..(620): n is a, c, g, or t
  misc_feature (629)..(629): n is a, c, g, or t
  misc_feature (658)..(658): n is a, c, g, or t
  misc_feature (763)..(763): n is a, c, g, or t
  misc_feature (772)..(772): n is a, c, g, or t
  misc_feature (776)..(776): n is a, c, g, or t
  misc_feature (788)..(788): n is a, c, g, or t
  misc_feature (807)..(807): n is a, c, g, or t
  misc_feature (839)..(839): n is a, c, g, or t
  misc_feature (864)..(864): n is a, c, g, or t
cttttccatttccagagttccaaggcttcccttttaccccttcgcttcccatggcgccgtgggtgtgggtggcgttgcaggcggccgccgtggctgcgtccgcggcggagagcgctgagcctaggacgtccaccaccgctactcggccaccgtgcgggagtgggcggggcaccgcgcagccgccagccgggacggcggagtactacgcggcgctcgccgggcacgacctccgccggcgctcgctggcgggagggggggaggtggccttcgccgacggcaacgacacgtaccggctcaacgaactgggattcttgcattacgcggtggtggcgctggggacgccgaacgtgacgttcctggtggcgctggacaccggcagcgacctcttctgggtgccctgcgactgcatcaactgcgcgccactagtctcacccaactacagggatctcaagttcgacacttacagccctcagaagtcgagcactagccgaaaggtcccatgcagcagcaatttgtgcgatgaacagagtgcattccggtcagcaagcagcagcngcccccacagcatccaatacntntnttanaacacaacaaccaccggtgttctggttgangatgtnctgtacctngtcacggagtatgggcggcaacccaaaancgttacggcccccataacgttcggctgttgacggactcagacgggttcgtttcttggcacttctgcacccaatggtctactttgcctgggcatggacactatatnggtccccantttnctagcaagttanggagttgctgccgccaatnccttctccatgttctttgcacaagaaggccanggtagaatcaattttggggacactngaagctcaca

SEQ ID NO: 8599 - DNA, 2407 bp, Zea mays
cattgggtacctcgaggccggccggggagggtaccgcgcgcccgctcggcgctcgatccactgatcgacatcgctgccggctgcgcggcttccttctctccccatttccggggcccagatcctgcggcgaattccttccaactccaggatcgagagcacacgcagatggcgaggcacccccgcgcgccgctgctccggcgtctgctcctcctggcggccctcgcggcctcctgctcctactacctcctcttcctgcaggcgcaggcctccgtcccgccgcggtacgacgggttcgcctacggcggcggcgccgcgacggcctggaaggacgccgtcctcgtcgaggcctttctcgacccgctctgccccgacagccgcgacgcctggcagccgctgaagctcgccgtcgagcgatacgcgccgcgggtctcactcatcgtccacccgttcccactaccataccacacatatgcattctatgcctgccgcgcgctttacatagctaacaagttgaattcatcatcgacatatccattgctggagctgttcttcaagaaccaggaaaagttctacaattctgccacatcatctctctcgggcccttccgtagctctaggaatgtcgaagatggctgcgcagactgttggtaactcagtatccgagtttctgtcgggcttcagcgatgggaagacagactcggcagcgagagtttcattcaagtacgggtgcacgaggggagtctttggcgcgccgttcttctttgtgaatggcttcctccagcctgggggcggatcgcctatcgactacagcacgtggatcggcatcctggacccccttgtttcccagaacggtgaacggatcgagatgtttacttcgatgtaagtgattgaagtggccttgctacggaggatacggtcgtacagatgtttcgctagtgccgacggcggacaagcaaacagctattatgcaattgcaaactgtgtgtaagctctgcagtggtaaatagcatcccactttgctcgttgtactgttaagctagcagttgtgtgctagctagtagctacagctagtatatcgggtaagtatgtgaagaagctcttgcattggagcctgcgatatgttaaacttcgcataatcctatgttcacattcgctcttctccttgctttttcttaactattggcactcctctgccttgtcatttcgttgactaacgatactatgtttattggcctgtcgtgtctcagtgtacacacatggtcatggtctctgcgttggcgcgttttagatatctgcggcctagtttggtagacgatcaccaattcaccatcagccaatcacctctgccaagaaccgaagcacatgcgaaagttaaaaaaaaactcaatagtatttggcaacggatcaatttggcggatattgaaaatattcgtccgcaattataactgtgggtagaaatttatattcacgcccgtgctaatcggatttcggatatccgtcaaatatgatagacaataatttttcaacaattcaatagcagaattaatcaaaattttccccaattcaccataatacaccattaaaactacataagtatatcacattaaatattcattgtacacatagaattgaacaaagttagattttccattttataattttctctataatttactgtgtttgtgttttttaaagattcaatcgaaataaacataaaaggaggaaactaagtaaacaaccagggagaccatgtgttcgattttaggagacgagggaggaactatgtccgattttatatttgatggagaaaagactgactttatatactttttaattacaaagtgcaatacagatgcttacaacgcacacaagaacatacacatataaaccatatcctacgagcatatttgaagactcgatccacaattcctcgagacgagattcgttactacaaacacgagaacatcgcttaccactaaaactataaagctcttaaattctttaatattcgtttttgcagaaagtcaatcaagaaatcatatgttatagaggttttcagtaagactcgtgtatataatcgtgtaaaatactaattttacattaaagattcaattgtttattaagtagagtataaaataggatatcatgatacaacagtgaagtggatttgaaataggccttttcgatcaataaccaatgacacgcattgggctcaaatcgagtccatcaaagtgacccacacagcccatatacctttcgttaacgtccttccggtacaaatcccagccgttaagctgtactctccaaaatctgtccgtcaaaatagaatcccagtgcacaaaaaaacccacgcaacgttcaggggcatttccgtaactacaacctacaaaaccctagacgcgctgcag

SEQ ID NO: 8600 - DNA, 2204 bp, Zea mays
gctgcttctgctcctgctacttgccccctcttatcagagagagtggtgtggtggcgcctccccaccatcaccaccagccagcaccacccctcctgcccctctgcgctggcgggccgagcgccgcgagcgagctgggccgcgggcggaggaggagtcgaggctgaccgaccccgcggccggcggcgacgagcggacgcagattcggcagccgtgcgcggaatgcccgtggaaggaggggagggagggcgcaggcgcagctgagctgagcccgcgaggttcgcggtctgcggtgcggcggcggaggtctcgccagcgcgatggccagcggcggctcctccaggtacagctcgtacaaggcgccggggctgcgcggcgcgctgctggaggcggcgcacgtgtcgtgcctcgaggaccggtacgcgctgggcccgcagctggggtggggccagttcggcgtgatccggtcctgctccgacctggtcaccggcgaggcgctggcctgcaagtccatcgccaagggccggctcgtgtcccccgacgacgtgcgcggggtcaggctggagatcgacgtcatggcgcgcctggcgggccaccccaacgtcgtggggctcaaggccgtgtacgaggaccgcgactcggtgcacctcgtcatggagctctgcgccggcggcgagctcttccaccgcctccacgagcgcggctgcttccccgagcgcgaggccgccgcgctcttccgccacctcatggaggtcgtcgcgcactgccacgccaaggggatcgtgcaccgcgacctcaagcccgagaacatcctcctcgtcagcaggtcgccccagtcgccgatcaaactcgcggactttggactcgccacctacacccagcctggccgaagcttgagcggcatggtaggcagcccgttctacattgcgccggaggtgctctccggcgggtacaacgaggccgccgacgtctggagcgcgggggtcatactctacatcctcctcagcggcatcccgccgttttggggcaagaccaagtccaagatcttcgactgcatcaggtccatggagctgcggttcccttctgacccatgggacagggtttctgattccgccaaggagctcgtcaccgggatgctgcggcgcgaccctaggctgcggctcacggccaagcaggttctagagcatccgtggatgcaggaacacgcggacccacaagactcgtgcgggcagtgccacgagaccggcctccaacgggagggcgccggctcgtgctccttctccacgccgttggcgtcgcggagcagggacgtgagctttgacacgcgtggccccatcgcgtggaggggtgggggcgaggacgaggcgacctgctgctcgcccacgttcgccgccgtctgcaggtcgtcgttctcggcgttcatcaccgacccggccccgccgccctgctcggcctcctccgccttgggtggctctggcttctcgttcggtgagccctgcgaaccacttgacggaggaggaggaggagggttcccgatgcccatggcttccatgccgagcttctcgttcttctgcgcgcgggacagcagcgagccagctgagccacagccggtcgctgcctcctcgactccgaggacggcgaggggatccacgccacggggcgtcaacggcaggcggaaccacacgatcggcggcggcgggcgggagcacctggacgtggcggtggagtctgtcatccgctgggcgtcgtgcaccaacttctccacggcgccctcacttcgggcctccctcgtatgctagcactagcaacgtcgttccgcgcgccggcgccgccaacgccgggctgagggtgaggaggagaattccgacgagacgagcggtagagagtgtgcagtagcctcgaattgtataatatatatacagacacagtgctgttatagtggtgatgatagattagagagtgaagacgaagttgctacggaaggatggatgcatggagatggagagcgagtggcagagctggaactgatgtgtttcattcttcgctgtcacgctgctggtcagataagatttgggaacagacctgccgatggagagagatggcgtctgataacttgatatgaacaagaagcaacaatgttcaggatgcaggaaaaaaaaaaaaaaaaaaggactgtttcagtttgtgtgtcagatctgttttccacc

SEQ ID NO: 8601 - DNA, 1369 bp, Zea mays
  misc_feature (492)..(492): n is a, c, g, or t
tgcctgcatcactgactgtcaagctgcaacccactgcgagctagtgagtgtgagagacgagagttagagagcgagatggcagccacggtttcgttcccggtggtgaacatggagaagatggagaccgaggagaaggccacggccatggaggtcatccgcgacgcctgcgagaactggggcttcttcgagctgctgaaccatggcatctctcacgagctgatggacgaggtggagcggctgaccaaggcgcactacgccaacttccgggaggccaagttccaggagttcgcggcgcggacgctggaggccggcgacaagggtgccgacgtcaaggacgtggactgggagagcaccttcttcgtccgccacctcccggcctccaacctcgccgacctccccgacgtcgcccgcctccgccccccgccgttcgtgcaattcgcaatcggagatccagaagctgtcgggagaagctgctgagacctgctgtgcgangaacctgggcactggagcccggctacctcaagtccgccttcgctggctccaacggccccacgttcggcaccaaggtgagcgcgtacccgccgtgcccgcgcccggacctcgtcgacggcctccgcgcgcacaccgacgccggcggcatcatcctgctgttccaggacgaccaggtcagcggcctgcagctgctcaaggacggcgagtgggtggacgtgccgcccatgcgccacgccatcgtcgtcaacatcggcgaccagctggaggtgatcaccaacggccgctacaagagcgtcatgcaccgcgtgctcacccgccccgacggcaaccgcatgtccatcgcctccttctacaacccgggcgccgacgccgtcatcttcccggcgccagcgctcgtcggcgccgccggcgccgaggaggagcgcgccggccaggccaggtacccgaggttcgtgttcgaggactacatgaacctgtacgtgcgccacaagttcgaggccaaggagccacggttcgaggccatgaagtcggccatcgccaccgcgtgatgaacaaacacactgctgccttcaattctgctccttgtcccttcgtgtcctgcattatgctttgagcttgaagccttgatgaggctgcaatgaacagtgtccatgtgcttatatgtagtttggcacggtggttatgcgtgtatcgtggaacggcgtaatgtattttggttgtctcggatctatatgtatgtacgtatatattgagtactgtatgtaaagtgtgtgtagcatctgatccaatgtatgagcagtgtgtacgtgaccaggacctgatgtgctgctattactaccacctcaagtggagggaacatgaattattagtagttctc

SEQ ID NO: 8602 - DNA, 1382 bp, Zea mays
  misc_feature (13)..(13): n is a, c, g, or t
ggccgctcgaggnccggcccgggcctgggactcaaacaaactcaagcctgccctgtcctgccttgttaagcaacacagcgagacatcacgagagctagagagagatggcggccacggtttcctccttcccggtggtgaacatggagaagctggagacagaggagagggccacggccatggaggtcatccgcgacggctgcgagaactggggcttcttcgagctgctgaaccacggcatctcgcacgagctgatggacgaggtggagcggctgaccaaggcgcactacgccaccttccgggaggccaagttccaggagttcgcggcgcggacgctggaggccggcgagaagggcgccgacgtcaaggacgtggactgggagagcaccttcttcgtccgccacctcccggcctccaacctcgccgacctccccgacgtcgacgaccgctacaggcaggtgatggagcagttcgcatcggagatccggaagctgtcggagaggctgctggacctgctgtgcgagaacctgggcctggagcccgggtacctgaaggcggccttcgccgggtcggacggcccgacgttcggcaccaaggtgagcgcgtacccgccgtgcccgcgcccggacctcgtcgacggcctccgcgcgcacaccgacgccggcggcatcgtgctgctgttccaggacgaccaggtgagcggcctgcagctgctcaggggcggggagtgggtggacgtgccgcccatgcgccacgccatcgtcgccaacgtcggcgaccagctggaggtcatcaccaacgggcggtacaagagcgtcatgcaccgcgtgctcacgcgccccgacggcaaccgcatgtccgtcgcgtccttctacaacccgggcgccgacgccgtcatcttcccggcccccgcgctcgtcggcgccgccgaggaggaccgcgccgaggccgcgtacccgagcttcgtgttcgaggactacatgaacctgtacgtgcgccacaagttcgaggccaaggagcccaggttcgaggccatgaagtcggccatcgccaccgcgtgagcaaagactgacttccgctcccggcttccttcgtggcgtcaagccttgaggcttgaacgaacaacgtacgtccatgtgcttatagtggcacagttatcgcgtggaacggcctaatgtatttcggttgcctcagatcgatctatatgtgcgtatacattatgtactgaaaagtgtgtagcgtctggttaatgtacgagcagtgtgtatgtgaccaggacccggtgtgtagttgctactactaccatatccggtgaatgatcaaaccttttggtgtattaagggggtgtttggcttcttgggactaatttttagtccctacatttt

SEQ ID NO: 8603 - DNA, 1385 bp, Zea mays
  misc_feature (13)..(13): n is a, c, g, or t
tgacaagtcgggnaaagctcgtccacttccagttccactccgctagaaagcttgaacttggatgccgagcctataaatggcgaccgaccccggccacttccactcaccgcactccagcgttcagcattagacacgagagctcctagtagccagaccactagtcccgcgaccctgtcgagagaaacagacagagcaacatggcgcctgcattgtcattcccgatcatcgacatggggctgctcgccggggaggagaggccggcggcgatggagcggctgcaagatgcgtgcgagaactggggcttcttcgagattctgaaccacggcatctcgacggagctgatggacgaggtagagaagctgaccaaggagcactacaagcgggtgcgcgagcagaggttcctcgagttcgctagcaagacgctcggggacggccgcgacattgcgcagggcgtgaaggcggagaacctggactgggagagcaccttcttcgtccgccacctcccggagcccaacatcgccgagataccggacctggacgacgagtaccggcgcgtcatgaagcggttcgccggcgagctggaggcgctggcggagcggctgctggacctgctgtgcgagaacctcggcctcgacaggggctacctggcgcgcgcgttccgcgggcccagcaagggcgccccgacgttcggcaccaaggtcagcagctacccgccgtgcccgcgcccggacctcgtcagcggcctgcgcgcgcacaccgacgccggcggcatcatcctgctgttccaggacgaccgggtgggcggcctccagctgcttaaggacggcgagtgggtggacgtgccgcccatgcgccacgccgtcgtcgtcaacctgggggaccagctggaggtgatcaccaacggcaggtacaagagcgtcatgcaccgggtggtggcgcagcccagcgggaacaggatgtccatcgcgtccttctacaacccgggcagcgacgcggtcatcttccccgcgccggcgctggtcaaggccgaggaggcggccgcgggggtggtaccccagcttcgtcttcgaggactacatgaagctgtacgtgcggcacaagttcgaggccaaggagccacggttcgaggccttcaagtccatggagacggacagctccaatcgcatagccatcgcgtgaaacaccggacctgcgccgagctctggcttactgttcgagatgtacgtgcggcgtactgtactgctcttcttcgttcgctacttggccagcttgctagttatatgtgtcgcgccctctgtattactactactacaaaactatatctctactatattactatatctcttctatattaaaatatcagtttcaacgataatcccgcctcc

SEQ ID NO: 8604 - DNA, 2543 bp, Zea mays
tttgcattgtgattctcttctccttcatcgttgatgtcatcctctacacatatatgcctcatggctaaaggtgaatgcaaggtataaaatgatgatgatagtagcgataaggaatttgattcactgtcatatgatgaactagttgacttgctaaaagaatatactcaaagtcattagaaagaaaaaaaaaataaatgtgacaagttaaaaactaagaataaagctatgtttggaaccttagagctaatagttagctagctaagaaattgttagatgggttgagtcagttaatggactaattgttagctttgagttagctaacaattagatgaggcattagctaggggtctagctattagttctagagtattcaaacagaacctaagtctttatatgataggtgttacatagacataaaaattaatgataaagtaagatatgaaaatcaagctatgtcgtccaatgctaaagagtttaaatcttctcttagagatataaaagaaaaatatgataaacttgataaaaacaaacgaagagtttatgatatatttgttttttaaaaattgaccgtgacaatattgttgctgcttataacacatgatactactaacaaaagagttttcatataacacattattaccaacagatatcatcggcgtctcattcctttgcagacgctcagacgcccgggtgggcggtggcggcacggcggtcccgcgatcgagacggtttgccatgggccgctcaaccttcgccacggagacaaaatggcatttgccatactgtgccatatggcttgccatccccaacttgagtgctcgaccacggaagcgcacctcaccccatccatccgccactgtcgacggctgcccttccccgagctgacggccagcccagccaagccaagctggagtgcaagagaatcccgtgcgtgcatgctgagggcccgcgacgagacgggccaacacgcgtcgcccacatgggcgtggcccgcgtgggtgcccacaggtcaatgccctgtctgtcagcaagagcaacaaccaaaaaacaactctgctgctggctgctgtctgttgacaagtcgggaaagctcgtccacttccagttccactccgctagaaagcttgaacttggatgccgagcctataaatggcgaccgaccccggccacttccactcaccgcactccagcgttcagcattagacacgagagctcctagtagccagaccagtagtcccgcgaccctgtcgagagaaacagacagagcaacatggcgcctgcattgtcattcccgatcatcgacatggggctgctcgccggggaggagaggccggcggcgatggagctgctgcaagatgcgtgcgagaactggggcttcttcgaggtagatgctcagcatggatggagaactgatccaactccaggaactgaaacaaaataattaagctgcacaaatatacactctatctgtttttatcgttgatgatggtgctctatctgttttctttaatcctattattccctcctgccctgcagattctgaaccacggcatctcgacggagctgatggacgaggtagagaagctgaccaaggagcactacatgcgggtgcgcgagcagaggttcctcgagttcgccagcaagacgctcggggacggccgcgacattgcgcagggcgtgaaggcggacaacctggactgggagagcaccttcttcgtccgccacctcccggagcccaacatcgccgagataccggacctggacgacgagtaccggcgcgtcatgaagcggttcgccggcgagctggaggcgctggcggagcggctgctggacctgctgtgcgagaacctcggcctcgacaggggctacctggcgcgcgcgttccgcgggcccagcaagggcgccccgacgttcggcaccaaggtcagcagctacccgccgtgcccgcgcccggacctcgtcagcggcctgcgcgcgcacaccgacgccggcggcatcatcctgctgttccaggacgaccgggtgggcggcctccagctgcttaaggacggcgagtgggtggacgtgccgcccatgcgccacgccgtcgtcgtcaacctgggggaccagctggaggtgatcaccaacggcaggtacaagagcgtcatgcaccgggtggtggcgcagcccagcgggaacaggatgtccatcgcgtccttctacaacccgggcagcgacgcggtcatcttccccgcgccggcgctggtcaaggccgaggaggcggccgcgggggtgtaccccagcttcgtcttcgaggactacatgaagctgtacgtgcggcacaagttcgaggccaaggagccacggttcgaggccttcaagtccatggagacggacagctccaatcgcatagccatcgcgtgaaacaccggacctgcgccgagctctggcttactgttcgagatgtacgtgcggcgtactgtactgctcttcttcgttcgctacttggccagctgctagttatatgtgtcgcgccctctgtattactactactacaaaactat

SEQ ID NO: 8605 - DNA, 1271 bp, Zea mays
gccggccgggtctcaaaaaaagcttggcctgcctgttaagcaacccggcgagcgaggtggtgagagaacgagcgagagggagatggcagccacggtgtccttcccggtggtgaacatggagaagctggagaccgaggagagggacacggccatggcggtcatccgcgacgcctgcgagaactggggcttcttcgagctgctgaaccatggcatctcgcacgagctgatggacgaggtggagcggctgaccaaggcgcactacgccaccttccgggaggccaagttccaggagttcgcggcgcggacgctggccgcggccggcgacgagggcgccgacgtcagcgacgtggactgggagagcaccttcttcgtccgccacctcccggcctccaacctcgccgacctccccgacgtcgacgaccactaccggcaagtgatgaagcagttcgcatcggaggtgcagaagctgtcggagaaggtgctggacctgctgtgcgagaacctgggcctggagcccgggtacctgaaggcggccttcgcggggtcggacggcggcccgacgttcggcaccaaggtgagcgcgtacccgccgtgcccgcgcccggacctggtggccggcctgcgcgcgcacaccgacgccggcggcctcatcctgctgctccaggacgaccaggtgagcgggctgcagctgctcaggggcggcgccggcggggagtgggtggacgtgccgccgctgcgccacgccatcgtcgccaacgtcggcgaccagctggaggtggtcaccaacgggcggtacaagagcgcggtgcaccgcgtgctcgcccgccccgacggcaaccgcatgtccgtcgcgtccttctacaacccgggcgccgacgccgtcatcttcccggcccccgcgctcgtcggcgaggaggagcgagccgagaagaaggccaccacgtacccgaggttcgtgttcgaggactacatgaacctgtacgcgcgccacaagttcgaggccaaggagccccggttcgaggccatgaagtcgtcggccatcgccaccgcgtgagcacataatactgccgtgttctcccttcgtggggtgcatatgcttgagcttgaagagccatgtgcctgtatgtagtggcacgtacggtggttatgcgtgtatcgtggaatggcgcggcgtgatgtattttggttgtctcagatctaagtgtgtgcgtatatattgtgtactgtaaagtttgcagcgtctgattaatgtacgagcagtgtgtgtacct

SEQ ID NO: 8606 - DNA, 2727 bp, Zea mays
ctctgcagactgcttgctgctcacaccaagctaccacagaacacaattattctactaaccaacgcaccacacctgatcacaataagtaatgatctaaccacacagcaggaagaattactacttcacttgttgtttgcctgacctgccacccccctgcttcttcaacatctagagccccttcattctgtcagcacatgcaagctgttcgtttcggatcaaatctatttgttcggactgctgacagtagaaaccgatactcgttaaagccagcaccaccgttccagaaaaagaaaagcaaaacaaagtattctagcagcttgctttacctaacaaacagcctccgatcctcgaacgtacagattcctattctccatgccatcaaccggccgaccaccagctgattccatcacgtctctctctcaccgcgcctagctgatgagcacacacaaagtagcatcttatctattggttcgttgatgcccagctctcgaacgaatcaccatctcatgtattgtcttgtccccatccccatgcatgcagctgctgaaccacggcatctcgcacgagctgatggacgaggtggagcggctgaccaaggcgcactacgccaccttccgggaggccaagttccaggagttcgcggcccggacgctggaggccggcgagaagggcgccgacgtcaaggacgtggactgggagagcaccttcttcgtccgccacctcccggcctccaacctcgccgacctccccgacgtcgacgaccgctacaggtgcgttcagacctcaaacacaacactacgtgcgtgcgtgcgtgctagctagctagcttatgcgcgccattaaattaatgacgtctggcgcacagggccgggccggcataattgaaggccctgtactgtttttttttcttttttttctttgttaagaatagatgatacagattaatctcatttattaacagtgattgaattattaatgtaggaaatggcttaataacgataacaaatgatcttaaagtttggattttatgctagcatgtgctagctgcacttcgccatatagccaaaataagttgcatgagagattggtactcgcttgttacgacaaacactatgttttattcttatcgagctgacttagctagactttctaatcattactaaaatttatattgattaaattatcactaactattattttaggggcccttgaagggagggggccctgttcttgtgcactagtgacacatgcctcccgcccgggcctgctggcgcagtatcgtatatttattagtgtttggctgctagctgcgacccaatgatcagtcgtctttgttaatcgactttttgttggcttctgacggaatgttctaagtgccatgtcacccgcttttgactgatcagtttattttaattgatctgattagtcttagcttgagagtgacttgagtatagcaggctgggatactacctgacctgctcctacataacggattaagtaatgtttcaagaaattttgtccatacgcatataattaagttatcattatcagaattctgcctgacgacgacgacgacgacgcgaaaacagttagttatctggtcaccccgcggcccggcgcgtggggacaagctagctagctagctgtacagcagaatgcggtgcgagccccgtagctatgacaaggtcgatcgaatcgccttttcagcaggcgacagcgctatttgtccggtggaattattccggccgtgtctcaaagccttccttccgtacgtgtcgctgcaggcaggtgatggagcagttcgcatcggagatccggaagctgtcggagaggctgctggacctgctgtgcgagaacctgggcctggagcccgggtacctgaaggcggccttcgcggggtcggacggcccgacgttcggcaccaaggtgagcgcgtacccgccgtgcccgcgcccggacctcgtcgacggcctccgcgcgcacaccgacgccggcggcatcgtgctgctgttccaggacgaccaggtgagcggcctgcagctgctcaggggcggggagtgggtggacgtgccgcccatgcgccacgccatcgtcgccaacgtcggcgaccagctggaggtcatcaccaacgggcggtacaagagcgtcatgcaccgcgtgctcacgcgccccgacggcaaccgcatgtccgtcgcgtccttctacaacccgggcgccgacgccgtcatcttcccggcccccgcgctcgtcggcgccgccgaggaggaccgcgccgaggccgcgtacccgagcttcgtgttcgaggactacatgaacctgtacgtgcgccacaagttcgaggccaaggagcccaggttcgaggccatgaagtcggccatcgccaccgcgtgagaaagactgccttccgctgccggcttccttcgtggcgtcaagccttgaggcttgaacgaacaacgtacgtccatgtgcttatagtggcacagttatgtgtgtaactaccgatcgtggaacggcctaatgtatttcggttgcctcagatcgatctatatgtgcgtatacattatgtactgaaaagtgtgtagcgtctggttaatgtatgagcagtgtgtatgtgaccaggacccggtgtgtagttgctattactaccatatccggtgaatgatcaaaccttttggtgtattaaaaaaaaaaataataaacaatacatataacaccccaaaagcggcc

SEQ ID NO: 8607 - DNA, 2284 bp, Zea mays
cctttctttttttttttaaaaaaaaaggctttccgtgtcgctgctgcaggcaagtgatgaagcagttcgcatcggaggtgcagaagctccccgcgtccgtgctggccctgctgtgcgagaacctgggcctggagcccgggtacctgaaggcggccttcgcggggtcggacggcggcccgacgttcggcaccaaggtgagcgcgtacccgccgtgcccgcgcccggacctggtggccggcctgcgcgcgcacaccgacgccggcggcctcatcctgctgctccaggacgaccaggtgagcgggctgcagctgctcaggggcggcgacggcggggagtgggtggacgtgccgccgctgcgccacgccatcgtcgccaacgtcggcgaccagctggaggtggtcaccaacgggcggtacaagagcgcggtgcaccgcgtgctcgcccgccccgacggcaaccgcatgtccgtcgcgtccttctacaacccgggcgccgacgccgtcatcttcccggcccccgcgctcgtcggcgaggaggagcgagccgagaagaaggccaccacgtacccgaggttcgtgttcgaggactacatgaacctgtacgcgcgccacaagttcgaggccaaggagccccggttcgaggccatgaagtcgtcggccatcgccaccgcgtgagcacataatactgccgtgttctcccttcgtggggtgcatatgcttgagcttgaagagccatgtgcctgtatgtagtggcacgtacggtggttatgcgtgtatcgtggaatggcgcggcgtgatgtattttggttgtctcagatctaagtgtgtgcgtatatattgtgtactgtaaagtttgcagcgtctgattaatgtacgagcagtgtgtgtacctaaccaaaaaaaaaaaaaaagcggcctgtgtgctgatattactaccacatcaggtgagtggccacccgtcgtcgcctcctacggctccggtgccgactcgaccccttccttccctgcgaccctgcggccccaccgcccttatctccatggatacttgcggcgagcaaaggcttaacaaaggagaacagtgtgcaaaacatacctgcagtgagcaaaggctttacatgaggatatcaggatatgcacagacctaccatacaagctatagcctttcctttacaacaaaacaccagctagaagatccgcatatgctaccgattgttcactctccatgttttgttcggcttacattgttacgctgagttagatggttaattgcacagtaacctgccgactgcactatcaccttgtcttggctttccttctcttctatacaaaagcgagtcagtggacacattcagagaagtggaagggaagaaagaagaaaaggcggcaaagaaaactgaatgccaaccggtgcctaaaattcatgtaggatgcagatgctaggataataaacatcgaagtaacgttccaagttacttcagagttggaaactgacttgtcagatagttctcggtacatgtcctcttgccataatgtgattccggagcgattcaattaattaacttgatgtcaggaaaacataaagtacgatgtgacatcatttcaacatttgcttcttgaaaatgggagtacaggtttgattagtgagtatcttaggctaacataacaaacatgaaccaccaactcgacgagccacgccatcagcgccagaaacagctgaggcggcggcaccggcaccggcgcggcggccgcgccgatgacgacagttgctccggaaagcatcagctggagcgcccagatgcgcagcggatgcccacgtcgagcgacggcttgctcttgctcttgctcttgcgctgtcgcgggggtgtcgtcggtgacgctgctagcatcctcccaggccatcgcagccgtgacgacaggtcgctgcagcaccgacacgacacgagctcaaactccggccagagcagagcagagcagacgggcgctccgctacgtgcaggactgcaggcaacaccaactcgacgatgtatttatagagctcgtgttcacattacgcactgcttttccgcgctcgatggtttcgtacatgttgatagacatcagttgtttcatagttgacttcgaaaacgacctatgcgaagaaatacaccgtagcgaagcttccaggaaacttccctcttcctgctgcagccggccgtctatcgccactacggtgcacgccgcaacgctaacccaaccgattctgcagagaaaattcgttggagatcggtcggactagttgtgtgaat

SEQ ID NO: 8608 - DNA, 1411 bp, Zea mays
ccggccggggagccccctagggcccggccgggactcatcaacaaactcaagcctgccctgccctgccttgttaagcaaagcaacccagctgcgagacacgagagctagctagagagagatggcggccacggtttcgtccttcccggtggtgaacatggagaagctggagaccgaggagagggccacggccatggaggtcatccgcgacggctgcgagaactggggcttcttcgagctgctgaaccacggcatctcgcacgagctgatggacgaggtggagcggctgaccaaggcgcactacgccaccttccgggaggccaagttccaggagttcgcggcccggacgctggaggccggcgagaagggcgccgacgtcaaggacgtggactgggagagcaccttcttcgtccgccacctcccggcctccaacctcgccgacctccccgacgtcgacgaccgctacaggcaggtgatggagcagttcgcatcggagatccggaagctgtcggagaggctgctggacctgctgtgcgagaacctgggcctggagcccgggtacctgaaggcggccttcgcggggtcggacggcccgacgttcggcaccaaggtgagcgcgtacccgccgtgcccgcgcccggacctcgtcgacggcctccgcgcgcacaccgacgccggcggcatcgtgctgctgttccaggacgaccaggtgagcggcctgcagctgctcaggggcggggagtgggtggacgtgccgcccatgcgccacgccatcgtcgccaacgtcggcgaccagctggaggtcatcaccaacgggcggtacaagagcgtcatgcaccgcgtgctcacgcgccccgacggcaaccgcatgtccgtcgcgtccttctacaacccgggcgccgacgccgtcatcttcccggcccccgcgctcgtcggcgccgccgaggaggaccgcgccgaggccgcgtacccgagcttcgtgttcgaggactacatgaacctgtacgtgcgccacaagttcgaggccaaggagcccaggttcgaggccatgaagtcggccatcgccaccgcgtgagaaagactgccttccgctgccggcttccttcgtggcgtcaagccttgaggcttgaacgaacaacgtacgtccatgtgcttatagtggcacagttgtgtgtgtaactaccgatcgtggaacggcctaatgtatttcggttgcctcagatcgatctatatgtgcgtatacattatgtactcaaaagtgtgtagcgtctggttaatgtacgagcagtgtgtatgtgaccaggacccggtgtgtagttgctactactaccatatccggtgaatgatcaaaccttttggtgtattaacactagatgttcatctaaaaaaaaaaaaaaaaaaggcccctagggcc

SEQ ID NO: 8609 - DNA, 5798 bp, Zea mays
aatgctatggtatttacatgttcaccacaagacagtatggggtacaaatgtttgaagtgacaactgtgacttaattgttctttccagctttgggatgttaggagtatgcattctcaaattgttggaccagtaacatatatgtggcgtccattctcaagagcagatgacaaatctgggattgaaggagatcagtgtacttctcactgcattcacgatgaaagcggcaattcctcacgacgccagttgtggatatggattcatcctgctgcacttgatgatggaattagtgcaatacaatttgcatgtgagagacaggtgcttcctcaatttcttatgtaaggctttaacttgctgttttcaggtttgtttggagggtaaaggaggaacttatttcagcacgctaaaatttgaaaagtagtttttaagtagttggctccttgaatttgtagtttcactaatttatagagaacttatacttctagtttgagtgtgcggatattcaagggagatgtaagttatgtagaatactttcttttgtcactctctcttttttttttaatttttgaccaccacaaatatatgactccatgtaaaactttatttgcatttcctattcagattaaaatgcaaactgctcacaaaaaatacaggatgcaccatgatctgggttttataggaggaagagaacgacaagaaaggaaacctcgtgcccccttttttgtcggtagcttctgtaaacaaacagatgagttcaagtactatgttttgaactgttgaccagaaaaatactagtcattttgttcttttcatggttgaaggtatcatttaccagtttttatatcctaatgagaaacatccacctgttcagtacctaagcactttagaaattgctgttttcatgatctgaatgtaggaattaagatgctatttggtgagtataatttatcttgtgcaatgtaatccttactgctgcgtaacagttacaagtagtaagtttccttgtaatactattcctgctttcatctcaccctataaagtcctgcccttcactacagattcaagattctggtggtgtggtcaaatgttgttcattagagggaaaaattggaagattggaagtcaatggatgcaaggctatgcaatctcttaagaagattttgcatccaaccaggtaaggctcttctttttgggaactaagttaatgttaccagtgagaaaacaaaggttccatgtcatgctaatttatgttttttaattaacaatgcagttcaagtaagatcaacacgatatcaacaagtgatatctccgcatcaactgatactctcctggattcctgtattgcccctcatcttttgaaagcttctgtcattagtaatgctgagattcttcaacctggtgctatactatccatggtagttcatgaccccagggaagtttcagtcaagggaatagattcttctaaaatagtctcccatgacaaacagagcgaagttttggaggaagatgtagccccaaatgctaatgaggcgtcatcagaagttgcaaatatattgccattgatgtggatgcaccctgggaaacatgatatactcctttctgactgtagggaactgtgggactccaggcaaaccataaatcctcctgtgtcagatgaggttctctgtaaggagaagcactctgaacgtataaagtttttctgcttggattcaggaaatgatcaagagcaaacaacacaagagaaggacaacttcattcgatcctgcccggttattcttttgaaacatgccagagaaggaataccttctctagggtaaggcctatcttttgtccatgaaaatgtcacattactactactgcttgcaagagcatacaaagaaattgtttacttctatgctaggtttatatttccccagttagataaagaaaggggcatttacatggttgtcccatgttgcttcctaattatgagcttgtccctcctatcatgacacagtctatgtatctcatgttcgtttcagatttatgttttttttttgcttcttagaagaaatataatttagatcagttatcaggagttttgatttttgaactctattttatgttttggagtcctatataatatgctattatggtttgtctagtaagttggtgcatgaggttgtgatttatatactatatattgccacatcacgtaatcctgctaatgagactggcttattgtccacattgaatgaatttacaggtggtccatcattctacctttgagttgggtgaaacctttctggctctttctagtatctcatggtgcccatgcaattggcttaagagagagacggtggattgcagcaaaggtatttgcatgtgtagtactacgagaatctagttatcagacactagcttccttgcaattatcactgttttttttcttgaatggacaattattgatgaaggcttaactttatcaaactgttattgcaattgtttaacttagcgacaaagctatccatgatatgtgaaatacaatgagaatgaactagtggtgaaatctcggtaccttttgttgacagaggtagtaaatgtcaagtttgcccatcaaggaatgaacactgcacagtaggtttagtaaattagtagcaccgtttttattttatcttcaacactgctgatgcactgatatatctattatgcagttgagaatgccatgctttccttatgattatccagatagcaaagcgtatgcatcatacatgtccaaagaagctgctggttttgataaagtagttgagcgccgccctgttgccaagagaccaccaagagttcctgtgcctcctttatggcactgtatcatgacttgttttcgtaaagattatgatggcatattgggtgttcttgaagtagacgacttggtgcgggctaacatggtattacctaaaaactcttctgcacattgcgaatctggagacgcagaaccatcgcaagcaaatgttgcatccttgcaacttcatgtgccaagaaccacccaaatgttgagacagtatgtggaagaatttgataggaagtatctgagctcatcatctgacatgaaagtggattctgatgaacccaacctagcttctgataacactgtcggcatgacacggttcgcgagtgaattatgccttacaagggttctgatccgagctttcaaggaaggttcttttgaagagggtgcagttgtttgtgccccattacctgcagaactttcagcttggaaaatcaggtcaatatcctgtgcgtccgttttcttttattggttgatgtcaaaagagcatacaatacaagtccttgttcttgaattgaatgtaatcttgctttgagcatttgttaaacatctcgtcatgtaatctgtttcctgtagtatcctttccatggtggtagcaggaaacaaaatacatacatgtgtttaaagatactaatgggctcatttgatgcatggaacagatcaaaggaagaagaggaagaatgcgtagaaaaatgggagctccagcttcctcagtcccatgttagttcctatttctcgtggtttgatcccagcacgagcagcctccagttgcctacggatggcgtcgcacgggaggcgttcaggtggccgataggctttgtcaccagtggtttcatccatggaaggtactattccatctctcgtccccccttcccatccaaactatcgtctcgtctggtagtaactttggatttgttccagtaacgggcaagacgcagtggcggtcgcattctgcgaggcaaagcttctggcagcgttgaggcgacagcaatggacgcatggaaacttgcagagccgggaggtgtgcgtccttgtcaggaacgcgagatcggctgcctaccgacgagcgctggccccctccgtcctggagcatcaggaatcagacctagcgtttctgtagtctagtcgggaacctgttgacgttgattttttctctctctctcccgtttggaggtccatccatcctccgctcatccgttgatgaacctaagtaatttactggtgattacagtttatttgtgcgatgcaaaatcattaaacagaagaagtaaatgcatctatctcatttgacggatttcaatgatttactgttacatagtatgaataataataaagcagctcgtccggaaaaatgaatgagtagctgttgtttgaaggcccgcctgactgttactgctgacacacaatgacaatgggcacctggctgaccaccgaccggcgaggtcagtgtggggagcgtgaggctgttggcgggccccaccccccacgtgccaggtcaggtctggtcactactcactcttacgcggccatcagataggacacgtgctatccgatcctccgcacatggtgcctttcttcccttgcttttcgttttgtttttcaaaaaaaagttatatatattttgtttggtcttggtggcgggtcgcaaacagggacgaaagaaaagaaagattccgttttgcatgctttttaaaacggatactattttaaaacgggatagagtatatctttttgctgcctttttggttacttgcttgcttttgcattcaaacatcgcacacgtttacacttgtgaagcatcatttcacattcagcttacacgacttcacattcagcttacacgacttctttagcgccagtcttagcaaatgataacaagaccaaaggagaccttacagtttaagcaaagcaagagacagatcaaatcaaatattgtccaaaaccaatccaaaaaaagccaagcaaaatcgatcgatcaactctaacagctagttgaaatgtacaggcatatcccatttccattgccatccaaatccattccaagagaaggagctgagcgcctgagccgagctatggcggagcaatcatcgttgacgccgtcgtcggcgcggaagacgaggacgcgaggtcgtgcgtgagctggcccatggcgcgcacctgcatctccagtgcggcgacgtagtcggacacctcggccaggagcgcgggcagcgacaggctccggcaccctggcaccaaccgcgccagcaccttggccctgccagccagccctcccgccggccgctcgtcctgctgctgctgatgccgccgctgacggtgccttggcgtcgggggcggaggtcggcgcgcgcggaggagcgcccggcgccggcggctgcgtgccaggatggcgcggctccagcgcgaccggccccgcgccgccacggccagcgcgcggtaggccgcgtcgcgcaccgccggggcggaggcggggcaggtgggtgtgccagtgccgccgcgcacgaggcgcagcgcctggaggagcttggaggagtatgcctgctgcgcgcgcggcgtcagccagtgggacgacgggccctgctggtcgctgccgtcggatgcgcatgcggccgacgagcctcttttgcgtttgctgcgggcgccctcggcgtcagcggaggcagaggagggcatggtggccggcagagtgtgtgtgctttggttggtttttggacgtggaagaaaagccacgccgcggagacaaatttataaaggagacggactcaagacctcataataacagtacttatatgcttgcattaaaaatcataagaacgaaccatgagctaatcagatttaatatattcgtcttgctatttagtccttatacggggaaataattttatagtaattagattatatttaatacttttaactaccctaaaccccgtacaaacatctgatatactaggaataaaatttttagttacctagatcc

SEQ ID NO: 8610 - DNA, 2157 bp, Zea mays
gataatggtatgctgctgtcagttgtcacaggctcaccgagtcctggactcctggttgccggttcaccgtcggagcctaacgtcacgccacacgccacgcgcgggtaacacggccggcgcctgcacggcgcccgcggctccgcgcgctcgtcctacttgccatccgtcactggacgggccacgcgactgcgatccctgccgcacgagcgcaacgcgccatgggtccggcgtgccagtgagagcgggagaagctcggacatctccgggcaaaatctgctcccagtttctgcaattgcttgttttttttcgctgtgttttcagtggagggacatcttctccagcgattcagcgcgggatcctgctggactggcctgatccctccgtgctggtgtcggcgagcatgcaaggaaggatgcgaggcgcgcggcggagcgcgcgcggggaatcgtcccggaaggcggcgggccgcgaggtggagccattcacgctgtgcggcgagatgtcccatctcaccagggccacgtcagagccgtgccgcagggctcgcggcgccgccttcgcccgccgggcgaggcccttctcggcgtacgagctggtgtcggcgcgggaggccggccgcgcgggcggcgccgggttctccgcggccgatcgagcctacctcggcaggcagcacatccccaccaaggggccgtggggcgtcgacgacgtggaaagcgaggcctacgtctcgcagttctccgccgatggctcgttgctcatcgcggggtttcggggaagccgcatcagagtctacgacgccgagaaagggtggaagatccacaaggatataagctgcagaagtgtgcactggacggtttcagatattgctctctcacctgaccaacgattccttgcctatgcaagtctgacacctattgttcacattgtgaatgttcagaatgctggaaaggaatcacatgctaatattactgaaattcatgagggattggatttaaccggtggtgatgaggatgaggactttggaatattttctgttaaattctccaaagatggtaaagaagttgttgttgggaacaatgaaaagtcaatatatgtttatgacctttcagcaaataaagtgtcagcccgcatccgtgctcataaagctgatgtcaatgctgttaccttcgctgatgaaactggaaacgtgttgtactctggaagtgatgatagtctctgtaaggtgtgggacaggcgttgcctttcaggggaaaagtcagcaggtattttgacaggtcatttagatggagttacatttatcgatagccgtggtgatgggcgttatttcatctccaattgcaaggatcagagaatcaaactttgggacatcaggaaaatgtcttccgtcgtgagatctcggcccagtgagtctagtggactgggactataggtggatgccatttccatcagaagctcataatcttaagcatccaggtgatcagtctgtggccacatacagaggccattcagttctgcgaacacttatccgttgctatttctcccctgtgcacagcacgggtcagaggtacatatacacgggatccagtgacaagtctgtacatatttatgacgtggtaaccggggaggctgtcaagaggctttcgtggcatggctccatcatcagagactgcacctggcatccatactacccaacgctcgtcagctcctcctgggacggcttcgttgcccggtgggaggcctcgggcgacgacgacgaccattcggtgctcgtcgccgacgagatgagaggaagcccttactaccggagatacggcgatcccttggtgatgtagagatgtctgcaaagtggttaacaccaaatggtagtgagcatgtactttgctttgttgtttgggaattacaactgagcagcatgtacagtgccgtttggctcatgtggttgtatagccttacgataaataatatgtagggatacagaaagaacacatgagatcgaagcgactttataaatcctatggaatttatagaaacagacaagatcctctttccttgtttttaaaaactttataaatactttttcgaattaaaaacccacggccataccccgttgttggattcaaaaaaaaaaaaaaaaaaaaaaaaaaaaaaaaatccgta

SEQ ID NO: 8611 - DNA, 2025 bp, Zea mays
gcacgagaccattacctagaacatcctaatcgaaaagactcctagggtctagaaacaaaccatggagctgtgaccgctccgtgtccgaggagagcggcggcggcgcaaggagtcttcctctccgacgccagcaacgtcgacaccgctggcaagcttctctccggtttgatcctttctcatctgctctctgcccctctctctatctttctacgtccctgtccccctcagcaccgccgccgccgtcgcgccgcaacctcgccatggcacgccctccgtcggcggccatcaagccaccgtatccggccttccattcccatcccagcgatctcgagctcgtcaactcctatctccatccctgggtcgagaccggcgtcaagaccggcgcccctgcttgtcagttcacgggaccgtggccaccggcggcgggtgctggcacaacgaggcttgcttgttctctccataagctaggttcatcaccatcgatcacaatcctatagaggtcaatcaaggctgcttgcttggaattttgtttacttgggctacaggttcctaaactagaggtcaatcaagagagtcatggctactatctggtgatgaagcgcagattcaggagagcgctctgtcacttgcagatagccttgcgaggggccacgagaaatttcagctgggaaatcgttccctattttcaccgtcccagatcgttttgttcctttctcttctttcattttcttaggccttgaattttgtggcatgcgaatcatgtttagaagcatcgactaataaatatggaaaaggactaacctgtaggccatctatacatatgaggacttttacattttaagtttcgttttagctacagtatatttataatggtagagtagtgttcagcatgttcatcattgatgaataatattactctatgcagagtagatctatggtgctgaaacatccgagaacacacagctcatacttgcagtacagtgactaagtgacttgctgtcccgcctctagaacctttccctgacaaactgaaatggtttccccacacacctcgtgtagcatcagaaacgtaaatcccaactgtcacacatcaatctgatttttatcactaacagatctctttatttattttcagattgtccctgctccagtaagagtaggcgagacgagcctcccccatcttgggtgttggtgcctgacccattttctcaaggtactagccaaaacctaaagaaattgaattatatgaactacataactagttttagtaattaattttccttatgtctcttgatgctactttagttttgctatggatatgagcaatagagatcaccttaggaggagggaggaggatgatgatgacctcttccttttgattctcccttccctacatctcttgggctatattggacgtagtaaaaagaaaattgaggcatacatcagcgctgaccggggaggaaaaggttcgagagctacttgaaggtcatatcaagaactgcagggtatcatttagaatggaaccttacattttcaaatccttggcgaactatcttagaatggaaggattggttaaagatacaagaatcaaagttgaggaaaaacttggcttcttcctatacatgattagccacaatgcgacatttgaagatctccaagtcttttttggtcatagcaatgatacatttcaccgtgtcatcaaacatttcttcgacattgttatccctggtcttagcatgcggttcctaaagcctcctttcaatcaagttcatcctaaaattcatggagacaaccgattttatccatacttcaagaattgcataggttcaatagatggaacccatgttccagtatcaatgtcacctgatcaagccgcaccattcaggaatagaaaagggacccttagccaaaacgtgatggttgtgtgtgattttaaccttaacataacttatgtgtcagccggatgggaaggatcagcaacagattcaatggttcttagatctccaaaaaaaaaaaaaaaaggaa

SEQ ID NO: 8612 - DNA, 2587 bp, Zea mays
tctgccatggggactcacacataagagacagccctaggtgccaggaagaggcctgcgccggatttttgccaagattcgcacgctagtgatctcggcgagctgttgaacacgggcagaagaacacttccacgtgttcgacgcgctctgagcgcgccagagcacgcccgcgcccgaccccgcgcgccccgcgcctcgctgagccatgcccgtgtcccctgctcgcgcccgcgcctataaagcccccttaggcgtcgaccgtactcctctgcgcacgctcgacctcactggagcccgaaaccaccggcgtttgcctcgcgcacggcatgcccgcggccacccgagcccctgccaccgtagaccggccaacagagcccttcccagccatgcccgaccctcggaagagaccgtgcatgcctcggtgaagctccccaagcaaggaatcggactttgcttcgctggagaagtcagtccacgatcgccggatttcacccgatcgccggtgaacgtagaccgggtaaatctctgccccattcttcgattccttgcgcacatagcctctaagtcatcccgtggagctcatcatgccgtttaattgaactagatcgccgtggttcagccggaacacccgccgccgacgagatcacccgccctgtccacgtggaccggccgattccggccaccaccgcggtcgagccgtacaccgctgtgaccgccaggacctccagaacccaaccctgcccctcgccggacctctctcaccgccgataagccacgccgcccttttctttcccgcgggtactgtttgcatagggggagggacctcggggaagaagaaatagaagtcaggggggtttttgaactgtcagtgactcaggggaatagtggcgtaggggtagaaatgagtggattgatttagaatgaacccagggtcctcggtgtaaactggttttccaggaaacctttttaatatttctaatttaaatgcaaacagagcttgtaaaattcataacttcagttttattcaaccaaacttggtcaaacaaattttgcctgattctaaataatgtgaactacttaggaaaaatacaaaacccccttagtattgcaaaagaatttaaggtttggatttaaatattgatttggccaaaaaatctaaataatagaaggaaaaatagttacactgttagactgaggttaagaaaaatcaaggaagaacttgatcacttcctaacatgttcaaaaataataaacccctctgtacaccaagttaaggtagagtttaccatttaaatcatttttagcctgaagttagagaaaatattaaaggtggtttaaataaagaactagggagcacccacatttttgttagtttacttattcagtatagtttactagaaaaatttattatccccttgtttagtacagaagaaatgagataccttttattttaggaaaacaaggaaaacttagaagaaccatagaaaaataaccccaaggagaaaacaccccaaaccttgggataactaatgatttgttattatgaacataggaaaaatatgaaatctgttgtttgatattattcaaataacaagttagttataagcacctttttgacataaaactttagaaaaaccacaactaaataaccaccaaataaccttctatgatttttggcacagaagcatgttattacttctagataccagcaaaaatgacccttaggacagaacccacccctagttaagagttgtagtgcaaagtgaccctttgccccaacttttgttatttttgtccagggcatactctatttattctggacctcaaatttataggacagactacagtaaaaaatagtaacccactataatttttgcagaatttttagaaaaagttaaatcactgttgtagttcaaacccaccctagaattcataagtagaaaatgaaaaaggggaattaatagtggagattaatgtcaccctaacccaaccagcaaaactccttaaatgcctactaaaacatctattttttttttttttttcaatccactatgcttatccctaggcaaaacccaaacctaaagttgataagcataaaccactaagagccacgtataaccaggaaaccctaagtcactaactaacttagtttttcttcacttagcataatgattattaaatcatgcataatcttagcatacatattcttattcattgcattcgatatattgcaacctcgctgatggagagtacgtcctcgtgccggagcaaggagttgctcaggaggtagccccggatccagcaccagagcctgccctagaggatctgcctgccccagctttggaaggcaagccccggttttatgcataacctattctatatgatattttactacacttaatgtttgtgggggggaatgtgcacttaagtgtaggagttgattgaaaccctagttgcatgatctcatgaatcctgttgtgatggatactagtatgctaggtcgaatagttgctttactaattagggatctcggtagaagtcgagtgatttttctagcactcgcgcgaggtcaggaattggttgtatgcat

SEQ ID NO: 8613 - DNA, 1080 bp, Zea mays
ccggccatgactcctagggtctggaaacaaaccacggagctgtgatcgctccgtgtccgaggagagcggcggcggcgcaaggagtcttcctgtccgacgccggcaacgtcgacaccgctggcaaacttctctccgattgtccctgctccagtaagagtaggcgaggatgagcctcccccatcttgggtgttggtgcctgacccattttctcaagttttgctatggatatgagcaatagagatcaccttaggaggagggaggaggatgatgatgacctcttccttttcattctcccttccctacatctcttgggctatcttggacgtagtaaaaagaaattgaggcatacatcagcgctgaccggggaggaaaaggttcgagagctacttgaaggccatatcaagaactgcagggtatcatttagaatggaaccttacattttcaaatccttggcgaactatcttggaatggaaggattggttaaagatacaagaatcaaagttgaggaaaaacttggcttcttcctatacatgattagccacaatgcgacatttgaagatctccaagtcttttttggtcatagcaatgatacatttcaccgtgtcatcaaacatttcttcgacattgttatccctggccttagcatgcggttcctaaagcctccttccaatcaagttcatcctaaaattcatggagacaaccgattttatccatacttcaagaattgcataggttcaatagatggaacccatgttccagtatcaatgtcacccgatcaagccgcaccattcaggaataggttgggagtagttgtacttggttccctgcagctgacaggaaatattggtcatatggagacagttctgcacagcgttctgagtgccgatatgagctatatatatgttgcatttctccatgtttgggctcagcatgtaatagaactgaaggaaggttgttgtgagacttgtatggcatgcttaaatttctggataaaatctagcatataataagtctattacatgcttaaatttccaaaaaaaaaaaaaaaactatgtttatacgtcggggggccgggtaccc

SEQ ID NO: 8614 - DNA, 1844 bp, Zea mays
gaccgaggggagcggcggcggcagcgcaaggagtcttcctctccgacgccggcaacgtcgacaccgctggcaaacttctctccgattgtccctgctccagtaagagtaggcgaggacgagcctcccccatcttgggtgttggtgcctgacccattttctcaagatatgatgttcacaagaggttctcccaaaattttgatgttatctaaagctgctcaaaagaaggtttctcctaaagcttctacatcaaagaagtgtggaggtggtgttcagagagcagcatggaattctgaattggagaagagcctcgttgatttgttgtttgagcacaatgtacctccatatagggctcaaaatggctagagtccagatgcttggaacaaaattgttactgaattcaacaagaagcatgagtatgtcacattcaacaagattcaaattcaggagaaggagagggaattgaaaagggattacaagatgttgaaagaggctagaaagcaaagtggcgtttcctggaatgagaaacgatgcatgattgttgctgatccaccaatatgggaaaacatcataaaatcatttcctagggccaagaaatttcaaaagaagtctttccctctctttgatgctcttggggaactatatgatgggcacattgctcaagggacctagaacataacatctacacaactaccacaagaatggaacacaatttcaaatgaagaagaacaagtgaacaccacaagaatggatgaggaaggcattattcaacaacaaccacaagaagaggattcaagattggaacaagatgaagatcctatgattgaaaggactgaacagaggtctactgcaacgagaaggtctactgcatcaacaatcaatcaagataaggaagcaaagaggatgaagaaggattctttggaaggacttgttgggagatatctagatctgaaatcaaaacaagttgaggatgagattacacaaatggcgaaaggaaaagaatctgctcaaggtaatgacttctccatcatgagatgcatttctgttcttagatccatgaatgtgacagcagatgagaagataaaagcagctgaggtgttcgacataccaaacaacagagagacatttatcagttttagtgttgatgaaccagaaactgccctcctatggttaagacggaagattgataagctctaaggtaagtataatctatgatttcataccttgatgaactagaaactgccctcctatcagttttagtgttgcatggggatgaatgcaacgggggtactacatttgtattgcttgagagagactgaatcccatggttgggagtagttgtacttggttccctgtagctggtgagttctttgttgttgctgctgttaatcagcctccatttgtgctcactcaagaaaagtgtagcagcaacaacaacatgcgcttgcatattttgaggacccgatgtttattaattgatatgggttccctgctgtttttctttctgcataaatttcatttttttatctgttgatttctgcttttgattccttatttgaactttgcagacaggaaatattggtcatatggagacagttctgcacagcgttttgagtgccagtatgagctatatatatgttgcatttctccatgtttgggctcagcatgtaatagaaccgaaggaaggttgttgcgagacttgtatggcatgcttaaatttctggataaaatctagcatatactaagtctattacatgcttaaatttttgaaaaaatatgtatcgagaattggatggaatgcttaaatttctagataaaaaacaaatactggggggggatttctggag

SEQ ID NO: 8615 - DNA, 740 bp, Zea mays
  misc_feature (693)..(693): n is a, c, g, or t
gactcctatagggcgattgggtttctcgcccccgcccccgaggtgatagggggaaaaatcgggaagccttcggagaaaagaaaagggcaaccgagaccgtgagagaggggaagcggggagccttgtccgatccggtgcagcccgcgcgtcaaactcccggttaactgtggcatatgatcccaaaccttgatccacttgaagtgttcagtacattctgtagttggtttcaagatgacaagtaagaaaagtaacagatctacagtcacaccacacactgctctgcatatggaatgggacaggatttcttgccctatttgtatggagcaaccccacaatgctgttttacttatatgcagttcatacaagaatggctgcagatgttacatttgtaacacaagccatcgtcactctaattgccttgatcggttcagaaaaatgaatggtgatagtaaggtccgtgcttcacactcaacctattcggtgctttcaaactccaatatcagaactgtccaaccaagagctcactataatatgatttccagacgttcacggagcccaagactcggaagacatgttgataatgagggatcttatcataccgatgtaaacagtggcccaaatccagatgacatatctagatctgaatttgatttcgctaacccatcaagaatttgagaactcaacctttactgntgaaaggtggtattgtatcggggggaatgccatgatgcccatgcaag

SEQ ID NO: 8616 - DNA, 1658 bp, Zea mays
acagcgccagccgcccaccaccaacaatgccaaaatcccctccctctcttggtctttcctatatagccgcaggagagggcgggggatcggagcaggtgataggggggaaaatcgggaagccttcggagaaaagaaaagggcaaccgagaccgtgagagaggggaagcggggagccttgtccgatccggtgcagcccgcgcgtcaaactcccggataactgtggcatatgatcccaaatcttgatccacttgaagtgttcagtacattctgtagttggtttcaagatgacaagtaagaaaagtaacagatctacagtcacaccacacactgctctgcatatggaatgggacaggatttcttgccctatttgtatggagcaaccccacaatgctgttttacttatatgcagttcatacaagaatggctgcagatgttacatttgtaacacaagccatcgtcactctaattgccttgatcggttcagaaaaatgaatggtgatagtaagacgttcacggagcccaagactcggaagacatgttgataatgagggatcttatcataccgatgtaaacagtggcccaaatccagatgacatatctagatctgaatttgatttcgctaaccatcaagaatttgagaactcaaccttaactgttgaaggtggtattgtatcgggggaatgccatgatgccatgcaaagttctgctgaagttaagtgtcctctctgtagaggatctgtatctggctggattcctgctggagatgtgagacagtatctagacaataagttgagaacttgctctcatgaatcctgcaaatttactggaacctatgaacaactgcgtgaacatgctaggactgcacacgttcttacagagcctgctcatgtagatctgtccaggaaaagagcttgggatcgccttgagcgtgagcaggaggtcggtgatgtcattagtgcaatcaggtcccaggtacctggggcaataatagttggtgactatgttattgagactagagatgacatgtccccagacatagactctggcgacgatgaaagtagtgaatggtggtcagaccaagttgaatcaccagatgctagacttgatcccccaagggtttggccacatgaagccctagggtcacctagcatttggtcagatgaaaggcgtaatttggcaaggataccacagaacaacagagtaccacccaggttttcattaggcagtaggcgacccctgcattcaggttggcaggggggtcgtcggtcaagcacacggaatcgactgcaacggggcttctcaaatcaccactctggacaccgtagcaactatcgtggacatcgtcacttgcttctggataggtcctatgttggtacccgagattcaggctccggcaggagcctaaattcgtcagtggtgccaagcaggcggcagcggctgcggtacacgcacagaagccactactgatggaagcaatatcagttctacgtgtagagctttattggttaatccattcatgctatctttgtaaatatatgttaaggttatgtttttatttaatgtatttaatctgtctaaacaatctatcctagatgcaaaaagaactacattatttatcataaatgtcatttgtggtgtctctgcatttctttgatggt

SEQ ID NO: 8617 - DNA, 1427 bp, Zea mays
  misc_feature (708)..(708): n is a, c, g, or t
  misc_feature (713)..(713): n is a, c, g, or t
cattgggtacctcgaggccggccgggggccgcctcttgtcctcctcacctcccaaattgaaatcctcctccctccccgcctagggttccgcttcctcccccgtccgagcaccactcaagcggcggcagcagcggtggcagcctggaagcagtcccatctcgtcgccctagacttccctgccgccgcacgtctcagtttcttgttcgcccgctctcctgccggtccgcccatcgcctgaggttcttacggtgccacggagttggcaactgcaaggagtgatattgtggtacaacactagttctaattgaagtaataaggcgggggtgaaactgtctgctaccattgcttccatggcaactaatgagaacctcccgccaaatgtcatcaagcaattggctaaagaactgaagaaccttgatgagtcacctccagaagggattaatgtgattgtcaatgatgatgacttcactactatttttgctgacattgaaggccctgctggaactccatatgagaacggagtattcaggatgaagctattattgtcacgcgatttccctcaatctcccccaaaagctactagtggtgagatatgtgtaaacacactgaagaaggattggaatcctggccttggattaagacatgttcttctggttgtgagatgccttctgattgaaccatttcctgaatctgcacttaatgaacaangctgngaagatgttacttgaaaattatgaggaatatgcacggcatgcaaggttatacactggcatccatgccctgaaacctaagaatacgtccaagaccggagctatatctgagtcaaccacagctctgaatgtcgacaagtcaagtactacttctagcaagaacacaccatcgatgccaccggcggtatctagctccactgcatccagagcatttggtacgagtttgcaggatcagaaccccactgtttctgatcctgctgtaggagctgcggcggcgcgaaagaaggatggcccaatggcttccaaagttcctgtggataagaaaaagctggatgcgcggaagaagagcttgaagagattataggcggaacgtcctgtgaagaagagatttagatgcttatttattaagctgggagagaaacaattaggggaggagaggcatctgatgacctggctttcgggagaaggggtccggggcggggccaaaggtgaataatgtgaagtgtgaactgggtccttcgggacaactgtatgtgcaatgcccaatcatttggaagaacacttgcctatttctttttgttgtctctccttgtctgcattcaatcagcatgcatgcctgccattcaatcgttcttcaagtgcccagagatagggttgtttagactcttttcaagttgtccaagctatgaattgaaagtggccttcaatgcgcagagt

SEQ ID NO: 8618 - DNA, 1523 bp, Zea mays
gacagtcccacttccggtaataaatacggcaactgaaaaaacgagagagtcgttcgttttcatccctaccggccgcctcttctcctctccacctctcaatttcccaaattgaatcctcctcctcctcctcctcctccccgcctagggttccgattccgcaccgtccgagaaccacccaagcggcggcaactgtcccttctcgtcggccaccgccgcacaactcagttgcttgttcagccgctccgctgccgacccgcctatcgcctgaggttcttacggtgccacggagttgcaactgcacaaaggccttttgtggtcacaaagggtgctattgtgttacaacaacagttctagttgaagtaataagacattttttaaactgtctgctacattgcttccatggcaaccaatgagaacctcccaccaaatgtcatcaggcaattggctaaagaactgaagaatcttaatgagtcacctgcagaaggaattaatgtgactgtcaatgatgatgacttcactactatttttgctgatattgaaggccctgctggaactccatatgagaatggagtgttcaggatgaagctattattgtctcatgattttcctcaatctcccccaaaaggattcttcttgacaaaaattttccatccaaacatagctactagtggtgagatatgtgtaaacacactgaagaaggattggaatcctagccttggattaagacatgttcttctggtagtgagatgccttctggtcgaaccatttcctgaatctgcacttaatgaacaagctgggaagatgctactcgaaaattatgaggaatatgcacggcatgcaaggttatacactggcatccatgccctcaagaataagtccaagactggagctatatctgagtcgaccacagctctgaatgtcgacaagtcaagcactgctcccaacgagaacgcaccatcgatgccaccggcaatacctacctccgctgcatccagagcacttggcacaaatttgcaggatcagagccctactgtatctgatcctactgtaggagcggcggcggcggcggcggcacgaaggaaggatggcccaatgccttccaaagtacctgttgataggaaaaagatggatgcacggaagaagagcttgaagagattataggcggaaccttcatagtccagcatttaaatctgtcggaaatttagcagatgcctagcgaagctgggagagagacaattagttgggaggcatctgatgacctggcttccgggaggtaggggtcctgggctgggacaaaagtgaataatgtggcctgggtgagtccttcgggacaactgtatgtgcaatgtccaatcatttggaagaacacctgcctatttccttctgtcctctgttttttgttagcttagcggtagtgttagctagctcataggggcaattccctgtctagccatgggctgctgctccgtactctgcttgaataataatttgtccgtgcaattacagctaaaaaaaaaaaaaaa

SEQ ID NO: 8619 - DNA, 1931 bp, Zea mays
  misc_feature (34)..(40): n is a, c, g, or t
attgggacctcgagccggccgggaaaaaaattcnnnnnnnaaaaaaaaaaaaaaaaaaaaagttggttctcatcaaagctcgcaactacttcctcccctcccatccccttccttcccttccggccgcctcttgtcctcctcacctcccaaattgaaatcctcctccctccctccccgcctagggttccgcttcctcccccgtccgagcaccactcaggcagcggtggcagcctggaagcagtcccatctcgtcgccctagacttccctgccgccgcacgtctcagtttcttgttcggccgctctcctgccggtccgcccatcgcctgaggttcttacggtgccacggagttggcaactgcaaggagtgatattgtggtacaacactagttctaattgaagtaataaggcggggttgaaactgtctgctaccattgcttccatggcaactaatgagaacctcccgccaaatgtcatcaagcaattggctaaagaactgaagaaccttgatgagtcacctccagaagggattaatgtgattgtcaatgatgatgacttcactactatttttgctgacattgaaggccctgctggaactccatatgagaacggagtattcaggatgaagctattattgtcacgcgatttccctcaatctcccccaaaagggttcttcttgactaaaattttccatcctaacatagctactagtggtgagatatgtgtaaacacactgaagaaggattggaatcctggccttggattaagacatgttcttctggttgtgagatgccttctgattgaaccatttcctgaatctgcacttaatgaacaagctgggaagatgttacttgaaaattatgaggaatatgcacgacatgcaaggttatacactggcatccatgcccttaaacctaagaatacgtccaagaccggagctatatctgagtcaaccacagctctgaatgtcgacaagtcaagtactgcctctagcaagaacacaccatcgatgccaccggcggtatctacctccagtgcatccagagcatttggtacgagtttgcaggatcagaaccccactgtttctgatcctgctgtaggagctgcggcggcacgaaagaaggatggcccaatggcttccaaagttcctgtggataagaaaaggctggatgcgcggaagaagagcttgaagagattataggcggaacgtcctgggaagaagagagagggtttagagttcagaatttttatcggaaactcagcagatgcttatttaagctgggagacaaacaattaggggaggagaggcatctgatgacctggctttcgggagaagggggtccggggcggggccaaaggtgaataatgtgaagcaactgagtccttcgggacaactgtatgtgcaatgcccaatcatttggaagaacacttgcctatttcttttaaaaaaaaaaaaaaggccaaaaaaaaaaaaaaaagcggccgctttttttttttttttttttacttaacaggtaggtcgatattagcagcaaataaagctccatcataataggttcacaaaacgactgactgatttgtcttagcacaaaactctggatatagctagaaaccacgatagatggcctactgaagtgcaggtttccaagacgagccattggacccatggcaaacggtgacgacgaactaggatgtgacatctctccatgaactcacgcatcgaagaaacgtaacacaactatgccgacaccaccatccacaatccccatcagcctacttggatctctgcctcatctttcggcgcttcctcttcagcctcctcatgcgcttcttcttccacttggccctcatagtcgcctccttgcgggcactccttgacgcgtctcctgctgctgcgtcggcggcgagtcaccccggccggcctcgagggtcc

SEQ ID NO: 8620 - DNA, 5121 bp, Zea mays
  misc_feature (825)..(825): n is a, c, g, or t
  misc_feature (1718)..(1718): n is a, c, g, or t
  misc_feature (5049)..(5050): n is a, c, g, or t
  misc_feature (5060)..(5060): n is a, c, g, or t
  misc_feature (5083)..(5083): n is a, c, g, or t
cttctaccgaaaattcggttaagcggttgcctagtcctactattcaccccttgtctacacccttgctagatattatatcaccatcaaggtcccaaacttaacttgggtgtcatcactagtctaaaagaacatttgttccagagaggaaatgaggagttaattggtatggatgtacccaatagtcaataatggctagtgctaatataatagtgacatagcagccacggtcaattgtacgacggtgtgcataatggatatttgttgttgcaactgctagttcactccttaggctataaataggacccccaaagcagccatttgtgatgtgtgtgagctaaggaacatcacaatagagttggggctcatctcttgtagctctagatacccaagtgcttaataaatcactcagtggttagcacaagtgctttgtgaagttcttaggttagttagaccattattgttagcacttgctctaggttttccttagtgattagaagtggggaatatagacctctaccccttggtgcttgcacacaccatttaattgagttttatccagtgagaagtgtaagtcttgtgagatcacacaactgtgtttatggtgcgaccaccatcgtgtactatagagaatgaagctcatggtgtttaggatagaaacttgattatggagatggtagggagcatcctagagaggccatatgaaagtagcctagagggggtgaataggctaaacctaaaattttcaataaaaaacttcaaaacagagtgagaatactagttcaaccattgcgggccagttcaacaactactaggggcacttgaacnactttgaaccggttcaactgcaaagttgccactaaattctagtctaacaccaagattgatgacagaagcttcaattgaacatattcttaagataatcgaggcataaagttagtggatatgagtgaagtgactccacaagatccacacacacaaagttatgccacaaatgtgccctacttccttgttgagtagcctacaaaaggccaggttttttccaaccctaatcctcccttgtccgactacaaaggtcaaggcataatttcttactcaagtatgctcagagagcaggtaatatacaaagttcttgaggtcgtccacaactttggagattctcaagcgatttcaaaccgtctaggagcacatagttccaaggacaacaaatccacccaaattgatgtttgcaaagagcttaagctagagaaagggagagagaggggagtgaaatcaatgctcaagaccaacaaactcaacttcacaccaagggatcctcaattcaacttgagtggatgagagttggggtgtgagggtgagagagagaggagtgaatgcctttgtctcgagttaggtcaacagtaaatggcgtaagtgcggagagagagagagatgagggctatatatgtggggctctccatagatctgacatttgaaaatttatgcgcaaagtgtagttgaaccacatagaaaaccttattgaaccagtattttccaaaggtgatctcggttcaactcctagttgaaccggcacctcaaccaccctaaccctggttgaaccacccctagaggctagtttagccaatttttaccagagcgcaacctagcaaaatcctagttgaaccgaccctgagggccggttcaatcggtattttctagagatatctctcgaccaatctcgngaaccgcccctaggggatggttgaaacaatattttctagagagcatctcaaaccagcgaactctagaaggttgaactttgcacatcacggtccaaagaccaagtttcaaaaatagattttgaagtagagatttttaagcaaattgcaaacattgttacctctttgcgaattcctctaagaaacatgacgattcctatgactcaaatgaaattaaaaataaagtcttgatcgcttggaaccacgtagggtaaatgaatctctattgaaagaactgcatgattctattgaattacatgctccaagttttattcaatatgatctcgtgtacttcattggatcttacgataactgagtacatacttgaagcatacttattagaagctttatttgttttgtcattctatcagcaaaatcatcaagaggttgattgcacttacaccataattggagcaccaattgcacgaggagaagcctcatggttatccttggtgttacctgtctgagaggttagcccttgtggcttcaacaagggattagggggaggttgaccatatgttggggtcacactgtcttacacaatgttgacttgatttgattacatccaattgcatatcatgcaacctccctattacaactagtacatgaaaatccccccaatattttccatctatgaaagtttagtttcattacaaacgtacagatctcaatacatcgtacaattatggtccctcttgcgaattggggaaaattttgggatattaatatctatctatcataaaatcattagagtccctcatagggagacctactccgcctttggtgtgtatattgtatcttcaatgaagatctgttcgttagcattaacgggagaactcaaaaccacaaaaattgctagggaatcaattgggatgctacagacatctccatccctgatccacatactctagaaacggaacttcaagttcagaaactcattaatttgcaacacactacaaacaacatgtcatatgcatttactaattataaggctgttacaaaatcctacaatttcacgagaaatgtgtcgaaaagagcagaggtatcaaataaaactactcaagtcacaagtaagagggagagaaatacaattatttccacggatgcagcttctatctagcaaagaaaatagaagaacaaaatcttctaacccagtaaatgcaactcaaccctatggaggttcaactttcacatcccatatcaacagtgcactcaattactgacattgggacatcgaaatacccagatgcaatcattttgggatatgatgatgcataaaaaatggcacataaaattccatcaattagttcaagtctagagaatcatatgacgaaagaatacaattgtggccatttattctttgcaatgattgtagaggtccttcaaaattatctagagaacaataaaaactcattttactgtttctgtatctcttttactttcctagataattgcaacaaaattaaagccacgacatgctaaagcaggaaaactgtacatagatgattagagattttttttcttatattcactatgcgctagacagggctataaaaatataggataaaattttaggagtttctaatatcataggttcagattccctctttcattcagaaaaaaagaaaaattcaggctacggtcagggtcagcgctagatcgctcttcgtcatttcaattttgcaggccttgcgacttgcgaggccccccacgacggacaagtgaacgcagattcgttccccaacggctacgacgcaaagtaccaaacccaaacggcaggcgcgtcggtgcacgggcgcccacgtgggcctgcgccatccgcgccgcaccgggtctggggcccgcccggactcaacggtcggatctctcgtccctatcatgcaccgctccgctttcggacagcagttggttctcatcaaagctcgcaactacttcctcccctccccttccttcccttccggccgcctcttgtcctcctcacctcccaaattgaaatcctcctccctccccgcctagggttccgcttcctcccccgtccgagcaccactcaagcggcggcagcagcggtggcagcctggaagcagtcccatctcgtcgccctagacttccctgccgccgcacgtctcagtttcttgttcgcccgctctcctgccggtccgcccatcgcctgaggttcttacggtgccacggagttggcaactgcaaggagtgatattgtggtacaacactagttctaattgaagtaataaggcgggggtgaaactgtctgctaccattgcttccatggcaactaatgagaacctcccgccaaatgtcatcaagcaattggctaaagaactgaagaaccttgatgagtcacctccagaagggattaatgtgattgtcaatgatgatgacttcactactatttttgctgacattgaaggccctgctggaactccatatgagaacggagtattcaggatgaagctattattgtcacgcgatttccctcaatctcccccaaaagggttcttcttgactaaaattttccatcctaacatagctactagtggtgagatatgtgtaaacacactgaagaaggattggaatcctggccttggattaagacatgttcttctggttgtgagatgccttctgattgaaccatttcctgaatctgcacttaatgaacaagctgggaagatgttacttgaaaattatgaggaatatgcacgacatgcaaggttatacactggcatccatgcccttaaacctaagaatacgtccaagaccggagctatatctgagtcaaccacagctctgaatgtcgacaagtcaagtactgcctctagcaagaacacaccatcgatgccaccggcggtatctacctccagtgcatccagagcatttggtacgagtttgcaggatcagaaccccactgtttctgatcctgctgtaggagctgcggcggcacgaaagaaggatggcccaatggcttccaaagttcctgtggataagaaaaagctggatgcgcggaagaagagcttgaagagattataggcggaacgtcctgggaagaagagagagggtttagagttcagaatttttatcggaaactcagcagatgcttatttaagctgggagacaaacaattaggggaggagaggcatctgatgacctggctttcgggagaagaaggggtccggggcggggccaaaggtgaataatgtgaagtgagaactgggtccttcgggacaactgtatgtgcaatgcccaatggaagaacacttgcctatttctttttgttgtcaannaaaaaaaaanaaaaaaaaaaaaaaaaaaaaaanaaaaaaaaaaaaaatttttaaaaaaaaaaaaagggcgg

SEQ ID NO: 8621 - DNA, 1524 bp, Zea mays
ccggcggtcgttttcatccctaccggccgcctcttctcctctccgacctctcaatttcccaaattgaatcctcctcctccccgcctagggttccgattccgcaccgtccgagaaccacccaagcggcggcaactgtcccttctcgtcggccaccgccgcacaactcagttgcttgttcagccgctccgctgccgacccgcctatcgcctgaggttcttacggtgccacggagttgcaactgcacaaaggccttttgtggtcacaaagggtgctattgtgttacaacaacagttctagttgaagtaataagacattttttaaactgtctgctacattgcttccatggcaaccaatgagaacctcccaccaaatgtcatcaggcaattggctaaagaactgaagaatcttaatgagtcacctgcagaaggaattaatgtgactgtcaatgatgatgacttcactactatttttgctgatattgaaggccctgctggaactccatatgagaatggagtgttcaggatgaagctattattgtctcatgatttccctcaatctcccccaaaaggattcttcttgacaaaaattttccatccaaacatagctactagtggtgagatatgtgtaaacacactgaagaaggattggaatcctagccttggattaagacatgttcttctggtagtgagatgccttctggtcgaaccatttcctgaatctgcacttaatgaacaagctgggaagatgctactcgaaaattatgaggaatatgcacggcatgcaaggttatacactggcatccatgccctcaagaataagtccaagactggagctatatctgagtcgaccacagctctgaatgtcgacaagtcaagcactgctcccaacgagaacgcaccatcgatgccaccggcaatacctacctccgctgcatccagagcacttggcacaaatttgcaggatcagagccctactgtatctgatcctactgtaggagcggcggcggcggcggcggcacgaaggaaggatggcccaatgccttccaaagtcaaagtacctgttgataggaaaaagatggatgcacggaagaagagcttgaagagattataggcggaaccttcctgggaagaagaggagggttcatagtccagcatttaaatctgtcggaaatttagcagttgcctagcgaagctgggagagagacaattagttgggaggcatctgatgacctggcttccgggagtaggggtcctgggctgggacaaaagtgaataatgtggcctgggtgggtcgggtccttcgggacaactttatgtgcaatgtccaatcatttggaagaacacctgcctatttccttctgtcctctgtattttgttagcttagcggtagtgttagctagctcataggggcaattccctgtctagccatgccatgggctgctgctccgtactctgcttgaataataatttgtccgtgcaattacagctattgttttgtttggaggaatagttgcctttttctgtt

SEQ ID NO: 8622 - DNA, 1037 bp, Zea mays
aaactgtcccgtaggagacgtgttttgcttggttttcttcatgccgctgctcatcttacttcggcagtgctactgatgctacttatggaattagctattgaaatctgcattcggaaccatctattagcaacatcaggttaccataccctttatgaatggtaccgaaaagtggaaagcgaacattttcctgatcccacaggacttcgcgctcgtctcgagcattggacctttggactttaccctgcatgtattaagtacctcatgtctgcattcgacatcccagaggttatggcagtaactagaagtacaatctgcaaaaaaggaatagagtcccttcccaggggaggtgccatcatctattatgtctgtgttttcctgtacttctgggtcttgtcaacacctgtcgtatcgctggtgtttgggagctacttatatttatgcataaactggttccatatccatttcgatgaggccttctcctcgctgcgcatagcaaactataaggcattcacacggctccacatcaagaaaaacggagaccttgaggtcttcaccctggctgtggacaaggtgccaaaggattggatgctggatccagactgggacatggaacccaagcagccattccagatgagctacaccaggaaattcccaagcaaatggagggctgcgtcgggccttgacccaatcaatgctgtgcgcattgttgaccggtttgtcatcccgcgaacgccctcaagtcctacaacaccaggaggctctgtttcaagtcctacaacaccaggaggctccgtttcaagtcctacaacaccaggaggctttatgagatgatgttcatgctgctgtgaaatataatgtaatgtacacaaggatatcttcgacttctcgggagaaattgtacagtacacaaggtcctctaacataccacgggagaaatagttgggaaaaaaaatagagggcaaatctccacaagatccaaatgttgtacatctggtgttatatcagttgtcctgatcaggtgtaatgataagtttttc

SEQ ID NO: 8623 - DNA, 2293 bp, Zea mays
  misc_feature (2)..(2): n is a, c, g, or t
  misc_feature (4)..(5): n is a, c, g, or t
  misc_feature (14)..(14): n is a, c, g, or t
gngnnaaattgaanaaaccagttgaaaccagattttgaggacatggttccctggtactctgggacatcaactgatttatttaaaactgtctttgacctcatgatatctgtgactctgtttgttggtcgatttgacatgcgtatgatgcaggctgctatgaataaaactcctgatgaagctaacagccatgaccttttgtatgatcatcttgatggaaaagatgagctttggtttgacttcattgcagatactggtgatggtggcaactctacatatgctgtagcacgattacttgctcaacccttgttagttataaactctgatgactcgaggctaacatttcctcgtgggcaactgcttctcgttggtggtgaccttgcgtatcccaatccatcctcattttcgtatgaacgacgttttttctgtccttttgagtacgctctccagcctcctgcttggtataagcctgaacatatagcactggagaagcctgaacttccccttggggtttctgagctcaggcggtacagaggaccacagtgtttcatgatacccggaaaccatgattggttcgatggattaaacacattcataaggtatatctgtcataagagttgggtgggtgggtggttcctacctcagaagaagagttattttgcattgaagcttcccaatggatggtgggtttttggtcttgaccaagctcttcatggcgacattgatgtttaccagttcaagttttttgctgagttgtgtcaacagaaggtcagagaaagtgattccgtaattattataactcatgaaccaaattggctccttgattggtattggggtgatagcactggcacaaatgttgcatatttgatacgggagtaccttaggggaagatgcaaactgcggatggctggggacctgcaccattatatgcgacattcttgcattgagtcaaaagaaccagttcatgtacaacacttactcgtaaatggctgtggtggggcctttttgcatccaacacatgtctttgaaaacttcagggtattttatgggaacaagtatgaaacaaaagctacatatccttcttaccacgattctagcaagattgcacttggtaatattttgaagttccgaaggaaaaattggcaatttgatgtaattggtggttttgtgtactttgtcttggttttctcaatgtttccacagtgtgactcatttcacatcttacatgaagactcctgggctggtcgtctcaatggtttcttcactgcaatgtggaatgctgtttttgagattctagagagatcttatgtgtccctaggtggtgttgttactctattgatggtatcatttttctttgtacccacgaaactgtcccgtaggagacgtgttttgcttggttttcttcatgccgctgctcatcttacttcggcagtgctactgatgctacttatggaattagctattgaaatctgcattcggaaccatctattagcaacatcaggttaccataccctttatgaatggtaccgaaaagtggaaagcgaacattttcctgatcccacaggacttcgcgctcgtcttgagcattggacctttggactttaccctgcatgtattaagtacctcatgtctgcatttgacatcccagaggttatggcagtaactagaagtacaatctgcaaaaaaggaatagagtcccttcccaggggaggtgccatcatctattatgtctgtgttttcctgtacttctgggtcttgtcaacacctgtcgtatcgctggtgtttgggagctacttatatttatgcataaactggttccatatccatttcgatgaggccttctcctcgctgcgcatagcaaactataaggcattcacacggctccacatcaagaaaaacggagaccttgaggtcttcaccctggctgtggacaaggtgccaaaggattggatgctggatccagactgggacatggaacccaagcagccattccagatgagctacacccggaaattcccaagcaaatggagggctgcgtcgggccttgacccaatcaatgctgtgcgcattgttgaccggtttgtcatcccgcgaacgccctcaagtcctacaacaccaggaggctctgtttcaagtcctacaacaccaggaggctttgtgagatgatgttcatgctgctgtgaaatataatgtaatgtacacaaggatatcttcgactcctcgggagaaattgtacagtacacaaggtcctctaacataccacgggagaaatagttgggtaaaaaaaaaaaaaaaa

SEQ ID NO: 8624 - DNA, 1491 bp, Zea mays
ccacgcgtccgcgcttcttgcgtgtgcgccccgaggcccgcggcggcgtgtgtcactttcccacctcccgtcgtcactccaccgccgtccccttgagcgctcgccccaacctggggacgctcgccccagccgatccgatccgtctcaactccattaaaaaaatctctcctttccccctccctatccaggaaaaggagaaggtaccacctcggtcgatcttccctccatttactcctccgggcgaggtcccgattcgatcgaaggcggcggagagagatgaggaagcgtgagcgagagaacccgtgcgggatctgcgggcactaccacaagtacgaggagggggaggtgtgcggcgtctgcggtcaccgcccacctgcagcgtcaccagtaggggccaggcagcaagactcggcgttcccgtccgagatcctcaaggagttcctcttcctcggcagctacgacaacgcctcccgctcggagctcctcaagaccatcggcgtctcgcacatcctcaatactgtacctttgtgccaaaacctttaccggaattcattcacttatcactgccttcaagaggacaagactctgcagtttgatgatgcaaaccagtttctagagcaatgtgagagggagaaagcacgagtcctagtccattgcatgtctgggaaaagtagatcggcagcttttgtaatagccttcttgatgaagtcgagaggttggagattggcacaatcttttcagtgggtgaaagagcggagaccacaagtgcaactgtctgatgcagcacagcagcagctgattgagtatgaaaagaagctttttggttctaatgatggcagcataccagctcaaccttttgctccagtggattcgctcccttctcttggatttggttttccaaaaccaccaggcgacatccaagcgcctacctttaatcagcaggctccagcatctatctttgagcgcgttaccccgaacagcttccctagtaatttcatattcggagccgaaagaactagtgatagtgatgcgaaacttccagatagcaacaatttcggcgtggtaaactcgtctgggagtgatagcatgatggacagctcctaggatggttttgccttcaccaaggctatctccagcagcttaatcctcaattcctcatctctcgtttcaaatttcacttccactcttgtacaactatagcctgatatacaaaagaaatgactcagtcgcaaatttagtcaggtttctcgggatgtttttttatttctgagaaggaaacgcatttttgtaatagtatgttgtaatatttgccagtattactaaattgctgctgtgcattttaacaatcatgagtgtgcttttttatgtaacttttctagggtaattcacgataacaaattacgctggaaagtttgaataaaaggttacacatgtgcttgttaagatgtacagatttgtgggctaaaaggaaaaaaaaaaaaaaaaaaaaag

SEQ ID NO: 8625 - DNA, 1835 bp, Zea mays
agtgtaagcgtctaacgattcatgtttctctacggactccgtgcttggacccgcctcttgcgtgtgcggtcggaaactcggaacggcgtgtgtcactttcccacctcccgtcgtcgctccaccgccgtccccttgagcgctcgccccaacctggggacgctcgccccagccgatccgatccgtctcaactccattaaaaaaaatctctcctttccccctccctatccaggaaaaggagaagcacctcggtcgatcttccctccatttactcatccgggcgtcccgattcgatcgaaggcggcggagagagatgaggaagcgtgagcgagagaacccgtgcgggatctgcgggcactaccacaagtacgaggagggggaggtgtgcggcgtctgcggtcaccgcccacctgcagcttcaccagtaggggcgaggcagcaagactcggcgttcccgtccgagatcctcaaggagttcctcttcctcggcagctacgacaacgcctcccgctcggagctcctcaagaccatcggcgtctcgcacatcctcaatactgtacctttgtgccaaaatctttaccggaattcattcacttatcactgccttcaagaggacaagactctgcagtttgatgatgcaaaccagtttctagagcaatgtgagagggagaaagcacgagtcctagtccattgcatgtctgggaaaagtagatcagcagcttttgtaatagccttcttgatgaagtcgagaggttggagattggcacaatcttttcagtgggtgaaagagcggagaccacaagtgcaactgtctgatgcggcacagcagcagctgattgagtatgaaaataagctttttggttctaatgatggcagcataccagctcaaccttttgctccggtggattcgctcccttctcttggatttggttttccaaaaccaccaggcgacatccaagcgcctacctttaatcagcaggctccagcatctatctttgagcgcgttaccccgaacagcttccctagtaatttcatattcggagccgaaagaactagtgatgcgaaacttccagatagcaacaatttcggtgtggtaaactcgtcgactgggagtgatagcatgatggacagctcctaggatggttttgccttcacggaggctatctccagcagcttaatcctcaactcctcatctcgtttcaaatttcacttccactcttgtacaactatagcctgatatacaaaagaaatgtctcagtcgcaaatttagtcaggtttctcgggatgtttttttttatttctgagaaggaaacgcatttttgtaatagtatgttgtaatatttgccagtattactaaattgctgctgtgcattttaacaatcatgagtgtgcttttttatgtaacttttctagggtaattcacgataacaacttacgctggaaagtttgaatcaaaggttacacatgtgcttgttaagatgtacagatttgtgggctcggaaaatgtaattcacgataacaatcatgagtgtgcttgctcgctgctcgggcgctccagtcgcgaccaccccctcccccggctgtattcgcgacgactcggcttgctgcccctcgccccttcctccctgctccatggattagcatccgcacatcaggaaggtcttgaggaagctacgactgacactgaagaggcttcttgtggttgaaccctttgtcacctacgggtaatataacagcaacattccacaaggctatgatcggttatcttgttcttttttagtatcacgtttttttgtattcatcattgctcctgggagcatgttcaacagcagggacat

SEQ ID NO: 8626 - DNA, 1688 bp, Zea mays
ttgcttcgctgagtggcgtcaacttcactcaccgaatcttaagcgtagcctgggcccctcgtgccggcgcgtgcgccaagcgagcagactactggagagtctttcaccatttcgtttttcgttcagtctgcctgaaagctctgcccccttcgttgccgcttgcccgcttgtctatataaagctggaagctctgctcctcccgccatcccacatccatctccacctccctcatacaacgccgcgcgtgccctagtggtagcaccaattgcgggcctgtggcaacagtgatggccaatgccactgtccccgagttgcagccgcaggttcaagcggcgggtggccgcaaggtggtggacgaggtgtccggctggctgcgcgttctggacgacggcagcgtcgaccgcacgtggaccggcccacccgaggtcctcccgatgatgcagcccgtggcgccgtacgacgtgccccgcgacgggcacacgctgcacgacctcccaggggagcccaatttccggatctacctccccgaggtcgacgacgaccgcaagggcgggcgcctgcccgtcatcgtgcacttccacggcggcggcttctgcttctcccacccgtcctggctcatgtaccaccagttctactcgcgtctcgcgtgcgccgtccctgccgtggtcgtctctgtcgagctcccgctcgcgcccgagcgacgcctgccagcgcacatcgacacggccgtcgccgcggtccgccggctccgctgcatcgcgctgtcggaggacggagctcttggtgacaaggcaggtaagctcctccgtgaggccgccgacgtctcccgggtgttcctcgtcggcgacagctctggcgcgaacgtcagccacttcaccgccgcgcgtgtgggccaggacggcgctggcgtctgggcgcccctgcgcgtcgccggctgcgttctgatccaaccgggattcgtgcgcgcaacaaggagccggtcggagctggaggtgggagagtcggtgttcttcacgctggacatgctggacaagtgccaggccatggcgctgcctgttggcgccaccaaggagcacccgttctcgtgccccatgggtccgcaggcgccgcccctggagtccgtgccgctcccgccgatgatggtggccgtcggcgagaaggacctcgtccgcgacacaaaggagcacccttgcaagcatttagggggtgtttggtttgaagaattaattcattttagatgatgcgatgcatcatgagtttattccacaaattatataagtttggtttgaaataaaaaaaaaaaaaaaatccgaggtatcactttctattgatgatcttgtcgctgaggtagatgagctggtggctaatttggcgagtcgcgacaagttacttaggcttgttgcttgtgagaggaaagaattcaagagcaagtatgagagcaagcttagggagcttgagtctgctagagcttctattgtggtcttcgacgagactgaatgtgatggttgtgcccttcacatgtcgaacatcgccacattgtagaccaagtacgccaccctgctagatgagtgcgacgagcttcaatctaggtctaacttcttggggtgcgtgtcatacttgtcctgccttgcagactgagctagcagagaagatcgctaggatagccttgtgagaaagctagcttaggg

SEQ ID NO: 8627 - DNA, 892 bp, Zea mays
  misc_feature (877)..(877): n is a, c, g, or t
atccatatgcactagcagtatcacctcatttaatatgcggccggcatcgtcgccagagctctcgataaggctcgccagagctctcatctcatacgccggagtgctccagagagcagggctgaagaggtgcggcaagagctgcaggctgaggtacaccaactatcgcgcgctgatctgggcgacgaactgcgtgcgcgtttgcaggtggtccctgatcgcgaagcagctgccggggcggacgggcaacgacgtgaggaaccgttggaacacgaaactgagagcaagcagctgcggcagcgcgggatcgaccccaccgcccccatcgccggcctcatgcacatcttcgtcggcgccctctccttacggcgacgacggcacgggaacgacgacggcacgggagagatcatcgacgccaccctggactgcgacaagaagacacgggtggaccagctcatcgcctagctgctggccgacccggcctactacgctggctcctcctccgagatgggctggatcatgggcttgatgaatgctgattaattagcggttatacaatggatccatgaggctaaagcaaactgactgaaatagtcactttagaggctaaagtttcaaacataaagaactaaaagggactaaaatgttttagctcctttagcttgtaaggacgagttaaactcgactaaaacagctggtcccacacccacacaaaaaaaaaaaaaatgctgctgcacccgcgctaactgccttttccacaaatcaatgcctggtccccacactagcatttatgatttaatgactgctttagtcacttgttccaaacacgagtaactaaattttagtcagtcacttttaggactggacaaaaaactcgtangctcgtactcgctcg

SEQ ID NO: 8628 - DNA, 3112 bp, Zea mays
gcatctgtgggggttctccagggtccaaacttggttacggagtgaagttgtttagttcttcatgcatggcgttcacctagtccagatcctatagcgcctcatctatacatgtaggctcaacacaagaaacaaaggagtgatgttcaataaaagaagcatgtctatatgatcgagtaataaccccttgtgaaggactcctaatgatgtggtcttttgggtgtgcttgaagtagtgatgagtttctccctgtcaaccacttgggaagaagatcctagagcatcaacatcttcggcttgtacccttacttgatcatgagagacaaatgtatcttcatttgcatgcctctcatctttttcatcatcttgtggtacacttgatgaagatggtctgtcaatgttttgcacctcttcatcttcttttggtttgatagctccaattgtcatgttcttcattgcttccctaagtggctcatcacctacatcatcaagattttcaagtgctccttgggagccattagtctcatcaaattccacatcatatgtttcttctaccacgccagtggcatgggtggatactcgatatgctttggacttcgatgaataacccaatagaaaaccaatatcacaacgtctttgaaacttccctaggtgatggcgtttcttgtagatgtagcatttgcacccaaacacccggaagaaggagacgtctggctttttcccatttagcagttcatagggagtcttcgcaagtagccggtgagggaatagcctgtttgatgcataacatgcagtgtcgacggcttcggcccaaaacctctccggtgtgttatactcatcaatcattgttcttgcaagtgtgatcaaggtcctgtttttcctttcaacaactccattttgttgaggtgtgtatgttgcagatacttcatgcttgatcccaatttcatcacagtactcgtgaatgttggtgttgtcaaattctttgccattatcacttctaatcttcttgatcttgcaatcaaattcattttgtgctttcctggcaaacttcttgaatatggatgcaacttcagatttgtcatggagaaaggacacccaagtgtatcttgagaagtcatcaacaatcactagacagtagaggttgccaccagcacttacataatttgtaggtccaaataaatccatatgaagtagttccagtggccttgatgttgacatgaaagctttagtaggatgtgtattagcaacttgctttccagcttgacatgcactacatggcttgtctttttcaaacaccacatcctttaatcctctaaccatgtccttctttaataccttcttgagtgtgctcatcccaacatgtgcaagcctcctatgccaaagccatccaagtgaagctttggtgaagaggcaagttcttaagtctgcatcttctgaagtgaaatccactaagtagaggttgttgtatctaaatcctttgaacaccattgattcatcatccatctttgatacaataacctctgttggagtgaataagcattgaagtccaagatcacagagttgacccactgataataaattgaagctcaaaggtgcaaccaagagaacatttgatattgataaatcatttgaaattgccaccttgccaagtccttgcacttttccttttgaattgtctccaaatgtgattttatcttgtccatcaacattctcatcaagtgaggtgaacatccgtgggttgcctgtcatatgttgtgtgcatccactgtcaataacccaatggctcccaccggtcttgtagttcacctacatccacagacaaatcaagcttgagttttgagggccctatattgcataggaccagtgactctctcaatcaaggactttgcaacccagatttgtctaggtctactcttgtttggtggacctaggaatgtaactttgacctttccatttgcaacctttcttagaacataatgagcattgaaagcaaatggtcttgagtgcttaggcaagggagttggtggtttggctttgcagttgtgggcaaaatgaccttcatttccacactcaaagcatttgataggcttgtgagtctgctttggcttgtattgagtggtagctttcttttgcacaaaagcattgtatccaataccactcttgttgtttttcatgacagtgttcataagcagctcattttggaggtattgacccttgttgaacttttgcacacttgttgcaagatgttcattttcactttttagtttcttgacctcatttttaagcctttgattatccactgccaactcattgttgaaatcattgttctcaatagcaacctttcctctagtagttgcatcagtcaagtaattcttcaatttttggttgtctaaagtcaggacttcaactttttcagtcaattcagcatgtagactagtttgctcttcttgactcaaatcatcacatgaggttgctacatcaatcttaacaacagggttaatagcctcatgtgttttgcaagataaaagttcattttcaacaagaagattgtcatgatcaaatttaatttgagtatagtcttccttgatctttactagtctattttgcaactccctattagcttcatttaatttgtcacatttttccttagcatcttttagggagtttgtgagctcatttacagttgatgacatagttttattttcttcttttatttcatcactagcctttataactatgtcatatttggcatttaaagattcattttcatttttcaacctatcacatttagcttttgactttctaatgatttgagtatattctttaagcaagtcagctaactcatcatatgaaggtgaagcaaattcctcatcactatcactatcactatcatcagcaatattaatatcattttgtaccttccgttcaaccctagccatgaggcataggtgagaagttgatgatggcgatggtggtggtgaagagaagtccccggcgatggcggcgactttttcatcattctcttcttcacttgaagaagacccacttgatgattcgatgtcggtgagccagtcgccaacaatatatgcctttccattcttcttcttgtggaacct

SEQ ID NO: 8629 - DNA, 1556 bp, Zea mays
gcacgagaccattacctagaacatcctaatcgaaaactcactccctcatcagagctgctgcctcacccccgctaccctgcaaaacgagggttactagggttccggagggatcatagccgcgctgctacatcgaaaataagagttaccatgctcagccagcagaatccgggcggcgagagcgccggcacgcctcctctgtacctcgggatagacttcggcacttccggagcaagatacgccctcatcgacgagcacggggccatccattcggaagggaagcgagcttactgtgcgcctgtcggcgacgccgcgggctgggcgagctcgtggcgagcggcgctcttccagctcctcgccgacgtcccgcctgcccaccgcccgtccgtctcctccatctccatagacggcacctccgccaccgcgctaatcgtcgacagcgagaccggggagctcctgggcgggccgttcctctacaacgaaggcttcccggacgctctgcccgccgtggagtcggtggcgccggcgaaccacaccgtgtgctcccccacctccacgctctgcaagctggtgtcgtggtgggcggcctcgggcggcgcagccgcgggcgcggcggtgctgatgcaccagtccgactggctcctgtggctgctgcacggccggcccggcggcgtctccgactacaacagcgcgctcaaggtgggctacgacccggagctcggcgcctacccgggctggctgacctcgcagccctactcgcgcatgctgccggccgccgtcagacctcctggggctcccgtcgctgcgctcagagacgacgtgcgctcacagtacggattttctgaggactgcgttgtgtgcgctggaaccactgacagcatcgcggcgtttcttgctgcccgcagaagtgaaccaggaacagcttaactgtgaccaggttacgtcgctggggtcaactctggcgatcaagctggtgagcagagtccacgtggccgacgcgaggttcggcgtctacagccaccgcctggacgacgtgtggctcgtcggcggggcgtccaacaccgggggagccgtgctccggcagctcttcacggacgaccagctcgcggcgctgagcgagcacatcgacccggccgtcccttcccctctcgactactaccccctgccgaagaaaggcgagaggttcccggtctccgacccagacatgatgccaaggctgcagccacgccctgggagcgacgcggagtacctgcacggcatactggaatcgatcgcgcgaatcgaggccaaggggtacagcctgctgaaggagctcggcgcgacggcggtggaggaggtgttcacagcggggggaggagcgcagaacgacaggtggacggccatccgggagagggtgctcggcgtgccggtccggaaggcccagcagactgaggcggcctatggagctgcactgctagcactcaagggcgccaagagcttggctggctagtgtgtcttgttgtgcttggaaattttttaaaaagccagatggtttcatggcttcaaaaaaaaaaaaaaaa

SEQ ID NO: 8630 - DNA, 3124 bp, Zea mays
ccaccacttgggaagaagatcctggagcatcaatatcttcggcttgtacccttgcttgttcatgagagacaaatgtatcttcatttgcatgcctctcatcttttccatcatcttgtggtacatttgatgaagaaggcttgtcaatgtttggcacctcttcttcatcttcttttggtttgatagctccaattggcatgttcttcattgcttccctaagtggctcatcacctaaatcatcatgattttcaggtgctccttttggagccattagtctcatcaaattccacatcatatgtttcttctaccacgccagtggcatgattgaatactcgatatgctttggactttgatgaataacccaatagaaaaccaatatcacaacgtctttgaaacttccctaggtgatggtgtttcttgtagatgtagcatttgcatccaaacacccggaagaaggagacgtctggctttttcccatttagcagtccatagggagtctttgcaagtagccggtgaggaaatagcatgtttgatgcataacatgcagtgttgacagctttggcccaaaacctctctggtgtgttatactcatcaatcattgttcttgcaagtgtgatcaaggtcctgtttttcctttcaacaactccattttgttgaggtgtatatgttgctgacacttcatgcttgatcccaatctcatcacagtattcatgtattttggtgttgtcaaattctttaccattatcacttctaatcttcttgatcttgcaatcaaattcattttgagctttcttggcaaacttcctgaatatagatgcaacttcagatttatcatggagaaagaacacccaagtgtatcttgagaaatcatcaactatcaccagacagtagaggttgccaccagcacttgcataagttgttggtccaaataaatccatgtgaagtagttccagcggccttgatgttgacatgaaagcttttgtaggatgtgtgttagcaacttgctttccagcttgacatgcattgcgcggctcgtccttttcaaatacaacatcctttagtcctctaaccatgtccttctttaatactttcttgagtgtgctcattccaacatgtgcaagccttctatgccatagccatccaagtgatgctttggtaaagaggcaagttctcaagtctgcatcttcagaggtgaaatccactaagtagagattgttgtatctaaatcctttgaacaccattgattcatcatccatttttgatacaataacctctgttggagtgaataagcattgaagtccaagatcacagagttgacccactgataataagttgaagctcaaaggtgcaaccaagagaacatttgaaattgatagatcatttgaaattgccaccttgccaagtccttgaactttccctttgaattgtccccaaatgtgattttgtcttgtccatcaacattctcatcaagtgaggtgaacatccgtgggttgcctgtcatatgttgtgtgcatccactgtcaataacccaatggctcccaccggtcttgtagttcacctacatccacagacaaatcaagcttgagttttgagggccctatattgcataggaccagtgactctctcaatcaaggactttgcaacccaaatttgtctaggtctactcttgcttggtggacctaggaatgtaactttgacctttccatttgctacttttcttagaacataatgagcattgaaggcaaatggtcttgagtgcttaggcaagggagttggtggtttggctttgcagttgtgggcaaaatgaccttcttttccacactcaaagcatttgataggcttatgagtctgctttggcttgtattgagttgtagctttcttttgcacaaaagcattgtatccaataccactcttgttgtttttcatgacagtgttcatgagcaattcattttggaggtattggcccttgttgaacttttgcacacttgttgcaagatgttcattttcactcttaagtttcttgacctcattttaagcctttcattatccactgccaactcattgttgaaatcattgttctcaatggcaacctttcctctagtagttgcatcagtcaagtatctcttcaatttttggttgtctaaagtcaagacttcaactttttcggtcaattcatcatgtagactagtttgctctccttgactcaaatcatcacatgaggttgctacatcaatcttaacaacagggttaatagcctcatgtgtattgcaagataaaagttcattttcaacaagaagattatcatgatcaaatttaatcttagtatagtcttccttgattttcactagtctatctttcaactccctattagcttcatttaacttgtcacatttatccttagcatcttttagggaggatgtaagctcatttacagtggatgacatagttttgttttcttctttcatttcatcactagctttcataactatgtcatatttggcattcaaagattgattttcatttttcaacttatcacatttagcttttgacttcctaatgatttgagtgtattctttaagtaagtcagctagttcatcataagaaggtgaaacaaattcatcatcactatcactatcatcagtaatatcattatcattttgtaccttcctttcacctctagccatgaggcataggtgagaagttgatgatggcaatggtggtggtgaagagaagtccccagcgacggcggcaactttttcatcattttcttcttcacttgaagaagatccacttgatgactcaatgtcagtgagccagtcaccaacaatatatgcctttccatttttatttttgtggaacctcttgtgcttcccatccttcctcttgaagaagctcttttcctttttctcatcatcgctgtcatcttctttcttgcccttgaacttgttcttcttgggcttgttacattgatgagcaagatgaccaagctctccacagttgtagcaatccatttcagaaatgggctttcttttgctggaaaagaatttcttctttcttgaatcaaattttatgccttctctgttgagcttctttaacatcttggtggtcttcctcaccattaaggcaa

SEQ ID NO: 8631 - DNA, 834 bp, Zea mays
tcgagggccggccggggcccgggccaatagccggccgggccccccatcatcttcgtccatcccgtcggagccacacgttgattagagcggcagttgaagcgcctagctgcacaaacagtctgcacagtgcctgtttgttccatttggtatagcatgccacacccattgctcgcggcagtaagtgctgccgtctattcgtccttcctctcaccgccgcggcgtgtcccagcttctctgggacgacggcgtcctgccggcgtcgccgtccggtgcgcgccgaacggcggtggcgtgcccgcagcgggcgacacgaaagcgaagctcaaggtgggctccccgatcatcatcgtcgaggcgcctgtgatgctcaagaccgccgcgtcggtgccgtcgctccggcacaacagcggtcaggtcaagcccggcgacgtcggaaggatcatggcgcggaagcccaaggacgtctgggtcgtgcggctcgccgtcggctcgtacctgctggatggcaagtttttcagtcccttggattctgacaacggagatgatggtgagccccaggcccaggatgaatgagtgatcaatgccttaacggcatgattgaatcgcatgtttactcacatgtcgtgcagacatgtccatgcctatatgcatgattgcaatttgcaatgtaagatccatgatgtgtaacttctgccgacagcgagtgattactatctgtcttattatcaacttatcatagaggggaaacacagcttcaatattctaattttgagtacaacctcactttttgcacaaacaaaaaaaaaaaaatttcccccaaaaaaaaaaaaaaaa

SEQ ID NO: 8632 - DNA, 1363 bp, Zea mays
cggacgtgtgggtttccagggtcgcccgcgtgcttgacgcgtaactgtcgtctaactgtgatggaaagtacagtactgtacgtaacaacaactgctctggatggaaacacaagcaggagctgctggaggagctgggcgtgtacatggtggcgttcgaccgggccgggtacggcgagagcgacccggacccgcggcggtcgccggagagcgcggcgctggacatccaggacctggccgacgcgctgggtctgggtgacaagttccacctcgtctgctcctccctcggttcccacgccggctgggccgccgtcaggtacatcccgcacaggctggcggggctggcaatgatggcgccggtcatcaactaccgctggcgcgggctgccgcgggggctggcccggcagctctacgggaggcagccggtcggcgaccagtggtcgctccgggtcgcctactacgcgccgtggctgctgcactggtggatgagccagccgtggctgcccacctccaccgtcgtcgacggctccgcgcccttccccaacgcgctggacgagaagaaccgcgtcatggcgctctccaacggcatgttccactcggttcgtctcgcctcgctcggttgccctgccttagttagcttctctctgtctcccaccacaatgaaacggacttcgatctttctttcttgcagagggcgaggctggcgacgcagcagggcgtacaggagtccttctaccgcgacatgacggtcatgttcgggaggtggacggacttcgagccgacggacctcgagaagccgccgtttccggtgcacctgttccagggtgacgaggacggcgtcgtgcccgtgcagctgcagcggcacatatgcaataagctcggctgggtcagctaccacgagctccccggagctgggcacttcttgtcagcggtgccaggactcggcgacaggatcctcagcacgctcctgtcctcgccggcgtcggcgtgactgatccacgactcgcacctagcaagtactagactactagtacatgactgatgttgctgtagctatgtctccaaagcattgctggtcgctgaagaaaagcactttatatgagcttagactatctctagcagatttattatcacatctcatatctcactctctatttcaaactccattgtacaaacagtacaatctacagtacaaaacaatatttttcccaacgttctggatatggccttagcccctactggtgttgtaccaagaaaccgacgagaaggcacttttatactccctccaatccaaaatagtagtcgttttagctctaaatcatactcaatatcgcatttcttatttcaaactagtctataaacagaa

SEQ ID NO: 8633 - DNA, 995 bp, Zea mays
gctacaaaaaagtgagtaccccatcatcttcatccaccccgtcggagccacacgttgatcagtgcggccctcgaagcgcccagctgcacaaacagtctgcacagtgcctgtttgttccatttggtatagcatgccgcacccgttgctcgcggcagtaagtgctgccgtctattcgtccttcctctcaccgccgcggcgtgtcccagcttctctgggacgacggcgtcctgccggcgtcgccgtccggtgcgcgccgaacggcggtggcgtgcccgcagcgggcgacacgaaagcgaagctcaaggtgggctccccgatcatcatcgtcgaggcgcctgtgatgctcaagaccgccgcgtcggtgccgtcgctccggcacaacagcggtcaggtcaagcccggcgacgtcggaaggtaccagctagttgctctagcacatgacgatggaccgtacacagtgccttgatggtggttttggtcgagcaggatcatggcgcggaagcccaaggacgtctgggtcgtgcggctcgccgtcggctcgtacctgctggatggcaagtttttcagtcccttggattctgacaacggagatgatggtgagccccaggcccaggatgaatgagtgatcaatgccttaacggtatgattgaatcgcatgtttactcacatgtcgtgcagacatgtccatgcctatatgcatgattgcaatttgcaatgtaaggtccatgatgtgtaacttctgccgacagcgagtgattactatctgtcttattatcaacttatcatagaggggaaacacagcttcaatattctataaaaaaaaaaaaaaaaacccggcccacaatcaaatagagattgttatcctcaaatatcagtgcgatgccgcaatcagatgattaccgaaagtttggcatcggaccagttctcgatcgaagaccaacgaacagcttcgggtacttggatgtcttgctgttattttttatgcactgttgcag

SEQ ID NO: 8634 - DNA, 1551 bp, Zea mays
cttctcccatggctgcggcagctgcctccacgggcaactggtcgcgtgcgaccggcgtaatgcgtgcggccatggtgttgtgggtttgtttggcttacatgcgcggtgtgtgcgacgactggtcgccattgcggctgctggtgctcttggtggcggcggcgctggtggcgaggtggttcctgaacgccgtgcggccgcctcccccgacgccgtgcggcacgcccgggggcccgccggtgacggcgcccagggtgcggctgcccgacgggcggtacctggcgtacgccgagtccggcgtgagcagggacagggcgcgcttcaaggtggtgtactcgcacggcttctccggcagccgcatggactcgccccgcgcttcccaggagctgctggaggagctgggcgtgtacatggtggcgttcgaccgggccgggtacggcgagagcgacccggacccgcggcggtcgccggagagcgcggcgctggacatccaggacctggccgacgcgctgggcctgggcgacaagttccacctcgtctgctcctccctcggctcccacgccggctgggccgccgtcaggtgcatcccgcacaggctggcggggctggccatgatggcgccagtcatcaactaccgctggcgcgggctgccgcgggggctggccaagcagctctacgggaggcagccggtcggcgaccagtggtcgctccgggtcgcctactacgcgccatggctgctgcactggtggatgagccagccgtggctgcccacctccaccgtcgtcgacggctccgcgcccttccccaacgcgctggacgagaagaaccgcgtcatggcgctctccaacggcatgttccactcgagggcgaggctggcgacgcagcagggggtacaggagtccttctaccgcgacatggcggtcatgttcgggaggtggacggacttcgagccgacggacctcgagaagccgccgtttccggtgcacctgttccagggtgacgaggacggcgtcgtgcccgtgcagctgcagcggcacatatgcaataagctcggctgggtcagctaccacgagctccccggagctgggcacttcttgtcagcggtgccaggactcggcgacaggatcctcagcacgctcctgtcctcgccggcgtcggcgtgactgatccacgactcgcacctagcaagtactagactactagtacatgactgatgttgctgtagctatctctccaaagcattgctggtcgctgaagaaaagcactttatatgagcttagactatctctagcagatttattatcacatctcatatctccctctctatttcaaactcccttgtacaaacagtccaatttccagtacaaaacaatattttacccaacgtactggaccgccccctagccactactggtgttgtaccaagaaaccgacgagaaggcccttttatactccctccaatccaaaatagtagtcgttttagctctaaatcatactcaataaagaaaaaaaaaaaaaaaaaaaaaaaaaaaaaaaaaaaaaaaaaaaacaacc

SEQ ID NO: 8635 - DNA, 1333 bp, Zea mays
gcgaccagcacgacagacgaactaagtcacggcgaggtcggccgatgagggaaaacaagaaacatgatggtcagtcggcgagctgaagattgggaacgacagcctgttgaggagcttatccccagagagccgagaagggagcggccgacgagctccaaattggggccagagacacgcgtgcacggactcagggagatgggctgcggccacaggggtcgcccatcggagcagtttcgcgcgcacgactacaagaaaaaaatgagcggcacgcggccaaaagggaagcttcgcgcgcgccatgggagagctggagatggccggcgagcacgcgcgcgcagcaacgaatggacaccagggcgtgcgcacagggaactttggctgggcgcgagcacagggagcgagcttgagggcgagcaccatgggaagcagaggagctccacggcgagcttgagcacacaaaattcgagcagaggtcgcagacaaatccgagggagagaaagagaagcagggagggagccgagcaggaaataaatggaaggacgccctgctcaccaccgcacgtctccacatggcaggacagccaacatgctgaccaccacggccagacccgcgccgctggcctagagcacgcacctggcgtggattgctcctcggtctgcaatcgtgcggcgtggagaggagcaggaacgcgcgcaccagggagctgagcggctgaagacgaagctgcgggaggggcggccattggagaggagcttggaaaactgagcgccgtggaagatgagcgtcggccgaggagggcgcggtccgagcctgaagccggttgagtagaagctgggaactgacgtcgaggggatagaggttttaggcaaatcccagggtgcagcttgaggtggaggacgagcacagccatggacggaaaggagcaggggcatgattcggcgagattgcggaacaaggggcgctcggccgggcgccagagctggaggagaggagcgccggtagagagagcggaggccgaggcgaactggaagctgggcgagctgctcggcagaggaggaaatggagacggagccagcagctgtgagcggatgtggctgagggagaagttcggctggggaaagaagtacgcacgcgtgaaaaaaaatcaagcgtggggcgactggaggattgagccgactgggattttttttagatttttttgttttcttcttaatttttttaataaagaaaattgcaaatatattagaacgagatttttagtgatgtaaagtgggtctgccagctatacggatacatatttccttctctaaatttagcgaaccaacttatttac

SEQ ID NO: 8636 - DNA, 1459 bp, Zea mays
gcacgagaccattacctagaacatcctaatcgaaaaacgctagatcgatgatcaggaacgtacaaagggttcagttcagttttcagtgagtcggcatatgggcaactgcagcagcttcttctctcttccgaaacggggaagcaagctactcaaactcaactcacgaagggataaagaccattccggtgcagagagcctgcgagttcaccacgaactccgtgctctgcgtctgcatcgtcacttggaacatgaacagcaagatgtccgcggaagatgtggcgaagctggtgagctccgacaggaagttcgatctgctggtcgtcgggctgcaggaggcgccgaagccagacgtttcgcgggtcctgcaggaggcgttggcggggacacacgtgctgttgggtcagaagagcatgcagtctctccggatgcttcttttcggttcaaggagctcggagaagtacatcagagagatgaaggtggacaaacacgcggttgggggctgcgggggtatcatcgggaggaagaaaggagcggtggccatgtacatcaacttcagcgggatccggatggtcttcgtgtcctgccatcttgcaggttaattagttttcaatcgccaggccatgctttttccgatcgtcagggggggtatcttgcaggttagttgccatctcgaagtaacaaaggtgtaataaaaaacccgcagctcacgagcacaaggtggagaagaggaacgcggagttccagcacatctcgcagtcgctcttcgccaggtacggcgcgccgacgccgtacgcgcagtctgccgacataacggtgtggctgggcgacctcaactacaggctccaagggataagctcgacaccggcgaggaagatgatcgaggagaaccgccagagcaagctaagaggcagagaccagctgctgcaagaggccgagaagggccaggtgttcagcggctactgcgaggggacgctgtcgtttaagcccacgtacaagtacgacgtcgggagcagcgtctacgacaccagctacaaggtacgagtgccttcgtggacggacaggatactgttcaaggttggccagtcttcaggcctggatgcagtgctgagctcgtacgaatcactcgactgtgtccggagctccgaccacaagcctgtgaaggcgcatctctgtctcaaagtacgcagtgatggtgatgctgactgatatccagctggcgcaggagggtgtcaactggcggttacttctgcagattaacatacatgctacgatgaaaatgttctagtttggaatggtgattatactctagtatattttataacatggcgctcgatcttagcttgtgggccaattgtttcagaacgtgccattctttcttattctttttctccccttttgtttctccttgtacaactaaacccctttttcaaattgggttcaagcaaaaaaaaaaaaaaaa

SEQ ID NO: 8637 - DNA, 2165 bp, Zea mays
ctcgttgcctgcagatagcagcttcctggcccctatagatgcccaaacgggcggcccggcccggcacgggcccgttaggcacgatggataatcgggccgtgcctggccggcccgcgtgccgcggcccagacacggcacggcacggtggcctggtagtcatgccgggccggcccgttaaacggccacgctctactattaaatgaggaaaaatagcaaaaaactgtgtctgggtgaggaattgaacccacgacctccctctaacaggctgagagcactaactgaaatagactaaccagtagaactcgactacatttgttgtaaatatcgaatataaaatataaatatatatatattatattttgtaaaataaaaaccatataaacgtgccgggccggcactgcgggccgaaccagcggcccaaacacggcacagttctcgtgccggacccggcccggcactattaaacgggccgtgcttcggaccggcccgttaggcacggcccatttggccatctatactggcccctgttcctctacgcagtctctttcgcatttcccctaataacacatggactgctgtagccgccttctaatgacgggaagacagacgggatcccgtcgacgtcacatcaaggaggatgtgcagtactgcgtacctaacaatcaaatccagctggccccaaatggctggttcttggctactccacctgtcgccgtttcgtagcgctttgaaaattttcccttctcaagagcacatgggaaacagtacacatgaacgctcaaagccgcagagaaatttcggaggccagtagtattcgtatcgaaatccgataggttctctctgtggctgaaacctggaagtaaccctcgaccgttcgaacacaacacagctgtataaaaaaaagggctcctttgctatctcctccacgctagatcgatgatcaggaacgtacaaagggttcagttcagttttcagtgagtcggcatatgggcaactgcaggcagcagcagcggcttcttctctcttccgaaacgctactcaaactcaacaatggcatggtctcggtcgacgatgagggcgggactcacgaagggataaagaccattccggtgcagagagcctgcgagttcaccacgaactccgtgctctgcgtctgcatcgtcacttggaacatgaacagcaagatgtccgcggaagatgtggcgaagctggtgagctccgacaggaagttcgatctgctggttgtcgggctgcaggaggcgccgaagccagacgtttcgcgggtcctgcaggaggcgttggcggggacacacgtgctgttgggtcagaagagcatgcagtctctccggatgcttcttttcggttcaaggagctcggagaagtacatcagagagatgaaggtggacaaacacgcggttgggggctgcgggggtatcatcgggaggaagaaaggagcggtggccatgtacatcaacttcagcgggatccggatggtcttcgtgtcctgccatcttgcagctcacgagcacaaggcggagaagaggaacgcggagttccagcacatctcgcagtcgctcttcgccaggtacggcgcgccgacgccgtacgcgcagtctgccgacataacggtgtggctgggcgacctcaactacaggctccaagggataagctcgacaccggcgaggaagatgatcgaggagaaccgccagagcaagctaaggggcagagaccagctgctgcaagaggccgagaagggccaggtgttcagcggctactgcgaggggacgctgtcgtttaagcccacgtacaagtacgacgtcgggggcagcgtctacgacaccagctacaaggtacgagtgccttcgtggacgggcaggatactgttcaaggttggccagtcttcaggcctggatgcagtgctcagctcgtacgaatcactcgactgtgtccggagctccgaccacaagcctgtgaaggcgcatctctgtctcaaagtacgcagtgatggtgatgctgactgatatccagctggcgcaggagggtttcaactggcggttacttctgcagattaacatgacatgctaattaagatgaaaatgttctagtttggaagggtgattatactctagtatattttataacatggcgctcttagcttgtgggcc

SEQ ID NO: 8638 - DNA, 1476 bp, Zea mays
cattgggacctcgagccggccggggaaattttcccttctcagagcacatgggaaacagacacatgaacgctcaaaagccgcagagaaatttcggaggccagtagtattcgtatcgaaatccgataggtcctctctgtggctgaaacctggaagtaaccctcgaccgttcgaacacaacacagctgtggtataaaaaagggctcctttgctatctcctccacgctagatcgatgatcaggaacgtacaaagggttcagttcagttttcagtgagtcggcatatgggcaactgcagcagcagcagcttcttctctcttccgaaacggggaagcaagctactcaaactcaacaatggcatggtctcggtcgacgatgagggtgggactcacgaagggataaagaccattccggtgcagagagcctgcgagttcaccacgaactccgtgctctgcgtctgcatcgtcacttggaacatgaacagcaagatgtccgcggaagatgtggcgaagctggtgagctccgacaggaagttcgatctgctggtcgtcgggctgcaggaggcgccgaagccagacgtttcgcgggtcctgcaggaggcgttggcggggacacacgtgctgttgggtcagaagagcatgcagtctcttcgtatgcttcttttcggttcaaggagctcggagaagtacatcagagagatgaaggtggacaaacacgcggttgggggctgcgggggtatcatcgggaggaagaaaggagcggtggccatgtacatcaacttcagcgggatccggatggtcttcgtgtcctgccatcttgcagctcacgagcacaaggtggagaagaggaacgcggagttccagcacatctcgcagtcgctcttcgccaggtacggcgcgccgacgccgtacgcgcagtctgccgacataacggtgtggctgggcgacctcaactacaggctccaggggataagctcgacaccggcgaggaagatgatcgaggagaaccgccagagcaagctaagaggcagagaccagctgctgcaagaggccgagaagggccaggtgttcagcggctactgcgaggggacgctgtcgtttaagcccacgtacaagtacgacgtcgggggcagcgtctacgacaccagctacaaggtacgagtgccttcgtggacgggcaggatactgttcaaggttggccagtcttcaggcctggatgcagtgctcagctcgtacgaatcactcgactgtgtccggagctccgaccacaagcctgtgaaggcgcatctctgtctcaaagtacgcagtgatggtgatgctgactgatatccagctggcgcaggagggtttcaactggcggttacttctgcagattaacatgacatgctaattaagatgaaaatgttctagtttggaagggtgattatactctagtatattttataacatggcgctcttagcttgtgggccaattgtttcag

SEQ ID NO: 8639 - DNA, 1769 bp, Zea mays
tgggtacctcgtgggcggccgggccgggattccccagaggaagcccttactttgccattccaggatccaatcccatttccccacaccggggcgagaccacataccaggccaccaccatctctagaaccttcctcctcgcctccgtctttccctcccccagctcaggcaggaccgcaggagccagacccaaacccacgaaaccctcctgcctcgccgccgcttcctcatcctcccgccgcttagtcccggacccggaccaaccttcgtgaggacgggaattggactaagggggtaggatgccgccaaagaaagcggcgccatcgaaggcggagctggccaagaagcagaaggtcgtggaggacaagaccttcgggctgaagaacaagaataagagcaagaacgtccaaaagtacgtccagtccctgcaccaggccgtccagcccaagcctgactcgaccaagaccgccgccaagaagaagaaggaggaggagaaggcgcgcgagaaggagcttaatgatctgttcaaggttgccgtcagccagcccaaggtccctgttggtgttgatcccaagtcaatattgtgtgagttcttcaaggctggccagtgccagaagggttttaagtgcaaattctctcatgacctgaatgtccagaggaagggtgaaaagattgatatctatacagacaagcgtgatgcagaaaccatggaggactgggatcaggaaactcttgagaaggttgttgaatccaaaaagatggagtatcagcaaaacaaacctaccgatattgtctgcaagtactttcttgatgctgtggagaagaaacagtatggatggttctgggtttgcccaaatggcggcaaagagtgccattacaggcatgcccttccgcctggatacgtactgaaatcacaaatgaaggccttactagaggaagagagtgagaagatagctattgaagatgagattgaagatcagcgtaaaaagacaaagactacaacccctatgacaacggaattgttcatggaatggaagaggaggaaggcagaagaaagagaagctggtcaggctgccttgaaagcagagagggctaagaatgatcgcatgagtggccgtgagttgttcatggctgacgcaagtgtgtttgttgatgatgctgaagcatatgaagtatatgagagagaggagtctgaggccaatgaagaatcgaccaataaaagtcagaatccaggtccaagttcatcaacatctaatggcaaggaggttgaggagcctgacgacgatgatatcgatgttgacgatgacttagacattgatgaattgaatgaacttgaagcaagcctgtcgagaacttccatccaaattcgagagcctggcgagggaacatcatcttgagcagtactacaatggaagattgttgcgaagttgctctccatttttgcgcttccatccgatctagtcgcttttgcaaacaaagaaccgtggagcacagatgcaagtggaatagatctcttagccttgttcactagctatcttgagggagcaacgatcaacaaatgacgaccagtattatgatcacacatgacaattgatgtttgctgtgtgccttattttttttatcttgtgccctttgtgggaaatatgttgctacttgtgaataacaggactaaacagtttgttagctttccgcagactcaacagaattttgaagtgaacactacgatgaatcccaaaaaaaaaaaaaaaatcagacaaaaaaaaaaaaaaaaa

SEQ ID NO: 8640 - DNA, 4517 bp, Zea mays
cttcacttctatagtaaattgatttgtgtgggtttccttgattacccttgatgattagtgggttgtcgccagagagaacggaaattgtatgttgcgtaatcagtggcatggtggataattttcgtacagcttcatgaggagatataaaaacagtgtttttgaagcaccctctaaggagcttcataaatttcatgaaacgggcctctagtttcgatttttttaaaactaaagctcgtggaactggacctgtttgagttgaagaagttcgaacgaaattgaaattcttgaagtgaagctcttccaaacagggccttaaacacgcaatcttaacccagattcgtaaaccttaactaccaagaaatcgccgctagtagtacgtgatggaaaacacagattgcgtaggagagagaagacagagaagagagagagagggcagcagggagcaagggaaagagtccaagggaggtaatgcaccacaccaccacctccttgcggaaacgcacgcccaccatctccttcccgtccaagccgccgccttctggccttcctcaatctcgtcctgcgatttctccaacttccatctgattgtccgcgaccgcttcctcaccgcctccacacaaactccatcaaagattccgcaactcgccgtcgcgatcttaaggtatatatactagagtactagtctgctgtggctacttctagtaatttcgttctgttttatttactgtcggatcatcgatcggatcgattagttcgtcgtctcagtcggtgtcgtttggctggttcgtcggaaggtcaggttttccaatccgtaggtgcctcgttttgtcttcttggccggggggattgcgagtgatcgtggcccgaggtggggttttcttgggttttgggaacgtcgaagcgcgttatcatgtcaggttataccacggcgggtgggttcccggagcttgattccgctgcattcgtcggcgttttggtgtactccggtaccagaattgcggattcctttgtttcctcctccctgcgctgctagtgttacagcttctgttatatctgtatgtatgaactgcctggattgtacttgtgggcgttttcccccctttgctggattaacaaaatcctggataccgcgattattggactgattggatttaactcgcatggccgtgcccggaacacagcgattcatcttctttttagtttgttgaggacttgctgtcttgtgtaaagctatttgttctgtttccgtgtggagcttttgcctccgctttcttgcgggtgcattccctgttccaagtatccgaaaagataacgcttttgtttacgtctgtttcatcggaatttcgtgatacctgattgcaatattggattacctgtgttgtagggagattgaaggaacctgcattgtgtgattgactgctgcctagcgttcggctgatcatcctgcttctgccatgggggaatcacagagtagcgaggacgcttccaggttcagagctttgggcaacggtgtctccggtgctgggcaggggagtgctggtgacaatgagctccacgatgggagcattgcatcgcaggctgtcagggcttatccgaatggtgggagatccttggtttctgacgttgggttgtttgacacgttgagggttggaagcaaccagtattttggtttctctcacagtgccagtggtaatccctatgatgagcagtccttgtcgtttgcttttgagggcatgggctttgattcacgcaaaactaattcacctaccagtcatcacaatgtaccactgacaaatggacactatccatctgaacgtgtggatggtactctgagccagcagcatgcacctgcaacacgccaatgtgattctttgggtctacagtttagtgtgcaacatgccatgcagaacaatgatgttgaacaccaggaacaatctcccaggtttcccccacagttggggactttctcaagaaaccctgagctgcacagctttgatcgccattttggtgttccttggccatccatcaattgcatcagcttcatccttaaaaatgtggcaatctcaaatgtacacaccccatgatcagaatgttggctcaaacttcatgtggcagcaaaatactggtgtacaaccatactctattatgcaaccgaattatgcatgtccacaaatgcagcaagtttctgggtttggtatttctcgacataggagcaattgcatgcctgcagtctaccctcctgcaaagggcccatcctcatcatatattggaacaccaaattttcattggctggaaaatgggtattcttacctaaacggtgctgcttctcagaaaagaagaaatagtggcggtctgaataatacatttgcagacagcttcccaagtacatcttacaccggcagttcatgtggcagtggtgattttcaccattttcaatgggcagaaaaggttttcaattcatatggaccgcatcaccagcaaggtgataacctcagtcatccatatggcttaggtttatcacatcatcaaagatctgatatcgctcatccatatggcttaggtttctcacatcatcaaagatctgataaactcaacacagcaagttacgtggagaggatccgaatgagacctgatgttggaaattcagtaaatttttttgatttatcttcctatgctcgcttgctgaactccccgttcttgtcctcacaatctgatacatataaatccattgatgaagtgatgggaagagtatgcatgctgtcaaaggatcaagatgcatgtcgctttctacaaaaattattatcagaaggcactcaagaggacattgataaaatctttggtgaaataattgacaatgttggtgatcttatggtggatccaactgctcactatttggtgcagaagatccttgaagagtgcaccaatgaccaaaggacacacatgattcgtgaaatcactaaagcacccataaagcttcataaagcttcttgcaatgtgcatgggtatgaacacaataacctttactattttatcatccctatttgttgggttttttttaagaaaggcaggcgtgatgcagtgttgagagctgtcttactgagtgaccaggtcgtgggttcaaagcatttatctcttctctagaccccactcatgtgggaatctccgatactaggtctgctttttttttatttgttggattttttttctttgatcttgtcgtgaaaaatttcaggacccgcgttgtgcagaaggttatagacaccatgaatacccctgaccaagtgtcaatgttagtgtccgccttaaatactggaatgatgtgtttaatgactgattcttatgggaatcatgttgtggaccactgcctgcagaaattgttacctgagcacaaggcagtaagttgttacattcatatggtttaactattatttttgtgtgttttcagtagtactcgtacatgtacatgttggttgtattaaacttttgtgcagataaatagtttttatactagaaaacaatctctattcaatttatttgctctataatgttgtattctacactatagaatatgtaggccacagctgtatgtttccagcagagaaaatactaatgaccttgaacacttcatatatatgatgattgcccgaaggtgcacaattcatcggaccacattttaacacgcactgcgtaaactgtcgcagttcattcttgaggctgctgcatcatgctatcttcaactagcaagagatcgtcatggttgctgtgtcctccagaaatgtattggtcattcaagtgatgaacagagaaacaacttgttgtgcaagataacatcaagtgcccttacactctcagaagatccgtatgggtatgctcatcctcttttgctttatccatctgagcagatatcctgatctaatatgaatgatactactgtcatgcctttgcatattgcactatacaatcttagcagagatcctcatataataccaatgatactgctgttattatgcctttgcataatactcttgcaggaactatgttattcagtttattctggacctcaatatcgaatggataacagtcagagtagtggatgagctggcaggtcactttggaaatctatccatgcagaagtgtggttcccatgttgtggagcattgcctgaagctagcgccacggctgatctgtgataggatcatcaacgaactcatgcatgatcctaaactgttggatatcatccttgatcagtatgggaactttgtgattcagacagcgcttaaacagtgtcaggtaaagatactatacttaaccctctgccaaaagaattccatgtgcaatcaattaatggctgtttattgtttattgctgcaggctggccatcatgctgcttttgttgaaactattaagccgcacactgctgtaatgcaaagtaacatgtatgggaagaaggttctttcaaggatatgcttgaagaacaagcactgccgatttgacctccattaacctagcattttttt

SEQ ID NO: 8641 - DNA, 1636 bp, Zea mays
cgcatgccccaaaagcgaagcaaaccagcacaaaaaggagcacaaagctctctctccctcccccctctctctctctctctcctgttccccgcgagagtcgctcagggccgcgacgaggagaagcggcagcgcgtcacctctccaatggcatccccgtccctcctccgtgcaacctgtgcgcttctcgagtgctgaggctccctgtccctaagacaagcttgcgcgcgcgatggagggtttttcgagggacttgctgtgcgggattggcaagggggacgcgccgccaccggagaagaggccggggcagctgcgggaggagatggaggaggtggagcttagcctcgggctgtcgcttggcggccgattcgggctcgacaggaaggggagcaagctcccccggtcgtcgtccgtggcggccatgctgacaacgccggtggaggtgccggcgccgccctccctctcgcgggcgagctcgctgccggtccaggcggaggcgtcggaagttgagaggaagcaggggctggatggatggggttcttgccgtgagggcggcggtctcggcgtgcaacacgcggcgaggctgccggcgagcgggaacccttcctctgcctcttcggtaggtgaaggacagattttgcaaggcaccctcatgaggactagttcactccctgctgtcattgaggcttctggcaatgatgactggaagaaacgaaaggaagcacagagcctgaagaggctcgaggttaagaagaagaggattgagaggaggaactctctcgcctgcaacacttcaaaagaagctgctgggcagagtccaaaagagatgaatgcaaacactgacaaattagtaagttctgatgaaactattgtcagcgctaacgaaagtcatagcagtggcaagcatctggtgaaggggcttccaccaaagtaccaggccacaattacatcagaagacagttcgtcagcaatgcgaaagaagccaaactcggccttcaaaggaacagccatcactgaggagcagaactcatcatcgtctgttccttcctccggtgaagctataagtagcgtgacggcaccaagtctgcctctgttgtctttggtccccataacagcaacccttggttccagggaagaccaaagcattttaggcagggctggtgcaagggcaaacggcatgggggacgtggaaaggaggatgatgcaggagatgccgggcgtgttcaccaagggcctgtccaacggcagcagggtcgaaggcttcctgtacaaatacagcaaaggagaagtgaggatcgtatgcatctgccatggaagcttccttactccttcggagtttgtggagcacgccggcgccggcaaggtagataacccgctgcgacacattgtcgtcagcgctaccccgaacctgtgactgtgaggccaggcagacccgtgcacaagctatagtgttctgtagactcaggacctgagcctagcgtcagagcaatgtcaccgttagactgtgtggtgcggtgcttatgcccgattaaattggtgggcattgtggtaacataacctgttgataatgttttgacaatgttttgatccttcctatgcgtgatttagttctgcgcaaaataaaaaaaaaaaagcggcc

SEQ ID NO: 8642 - DNA, 1297 bp, Zea mays
cccacgcgtccgcttcctttcttcctcctgctatttagacggttctcaccggagctatcgcctccctatcatctcaatatgttgtagtgagtttgcctctatcccgcccacctcaccgtcgttgtctccgccaccgccaccgctcccaccactgccatgcattaacctcaacccttccgcaaactattcactgtcactttgtcatcggcgctccatcgttcactcaaatgtggtctccgatacctggcaccctcatgaggactagttcactccctgctgtcattgaggcttctggcaatgatgactggaagaaacgaaaggaagcacagagcctgaagaggctcgaggttaagaagaagaggattgagaggaggaactctctcacctgcaacacttcaaaagaagctgctgggcagagtccagaagagatgaatgcaaacactgacaaattagtaagttctgatgaaactattgtcagcgctaacgaaagtcatagcagtggcaagcatctggtgaaggggcttccaccaaagtaccaggctacaattacatcacaagacagttcgtcagcaatgcgaaagaagccaaactcggccttcaaaggaacagccatcactgaggagcagaactcatcatcgtctgttccttcctccggtgaagctataagtagcgtgacggcaccaagtctgcctctgttgtctttggtccccataacagcaacccttggttccagggaagaccaaagcattttaggcagggctggtgcaagggcaaacggcatgggggacgtggaaaggaggatgatgcaggagatgccgggcgtgttcaccaagggcctgtccaacggcagcagggtcgaaggcttcctgtacaaatacagcaaaggagaagtgaggatcgtatgcatctgccatggaagcttccttactccttcggagtttgtggagcacgccggcgccggcaaggtagataacccgctgcgacacattgtcgtcagcgctaccccgaacctgtgactgtgaggccaggcagacccgtgcacaagctatagtgttctgtagactcaggacctgagcctagcgtcagagcaatgtcaccgttagactgtgtggtgcggtgcttatgcccgattaaattggtgggcattgtggtaacataacctgttgataatgttttgacaatgttttgatccttcctatgcgtgatttagttctgcaaaaaaaaaaaaaaaaggaagaacgaatcaaaaagaaccaaaattaaaaaaaaaagaaatgaaaaaaaaaaaatcttcaat

SEQ ID NO: 8643 - DNA, 1187 bp, Zea mays
ctctagtacttaaattgagtttttcctgttttatgtatttcttttgggactcaccttcgagtgagtttgtggtattgatccctagttaagtggcttatcatactagatttgagggactggcggttattctgatttaagtgtgtacggcccctttaaggcatgactttggcacttaagctggaataattcgagcggttctgccacaacaaggcacataaagaggtgttaaaatctatcagaaatgaggggaactctagagtaatagcattggactatgtccatacatctaaaaatctagcagatcaaatctagtccccccccccccgaccccccccagattgtgcatcgagtgagatgggcctaagacccacctaaagtttatcatagtggtaacatgttctatgtgatcggagatcccgtgaattagaatggtgaaacaagctagtggtagactgagaggaaagacccttaataaggttcatttcagatgcacatctttccttactgtaaagtagggtggtgtttacatcttaatatgttccaagtggctttgtgaagcaaagatgttgtcctacagaacatatttagaggaacatacctatatgggttaactgctagccacagtttatgagatctgggttgtctctaaatacccgtgaaaggctatggagtttgacttatatgctccaaccagtggggatgcgctcggcaatctagtactggtaaatagtttagatgaaacttattccacgcaaaactgccaattcaagtcctagtccattgtgcagttgtggtcaagtgtattctagattctaggtagatgttcaacttaactgtctccatcgaaacaccagtatatcaaacgtttgagatgatgagagcattttagtgtgacttagacatttggcggggattgttgaattaatgtgcgcctgccccatattaatattcaataatagccaatgctagaggcccactttaatgctacggtggactagtactttagtaccataccggaaattcaaggaacaactcaatcaacttaaataggtgaaccattggtgcatctattgagaagctgagaaaaggatgaaggactgccacacgcgcgcgccaccggccgagcccggttgtggtcgtggtagatcggaccttggtccgaatattccttcctaacggttgcgcat

SEQ ID NO: 8644 - DNA, 1366 bp, Zea mays
tgatcctagtaagctattaaagaaaaatcgaaggatagctagggatcaattgagatattcccaaataattggttcactcatgtatttagctagcgctacgaggcctgacatctcatttgctgtgagcaaacttagtcgatttgtttcaaatccgggagatgatcactggcgtgctcttgagagagttttgcgctatctaaagggtactatgagtttaggcatccattataccgggtacccaacagtactggagggttattgtgatgcaaactggatatctgatgctgatgagatatatgccacaagtggatatgtgttttcacttggaggtggtgctgtttcatggaagtcttgcaagcagaccatcttaacgaggtcgactatggaagcagaactcacagcattagataccgcttcagttgaggctgagtggcttcgtgaactccttatggatttaccggtggttgaaaaacctgtgccggctatttccatgaactggataatcagactgtgataattaagataaacagttctaaggataatatgaagtcgacaaggcacataaagaggcgtttgaaatctgtcaggaaattgagaaactccggagtaatagcgttggattatgtccatacgtctaaaaatctggcagatcaatttactaaggggctatcacgtagtgtgatagatagtgcatcaagtgagatgggcatgagacccacctaaagtttatcatagtggtaacctgttctatgtgatcggagatcccgtgaattagaatggtgaaacaagctagtggtagactgagaggaaagacccttaataaggctcatttcagatgcatatctttccttactgtaaggtaggttggtgtttacaccttaatatgttccaagtggctttgtgaagcaaagatgttgtcctacagaacatctttagaggaacatacctatatgggttaactgctagtcacagtttatgagatctgggtggtttctagatacccatgaaaggctatggagtttgacttatatgctccaaccagagggaatgcgttcagcaatctagtactggtaaagagtttagatgaaactcattccacgcaaaactgccaattcaaggcctagtccattgtgcagttgtggtcaagtgtagtctaagttctaggtggatgttcaacttaacagtctccatcgaaacaccagtatatcaaacgtttgaggtgatgagagctttttagtgtgacttagcatttggtggggattgttggattaatgtgggcttggcccaaattaatattcaataatagtcaatgctggtagggccgcgttcatgggtggggcgaactgagtgaaattgggaacgtgga

SEQ ID NO: 8645 - DNA, 566 bp, Zea mays
ggtccctgctcacgtctccctcgtttggttcacccttcactgctcacgccaacgccggtagatccatgctcacgtcgcagccaatagatcccatgtccctactattgtctcctatccctggccctacttctctgtctaggtcagttcgtcgcggccgtcgtgcagacccgccgcaaaaccagtcgttgaggtcagccagcgaacagattcgtcaagatccgtcgatgtgccttactccaaccttccctttccatcgatggcaaaccagggagatgccttttgtgatttcttctctcaggggttgtcttatgtaaacaacaaaaatgccaaagaactacccctctttcgctcttcgtttgcccgcaaatcatcctcaacgggaaaggtcgtggaaaatcctaacctcaactcttaggatgacacatttccctaccttggttcctactcgggattactccaacccgaagctgggttacataagaaggggctccccctttgcccccagtaggtagatctcggcatgcctcctttcatctacctagattgaccactggcacaggctggtc

SEQ ID NO: 8646 - DNA, 2319 bp, Zea mays
  misc_feature (49)..(49): n is a, c, g, or t
  misc_feature (51)..(60): n is a, c, g, or t
cctcttgggcttgtggttccccccggctccccggttttttccccccctntnnnnnnnnnntctgctgttgtgttatatgccccccccccccccctgttttcacttggaggtggtgctgtttcatggaagtcttgcaagcagaccatcttaacgaggtcgactatggaagcagaactcacagcattagataccgcttcagttgaggctgagtggcttcgtgaactccttatggatttaccggtggttgaaaaacctgtgccggctatttccatgaactgtgataatcagactgtgataattaagataaacagttctaaggataatatgaagtcgacaaggcacataaagaggcgtttgaaatctgtcaggaaattgagaaactccggagtaatagcgttggattatgtccatacgtctaaaaatctggcagatcaatttactaaggggctatcacgtagtgtgatagatagtgcatcaagtgagatgggcatgagacccacctaaagtttatcatagtggtaacctgttctatgtgatcggagatcccgtgaattagaatggtgaaacaagctagtggtagactgagaggaaagacccttaataaggctcatttcagatgcatatctttccttactgtaaggtaggttggtgtttacaccttaatatgttccaagtggctttgtgaagcaaagatgttgtcctacagaacatctttagaggaacatacctatatgggttaactgctagtcacagtttatgagatctgggtggtttctagatacccatgaaaggctatggagtttgacttatatgctccaaccagagggaatgcgttcagcaatctagtactggtaaagagtttagatgaaactcattccacgcaaaactgccaattcaaggcctagtccattgtgcagttgtggtcaagtgtagtctaagttctaggtggatgttcaacttaacggtctccctcgatgcaccgggatcgcggacgtttgaggtgatgtcccccctccagtgtccaactttgcattgtggtgggcaattgttggattaatgtgggcttggcccaaattaatattcaataatagtcaatgctaatggcccactttaatgctatggtgtactaattatttagtaccatattggaagttcaaaagacaaatcaatcaacttaaataggtggactattggtgcatctattgagaagttgagaaaaggatgaaggactgccacacgcgcgcgcgcgcgccgccgccgccgccgccggccgggccgggccgtggctcgtggctcgtggctcgtggctcgtggtagatcggaccttggtccgaatattcctttcaaacggttgcgcattttgcctggagcgatgatcgtcataataacagtccgtttcacgtcattatggctagtaacggacgtcataataaccgtccgtttcacgttattatggctagtaacggacgtcgttatggctagtaacggacgtcattatggctagtaacggacgtcattactgtcgtcagtttccagttctaatgcgcgaccgtttctgtccgttggtcttctctctccttctgaccgcctataagaatggagagggagggctcttccaggcacgcgaattgcctcacgcgaattgcaagcaacacattcccgtcccaccttctgcgagcacagagagagtgggagagcaggcctccgaaatcaccgaccgcagagatacacttgcacgggtgtgcgggcgatcagatttttggggagcgtcttcgcgactgctcgcgtgatctgcttcgtcttcttcccggcgaccgttcgagggactgcactgcgtacaccttcctgcatcgacttcgtacggctacatcgaacaaacacacgagatgactcgtgtgaatggagccactgatgccttgagcatcggtccctccgctgggtacactctattcttcgtattcgtgcatgttttattgctatttactgcttatgcgagtagttatacacacatgcacatacatgtcatcacatatatcgcactgtttttctggattaaattaaaacaaaaaatgcctaactttctaacactggacacagggaagatggccgagcgcgcgtgcttgagagaggtgagcagaggatgaagacgcaagaagggagcgctcaaccatggatggacctcgggtgctcgcccatgggagatgcagggcatagtcgagcctgcgcccaatcaacgtccatcagaaataactcgagggggggcccggtacccaatttgttaaacacaataaagttggaactggaggggtgaaatgagtt

SEQ ID NO: 8647 - DNA, 956 bp, Zea mays
ctcgaggccggccgggaaccctatcttcagcccctgccgcgcgcccgcgatccaccccgtttcgacggccccccggctgcggccgggctgctgcccgctgtctacggcctcatacgactgccctgcgcccctcgtggcttctgcggttctgcacacgcgcacttgtccccaaacagcggcgtcggcgtcggcggcgatgagtatctcaggcgagcttcccggcgaaggatctgacggcgaggaggaggtcttcatcgacgaggaggacatcatccacgagataaccatcgacgaagaagatctccccgaccgcgacgaagaagatgacgacgtcggcgacgggattgttgattcagaagacatcattgatgattctacgtactcatttcttggccacaaagatgaagtcttctctgttgcatgcagtcctacagatgcatcacttgtggcttctggaggcaaagatgataggggatttctgtggaggatcggatcagatgagggtgccttggagctgactggacacaaggatactgtcggcacagtggctttcagttcagatgggaatttgttggcttgtggaagttttgatgggcaaataaatgtgtggaatacagctgcacgagctctcaagggaacccttgagggttctgggtcaggttttgagtggcttaaatggcatcctcggggacatttgataattgcaggatcagaggattgtaatgtatggatgtggaacgctgaccataatgccattataaatacatttgttggacatagtaacacagtgacatgtggtgattttactccagatggtaaacttatatgtactggatcagatgatgcatctttgaggatatgggacccaagaagtgcacaaagcaggcatgttattcgaggccatggttatcatactgatggattgacatgcttatcaatgactttggattcacaac

SEQ ID NO: 8648 - DNA, 1530 bp, Zea mays
cctgccccctcgtggcttctgcggttctgcacacgcgcacttgtccccaaacagcggcgtcggcgtcggcggcgatgagtatctcaggcgagcttcccggcgaaggatctgacggtgaggaggaggtcttcatcgacgaggaggacatcatccacgagataaccatcgacgaagaagatctccccgaccgcgacgaagaagatggcgacccccgcggcgcgccgggtgattcagaagacatcattgatgattctacgtactcatttcttggccacaaagatgaagtcttcactgttgcatgcagtcctacagatgcatcacttgtggcttctggaggcaaagatgataggggatttctgtggaggatcggatcagatgagggtgccttggagctgactggacacaaggatactgtcggcacagtggcttttagttcagatgggaatttgttggcttgtggaagttttgatgggcaaataaatgtgtggaatacagctgcacgaactctcaagggaacccttgagggttctgggtcaggttttgagtggcttaaatggcatcctcggggacatttgataattgcaggatcagaggattgtaatgtatggatgtggaacgctgaccataatgccattataaatacatttgttggacatagtaacacagtgacatgtggtgattttactccagatggtaaacttatatgtactggatcagatgatgcatctttgaggatatgggacccaagaagtgcacaaagcaggcatgttattcgaggccatggttatcatactgatggattgacatgcttatcaatgactttggattcacaaacggttgttagtggctccaaggacagttctgtgcacgctgtgaatgtaaactcgggccagatcgttggctcactagtaggccacaccacttccattgagtgtgttggtatctcatcaagctatggctgggtagctacagggagcatggatcaaaagctgatcatatgggacctcacacaccagtccagccgatgcacttgtgaacatgatgagggagtgacatcactggcatggctaggttcgtcaaggtatgttgcgtcaggatgcatcgacggcaaggtgcgcatctgggacagcctctctggggattgtgccagggagttcagtgggcatgcagatgtagtacagtcgatggccatcacagctgacggcaacgccatggtctcggtctcatcagatggctccgcccgtgtgtttgacatctccatgttcaagtgaaggaaactgggacggagtagatggttgctgtgtatgctaatgcttgttcgcggtgcatgtgcatgaatgatgatggcatgccatggtaatatgttattctactcatgggaaactcgtgcatttgtattgcatataagtcccgtactcttagtatctgttacagttgaacaaataatgtatttggagtctattccttccttctctccttgattactcttttgtgtgttttttcccattaggagagaagtaatctgttctg

SEQ ID NO: 8649 - DNA, 1980 bp, Zea mays
catcgggggcctcaaaaataaaatccaattttctcagtctcgagcgcccgcgtccctcgccccgtcgcgactcgcgacttcgcgagtcgccccgtcccagcctcccagccgtcccggctccccgcgaccccgccctccggcagtccggcgcgggggctcctctccgatccggtgagccgaacgaggatcccaactccccgaagaaagcggccacagccagagccagggtggctcggctctcctctcacagactgcgccgcagcgcctagcgctcggctggcagccgctccggccggtcggccccgcgcccccgcccctgctgcctacatccgcctgcagccagaagatctgcctccagcgaccgccctgcctgccccttgtggcttctgtggttctgcacaccagcacacgcacttgtccccaaacaacggcggcggcgatgagtatctcagaagagcttcccggcgaaggatctgacggtgaggaggaggtcttcatcaacgaggaggacatcatccacgagataaccatcgacgaagaagatctccccgaccgcgacgacgaagatgacgacgtcgtcaacgggatggttgattccgaagacgtcgatgattctacatacgcatttcaaggccaccaagatgaagtcttcattgtcgcctgcagtcctacagattcatcacttgtggcttctggaggcaaagatgataggggatttctgtggaggattggatcagaagagggtgccctggagctgactggacataaggatactgtcggcacagtggctttcagttcagatgggaatttgttggcttgtggaagttttgatgggcaaataaatgtgtggaatacagctacacgaactctcaagggaacccttgagggttccgggtcaggttttgagtggcttaaatggcattctcggggacatttgataatcgcaggatcagaggattgtaatgtatggatgtggaatgccgaccataatgccattctgaatacctttgctggacatagtaacacagtgacatgtggtgattttactccagatggtaaacttatatgcactggatcggatgatgcgtctttgaggatatgggacccaagaagtgcacaaagcagacatgttgttcgaggccatggctaccattctgatggattgacatgcttatcgatgacttcggattcacaaacggttgttagcggctccaaggacagttctgtgcacattgtgaatttaaactcgggccaggtcgttggctcattagcaggccacaccagttctattgagtgccttggtatctcgtcaagctatggctgggtagctacagggagcatggatcaaaagctgatcatctgggacctcacgcaccaatccagccgatgcatttgcgaacatgatgagggcgtgacatcactgacatggctaggttcgtcaagatacgttgcgtcaggatgcattgacggcaaggtgcgcatctgggacagcctctctggagcctgcgccagggagttcagtgggcatgcagatgtagtacagtcgctggccatcactgctgacggcaacaccatggtctccgcctcatcagatggctccgcccgtgtgtttgacatctccatgttcaagtgaaggaaaccgggacggagtacatgtttatgctatggcttgattgtgatgcacgattgatcatggcatgccatggtaatatgcgattgtactactctgctcatggaaaaatcgtgcatttgtattgcatatgactccacttgtagtatctattacagcagaacaaaggatgtatttatatatattccgtttttcccctttggagagaaggaatcaattgtgatagcagtgatagaattcggacgggaattctgtctcaaaattatattaatatgagctagtttgggccaaaaaaaaaaaaaaaggggccccctcgcgatctagaaccccacgcgtctgcggacgcgtgg

SEQ ID NO: 8650 - DNA, 642 bp, Zea mays
cgcgatccaccccgtttcgaccgctcgcctgctgcctgctgcctgctgcctgctgtctacggtctcctacgactgccctgcccggctgccccctcgtggcttctgcggttctgcacacgcgcacttgtccccaaacagcggcgtcggcggcgatgagtatctcaggcgagcttcccggcgaaggatctgacggtgaggaggaggtcttcatcgacgaggaggacatcatccacgagataaccatcgacgaagaagatctccccgaccgcgacgaagaagatgacgacgtcggcgacgggattggtagggttgattcagaagacatcattgatgattctacgtactcatttcttggccacaaagatgaagtcttcactgttgcatgcagtcctacagatgcatcacttgtggcttctggaggcaaagatgataggggatttctgtggaggatcggatcagatgagggtgccttggagctgactggacacaaggatactgtcggcacagtggcttttagttcagatgggaatttgttggcttgtggaagttttgatgggcaaataaatgtgtggaatacagctgcacgaactctcaagggacccttgagggttctgggtcaggttttgagtggcttaatggcat

SEQ ID NO: 8651 - DNA, 1855 bp, Zea mays
  misc_feature (1847)..(1847): n is a, c, g, or t
cctcgcattgggtacctcgaggccggccggggcgtccctcgccccgtcgcgacttcgcgagtcgccccgtcccaggctcccagcgaccccgccctccggcagtccggcgcgggggctcctctccgatccggtgagccgaacgaggaccccaactccccgaagaaagcggccacagccagagccagggtggctcggctctcctctcacagactgcgccgcagcgcctagcgctcggctggcagccgccccggccggtcggccccgcccctgctgcctacatccgcctgcagccagaagatctgcctccagcgaccgccctgcctgcccttgtggcttctgtggttctgcacaccagcacacgcacttgtccccaaacaacggcggcggcgatgagtatctcagaagagcttcccggcgaaggatctgacggtgaggaggaggtcttcatcaacgaggaggacatcatccacgagataaccatcgacgaagaagatctccccgaccgcgacgacgaagatgacgacgtcgtcaacgggatggttgattccgaagacatcgatgattctacatacgcatttcaaggccaccaagatgaagtcttcattgtcgcctgcagtcctacagattcatcacttgtggcttctggaggcaaagatgataggggattcctgtggaggattggatcagaagagggtgccctggagctgactggacataaggatactgtcggcacagtggctttcagttcagatggaaatttgttggcttgtggaagttttgatgggcaaataaatgtgtggaatacagctacacgaactctcaagggaacccttgagggttccgggtcaggttttgagtggcttaaatggcattctcggggacatttgataatcgcaggatcagaggattgtaaatgtatgggatgtggaatgccgaccataatgccattctgaatacctttgctggacatagtaacacagtgacatgtggtgattttactccagatggtaaacttatatgcactggatcggatgatgcgtctttgaggatatgggacccaagaagtgcacaaagcagacatgttgttcgaggccatggctaccattctgatggattgacatgcttatcgatgacttcggattcacaaacggttgttagcggctccaaggacagttctgtgcacattgtgaatttaaactcgggccaggtcgttggctcattagcaggccacaccaattctattgagtgccttggtatctcgtcaagctatggctgggtagctacagggagcatggatcaaaagctgatcatctgggacctcacgcaccaatccagccgatgcatttgcgaacatgatgagggcgtgacatcgctgacatggctaggttcgtcaaggtacgttgcgtcaggatgcattgacggcaaggtgcgcatctgggacagcctctctggagcctgcgccagggagttcagtgggcatgcagatgtagtacagtcgctggccatcactgctgacggcaacaccatggtctccgcctcatcagatggctccgcccgtgtgtttgacatctccatgttcaagtgaaggaaaccgggacggagtacatgtttatgctatggcttgattgtgatgcacgattgatcatggcatgccatggtaatatgcgattgtactactctgctcatggaaaaatcgtgcatttgtattgcatatgactccccttgtagtatctattacagcagaacaaaggatgtatttatatatattccgtttttcccctttggagagaaaaaaaaaaaaaaaaaaaaaaaaactcgagggggggcccggtactcgagggggggcnccgggtac

SEQ ID NO: 8652 - DNA, 1668 bp, Zea mays
ggtaccctcgcaaggtcggtcctacacggtcccgttctgcctggtgcctgcaacctgccttttcttcttccgtcgccacccagcgtgctctctctccctctttctctctctctcgtggcggcgcctgggcagccgtcgctgccgcctgcgctaggtgccaggtcttcttcgggcccttcgccggcgacgagtaccaccaggttgtacatgtgtacacccatgtgctttactgggtcggaccctactcatcctccacactaaggccatctccatagactgcactgtttagactccactgtttagagagtggagatagggagtgagatagagagtggaatagggaggatgctggagatagcctaaggttgccactgagtgtgtgcatgattcagaggcaatgtcatcacaaactggaggtggcaaagagagtgacgccggccctgggcaacacaggcagatgcaaagtttggcaagacaagggtctttatacaaccttaccctcgatgaggtgcagaaccatttgggggagccattgcttagcatgaattttgatgagctcctgaagagcgtgtttcctgatggtgtagattcagatggtgctgtcacaggcaagcctgatcggacctcgagcctgcagcgacaggggagcatcctgatgcctccgcagttgagcaagaagactgttgacgaggtgtggaagggcatccagggtggaccagagaccagtactgtggtggatggtctgcagaggcgagagaggcatccaacacttggggagatgacacttgaggacttcttggtcaaagctggggttgttactgaaggacttgtgaaggattcagctgattttccaagcaatatggatacagctggcagcagtgttgttgtggctgctgcttctagtttgaaccctggagcacagtggttgcaacagtaccagcagcaagttttggggtcccagcaattgagtttggcaggttcatacatggctagtcagttgcgccctcagccattgtctattgctacaggtgctactttggattcaatttactctgatgaccagattacttcgccatcatttggtgcactttcggaccctcagacacctgggcgcaagcgtggtgccttaggggaggtagtggataaggtggttgaaagaaggcagaagaggatgataaagaatagggaatcagctgcgcgatcaagagcgagaaagcaggcttatactaatgaacttgaaaacaaggtattccgtctagaagaggagaataagaggctaaagaaacagcaggagttggatgagatactgagctctgctcctcccccagaacccaaatatcaactcaggagaacgggttcggctgccttttgagtttcggcgctgacaatgctcatagtgatttttgtacattatacaaggattctactttatatggtttccttccttttgtattagaaacatttgatagattgagggtatagctttttcccggcccggtaggtcagtgtatgtaggtcgctagcaagctgtagcatgtcctggcggatcatttccttggtgtctgtcagtgtgtacatcttctagacacatgtctaagtctgagagcttccttatacgagaaggtattcaggtttgtgttgcccaggtgtctcctgctgttctgtttc

SEQ ID NO: 8653 - DNA, 1500 bp, Zea mays
gacaaatcctctcttggacaagccgaaccttcgctcgggtgtcctcgggttcagccaacctcgcacatggcgcgctgctccgtcgcgaaaccgctctgcgccaccaccgcgactccccgccttacccgtcgctgccggcagctctccgcgaacgccaccaccccggccatggccaccagtaaagcacggttgccggccctaaacaaaccggccaaaccgccgccgcctctcctctcgcgtccgaagctccccgtccccaccaacaccgcgactgacaccactagcggcaaggattgcaccaagaaaccaccgccggaagctacggactcacatccgccctcgtccggcgccggcgacgtgctccgcctgatggacgcgctgggcatccctcccgacgaggacatctacatatccctcctcagggagtgcgccgacgcagcagaggtggcctccgtgcacgcgcacataaccgcccgtcgcgcctccgatggactcccgtcgccggtcgccaaccgtctcctgctttcttacgccgcgtgtggggacatcgaagctgcccgccgggtgttcgacggaatgcccaccactaacggcatggcgtgggcgaccatggtgtccgcctactcggatggctgcctccaccatgaagcgatgcgtctgttcgcccacatgtgccatggaacgccggtcctggacggcgattgctactcccatgccatcgtggccgtgctgcggtcatgtacccgtgcaggcgagctacgtctcggtgagcaggtacacgctctcgtcgtcaagaaaggcaggatccacggtgacattggcagctcgctagtgcagctgtactgcgatggaggcggttttcacagaagcgcgcggcgagttctcgcgacgacgatgcagcaccactgtcaggaaccagtccctgaggcggcctggacgagcctgatcacatcctgccaccgtgaaagcctactgagcgaggctgtggatgtcttcagggacatggcgtcctcgggcgttccaaggagcagcttctccctgtcgagcatcctcgcggtgttcgcagagtcacaggacccagggtgctgctgcgggcagcaggtgcacgccgacgccatcaagcgcggcgtggacacgaaccagttcgttggctccgggctcatacacatgtacgcgaagcaagggcggctggcggacgccgccagggcgttcgagacgatcggtggcaagcctgacgccgcgtgcttgagtgccctggccatggcctatgctcgcggcggacggtacagagaggccaccagaatcatgtaccagatgaaagctgccgggatgaatccttctaaggagatggccgatgcggttaggttggcttgtttcagatgatcctgaactagtagtcgagtaggagtgccaaagagtgagttactttgattgtacaattgtgttaagcagacgccagtgcactggtgtctgattccaaacgaaaaaaaaaaaaaaaaa

SEQ ID NO: 8654 - DNA, 1519 bp, Zea mays
ggtaccctcggatctcgcccgccggccgctggataatagcatatcccgcggacaccggccacccgatcaagaactgctgctcatgtgcgcagcgcgaggctcgagccgccaaagcagggaagcagagagcaagctaataagcaaccgcgtttcccagattccttggcactgcagcagctgcgtccaagcttgctaggtggtggcggcagcagcagcctgcgcctatgtacactgcaatggcagcgcgaccgctgcttcttccccctccggtcctcctcctcctggtggtgctggctgcttcgtcggccgcccatggctacggcgcctacggctacggcgacgctgctgctgagctcagggtcgggttctacaaggactcgtgcccggacgccgaggccgtcgtccgcaggatcgtcgccaaggccgtccgcgaggaccccacggccaacgcgccgctgctcaggctccacttccacgactgcttcgtccggggctgcgacggctccgtgctcgtcaactccaccagggggaacacggcggagaaggacgccaagcccaaccacacgctggacgccttcgacgtcatcgacgacatcaaggaggcgctggagaagcgctgcccggggaccgtctcctgcgccgacatcctcgccatcgccgccagggacgccgtctcgctggccaccaaggtggtgaccaagggcggctggagcagggacggcaacctctaccaggtggagaccggcaggcgggacggccgcgtgtccagagccaaggaggccgtcaagaacttgccggactccatggatggcatccgcaagctcatcaggaggttcgcttccaagaacctcagcgtcaaggatctcgctgttctctcaggcgcccacgcgatcggcaaatcgcactgcccgtcgatcgccaagcggctgcgcaacttcacggcgcaccgggacagcgacccgaccctggacggcgcgtacgcggcggagctgaggcggcagtgccggagccgcagggacaacacgacggagctggagatggtgccggggggctccaccgcgttcggcacggcctactacggcctggtcgcggagcggagggcgctcttccactccgacgaggcgctgctcaggaacggggagaccagggcgctcgtctaccgctacagggacgcgccgtcggaggcggcgttcctcgcggacttcggagcgtccatgctcaacatgggcagggtgggcgtgctcaccggcgcccagggggagatcaggaagaggtgcgcctttgtcaactagctagcgatgctgtgttgtactttgtaccctctcgccttaattaaaatttaaatgctggagtttcacctagtctcgagagaatcttccatttttactcctacatagatttaggaacgtttctaggtttcatatgattgtgaaacgtttgggctgagctcatctgtaactgtaaactctgatggaatgcgataacgtgttccatattgtgtgcaaaaaaaaaaaaaaaa

SEQ ID NO: 8655 - DNA, 1981 bp, Zea mays
tagtgtttgttggtggcatgatttaagttttctttctttattggagtctatcgaactatcggcggcaaaggtacaaaccctcctaaattgttgaaaacgttcgaaagaaaaggattggctttcttctattggaacaggtgacctcccaatcaattgcgctaagccacaccagcatgtggtatcttaattgaccgaaacctagaccgaacaggattagttccctctgctccatgcaatgttcgcctctctcctactaccactacactgactggagttgctccacaaagctgcacggctgcgcacgagaccattctgcctcgcttcaaaacgcccctacccctaccattgcctagctcaccagatcgatcttaccatggctttcctcaccatcctcctcctcgcgcgcatttccagctccattgccatctcgtccaactacatctcaaggagcgccgagcagcaggtcatcgccaccgtcgcgccggccattgttcctgacatcgacggccagggcgcgcagccgttcctcacctcgccctccggatcgtacgccgcgtacctccgccgcgccgtggacggcgccggcggcctcggcggggacgcgtgctatgtccaagtccagcaagatggcgccagcggcagcgtatgggagtcggactgcaccccggtgggtggcgctgacgcgtgcgacctggcgttctcgccggtgggcctcgagctcttcgccggagggcagtcgctgtgggacaccggggtcgacgccgatccgggaacgctgagccttgacgacggcggcgacatgaagattgttagcaaggaaggtgtgacggtgtggacggcaagcagcgagccatggacggggcagcagtgcggggctcccttgccggtgtcaacgaccgcgccttcaatggaggcgctcccaccgccgccgtcgactgccactgccactgccagcacaaaactcgtgacgccaccagcagcgactcttgctggtgcgggaagcgcggtctctccttacggagaccaaccagtagtgccgccacctgtcgacacgttgccggactttccgggccagccgccagttgacacggcacccgaacagccactgccaccgccgccagcagacgcgtctcccgccttgccggacctgtcgctgccaccgccgccagcttacacgcctcccgactcgccggaccagccgctgctggcacccccgccagctgacatgttgccagacgagccgctgtactcatcgccgcctccagctccagccacctttggccctcaaacgccattgccgccattcggcgtgccactcgccgccccgccgaccggcgacacagtcccggacacggccacgccatctggcgagccaggatcgcctggccgcgtgcccttctcggggccatctcctgccggcatgccgcgccagcacgggcatccacaccagcagccccttgtaggatcgccgccgctgccggacgcgctggcgccgggcgtccacggtgcgggagccgggcagcccggtacccccttcggccatgggcagcagcaggcggggcagggcgtgttcggccagcagccgcagctgctcaacggcgaggggcagccgttggaggacagcgccgccggtgggtggtcaagaacaagaagcgagagcggcagggtggccgcgtgcgtggccttgttcggtctcatgacgttgggctttgccttttagtttgtttcccttttgtgttgtgttttggtttttgggattgcatggtcatttctgtagtactgtttattctccgttggtctgataggaggggtctttttgtggattgtagtaaaaaaatttgtgtgtaaaacctgtcatacggtgcgctgtctgattcattctgtaggatagcatgatctaccgtatgtacatctgtgtattatcgtgtgtaaatgtcaaatttatgctcgatttgtggtcgtaccaaaaaaaaaaaaaaaa

SEQ ID NO: 8656 - DNA, 1790 bp, Zea mays
ccggccgggccggggcttccgttggcaggcccaggctccgctcctctttttaaaaacgctccccatgccggcccgctcccaggaccagtcagcactcagcacacagagtccgcctccgccgcggctccggcgcccgcatccgtctcaggagtcccttctccccgcgggtggagacatcttgatcatttctgagattaaactgatgatgctgatgctcgtttagttatcttggtttggagatatatcagatatgggtgatcggaatcatggacgctctctccctctactgctctatctacatcttttgctgccaatacttccgtttgctatggcagatatagcctccgagaagcaagcactccttgcttttgcctctgcagtctaccatggcaacaaactgaattggagccaaaatatcccagtgtgctcatggcatggtgtgacatgctcactggatcgatcgtgtatattggcccttagggtgccaggtgctggtttgattggtaccattcctgctgatactcttggcaggcttgtgtccctccaagttttaagcatgaggtctaaccgtttgagtggaagccttccgaacgatgttgtctcacttccttctttacaagccatatttgttcagcacaacgaactgtcaggagacttgcctccatttctctctccaaaccttaatacccttgatctctcttacaactcctttacaggacaaatcccatcaggtttgcagaatcttaccaaattgtctgtcttgaatttagcagaaaattccctgtccgggccgattccggatctcaaacttcctagcttaagacagctaaatctgagcaacaatgaactgaatggttcgattcctccctttttccaaatcttctcaaatagttccttcctagggaactctggattgtgtggaccgccgctaactgaatgttcttttctatcttcaccaacaccgtcgcaagtgccttcaccaccaaaattaccaaatcatgagaagaaggctggcaatggcttggtaatcgtggctgttgctgggagctttgtcatatttctgctagctgctgtgatgttcactatgtgcatttcaaagaggaaggagaagaaagacgaagcgggttacaacggtaaggttactgatggtggaagggttgagaagcgcaaagaggatctcagcagcggcgtccaaatggcgcataagaacaagttagttttcttggagggatgcagttacaactttgacttggaggacttgctgagagcttctgctgaagttctcgggaaagggagctatggaactgcctacaaggctatactcgaggatggctctactgtggtagtcaagaggctaaaggatgtcgtggcagggaagaaagaatttgagcagcagatggagctcatagggagggtaggtaaacatgcaaacatcgcgcctattcgtgcttactactactcgaaggatgagaagcttgttgtttatgagtatattggtagaggcagcttctcagctctgttgcatggtatcaagggcgtgtgtgagaagaccccattagattggaacacaaggatgaagattatactcggaacagcacgcggcctcgagcacatccattcagaaggcggctccaggctcgcacacggcaacatcaagtcaaccaacgttctgctcgacggagaccacaacccttacgtctcagactacgggctgagctcgttgacgagccttccgatcaccacttcccgagctgtcgctggctaccgagctcaggagaccttcgaatcga

SEQ ID NO: 8657 - DNA, 2352 bp, Zea mays
  misc_feature (4)..(4): n is a, c, g, or t
  misc_feature (13)..(13): n is a, c, g, or t
  misc_feature (25)..(25): n is a, c, g, or t
cggncgcgtgggnaccatcatgtgngatggagacattggggacctcgagcagagcaggatgaaatggttaaagagcaccgcaagcggaaggagtttgaagtttttgttggtggtctggataaagatgcaacagaaaatgaccttatgaaggtttttggtgaagttggtgagatcactgaagttcgtctgatgatgaaccctgtcacaaagaagaataaaggctttgccttcctgcgatatgcaactgtagagcaagcaaggcgtgctgtttcagagctaaagaatccactggtgcggggtaaacaatgtggcgttgctccaagtcatgacaatgatacactctttgttggcaatatctgtaaaacatggacaaaagaacatttgaaggataaactgaagagttatggtgtcgaaagttttgacgacttactacttgctgaggacactaacaatcctgggatgaatcgtggctatgccttgcttgagttttctactcgacctgaggcaatggatgctttcaggacattacaaaagagggatgtagtatttggagttgatcgtagcgcaaaggtttcctttgctgattcctaccctcaagtcgatgatgaaataatggcacaggtcagaactgtatttcttgatggccttcctccctcatgggatgaagaccgtgttaagaaatatctcaaaaagtatggagctattgagaaagtcgaacttgcacgaaacatgccagctgccaagagaaaggattttgggtttgttacatttgatacacatgataatgctgttgcatgtactgaagggatgagtaactctgagatcggtgaaggtgaacacaaggcaaaagtaagggctagactgtcgagaccattgcagagaccacctagaatgaaacatggattgagaggaaattttagagttgggcatggtgccccgcgaggtggccgtttaccatattctcgtgctcctccacctcgcaggcctccgccacgtcttattcggcctgctgttagccgcttaccatccatcaggagtcatccgttgaagcggcccatagatattagagataggcgtcctgctatgtcaatgccagatagagctaggcgtttccctccagagagatcttatgacaggaggcccccagctccagtttacctgaagagaagtccaaggagagaatacgggaggcgtgatgaacttcctcctccaaggagcagagctacaactgattacattaccagagttccggttgatagacgtccctctttgagggatgattattcaccccggggatcaggttattcagacctcggtcctcgtagtgctccccgtctttctgataggcgagcttatgctgatgatagttatggggagaagtttgaccggcctttagtggcctatagggagggtcgcggccgtgattatgacaccatttctggatcaaagcgtccgtatgcagatatggatgatgtgcctcggtaccaagaaatcggtgtccgtcagtctaaggcacgtttagactacgacattggtggcagcagtgctcggtatggagatacatatagtgagaggtctggacgaccacatgcgggatatagtagcagccgatctatccctgttcatgattcagcatatggcagcagccgtcatggaatgagttatggaggttctgctagcagtgctgatgctggtggtatgtacccaccgagttacagtggtagctatgggtctcgtggatctgatgttggtgggagttcatattcttcactttactcgggtcgcaatttgggtaccagcagtggtggctactatggaggtagcggttccagttcatattactaagatttggcatcataggactttggtgtaggccctgcattttatggagctcctcgatttaagccacacagatctgtaaaagaagtgccaagcacccaagtgaggcaatgttttccaataagacatttcaacgaagccagaccatcgatttggttcgagcagtagttctgaggacgttctggcttgtttatgtaatgtaaggatttgctttatctggtcaagagttctgaacataacaaccagatatggtgttttaagtgtttcgacatgtttacttccagtgtttctataacattattgagacagatatggagtgtactttgaggtagtttctgcaattcaagttatttggggattacatcttgtgatgtgccggcaaaggccaggcttacaaaagaagttttggaatgagtgcttcttgtaaggctgttagtttctgaaaccctcccttcccttctgtcttctagaggatcaataatcaccaagacagaatgttgattggtcagactt

SEQ ID NO: 8658 - DNA, 1160 bp, Zea mays
  misc_feature (1152)..(1152): n is a, c, g, or t
aattcggcacgagggataagtaactctgaaattggtgaaggtgatcacaaggcaaaagtaagggctagactgtcgcgaccactacagagaccacctagaatgaagcatggattgagaggaaattttagagtcgggcatggtgccccacggggtggccgtttacagtacgctcgtgctcctccacctcgcaggcctccaccacgccttgttcggcctgctggtagtcgcttaccaccaatcaggagccatccattgaaacgacccatatacatcagagatagacgtcctgctatgccaatgctagatagagctaggcgtttacctccttcagggagggctggtcgcggggggcccccagctccagtttacctgaagaaaagtccaaggagagaatacgggaggcgtgatgaacttcctcctccaaggagcagagctatgattgattacagtcctagagttccagttgatagatgtccctctttgagggatgattatttaccccggggatcaggttattcagacctaggtcctcatagtgctccccatctttctgagaggcgagcttatgctgatgatagttatggggggaagttcgaccggcctttaccagtctatagggagggtcgtggccatgattatgacaccgtttctggatcaaagcgtccatatgcagatatggatgatgcgcctcggtatcaagaaattggtgttcgtcagtccaaggcacgcttggactatgacatcggtggcagcagtgctcgctatggagatacatacaacgagaggcctggacgaccacatgcgggatatagcagtagtcggtctatccctggtcatgattcagcatatggtagcagccataatggcatgagttatggaggttctgctagcagtgctgatgctggtggtatgtacccaccgagttacagtggtagctatgggtctcgtggatctgatgttggtgggagttcatattcttcgctttactcaggccgcaatttgggtagcagcagtggtggctactatggaggtagcggttccggttcatattactaagatttggcaataggacgttggtgtagtcactgcattttgtggagctccttgatttaagccctacagatatggaaaagaaatcccaagcacccaagngaggcaat

SEQ ID NO: 8659 - DNA, 749 bp, Zea mays
agcagtggtaacaacgcagagtacgcgggacgccatgatgagcttccaatggacagctgtcaagttcttctggttcttcttcatttcctacttctccttcctctacttcacctactatggcatgatggctgtctcaatctccccaaaccatgaggttgcatccatcttcgcagcagctttcttttctctcttcaatctcttctcaggcttcttcattccgagaccgagaattcctggatggtggatctggtactactggatttgcccactggcatggacagtgtatgggctcatcgtgacacaatacggagacctggaagacctcatctcagtccctggagaaagtgagcagacgataagctactatgtaacacatcattttggataccacagggattttctgccggtcattgcgccggttctggtactctttgcagtattcttcgcgttcttgtacgcagtctgcatcaagaaactgaacttccagcaacgataagaacaagatatggcagcaaaagctcttgagagtttttttggaacattgccgtgtatatagggtattttgcacatcgcgttctccttttcattttttgagtccctttaatacattgtcgtgtatatagggtattctgcacatcgccaaatgtggtgaggtcttatacagatttctagccatttattgcaagagcaaaaccaaaaaaaaaaaaaaaaaaaaaaaaaaaaaagtactctgcgttgttaccactgct

SEQ ID NO: 8660 - DNA, 678 bp, Zea mays
cccgggtttctggatggacatcgggcagccgagggactacatcacgggcctgcgcctgtacctggactcgctgcggaagaaggcgcccgccaggctcgcgtcgggcgcgcacgtcctgggcaacgtgctggtgcacgagaccgcggtcatcggggacggctgcctcatcgggcccgacgtcgcggtcgggccaggctgcgtggtggaggccggggtgcgcctgtcccgctgcaccgtcatgcgcggcgcgcgcgtcaagcagcacgcctgcgtctccagcagcatcatcggctggcactccaccgtcggcaagtgggcgcgcgtcgagaacatgaccatcctcggcgaggacgtccacgtctgcgacgagatctacagcaacggcggcgtcgtgctcccgcacaaggagatcaaatccagcatcctcaagcccgagatcgtcatgtgatccgggagtaaatctggggcgccaaatccaaatcacaaggggcccttgcattgcattgcatcgcatcgcatcccatcccgatatgcttcatacttttgttgtttgattttttgctcggtcgtttgtctgcaagtgtaaccagttgtcgagtgtttaatttgtcggctatatagacgattttcaagtttcgctcaaaaaacggacgcgcggccactagttctagatcgcga

SEQ ID NO: 8661 - DNA, 4977 bp, Zea mays
cctgcagatgtagatgaattgtatgtcgagatagaattctagtaggctttattaggatttgaagatgtatagatatagatagagatagatatgaatgtagatacaaatatagatacatatacagatacatatatgagtatagatatagatacatatatagatatagatataaagatcataataaaacacatgaattaggtgagcttctgatccctagaaaaatcccagaataaaaagggaaactgagagaccttaatggtctagattaaataaatcaaaggaagaaaaaatatagagaagattttttttgtactaatggtataatatatcactttacaagcggattttcccccacgaactaaaaaacggacctctaagaagatttagagagatttttaatctaccagggatttaaacctcttcaactccctccaatctcaccaaaccgaatatgccctaagtgggcttgctcacaacaacccgtagcaatttaatcctctgggactaaactagtatgataaagaaaaaaaaaatactcgtatctagctaagcaactactagtactttactagactaatcagctagtcatgatgtacttagtattaccacttttaaccaataagtgacatttcatggtttaagccaacaatttcaatttttggtcacaggctcacagctaagttttttacaggttgaatttagacgatatttgaaagaatatcaaatataattctgctatgttttgaactgtagtttcaaaacatataattctgctatgttttgtaaaattttataatgaatgatcataaacttccgtataggtgcacatatacgtagtttttggaaaatttgggccatggtacatcttttgagttcattttgtctcacactcagagatacacaatcgtgtgattatgctgctgaccattctgttttcccactcaaagctccggatccgcagtagtacgtacgccagtaaaggcatagtacaacagtattcatagcaccacaagccatgtgattaaaaaattacgtggctcacgcgcgggattgcttccaatgcagttattttataaagttgaagagaaggtatcacgcacgggccgagccgagccgagtcagcgtgattagcagacgagcagtagtagtagaacggatcgtggtttctacaatcggacgctgcacattgacctaggaaatcgcgttactaccaaggatccggcccggcccttggcccatcaccatcagtgaccaattcgtgcctttgctgtactcgtactcacaacgggaacacactttcaataccgtataaaataaaaagtaaactcgtatgaagtcttccttcatcgaataataagaagaaaaaaaggaaaggaaatggaagacgaacaagccagggcgcgaagacgaacgcgcgcgtcgcacgtacgtggcttgacgaacgacgaggtggcgtgccgccgataaacacggccgtgaaatacgggccggacgggcccattggtcatcgagcccgggcgcccacctaaagcacgggccaaagcgcacgcgcgcgcgctcgagagagagaggaatcggtagtgccagagccagacagaccaccaggtcgccgcggtctcggcgtcctcgtcgtcgcacgtaggaacgcgcctaactttagaggtcgcctaacggaaaaaaaaacagagtccagcacagagccgccggaggtagcagcgtgtggcccgcgtgtcatcctgtgcgtaagctgctgctggtgggcgcccgctgtttaatctccgggtatccgggtaggtgggttctggcgggttgggacgagctcgggccagcaaatggttgctgcgaaatactacaaaaaagggagaagagacgaagaaaagctcgatgattaattggcggcgaagccagtacattaaacacttcgtcaaccccaaccgtagtagtgctcaaggggagacggaggaggaggaggaagcggtataaagccgcggcgtcgttcgtcggcagccgcgtcctgagtcgctcgcagtcgcagccgacgccttttcctcctccttgtcttcttcctcgctgcagctctcgccgccgaggtcccgggcgccgtccacaaaccacctccctcccccgtctctcgtcgtctcggaaggaacggccgcccgtcgcgccaaggattcaaggtgcgtgcaccgcgcttcttgcagagagaaggtgcgctggtataagtatgctgattctctgctactgcctgttacgatttctgccatgttctctcgtttcctcccagctgtgccagtgcctgtgttcgccggtttggggggacagatcaccatgtcttgtcacacaactttgtaatctcgtagtgatggttcgtggtgctcattgtgtgtcggtagggaagatttaatttcacgatgccgcagacaagatcatccaggaaggcccaggacagatctgcaatgagcaacgcccactgttcattccttccgttcctttcctatccccactgttgagaccatgtcgtcacttcatcatctcatcatggatccagcctgtaaccatttcgcccttaaaaaaagatactactaggggttgattaataatagatagatgcacacagacaaaaatagaaaaagtcagctgttgcagtggcgtggttcgttttgcggtgggaggggaagggaggggacatataaggacaagtgcgtttccagcagcatacggcgcccggatacggatagagctatagatggatcacgcattcaggccctgatgcgagcgctccccccgccatttccttcaacttctgctaaatagcctaatacccccatcggccgatcggctcctctacctgcatttgccgattggcgtcttcctcgtcaacgaccagatccatcccctctccacccggggacggggggtctagaacgtcgtcaggtcgtccttatccgcgtgctggccttcggatttcggctgccgcgttggtttaacacaaaccacgcgtccatgcctgccgcttccgcaggctccatgccactgccacctgggtgggttttctttccgggggcacatcacacatggcgtccgtccgcgtaggcacagaaggcttctcctggagttcagtggctattccctactaactgctaactggcagcagcttctggatcgggccatcggggtcggtggatctcactgttttcttttcctgctgcttgctgcatttttcgcagggtgtgggagctgagttgggaggaggactgctgctgcagcccggaaggccctcattctcgtcggaggcttcggcacccgcctgcgcccgctcacgctcagcgtgcccaagccgctcgtggatttcggcaacaagcccatgatcctgcaccaggtcagcgcgattcctccgtctctgggacaaagttcagttctttgtttttagtcattagatacagcgcagggcgaaccggggaagttcatattcagttgtaggaattggctatggtttcctgttgctgaattgatactgtatttggttgttctttcttggactgaatttactgaatgaatgctgtgaatacccacccagatcgaggctctgaaggaagttggtgttacagaggttgtcctggccatcaattaccagcctgaggtaacataacaggcccgtctctgtctgtctgtctgtctccatcagcaagcaagaagcaagcgcacgtgaacctttgtcgggcgctcagatccatctgactcgccatgctttcggtaaaacccccgcaggtcatgctcaactttctcaaggacttcgagagcaagcttggcatcaagatcacctgctcgcaggagacggagcccctcgggaccgcaggcccgctggccctggcccgcgacaagctcgccgacggatccggcgaccctttcttcgtgctcaacagcgacgtgatcagcgagtacccgttcgccgagctcattgagttccacagggcccacggcggcgaggccacgatcatggtgaccaaggtcgacgagccgtccaagtacggcgtggtggtcatggaggagggcaccggcaaggtggagcggttcgtggagaagcccaaggcgttcgtgggcaacaagatcaacgccggcatctacctgctcaacccgtccgtgctcggccgcatcgagctgaagccgacgtccatcgagaaggaggtgttcccgcgcgtcgcggcggacggggccctcttcgccatggttctcccgggtttctggatggacatcgggcagccgagggactacatcacgggcctgcgcctgtacctggactcgctgcggaagaaggcgcccgccaggctcgcgtcgggcgcgcacgtcctgggcaacgtgctggtgcacgagaccgcggtcatcggggacggctgcctcatcgggcccgacgtcgcggtcgggccaggctgcgtggtggaggccggggtgcgcctgtcccgctgcaccgtcatgcgcgccgcgcgcgtcaagcagcacgcctgcgtctccagcagcatcatcggctggcactccaccgtcggcaagtgggcgcgcgtcgagaacatgaccatcctcggcgaggacgtccacgtctgcgacgagatctacagcaacggcggcgtcgtgctcccgcacaaggagatcaaatccagcatcctcaagcccgagatcgtcatgtgatccgggagtaaatctggggcgccaaatccaaatcacaaggggcccttgcattgcattgcattgcatcgcatcgcatcccatcccatcccgatatgcttcatacttttgttgtttgattttttgctcggttgtttgtctgcaagtgtaaccagttgtcgagtgtttaatttgtcggctatatagactattttcaagtttcgctccgtgcttgtagataggtatcagtcgtctatcagatgagtggaaataacaacttctcttcgtataataaaaaaaaaaaaaaggaaggccccgact

SEQ ID NO: 8662 - DNA, 1998 bp, Zea mays
ttggcgcgtgggcgttttgcggtgggaggggaagggaggggaggcagccgctggaacacatagggacaagtgcgtttccagcagcatacggatagagctatagatggatcacgcattcaggccctgatgcaagcgctccccccgccatttccttcaacttctgctaagtagcctaatactcccatcggccggtcggctcctctacctgcatttgcggattggcgtcttcctcgtcaccgacccgatccatcccctctctacccggggacggggggtctacaacgtcgtcaggtcgtccttatccgcgtgctggccttcggatctcggctgccgcgttggtttaacacaaaccacgcgtccatgcctgccgcttacgcaggctccatgccactgccacctgggtggcgttttctttccgggggcacatcacacatggcgtccgtccgcgtaggcacagaaggcttctcctggagttcagtggctattccctactaactgctaactggcagcagcttctggatcgggccatcggggtcggaggatctcactgttttcttttcctgctgcttgctgcatttttcgcagggtgtgggagctgagttgggaggaggactgctgctgcagccatgaaggccctcattctcgtcggaggcttcggcacccgcctgcgcccgctcacgctcagcgtgcccaagccgctcgtggatttcggcaacaagcccatgatcctgcaccagatcgaggctctgaaggaagttggtgttacagaggttgtcctggccatcaattaccagcctgaggtcatgctcaactttctcaaggacttcgagagcaagcttggcatcaagatcacctgctcgcaggagacggagcccctcgggaccgcaggcccgctggccctggcccgcgacaagctcgccgacggatccggcgaccctttcttcgtgctcaacagcgacgtgatcagcgagtacccgttcgccgagctcattgagttccacagggcccacggcggcgaggccacgatcatggtgaccaaggtcgacgagccgtccaagtacggcgtggtggtcatggaggagggcaccggcaaggtggagcggttcgtggagaagcccaaggcgttcgtgggcaacaagatcaacgccggcatctacctgctcaacccgtccgtgctcggccgcatcgagctgaagccgacgtccatcgagaaggaggtgttcccgcgcgtcgcggcggacggtggcctcttcgccatggttctcccgggtttctggatggacatcgggcagccgagggactacatcacgggcctgcgcctgtacctggactcgctgcggaagaaggcgcccgccaggctcgcgtcgggcgcgcacgtcctgggcaacgtgctggtgcacgagaccgcggtcatcggggacggctgcctcatcgggcccgacgtcgcggtcgggccaggctgcgtggtggaggccggggtgcgcctgtcccgctgcaccgtcatgcgcgccgcgcgcgtcaagcagcacgcctgcgtctccagcagcatcatcggctggcactccaccgtcggcaagtgggcgcgcgtcgagaacatgaccatcctcggcgaggacgtccacgtctgcgacgagatctacagcaacggcggcgtcgtgctcccgcacaaggagatcaaatccagcatcctcaagcccgagatcgtcatgtgatccgggagtaaatctggggcgccaaatccaaatcacaaggggcccttgcattgcattgcattgcatcgcatcgcatcccatcccatcccgatatgcttcatacttttgttgtttgattttttgctcggttgtttgtctgcaagtgtaaccagttgtcgagtgtttaatttgtcggctatatagactattttcaagtttcgctccgtgcttgtagataggtatcagtcgtctatcagatgagtggaaataacaacttctcttcgtatactacaagttgagcaactcc

SEQ ID NO: 8663 - DNA, 1865 bp, Zea mays
cggacgcgtgggcgttttgcggtgggaggggaagggaggggaggcagccgctggaacacatagggacaagtgcgtttccagcagcatacggatagagctatagatggatcacgcattcaggccctgatgcaagcgctccccccgccatttccttcaacttctgctaagtagcctaatactcccatcggccggtcggctcctctacctgcatttgcggattggcgtcttcctcgtcaccgacccgatccatcccctctctacccggggacggggggtctacaacgtcgtcaggtcgtccttatccgcgtgctggccttcggatctcggctgccgcgttggtttaacacaaaccacgcgtccatgcctgccgcttccgcaggctccatgccactgccacctgggtggcgttttctttccgggggcacatcacacatggcgtccgtccgcgtaggcacagaaggcttctcctggaggtgtgggagctgagttgggaggaggactgctgctgcagccatgaaggccctcattctcgtcggaggcttcggcacccgcctgcgcccgctcacgctcagcgtgcccaagccgctcgtggatttcggcaacaagcccatgatcctgcaccagatcgaggctctgaaggaagttggtgttacagaggttgtcctggccatcaattaccagcctgaggtcatgctcaactttctcaaggacttcgagagcaagcttggcatcaagatcacctgctcgcaggagacggagcccctcgggaccgcaggcccgctggccctggcccgcgacaagctcgccgacggatccggcgaccctttcttcgtgctcaacagcgacgtgatcagcgagtacccgttcgccgagctcattgagttccacagggcccacggcggcgaggccacgatcatggtgaccaaggtcgacgagccgtccaagtacggcgtggtggtcatggaggagggcaccggcaaggtggagcggttcgtggagaagcccaaggcgttcgtgggcaacaagatcaacgccggcatctacctgctcaacccgtccgtgctcggccgcatcgagctgaagccgacgtccatcgagaaggaggtgttcccgcgcgtcgcggcggacggggccctcttcgccatggttctcccgggtttctggatggacatcgggcagccgagggactacatcacgggcctgcgcctgtacctggactcgctgcggaagaaggcgcccgccaggctcgcgtcgggcgcgcacgtcctgggcaacgtgctggtgcacgagaccgcggtcatcggggacggctgcctcatcgggcccgacgtcgcggtcgggccaggctgcgtggtggaggccggggtgcgcctgtcccgctgcaccgtcatgcgcgccgcgcgcgtcaagcagcacgcctgcgtctccagcagcatcatcggctggcactccaccgtcggcaagtgggcgcgcgtcgagaacatgaccatcctcggcgaggacgtccacgtctgcgacgagatctacagcaacggcggcgtcgtgctcccgcacaaggagatcaaatccagcatcctcaagcccgagatcgtcatgtgatccgggagtaaatctggggcgccaaatccaaatcacaaggggcccttgcattgcattgcattgcatcgcatcgcatcccatcccatcccgatatgcttcatacttttgttgtttgattttttgctcggttgtttgtctgcaagtgtaaccagttgtcgagtgtttaatttgtcggctatatagactattttcaagtttcgctccgtgcttgtagataggtatcagtcgtctatcagatgagtggaaataacaacttctcttcgtat

SEQ ID NO: 8664 - DNA, 897 bp, Zea mays
gatgattaattggccgcgcccccagtccagtccgcacttcgtcaaccccaaccgtagtagtgctcaaggggagacggaggaggaggaggaagcggtataaagccgcggcgtcgttcgtcggcagccgcgtcctgagtcgctcgcagtcgcagccgacgccttttcctcctccttgtcttcttcctcgctgcagctctcgccgccgaggtcctgggcgccgtcgacaaaccacctccctcccccgtctctcgtcgtctcggaaggaacggccgcccgtcgcgccaaggattcaagggtgtgggagctgagttgggaggaggactgctgctgcagccatgaaggccctcattctcgtcggaggcttcggcacccgcctgcgcccgctcacgctcagcgtccccaagccgctcgtggatttcggcaacaagcccatgatcctgcaccagatcgaggctctgaaggaagttggtgttacagaggttgtcctggccatcaattaccagcctgaggtcatgctcaactttctcaaggacttcgagagcaagcttggcatcaagatcacctgctcgcaggagacggagcccctcgggaccgcaggcccgctggccctggcccgcgacaagctcgccgacggatccggcgaccctttcttcgtgctcaacagcgacgtgatcagcgagtacccgttcgccgagctcattgagttccacagggcccacggcggcgaggccacgatcatggtgaccaaggtcgacgagccgtccaagtacggcgtggtggtcatggaggagggcaccggcaaggtgggagcggttcgtggagaagcccaaggcgttcgtgggcaacaagatcaacgccggcatctacctgctcaacccgtccgtgctcggccgcatc

SEQ ID NO: 8665 - DNA, 3136 bp, Zea mays
  misc_feature (844)..(844): n is a, c, g, or t
  misc_feature (1002)..(1002): n is a, c, g, or t
cccacgcgtccgcccacgcgtccgcaggcctaacatccatacaactggggttacgaaccccgaacaacttgattcgtagaccacacaactatggggacacaaatcatccccacttaattttggacctgtacaactagggtacacacctgacacgtcctgtccaaagaccaaaggctgttaatccaatctcttggcaccacaactcacctagaagagcatcactgataatgacttacaactatctctacaaaaaaaaaacagccaagcatgcctggacaaccatgctagtccaaaatccaaatgtcagggcaactactcaaagctgcctgtacaaaaccaaaaactaataaggaaaaagagtggcatcaaactagatggaaagtgccaagctacagagctggaatagcctagtgaaaccttcaagaaggtaatgacgccagggaacactgattctgcccccagtccaacaacgtcccccaagtggatttggccgaccctgatgtagcacgatgcaaaaccaccaaatgccacaggagcagaagagaggagggggaggaaggaaagggaagggaagggaagggagaaggcacgggggagggctgagagggcctcgccgccgccctctcactgctcgccaggccttcggcaggagctctggcaagcggcagaggcagtgatagggttgagggaggggtgctggcagggggatatgggacctgctcgatgcggattaagtggggttgagttgtttctctactatatactatgtcatgctctcattggaaaaaagttccacatcttatttgattgttgtccattatgaatgaactaatgttgagatagntatatcagttatctcatctcctccttttacattttgttctaaaaccccaacacatatttgtgattcaggtacccttactttgctgctgttctcaactttagtcaatattgggccctgtactgtctagtagcatggtatacagccaccaaggacgaatnggctcctataaagcctctggctaagtttctttctttcaaatcgatagtgttcttgacttggtggcaaggtgtggtgattgcaataatgtatgctttgggccttcttagaagccctttagcccagagcttggagttaaaatcaagcattcaagatttcattatttgcatagaggtattcatccttccagggtgtttttaactttttattctctatctttgcctttgcttaaaaatcatttcattcatgttatgtggctagttatagatacctgatagcaccatggcttcctccaggacagatgggcattgcttcccttgttcacctctatgtgttcccagccaagccctatgcactcttaactaatcagtcacacggaaacatttctgtacttggggactatgtatcctctgagcccgtggacccttttgaaataaaggaaagcaaccggcctaccaaaatgaagcttccacagttggaaccagatgagagaagcgtgacaaacataaaagaaagtgttcgggactttgttgtcggcagtggtgaatatgtgagtgctgggaccaaatcttctttctgagtatttgcgacaaatttactctctttatacgttattgtaggttgagttttgaattttttgaaccagtagaataaatcttattaacttgacagtcaaatatgttctcttgtattattactttatgggttgtgtgggtttgcagaacatgtttgtgagcataatttccatgtgtttgttttgttttcttccctctaaattaggtgatcaaagattttaagttcactgttaaccaagcagtgcgaccagtggagaagcgcattgataaattgatgaaaaagaatgataagagtaagaaaagccaggacgacaactgggtgagtgcagcaacaccagagaggcctgttcgtgggattgatgatccattattaagcggaagcgcaagtgacagtggtgtcacaaagggcagaaaatatcgcagagttgtgagctcagttactgctgtggacagctggggaggtggtgatcaagcttctgacggatatgagatcaggggtcgccgctgggctgtaaaaagctaacgatttacatagcgagatggtaaattcgaaccatatcgcgtggggggaaaaggacttttaggtttgcaactgtttctgcgatactggccatttaggagccttcgcaagttcagattgtctttgtataggtacttaggtagctgataatgatatgtaacctttttgcgtagattgtttaattttcttttctttttcttggtcgagtcgtactgacatttggtattgcaaaatttgaaagtacaatagtttttttcattctttggaaatggaaacagagttcagcgagtgtgtccatttggacggatttgtatagtttcgttacacgcttacatgcatctttgatctgaaaaactgtcctcggcataactgagaactgacgttacattttatttctgatcgaggaatattctcttcaatacgaatccagaaccatggatcgggcggtggacgtggccacgtcgcccgctacgaagaagtgccatcccattatgagtcaaaccggtctcggttgggtttctttgcagacacaaaactctagaacttctcactcgttgacccatgctccctcccagttgagcccttgttggagtgtttttttttttttggagtttaggaatataagactgcattcgagacaagttgctccgaggatatatggaactagccccttgctctaaaactgaaataagattacatctgcgagatgaggccaagaagtacttgtatggtctaaaggtatcaccatattcatgtgccttttatttgtgttaaggctagtttgagaacaccattatttctaagtgattcctatttttccaagaaaaaatgaactatttttttagaaattgtaaatcccttgaaaaaaataggcttcttaaactagcctttaattggcttctggtgcaaatatatgatgggcaccaagattgttgtagctgctatctattttttttaccttggagtccaaccgtgttacctgaaattagcaacttttattagacttgcacatgacatcaacagtgctaacatggaaattgt

SEQ ID NO: 8666 - DNA, 1624 bp, Zea mays
ggtaccctcaaaaagccaattggcgtcacgtcgtcgcctctgcggaaaccggcggtccacgggaaaggaaagaggaaacagggaggcgacgccgtcacaattcgttctcgcgatttgcccttctccacctccccgtccatgtcgcgggaaatcacgcgcggcgacgctggattcacttagatccaacagggtaatcggcacggggcagcctctccacccattcccgcagccggttgggcgagtcgtcggttcagataatagactgggcgtgtggatccaagaggtttgatccctttaatttggattgaagtgccagctttcggtcaggaaggtgatgctggatgatgctgacggactttgaaagcataccggttcaaagaagtgttgcctgtcaccatgaggctcaacgttgggctcctagtgcccttgatggcacaatactccgcacccacatgggctactttagttgctgggttcttcatgctgcttgcgctttcgctctccacgtacctgatatttgagcatctctcagcatacaacaatccagaggaacaaaaatttgtactgggtgttattctcatggtcccttgctatgcaattgagtcatgtatttctttgataaatccaagtacaagcgtttactgtggcatcctacgtgatggttatgaagcatttgcaatgtactgctttggaagatatattactgcatgtttaggtggggaagataaaacaatagcctttttaaagagggaaggtggctctggttctgggcagtctctactgcatcacacgtccgagaagggaatcatacaccatcattttcctgtaaattatgtattgaagccctggagactggggacgcggttctacctgattatcaaatttggaatcttcccatatgtgatcataaagaccctcacagccaccttatctcttcttctagaatcttttggtgtttattgtgatggagaattcaatttacgatgtgggtacccttactttgctgctgttctcaactttagtcaatattgggccctgtactgtctagtagcatggtatacagccaccaaggacgaattggctcctataaagcctctggctaagtttctttctttcaaatcgatagtgttcttgacttggtggcaaggtgtggtgattgcaataatgtatgctttgggccttcttagaagccctttagcccagagcttggagttaaaatcaagcattcaagatttcattatttgcatagagatgggcattgcttcagttgttcacctctatgtgttcccagccaagccctatgcactcttaactaatcagtcacacggaaacatttctgtacttggggactatgtatcctctgagcccgtggacccttttgaaataaaggaaagcaaccggcctaccaaaatgaagcttccacagttggaaccagatgagagaagcgtgacaaacataaaagaaagtgttcgggactttgttgtcggcagtggtgaatatgtgagtgctgggaccaaatcttctttctgagtatttgcgacaaatttactctctttatacgttattgtaggttgagttttgaattttttgaaccagtagaataaatcttattaacttgacagtc

SEQ ID NO: 8667 - DNA, 1082 bp, Zea mays
cttgtttcatggtatacagccaccaaggacgaattggctcctatcatgccgctccccgaggcccgcccggtccaatcgatagtgttcttgacttggtggcaaggtgtggtgattgcaataatgtatgctttgggccttcttagaagccctttagcccagagcttggagttaaaatcaagcattcaagatttcattatttgcatagaggacagatgggcattgcttcagttgttcacctctatgtgttcccagccaagccctatgcactcttaactaatcagtcacacggaaacatttctgtacttggggactatgtatcctctgagcccgtggacccttttgaaataaaggaaagcaaccggcctaccaaaatgaagcttccacagttggaaccagatgagagaagcgtgacaaacataaaagaaagtgttcgggactttgttgtcggcagtggtgaatatgtgatcaaagattttaagttcactgttaaccaagcagtgcgaccagtggagaagcgcattgataaattgatgaaaaagaatgataagagtaagaaaagccaggacgacaactgggtgagtgcagcaacaccagagaggcctgttcgtgggattgatgatccattattaagcggaagcgcaagtgacagtggtgtcacaaagggcagaaaatatcgcagagttgtgagctcagttactgctgtggacagctggggaggtggtgatcaagcttctgacggatatgagatcaggggtcgccgctgggctgtaaaaagctaacgatttacatagcgagatggtaaattcgaaccatatcgcgtggggggaaaaggacttttaggtttgcaactgtttctgcgatactggccatttaggagccttcgcaagttcagattgtctttgtataggtacttaggtagctgataatgatatgtaacctttttgcgtagattgtttaattttcttttctttttcttggtcgagtcgtactgacatttggtattgcaaaatttgaaagtacaatagtttttttcattctttggaaatggaaacagagttcagcgaaaaaaaaaaaaaaaaaaa

SEQ ID NO: 8668 - DNA, 928 bp, Zea mays
ggtccggaatagtgtctagacagcgaaagggacggcagagggaggagagggctcaaaccgcctgcctgctgccctgcaccccgcgcccaccccacttcttccacttccaccacctcctcccctccagtccccctctccacctgccccccgctccctggtccggcgcggagaaccagccagccagcccgtcgtcgctgtcgcccgccggtgaagcagtagccgcgcgtgacgccggatccaatccgcggccctcgccgcgcgcgcggtcatggacttcgacggcgccattggcgatcagggtgagctgtgggaatggcaaagtcaggagtatggtctgcagaaagatttgttagctgctccatgtagcagcttgtgggctgaagcacccaacaatatgggtgatgattggagcatgtttgatgagcaaacaccaattaaacattgtacagacttcgaatttcagttctgtgatataggagatatcatcgtcaaggagtttgaagaagggaaggaaactttgcaggcaaagcgcagacgcatgttgcagttctgtccagaaaatgttgagatgacacgttctatgactgaagaggggcttttggaaagtcttcaggagatggatttttcaggtaccaactgtttactgaactctgacgggactgatgaactgccagaaggatggctagtcgattgctcacaagacaccgagcctggttttccgggcagaagaaatgaatagccctgctgctgccacggaaaaagatgttgatacgtctgcacatcagaatgcttcgcctagtcaacagtctatcgtagtcaacaacaatcgtgcacaggctagacctacaccgctgaaagctggcaagagcatcatccggggcaaagaaggcgaggacatcccgtggccttttcctttcgagctcatcaa

SEQ ID NO: 8669 - DNA, 2606 bp, Zea mays
ctgcagcgataggtgtaaaacatctattgttgattttcatagaagctgcaagcgttgtttctacgatctttgccttaattgctgcaaggagcttcgcaaaggtgagatcccaggaggagaagaggtggaatatgtgccacctgaacctaaaggtaggagttattcttttggcaagattcatctactgaaggatgctgatagaagtaagaactcctcaaatggcgagtcttacaacggcatgcctgctgttgggaactccaataatggtctgttgctctggaaagcaaaaagtaatggtagcataccttgtccaccaaaggaagtaggaggctgtggtagtacacttctggacctcaagtgtttgtttccagagaagatgtttgccgagctagaatatagagctgacaaagttctcaggagtgggacattagctaaagcaatggttagtagaagtgatcggtgcccttgcttcaatcaatcaggcaagataagaactgaaagcaaatcagtaagggaggctgcaagcaggaagggctcaagcgataacttcctatactgtccagttgctactggtattcaagatgatgacatagtgcattttcagatgcattgggcaaagggtgagccagttgttgtttctgatgtccttcagttaacctctggtctgagttgggagccaatggtaatgtggcgggcattgcgggaaagatccaaaggcaaagcagaagatgagcaatttgctgtttgggcgatagactgccttgattggtgtgaggtggaaattaacatacataggttcttttcgggatatacaacaggcagaactcatgctaggactcactggcctcagatgcttaagctaaaagactggcctccttctagttcctttgacaagcgattgccgcggcatggtgccgaatttattagcgcattgccatttcgtgagtatactgatccacggtatggcccgctaaatcttgcagccaagcttcctgctggtgtcttgaagccagatcttggacccaaaagttacattgcttatgggttctacaaagaattgggcaggggcgattctgtgaccaagcttcactgtgacatgtctgatgcagtaaatatcttaacacacacagctgaagtcacttgtcagactgatattggcttaattgaaaaaatccaaaaagacatgagagagcaagatctgcaggaactatatgggggtctaaattcccgctctgagctcaagttgtcaccagctccaactgaatgcagggatgaatctgttgatgaaggattgaagacctcatatagtagagaaggcaattgtgtaaatagagacaattataatggtttggacatcaatgcattaccacctgatgacgatggagatattgcaaaggataaagaatcatctcctggatcagagtggcaaagtgaactaggtcagagttcagatcacaacaatggggtcaacacaactgatgagatgtacaatggagctcattacatttcacacaatcaaaaaagcactggcaggaaagttggcattaaacctcaagaagagaaatctgaaaaggctgattgcagtggcacatgtgcttatctaaaaggaagttctgaagataatccggaaatgcctattgtggagagctcagaggagcagagcaccggtggtgctctatgggatatcttccgcagacaggattctgataaattgcaagattatcttaggaagcattgctctgaattccggcatatttactgcaatccagtcaaaaaggtatttcacccaattcatgatcagtccttttacttaactgaggagcataagagaaagctcaaggaagaatatggtattgaaccctggacgtttgaacagaagcttggtgaagctgttttcattcctgctggatgtcctcaccaagtgagaaatttgaagtcctgcatcaaagttgcgcttgattttgtttccccagaaaatgttggtgagtgtgttaagctgacggaggagtttagacgacttccatctttccacaaggctaaagaagacaaactagagatcaagaagatggctgttcatgccctgaacgaagctgtaaacttcctggatcctcgttcctcagaagagttgaaaattggggttggtgagaacatctgtgaggatgaatctgtagatgagaaggagctgccgcctagaagaggagttgaagtgtcaggcgttgatgagaagcctaaatagaaggcgagggaggcatcaagtccaaaagtgaagctgctgatgaggtcgcccattttaggttctcggaatcgtggttaattgatttgtcaaagcccctgttcatgtatggtgatcgctggctgacaccgatggatgaagagaagcaggacacgtgtgtgctgctgatatgtcgtgtcggcgagtgacatgaatatcatccctatccctatggtattattggtcttttatgtttatgtttgatcatttgtcttattcagttttttttacaaataataaaacaagaggttaaaagtaaatgacgtcatttatttaattttaagacggggcagatgcaaaactgaaggtagccgagaaaaaaaaaaaaaaaaaa

SEQ ID NO: 8670 - DNA, 3876 bp, Zea mays
gggggtctaaattcccgctctgagctcaagttgtcaccagctccaactgaatgcagggatgaatctgttgatgaaggattgaagacctcatatagtagagaaggcaattgtgtaaatagagacaattataatggttcgtaactcaaattcgcttctggtgatgaatccaaacatcccgtttaagaataatggaatttcatgtgtcctgcaggtttggacatcaatgcattaccacctgatgacgatggagatattgcaaaggataaagaatcatctcctggatcagagtggcaaagtgaactaggtcagagttcagatcacaacaatggggtcaacacaactgatgagatgtacaatggagctcattacatttcacacaatcaaaaaagcactggcaggaaagttggcattaaacctcaagaagagaaatctgaaaaggctgattgcagtggcacatgtgcttatctaaaaggaagttctgaagataatccggaaatgcctattgtggagagctcagaggagcagagcaccggtggtgctctatgggatatcttccgcagacaggattctgataaattgcaagattatcttaggaagcattgctctgaattccggcatatttactgcaatccagtcaaaaaggtccttttcttgttgcagacttgcagtcatttctttaggaaaaaaggaatcattcttatatatatatattttatgatgatcactagtcatattaaatgagcaggtattccacccaattcatgatcagtccttttacttaactgaggagcataagagaaagctcaaggaagaatatggttaggaaaatgttgtgtgataagtgtaacgaaagatgacatgttctttgtcttatcttttgacttcctgctttaggtattgaaccctggacgtttgaacagaagcttggtgaagctgttttcattcctgctggatgtcctcaccaagtgagaaatttgaaggtgtgggcaagctttacctccaagctggatctttttccttcttttgggtgttgacatgaaatatcattgttgtgattgatggaaccatcttcatctgtgcagtcctgcatcaaagttgcgcttgattttgtttccccagaaaatgttggtgagtgtgttaagctgacggaggagtttagacgacttccatctttccacaaggctaaagaagacaaactagaggttagcaatgtgcacttgcagtgatctatctggtctatccgatgtgatggatatgttttttttccagatcaagaagatggctgttcatgccctgaacgaagctgtaaacttcctggatcctcgttcctcagaagagtaagcgaaagttggcagtcattggcagctggtgacattattggtgactcgttactgtgtgattgatctggcaggttgaaaattggggttggtgagaacatctgtgaggatgaatctgtagatgagaaggagctgccgcctagaagaggagttgaagtgtcaggcgttgatgagaagcctaaatagaaggcgagggaggcatcaagtcccaaagtgaagctgctgatgaggtcgccccttttaggttctcggaatcgtggttaattgatttgtcaaagcccctgttcatgtatggtgatcgctggctgacaccgatggatgaagagaagcaggacacgtgtgtgctgctgatatgtcgtgtcggcgagtgacatgaatatcatccctatccctatggtattattggtcgtttatgtttatgtttgatcatttgtcttattcagttttttttacaaataataaaacaagaggttaaaagtaaatgacgtcatttatttaattttaagacggggcagatgcaaaactgaaggtagccaaaccacgctatggttgctgctgtctgattccaaaatgcgttcagtccaaaacgaaagcatcagtatgttctcagccaaataaaagttttttttttttttttggcaacgagtgcttctgcaagaagccgtatgtcatatttaacacttaaatatctacgtgtgtctgtttttatgtaacaacacagcagtgttttgcctccactcatggtgacagaagtaataaaaaaaacaagtatatgccctaaggctatagtcaatagatcgtgcaaaacacgtaccgtagctgcactcacagtaagatttgaaataaaagatgagaaggagcaagctgctagggaaatcgtaacacatgtcctacatcagaccaccaccatgattgattgatatgctcgttaaatagccaaggtttgatgacggtgaaagatcaagcagcttacaaagtccactccactcctgtaccacgccgcatttgctagcccagacacaaaagtttgtagcatctcatcataatattgcttaggttccactggacccaccatgcaagcacatgacgcttcatcagctaaccatcatgatacaagacgcccaaatagaatcccactaaataccaaagctccaaaccacttgttggacacgaacttcttgttgcaatctgagcggctagacagatccacggtcgaaacctgccacgctaactgggcagctgcagctgctatgaatggatagtagggccacccaaggtcagcattgtaaccactgagtgctaagctgccgacgcatgccgcgccaaagccactgatccagtatttggtcaaatctccaaatcttaatgctgtggacttgactcctactttcaggtcatcttctttgtcctgatgcgcatatatagtatcatacaccagcgtccaacaaataccagctgtatacaatggaaggatgattgcagggtctatgctttccttaatagcagcccaccctagtaaagctccccagttgaatgtcaggccaagataagcctgaggccaaaatgtgaacctcttcatcaggggatacgagaagaccagaacaagtgaagacgcccccagaatacgactgtagttattcaattgtagaagaatgcccagtcccaatagaagctgaattccaaggaagcccactccctgtaaaggagtaagcactcctgaggcaaaaggcctacttctggtgcgctcaaccttattatcaatgtcgcgatccagaagatcattcaccgtgcaaccagcccccctgagaaggacagctccacatccgaagagtgccagcattttcaagtctggcaaatcccctggcattgctgctattgtgatcgaccacatgcagggccaggcgaggagccaggtcccaatgggtttgtcgaggcgggcgagcatggcgtacggccgcgccgcctccgggatccacttgtccacccacgtgagctgcgccttgtccgcgggtctggaagaggaggaggaggtggagagcggtgaggcgtgcgaccagtgcctcgggaggagacccctggcgtggagcagctcgggggcgaggacggccgacgccgggagcggcgggcaccggcggagcgcgatgacgtgacgccggtcggcgtgggggttattaggctcggggcgggtggaggctgggctccggggagacagcgaggagaggagagatgacagcgccgggagaggggtaagagccccgcggccccggcggcggagctcggatacggcggcgcggagcagcgccatgggtggcctgtcagttcagttgtggggaacggacggatttccaacgaaggccagttgaatgttctggtggcaggcttctcctggatggggcgggcggcggagacggacggcttgccggcggaacggcggcgggtggcgactgcgattgcgacgacggggctatgggctagggcctatggagggagggagaggcaaagggagggcccggcccaaatgtttatgtctgtttctgat

SEQ ID NO: 8671 - DNA, 3087 bp, Zea mays
gcggggcctcccaatgggtacccaccacagaatcggtcgtctacgagttcttgtccctaccactacgtgtgccaccttaacaaatctcgttgctgtcgctttcgataatgactcccaacctgccacgtctgtgcttttgcttaaggacaataataggggtagttgatttcagttttgcccatccaacgatacagaacagaaaaacctcattcgcgcctcaccttcttacctaaaattgtgagttgattacattaattggagctcgagtgatgtttaaggtgtggctcggatacaacaagacgactctctcatgcactgtaaccttctgttttagcaaaaaaaggacgtcttttatgctttggtcaatctattatgtgccgggtttagataatagttctttgacctatcctctcgttagtcctcaactacaatggtttttcaactgttataatgcaaaccaatcttaagtagaggtgtaaatggtatatacgttatctgtctatattcgaattcgatctatttaagaggactaagatccgatctgtatccaagtctaggtactcaatatctgatctatatctggtctttatctgtattctcaaagttgaatgtttaatatgtcgatattcatttaaatcttatatggcacaacttgataatatccgtatccaatcataacccgaaaataaaatatgaaaatagatatgaaacgagtgatatttgtctgtattcgatctgattacatccatatttttaagtataaccaaatttatagagaagaacaataacatctaccgtgtaaaaatgtatcataaaaaatacattatgtatacatgtaataaaacttatttgatatcataaatactctacttttctctatgaacttagtaaaaatcaatatagctcgacttaggacaacaaaaatttatcatattctaaaatagagtagatataggaacaagtgcatattgttgtaccatagcttgggaagtttcagttaccattttttatgtttacctctggatctattcaaattataatttttttagcttttcttgatatatattttactatgtacttagatatataccatggctagatacatagcacaaataatgtatttagaaaagaaaaaatcaaaataccttataattcaaaattaagagtaccttacatcctatcaaagcaataacacattttgaatttaaaggtatgttgttgggattagtgttggctagaaacacctcaagcacaactaaaccacacaagtttcaatccataattcataccgatttcttttgtgtcactattatttacttaattgtagagctgtatatgcttttaatagccaatctaaagtttcataataagttttccataggatttgaacacaacacttctctaaacacctttataattagttattacagcatgacattactaaatctttagctagaagtagacctgcatcatgtttagcatggcacgagaccattacctagaacatcctaatcgaaaaccctttctattagatggcaatcaagttcacctacataaatattcatttgtcacaaatgattaaatgaaggcaacacaaccacagccagcagctcttctgaccagtctgaaaaataaaccatagctccgagtagtagactagggaactgaattgttgacaatttgtatcgtaaaaaaaggatcgtgcatcacatgttgctctatgccgtgtgtgtctagcaattttgctggcggatgatgtatgatagcgatgagagtgtgacagatcatatttgtttaacccaaaatcagaaagaaaaaaaaaacagagagggagagaagagcccagcaaaaaggatatacaacgaatgcatatttggctgcggcgaggagggcctttccggagcagcactgcagcagagtctttccaggagggctacttgggagagggagggagggagaggagaggagaggagagagaaaggggactggattgacgcgaagacggagagcaagaatcaaaatgtttttggagattgagtgatgcgatctgatagtgaaaatgcttctgcgagaaatggatggtgatccattccatcccatgcccaactatgatttcctgtctgggaacggttattcattaaagcagttagtgcgcagcaactctgatatagactcttcatcatccaagtctaagcagtcttggcaagacttatctgacagcagcctcagtggacaacacacaccaacgcaatctgctacccactatttttccagggttgtgcttcttatagtgctgatccatattatggcggggtgtgggcaggatacgcttcaaatggaattgtccatccccaaattagtggtgcagcaaacactagggtaccattgccagttgggcctgcagcagaggaacccatatttgtcaatgcaaagcaatacaatgctatcctccggaggaggcaaaaacgcgcaaaactggaggcccaaaataaactggtgaaaggtcggaagccatatctccatgaatctcggcatcgtcatgcaatgaagcgagtccgtggaccagggggcgtttcctcaacaaaaaggagctccaggagcagcggctgaaggcactgccttcacttcagactccaacaggtggggtcagcaaaatggcctttggcaggaacctatgccctgaaagcagcacatctcactcgccttcgacgagctctacaatctcgagtgcttcaaactggagtggcacgctagctcatcaagagcacgttagcttcgcatctgctaataaattcctccccagcatgaacttccacgcggagaatggaggtgaaaagatggccatcaatggcgtccgccaccacacccctgtcctgaggtgaacaacctcaactgtgggggtgctgtgctggtaccatcactggcgcgctccggtgtgcccgtggcaattcatccttggcttatgatgtatcttatagtaatttgctttcactttcatatggaacttgtctcagattaaactcggtgatatttattgcaactggatgactgaaataatctcatgtttcttcaaaaaaaaaaaaaaaa

SEQ ID NO: 8672 - DNA, 2044 bp, Zea mays
gcgccccggagtggactacgacgagaccttcagccctgtcgtcaagttcgccaccgttcgcgtcgtccttgccctctcttgggactgggcgatccatcagctcgatgtcaagaatgccttcctccatgacactctaatggggtttgtctactgcagccagcccaccggcttcgtcgacgtcgctcgtccggatctagtctgtcggctgaaccgctccctatacggcctcaagcaggcgccgcgggcatggtacagtcgcttcacctcctacttagcctacatcggcttcgtcgaggccaagtcggacacatcccttttcatctagtttcccactgttatgtccaatactccctctggtcataaaacatatagtttaggacaatttagttaaatctttaaaactacaaacatcaataatgtttaattgttgatttaaaaacatgcaagttatatatagatttgtattaaaaaatcggctgaatctcataaattttaagtaattcaagaatatattgtagaagaaattagtggtcaatgatttgcatcaaagaccatgcgaagtcaaatgtggcaactacttctgaccagatgagagtatttttgtagaaaaaatcatttcaccgaaataatagtgactttcataccttaacacatcactctttttctccattttccttgtgtagatttttttctctcgaatatacaggagagttgtgtatcattgcattaagaacaaacatatagattacaattatgttttgtttgcttaaacatcactcattgttacctaaacaaccattctaggatgctttctctgctccactgctttcccttgataatgaaagaaccaataaacttctttgcatgttatgattcgtctcatggcataatcatgtgtcaacctcttattattctatggctctacacttctacctcactaggatcttttcgtactgaaattattctattcagttatgtcattcagctattgaataacatagtgcttcttttctgaaagcatcagccagcatattcctgtcatgcaaattaagttggatacagtaagcacttgtattctttattttactttctagatataattttgctttcactttaattgggccaactttgtttcttccatgtatggttatctttgaacagcgctgtttatccatcggttacacacacagtttggacattttttatgggttatatcaatcagtatgaaagttttcttcccttctcagccatatctccatgaatctcggcatcgtcatgcaatgaagcgagtccgtggaccaggggggcgtttcctcaacaaaaaggagctccaggagcagcagctgaaggccctgccttcacttcagactccaacaggtggggtcagcaaaatggcctttggcaggaacctatgccctgaaagcagcacatctcactcgccttcgacgagctctacaatctcgagtgcttcaaactggagtggcacgctagctcatcaagagcacgttagcttcgcttctgctaataaattcctccccagcatgaacttccacgcggagaatggaggtgaaaagatggccatcaatggcgtccgccaccacacccctgtcctgaggtgaacagcctcaactgtgggggtgctgtgctggtaccatcactggcgcgctccggtgtgcccgtggcaattcatccttggcttatgatgtatcttatagtaatttgctttcactttcatatggaacttgtctcagattaaactcggtgatatttattgcaactggatgactgaaataatctcatgtttcttacaagtgtgtgagccaagacccgtttatcttgtaaaagtttacataggtcaatgcccatttatgttgctagaaggctatctccagtagcttactcatccacatacttatattcaaacctcactctatgaatgatgcggtctatatttttggatgatcttatgggtaaactactaaacacagtataaaacactagattccatagttatagtgctcccccaccatttaaatgataaaaa

SEQ ID NO: 8673 - DNA, 1574 bp, Zea mays
cgagaccattacctagaacatcctaatcgaaaaaagcagcccaaagcctcaaacccaatgcgaggcccttgggccagcagcgccttatcacttcgcctccgtctccgtggcgcgcgcgctcgcacgaacacgagtcccatgtcgtccaccgcagcgcgcgtcgtccacccggctgccgcggcgccgccgcctccccgcccacgccgcctggcgcccgcgaggtgcgcggctggatccgcgacggacacggccaccgcgggtccgacaagggtgacgaccgtcagcaaccgcggggactccttggcgatatgccgggtgctcaacggcatgtggcagaccagcggagggtggggccgcatagaccgcgacgccgcggttgacgccatgctcgcgcacgccgacgccggactctccaccttcgatatggctgaccactatgggccagcagaggatttgtatggcatgttcatcaacagaattaggagggagcgcccacctgagtttcttgaagaagtcaaggggcttacaaagtgggtaccacccccggttaagatgacaagaagttatgttgaggataatatcaacagatccaggaagaggatggatgttactgcattggacatgttgcagttccactggtgggagtactcaaatccaggctacttggatgcgctaaagcacatcacagacctgaaggaggaaggcaagataaagactgtggccctaacaaacttcgatacagacagactgcaaataattctcgaaaatggaatcccagttgtgagcaaccaggttcaacattctatcgttgatatgcgccctcagcagagaatggcagagctttgccagctaactggagttagacttataacgtatggcacagtgatgggtggtcttttgtctgaaaagtttctcgacaccaatgtatcaataccttttgctggtcctcctctaaataccccatccttgcagaaatataagaggatggttgatgcttggggtggctggagcctgttccagactttgcttcaaaccttaaagaaggtgtcactgaaacacggtgttactatttcaacggttgctgtgaaatacatactgaaccagacgtctgttgcaggttccatggtcggtgtgagattgggactctctgaacacatcaaagacaccaacgccatattctcacttgaattggatgaagaggacatgaacatcatcactgaagtgtcgaagaggggcagaaatttgatcgatattattggggattgtggtgacgagtaccgagcttagttggccatgctgctgctgggctactacagacctatatactcgtgcccaattttgcacagctctaaatttttgcctatttgggtctagcggctcagcgcactgttgaggcaaccatatacctgaatgcctattattcaggcgctagcatgtaccctccagtcctcaacagccagttataaaactgtaaatacacagcgatgcagatcgctaatgtggtaacttgttcagtcctttttagcgattactgtcccaaacaaaaaaaaaacaaaaaaaaaaaaaaaacggcc

SEQ ID NO: 8674 - DNA, 2186 bp, Zea mays
  misc_feature (884)..(884): n is a, c, g, or t
tcccctccaatcctaccgggatcccggttcaccaaatcagccctaagagtggctgcactaatgactatctcgagcagttttagtttactatacgtatacacatattcaaactgctctctagtaatatataataaaaataatgtttttggttatcatatgagtgaactgttgtacattgcatccatatatatagttaaaaaacatagttttgtattatacattacactgtttgtagagtgtaatttgaatattaatatatgtatgataagctcctagagggcacgatggaccctctctctctcggccgtagcaaccaccacggtgacgcgacctcagccagcccatccccacgaccaccatagcgttgagataaaaaaaaaattctaaatcacaattgtaaattttattaaaatattgcctaatattggaaaattttctaaatcacacaaaagaatcatctaatcaatatattattttagtaaactaaataaaaaaattaaataaataatacaaactacataattaaattaataactacttatccaagaacaattgctaattcactaaagcatctaagcaatatatactaatcgaggcattgtttactaatctaagcaatagtatctaataaactgattaccttaatctctaataaactcaattgaatcactaatttatctaaacaattaatcatctaattacatttatcaactaattttcgccatgtccgacataaattagcactttacaaattaaaatgatacgttaacgtttaaaaactaaggggcggccggggttggcgcggcctgcgcaggggctcggtggcggtgcgatctagcggcgcgggcgggcctgggcggtagtgccatgacggtgcacggggnggtgggggccgtgggggcgtggggcaaggcggtggcacacccgatgctactggagggtgtggtgtgaccgtgtgagacggcgctgcatctccagtagaattagcagccagcacggacagtctcaaggttgtattcatgccctgtgggtgacatatatttgcatcggcacccgtaatctaacatggctggagtgaaaatgaaatcaaatgaactgaattgtgtcgttttaaaatcatacaggttctcgacatgcgctgaactgttagcggtttgttggctggacatctccggttgcatgccatgcaggatgctgtcaggtgacacgcgctatgcagcctacctggtattcaagatggccgatgactgctttggcctggattctcctcttcaggaggcatcggtcagcgtcggagaggggggcacatcaacggcccactggatcagactacagagctaccacgtcggcgacgaagagaacggcgtaaccgaagaaggagctccacctaggctcccacatgagaggcctgatggctggatggaggtggagctaggagactggtacaaccatggaggcgacgacgacctagtggttcgtgccagtgtgaaggaggccaggtttggaggcaactggaagaaagggcttattgttcagggccttgagattagacctaagaactgattgagggctggttgatcataaaattatatgtatatgtctcagtttggagtgcattcatgttggagctattatgtaataatacgcctgcaggctgcagccgttcctgatgcaaaaaaaaaaaataaatctctgcattccttgcgccaaaaataagctttgaggaacatagtgtattgatccggttgacttggctcctgaccggaagattttttttaacaagaagccttgcctgaaagataattacctggaacggtagggagcatggactagacaactatataattgattagcgtaaactttccaaaactcatctgttggtgccgatctaggcgtcaaacactagaatgaaccacctagcggtgtactctgcagcggcacggacggtccgcaaccctaggccagaaggtccacgacctggacgcaggagcggatcctcctttgcacgtttttggatggtctgcgcctggagccggactgtccatgatggcgcagggtcttcttctacgtgaagaaccctagaactcgcgttcgagtagatctcatcaggagaagggttccaagggtttctccagggtcggcaggccaccggggcgtccctaatcggtgtagagtagaagagggat

SEQ ID NO: 8675 - DNA, 1100 bp, Zea mays
cctcgaggccggccgggcattgggcaccggggaccccgacgcacacccaccaagtctctgctgtcctgtccaagtaataaagcaccgaaaccggccgccgacgaccaagacctgcaaccgatggaaggcattcagcagctgccagcggacgtcctcgtgtcggtgatctcccgcgccgccgcggggccgagggatgcctgcatcgccgccacggtgtcgccggcgttccgcgccgcggccgactccgacaccgtgtggtcacgcttcctcccggctgacctcgccccgctcgtctacccgacgcctccgccaagatccaagaaggagctcttccttcgcctctctgaaacccatgccctcgttgaagatggcctcatgagcgcgtggctggacagggagaccggcgccaagtcctatatgattgcggccagggctatggctattatctgggtcgacacgccggactactggcgctggatagtgcgcgaagactcaaggttctcgacatgcgctgaactgttagcggtttgttggctggacatctccggttgcatgccatgcaggatgctgtcaggtgacacgcgctatgcagcctacctggtattcaagatggccgatgactgctttggcctggattctcctcttcaggaggcatcggtcagcgtcggagaggggggcacatcaacggcccactggatcagactacagagctaccacgtcggcgacgaagagaacggcgtaaccgaggaaggagctccacctaggctcccacatgagaggcctgatggctggatggaggtggagctaggagactggtacaaccatggaggcgacgacgacctagtggttcgtgccagtgtgaaggaggccaggtttggaggcaactggaagaaagggcttattgttcagggccttgagattagacctaagaactgattgagggctggttgatcataaaattatatgtatatgtctcagtttggagtgcattcatgttggagctattatgtaataatacgcctgcaggctgcagccgttcctgatgcagggatttttttttaaaaaaaaaaacaaagaaaaaaaaaaaaaaaaaagcggcc

SEQ ID NO: 8676 - DNA, 2537 bp, Zea mays
gccggccggtaactcggcagtttactagttgtacgcccataatgacccattctaccgtcatatacaggctcccctcggccgccgcccaatcagcgaagaggagacgacgactgctctgcctctgcctttcttccctacaggaacaggacgaatcaatcaatcattcccctctgcagccgccggccctcagcaagcaagcaagggacagacgcggcggggatgggcagcggggtccgggcgctgatgcgccggaagcaggtagactccgagcggacgcgcgccgccggcagcgcccaccagctccgcaaggagctctccgtcacccagctcgtcgccatcggtgttgggtcgacgattggagctggcgtctacgtccttgttggcacagttgcgcgggagcattccgggccggcattgacgctttcatttctgatagccggaatagcagctgcgctttcagccttctgctatgcggagctggctagccgttgcccttcggcaggaagcgcctatcattattcgtacatctgcgttggcgaaggagttgcatggttgattggctgggctttgatacttgaatacacgattggtggatcagccgttgcccgtggcatttctcctaatctagccttattttttggaggacaggatagtctgccatggattttagcacgacatgagatcccatggcttgatgtcgttgtagatccttgtgcttctttcctcgttttcgtcgtcactggccttctctgtgtggggataaaagagagttcatttgtgcaaggagttgtgacggtcttaaattgctttgtgatgttatttgttatcatagccggtagctacatcggcttccaaacaggatgggttggctacaaggttgctggcggatttttcccttatggagcgaatggaatgcttgccgggtcagcaactgtcttcttcgcctacataggatttgattcagttgccagcacggctgaggaggtgaaaaatccacaacgagatctgccactgggaatcggaacagcattgtcgatttgctgttccttgtacatgttggtttcagttgttattgttggtctggtaccatactttgctatggacccagacacccctatttcatctgcttttgccaaacatgggatgcactgggcaatgtatcttgtaacaactggtgctgttcttgctctctgctcaaccttgatgggatctatattgccacagccaagaatattgatggccatggcacgagatggcctgctaccatcattcttctctgatgtccataagacgacacaagttccagtcaaaagcacagtagtgactggcatctgtgcagctgctcttgctttcttcatggatgtctctcaactggctggaatggttagtgtaggcacgctactcgcgttcactatagttgctgtgtccatcttgattcttagatacgttcctccagatgaggtacccctcccatcttccctgcaagcatcattccgcttgagccaagaaaatgacgaggaaaagctgaggggtacccttggagatgatgatcatgagcaaggctcagctgaaataagtgatgttgtagtagaaccaatcactgaccccctgatcgagaagcagctatacgcaagcaatttgagtgaggcaaaacggcgtaagaccgcggcatgcagcatcacatctgtttgcataggggttctgatcctcacgacgtcagcctcggcaacattcttgcccttcccggtgagatgctccgtttgtgttttgggtggcatgctcctcctagctggtctgggcatgctctgctggattgaccaagatgatgggaggcactcctttggccactccggaggattcatctgtccgtttgttcccttgctgccggtaatgtgtatcctcataaatacatacttgttaataaatcttggtggcggcacgtggatgcgagtgggggtgtggctagtgatgggggtgttcgtctacattttctatggccgcacccacagctcgttgacggatgtcgtgtatgtccctgtggccgaggcgaatgagatatacgggtcatcctcttcgttagggtttgtggcgtaaagagagatggaaggagatgtttgttgaagcctatcttgagccagtcatggtacttctcacaaaaacctcaaagatcctgactggagcaggtacctgcttgagctattgtgttgcaggcatgggtttgaagaattcaatttgtacgtcatatttttaaaatgtgtaaattgtaacgcacggctaagcttgtgtgtctctgttggaggaatgtaaatattagtatattgcatagaactatatataggtggtgccaatatacaggtgtttaaaaaaaagggggggggtcattctaggaatctgtatgttttactacgaacttgttctaaattcctaggaattcaaacaggcaaaaaaaaaaaaaaaaatgtggttaaggcctcaaaggtccaaacacattttatttcatgttgaaatgaagattacacgagcagaaatgctcacgg

SEQ ID NO: 8677 - DNA, 760 bp, Zea mays
attcccgggagtaaatataaactgcgagctatcatatcaagttactgtgaagagtgaagacatatcacagggacctcttcaggcttcaaggcagatccgcagcagatggaggcgaagagcaggctgccggaggtgaccatcgtcccggcggcacggccgttggctggcgacggcacagtcgacgcggcaaaggcggcggcaggcaaggagcccgtaagcccgggcactccgtcctcggtggccgccggccgcagcagctgtgaggagaggcgcgcggtggacggcgtcgccctgcctgggtggaagctcgacgccctctgccaggagtcctgcccgtcgccggccatgagggcgcgcttcccctactacttctgaagctttcctgttgcagtcctgcgtgagttcttgagcggcgacatctggtgcatgctcttgacgactgatggcgttctcttgggtgttttccttgctcaggattttcctttcgtgcacgttcatgtatgtatgtatatgtatgtatttatgtattgtgggtataaagatctgtgagctttgtgtataacgcaaatgatgaaccttcgggtaactgcgtgtatggtcgtatctgtctatctgacataatttgagcacactgtctgtatcggtctcatcgaaatagttgccgatatggcatagcacgcgtaatacagcgtagaaatttcagaacctggagcaaggctttttggttctgtttaagctaattaatacaaacattacacag

SEQ ID NO: 8678 - DNA, 978 bp, Zea mays
atccccagatcttgttctagcttttagttagtggctgacaagagaacaagtcggcccccatcctttcccaccggcggcttgcccccaccagtccgctagtgctacatgctctccatccaatccatccatgacgcatcctccttcgcattgctgggccttagcatactgtcaggctaccagcaagcgaagtagctagccatgctcggcctccccgccgcgcccccggccgccgcagcaccgccgaacccgaagggcaaggggcgatgcagcgccgccccgccaccagcgatgacaggccgggtgtcgctggctgtccctgcggcggctgtctcgctctcgctcttcctctggtccagtccagtgaacgccggcatcctgtccggtttctcgggactggagtcgactcccggccccgacctcccccggctcgagttcctggagaaatggaatgcggagaaccagaagaagtacaccgagttcgataacaggttcaagaagtccaaggtgctgcaggacctgctcgagaagagcaggaagaacaaagagaagaacgagaggatgatccaggacaagtactgtctgcggggcgccgagtggggcgtcggggactgctccacggagggcatgtcagaccaggagagggaggacttcatttcggagctcaagaagagagctggagcagagtagcgagctgaggacgtcattcagtttcaacagacgaagtatgggcacacttcgccactgtagcagtccagggaatggccattttactcgtcataccctgattaccaagggaaatacgcaaacaatgtagaccagcccataggccactgggagtgcgagaatgttcaccaacatcatgcgagctcagaatttgcaatacatatgtacccattgtaaaatgcatttagcacgagcaaattaccagctacactgattcttaagatccctaaattcctctcaaaaaaaaaaaaaaaa

SEQ ID NO: 8679 - DNA, 1368 bp, Zea mays
gttaattttatggggagtacccaccatacttgccgggagcctcacgtgtcgctttgtcgatgcatttttggtagacctaacctactctaaacaataaaatcaaatatgattattaagtgacgttgccaagcacgtgtattgtactagtcgtacttaactcatacaactttgagtaattctcaaggtccaactctaaaagtcaccttgtatatgtattccgtacacataaaactcgagcagcatagagaaacaaccaagacaagtgcaccccaaaaaaagatcaaggagcgtaatccccagatcgtgttctagcttttagttagtggctcacaagagaacaagtcggcccccatcctttcccagcggcggcttgcccccaccagtccgctagtgctacatgctctccatccaatccatccatgatgcatcctccttcgcattgctgggccttagcatactgtcaggctaccagcaagcgaagtagctagccatgctcggcctccccgccgcgcccccggccgccgcagcaccgccgaacccgaagggcaaggggcgatgcagcgccgccccgccaccagcgatgacaggccgggtgtctctggctgtccctgcggcggctgtctcgctctcgctcttcctctggtccagtccaggtacggctactcttgcagtcttgctcaccggcacggcgcacttgctagcgacaccggtgcaacacagcatcagagtcaggcacacttgatggaacgtaaaacattcgaagattcgccgccggtgcttccagactaataatgcccggaacattttgttcgcgaactgcagtgaacgccggcatcctgtccggtttctcgggactggagtcgactcccggccccgacctcccccggctcgagttcctggagaaatggaatggttagttgagatcctgagttacctgctgagttcttgtggaggccaaggacttgttcttgctgcaagcgttttaccattccgggccttttctgactcatggaaaccatgtctccctgtttcgctctcaagcggagaaccagaagaagtacaccgagttcgatgtacaccggccgtgtacatcagaagtatttttttactagtagctccgttggcaaccgtaattaggtagagagactcatcgtctaggttatgcgtggtatccccgtgtctcagtcctaagtcctaacccgtgacctcctagacacacaaatgcacacaaaatgttcttacaaataaattataatttaccatgtgtgtgtatagctaatacagatgtactgtacatgtgtcagctccacccattcaaataaaactcttcatatatatacaataatggggatgatcgtccattttgaa

SEQ ID NO: 8680 - DNA, 1523 bp, Zea mays
agcttttagttagtggctcacaagagaacaagtcggcccccatcctttcccagcggcggcttgcccccaccagtccgctagtgctacatgctctccatccaatccatccatgatgcatcctccttcgcattgctgggccttagcatactgtcaggctaccagcaagcgaagtagctagccatgctcggcctccccgccgcgcccccggccgccgcagcaccgccgaacccgaagggcaaggggcgatgcagcgccgccccgccaccagcgatgacaggccgggtgtctctggctgtccctgcggcggctgtctcgctctcgctcttcctctggtccagtccaggtacggctactcttgcagtcttgctcaccggcacggcgcacttgctagcgacaccggtgcaacacagcatcagagtcaggcacacttgatggaacgtaaaacattcgaagattcgccgccggtgcttccagactaataatgcccggaacattttgttcgcgaactgcagtgaacgccggcatcctgtccggtttctcgggactggagtcgactcccggccccgacctcccccggctcgagttcctggagaaatggaatggttagttgagatcctgagttacctgctgagttcttgtggaggccaaggacttgttcttgctgcaagcgttttaccattccgggccttttctgactcatggaaaccatgtctccctgtttcgctctcaagcggagaaccagaagaagtacaccgagttcgataacaggttcaagaagtccaaggtgctgcaggacctgctcgagaagagcaggaagaacaaagagaagtaaaaacgtagtcttttattcggttcttgggatctctctggtgatgcatttccagcgctgaacctgtgttttttgcaggaacgagaggatgatccaggacaagtactgtctgcggggcgccgagtggggcgtcggggactgctccacggagggcatgtcagaccaggagagggaggacttcatttcggagctcaagaagagagctggagcagagtagcgagctgaggacgtcattcagtttcaacagacgaagtatgggcacacttcgccactgtagcagtccagggaatggccattttactcgtcataccctgattaccaagggaaatacgcaaacaatgtagaccagcccataggccactgggagtgcgagaatgttcaccaacatcatgcgagctcagaatttgcaatacatatgtacccattgtaaaatgcatttagcacgagcaaattaccagctacactgattcttaagatccctaaattcctcttatttttttcaaaaaaaaaaaaaaaaataaagctgccgctctctgcataactgaatgatcatagatgaaacagccctgaaaaccaacacgcgggcagagaaacatgcgaacatcccaacacacagcacacatggaaaggaaacgaggaagattgacatggataacttttttactcgtgccttaagagtaaattctggagtcat

SEQ ID NO: 8681 - DNA, 1054 bp, Zea mays
  misc_feature (997)..(1027): n is a, c, g, or t
gtgctaagcatccatttcttctgcagtcatcattgctatcttcttcagtgtatttacctggtgccttggtgggtgcacatacatagctgacacatgggggccactctacaagaatgactcgggaagaggataacgtaggccaaccacaattatttaaaaacaacaggaggaggaagataatcatgatgcacctatcagtcatcactgtcagcactaactccggaaagaaatatccacccgctctgatcttatccgtttctctgtagcatagaaggagacaaacgccatcgccttttccatttgttgcggaagtaaatatcatcggcgacctcgcctctcaagttactgtgaagagtgaagagatatcacagggacctcttcaggcttcaaggcagatccgcagcagatggaggcgaagagcaggctgccggaggtgaccatcgtcccgacggcacggccgttggctggcgatggcacaggcgacgcggcgaaggcggcggcgggcaaggagcccgtaagcccgggcactccgtcctcggtggccgccggccgcagcagctgtgaggagaggcgcgcggtggacggcgtcgccctgcctgggtggaagctcgacgccctctgccaggagtcctgcccgtcgccggccatgagggcgcgcttcccctactacttctgaagcttcccgttgcagtcctgcgtgatcgagttcttgagcggcgacatctggtgcatgctcttgacgactgatggcgttcttgggtgttttccttgctcagggtttccctttcgtgcacgttcatgtatgtatgttagtatgtattgtgtgtataaagatctgcgagctttgtgtataacgcaaatgatgaaccttcgggcaactgcgtgtatggttgtatctgtctatctgacataatttgagcacactgtatgtatcggtctcgatcgatatagttcccgatatggcatagcacgcgtaatacagcgtaggaatttcagnnnnnnnnnnnnnnnnnnnnnnnnnnnnnnnaggaaaaaaaaaaaaaaaaaagcggcc

SEQ ID NO: 8682 - DNA, 773 bp, Zea mays
gccggccggtccgattcttgcgaaagtaaatataaactgcgagccatatcgagttactgtgaagagatatcacagggacctcttcaggcttcaaggcagatccgcagcagatggaggggaagagcaggctgccggaggtgaccatcgtcccggcggcacggccgttggctggcgatggcacaggcgacgcggcgaaggcggcggcgggcaaggagcccgtaagcccgggcactccgtcctcggtggccgccggccgcagcagctgtgaggagaggcgcgcggtggacggcgtcaccctgcctgggtggaagctcgacgccctctgccaggagtcctgcccgtcgccggccatgagggcgcgcttcccctactacttctgaagctttcccgttgcagtcatgcgtgagttcttgagcggcgacatctggtgcatgctcttgacgactgatggtgttcttgggtgttttccttgctcagggtttcccttacgttcatgtatgtatgtatgtatgtattgtgggtttaaagatctgtgatctttgtgtataacgcaaacgatgaaccttcgggtaactgcgtgtatggttgtatctgtctatctgacataatttgagcacactgtatgtatcggtctcaaaaaaaaagaaaccaagcggcccgccaatagttgccaatatggcatagcacgcgtaatacagcgtaggaatttcagaacctggagcaaagcttgttggttctgtttaatataattaatacaaacattacacagctac

SEQ ID NO: 8683 - DNA, 3149 bp, Zea mays
gttccctggtaatggggcctgcgtgtcaagtgaccctctatccccatatctatttctccttgtggttggcgtgctgcaggcatcatcagacatgacgaccacatcaaacatcctcttcccaacgaccaaccttgcacgaccctccaatacgccaacgacatcctcattctccttacgggtcaccttagtgatgcagcctgcctcaaatcagccctcgacctgttcagctctataataggtctcaagatcaacttcaacaaaactgtcgtcgttcccatgcacatggacgacgaccacactcggcaatgcaccacccccctgggctgcaggcaagaaggtttccctcggacctacctcgcttgcccctctccaccaaactccgcctccatctgttttcctccactatcgcaaaaactgataaatgcttagctgggtggcaagcatccctcctcaaccccatgggctgcctagtcctcatcaactttgtcttagatagccacctaaactacatcatgagcactgtccaactcctgaaaggcaccgtcaaagccattgaccaacgtagtcgtggcttcctctgggcgggtcagaagctttgcagattcactccacagaatctgggagcactttgaggtgttaggcccacctcattattgcaatttttgttgttgttgttgtagcactaatcctttcagctttgatgcacttcatgcacaaccttaccatcgttcaagcactttggcacctctgcatttctcactgtattattttttttttctatcgcttttgcgctcaggcatgtggtgggagcagtacggcgactcagcaccgtcgctgcaacgcgccgccgtcagaataaccagccaggtgtgcagcacgctgacgttccagagggactggggcgtgatcctgcagaaccactacgagaagcgcaacaagctggacaaggaggccctggccgaccaggcctacgtgcactacaacctcacgctgcactccgagccgaaggcgaggaggaggccggacgcggacccgatcgcgctggacgcggtcgacatgacgtcggcgtgggtggaggactccgacggccccatcctcacccagtggctcgacaggttcccgtcggcgctggatggcggggacctgaacacgagacagttcggtggatccatcttcggcaccaacgacaacctgttcggcctctgatggcttccggctccaggtctgtgtccgacgccgtgcttgttgtctgtgctgtacttttttttttttttttatccatgtactgtaggtcttttgtagtagttccatctctgatagtgtagtgtacatcgtagaatctagattgataacaggagaagaactaattgttgctcatatttggtcttcagggggtggggggacatctgcctgttctcatttgttttgattaacacgagagccatgaagctgctgaaaatgtgctaagcatccatttcttctgcagtcatgtacgtagaacatgcctttgagagtattgtcatcatcttaaaaatatggtagtcattccctgtctcgactgctgagtgctgacacctgagtgttctgcagcattgctatcttcttcagtgtatttacctggtgccttggtgggtgcacatacatagctgacacatgggggccactctacaagaatgactcgggaagaggataacgtaggccaaccacaattatttaaaaacaacaggaggaggaagataatcatgatgcacctatcagtcatcactgtcagcactaactccggaaagaaatatccacccgctctgatcttatccgtttctctgtagcatagaaggagacaaacgccatcgccttttccatttgttgcggaagtaaatataaactgcgagctatcatatcaagttactgtgaagagtgaagagatatcacagggacctcttcaggcttcaaggcagatccgcagcagatggaggcgaagagcaggctgccggaggtgaccatcgtcccggcggcacggccgttggctggcgacggcacagtcgacgcggcaaaggcggcggcaggcaaggagcccgtaagcccgggcactccgtcctcggtggccgccggccgcagcagctgtgaggagaggcgcgcggtggacggcgtcgccctgcctgggtggaagctcgacgccctctgccaggagtcctgcccgtcgccggccatgagggcgcgcttcccctactacttctgaagcttcccgttgcagtcctgcgtgatcgagttcttgagcggcgacatctggtgcatgctcttgacgactgatggcgttcttgggtgttttccttgctcagggtttccctttcgtgcacgttcatgtatgtatgttagtatgtattgtgtgtataaagatctgcgagctttgtgtataacgcaaatgatgaaccttcgggcaactgcgtgtatggttgtatctgtctatctgacataatttgagcacactgtatgtatcgttctcatcgaaaaaaaaaaaaaaaacgccgcccacgcgtaatacagcgtaggaatttcagaacctggagcaaggctttttggttctgtttaagctaattaatacaaacattacacagctacaacacctcctcgacaggcagcgccgctcgccagctcatctcacacatgcttagcatagcgtaattatctttactactctataaggctttagtgtagacttcacaatcgtgcaccatgttctgccgcacaatcctctctctccactcttcatcgcacggatgtcctcccaccacgccacagccgctctcaattgctcccccgccgcaatccacgcctccccaccgcacccttccatccatggcggtcgccgcaatccaagcctcccccaccgcgccagatccctcggcccggccccgcttgctcctcgccacacggtcgtcgtcttccttcccatgctgctcggacctttttccttcccatgatgtcgccgccgctgcacacctgctcggaccagcgggatccagctctcccacgcggtctcatcccatccatcagcccggatctcgcgtcccgctccctctgaggaccctatcgtcctcctccttcgccgccgctgggacctccttcgagaagaggagcatcgacctcgtggg

SEQ ID NO: 8684 - DNA, 2084 bp, Zea mays
gggacgaattttcggatacggaaaatagcgggcctagaacgtgttgaccccaccactgccgtttccgtcccgtttgctcgcgtccccaagccgccgagaaccagagacagacagagaagaaaaactgcagccgccgagctcagcctcagccgccgcgacggggacagagaaagatggccgacggcagtgcctccgcctcaccgccttccgtttctccgcaccagtaccaccgcgacgccatcaagtcctcagtgcgcaatacagctgctaataggaggagagaacatgctattgcaatagggaaggaaagaagggaagccttgatgcgtgcaaagcgtgtatgccgagctcctctttctggcagtgatgaggctgcagcagaagagggggacatggttgttgatgaggagaaagcagatcttgagactagaacgactcaggctgttgaggagctgaaatctgctttgtcaagccagggaaaaggtgcacagaataggaagacagaagtgcttcgtgctttaaggcgtttgttgtcccagtctgaagtacctccagttgatgcagcaattaaagctggagcagtccctctgttagtgcagtctctgtcgtttggatcaccagatgaacaattgctagaggcagcttggtgccttacaaacatagcggcagggaaacctgaggaaactaaatccttacttcctgctctaccattgctcattgctcaccttggtgagaacagctctacacttgtcgcggaacaatgtgcatgggccattggtaatgttgctggtgaaggagcagagctgagaaacacattacttgctcaaggtgctttgtggcctcttgcccgtttaatgctgtcaaataagggttccacaacaaggactgctgcttgggcattgtcaaatctcatcaaggggcctgattccaaggctgcgaatgaacttattggtatcgacggcatactgaatgcaatcattcggaacttggaaaaggcggatgaagaacttgtaactgaggtggcatgggtggttgtctatctttcagcactttcagaaaaagctaccagcctaatagtaagaagttcgatgccacagttgctgatcgggcgccttctagcatctgaaaacttgcagttgctcattccggtacttcgcggtttaggaaatcttgtagctggtgatggttacatggttgattcagtcctaattgttggaaacagtgtcacagatcaagccttatcaagtcttatcaagtgtttgaagagcgaccatagggttctcaagaaggaggcatcatgggccatgtcaaatatagcagcgggcagttttgagcacaaaaaactgatatttgctagtgaggcgactcctttgctgatgcacctcctcaggactgcacagtttgacatccgcagggaagcagcatacacgctgggcaacctgtgtgttgtcccagcaggcagtggtaaccccccaagtataatcgttgagcatttagttgccatcgtagatggtggagcccttccaggatttataaatttggtgaggtcggccgatatagagagtgcgagacttgggcttcagttcctggaactggtgatgagaggataccctgacagccagggcccaaagctcgtggagacagaggacggcattgaggccatggagaggttccagttccatgagaacgagatgatgaggaatatggcgaatggtttggttgataaatactttggcgaagactatggcctgtgagttgtgccgccgatacatctgggtaaacgcgtggagctatttgtgggtttgaaatgtaacgatcctggaacagaaggatgcgccgttcatcatggtttccatgcaatttagcccctaatatatagctggaaatgtgaatgtgttgaaactgaccgtgaactggagatgttaagtgtggataccttagatagacatagactgacatcttgcacagtacttcctctatctcaaaatatttttcgtctcgtattttaagtgtggaaatgttggagatgctcttagagtacaaatatatgactgattaatctgatgatgtttataatgtcccat

SEQ ID NO: 8685 - DNA, 1056 bp, Zea mays
ttgggaccctcgaggccggccgggccgggacagcagtacgcagcaacaacctagctatagctagccaagtcgcaagagccagtacgtgtgtgctgctgtgctagtcggtgcgatcgaaatggctcctcatggtgacatcgaccttgccaaggcctaccatcacgtcactgtgtcaatgagggagcacacggagaaagtgatggtgaagctcaccgcgccccacaccggcaagggcgacacggcgccgctcgacatcgtggttgtcctggacatcagcgggagcatgcgtgggacgaagctcgagcacatgaagcacgccatgaccaggttcataatcgagaagctcggcatccgcggtgaccgcctcgccatcatcacattcgaatcgaaggcacataaagtgttcgatctgtcgtccatgctcccggaccaagtgaagaaggcggtggccgttgtggaaggtctgaaagccggtggagacaccaacatcaaggccggcctcgaggctggcctcgatgtgctcaagacccgtagggggcattcgcataatgcttcctgtatcttcctcatgtccgatgggcatgagaacgtggacaaggcgaggaccctccttgaccgtgtcggcgagcactccgtggtcacgtttggttttggtgagaagagcgacgaacagttgctgtacgacatcgcataccacagccatgcaggcacgtaccaccatgtccgggagaaggaggatgagaaccagctgatgaaggccttcgcgttcctggctatctaccgctccatctccatgttggatctcaaggtgacagtgagtgcccacaaagaagctgcaggagccatcatacggggagtggatccttgccgctacagggtcgacggtccgcacggtgacgggtctttcacagtccatttcggtgatctcgcccgcgagggagagccgaaggatactggtggacgtgcagctcccctcaagtacagcatgagcaaaaagataagccggtcattcctggccaatatgaaatatactcccccccgaagcgggaagggccc

SEQ ID NO: 8686 - DNA, 2139 bp, Zea mays
ccggcccccacgcgtccgcgcttccctcgtcaaccaaatcaactcgtgaggtctcctccccatcgccacacccacgcgccgcgcaccgcccgcccgctcgccccgcctccgatccctaatcaatcggcctgaccctagcccgccgccggccgcccacgcccgcccgcctcggctcgtctcaaatcgggcgccccaggggagcgaggcctcgatcgcggcggaccccgatgctccgcattccggcccctccggcgacgtcggcggcagcggaggcatgatccggtggggactcggcggacctgccagccatggacgccaccgcacgcccggccatcgtcatcgacaacggcacagggtatagcaaacttggattttctgggaactcggagccgtctttcactctccccactgtagtagctgcgaatgaatcttttctagaccagacagagctgttgagtagtgcaaactggatagcacagtataatgcaggcatcatggctgatcttgacttttttattggagatgaggctttatcgcggcttaggtctagtgggctgtacactttaagaaggccaatccgtcatggtcaggttcatgactgggatacaatggagagattttggcagcaatgtattttcaattatctacgttgcaatcccgaagagcattatttccttcttacagatagtcctgtcagtacacctgaaagtcgtgaatgtacaggagaaataatgttcgaaaccttcaatgtccctggactatatatttccgttcaatctgttctcagcctttctgctggatatgcctatctgaaaagtatttctgatgacgattcagatactgtgtctgatatgacaggggtagtagttgatattggggatggagctccacaaattgtgccagttgtaaatggctatgtaatcgggagtagcataaagtcttttccttcctccggaagtgatgtaacccagtttgtttcgcagcttttacaggaaagaggtgagcttttgccacctgaggattctttagatatatctcgtaaagtgaaagaaatgtattgttatacttgttcagacattgtcaaggagttcaagaagcatgacaggaagcctgataagtacatcaaacattggtcagctgttaaaccaaagactggggtcccatatacaattgacattggatatgaacgctttcttgggccagagatcttcttcaatcctgagatttactctgccgatttctccactcctttgcccgagttgattgacaactgtgttcagtctgcaccaattgacacaaggagagctctgtacaagaatatagtattatctggtggatctaccatgtttaaagacttccacaagagactccaaactgatataaagaagatagtggatgaccgtgttgctgcgactaatgcccgtcatcgtgtggaagtgagacctattgaagtcaacgtggttgcccatccaatacagagttacgcggtttggttcggggggtcactagctgcatctaaccctgacttctttgagttttgccacacaaaggaggactacgaggaacatggagccagcatctgcagaacaagccccgttttcaaaggaatgtactgaatttttcctcacgacccatcctctagctggtgagctcatttaggtttcttcgacagaatatagtcaattttgattcttttttggtgcgttccaaccattgtcgggccaccctgattaggtatgtagctctgtttgtactagttgtttgttttgtgttctgcgtcgaatgttgtgtatagccaacagtttggttcctgttcgaggtgcttcattgtagccagaacctcggacagtttagaggaaaaatatttggttattcttttacattagcttgttcagacagatttacgggactcttattaataagagaagtcaaatttaggactttgtcgtggatgaccacattatttcaattgaataatatggtatccctactttcaacgattcatctcgtctattatcttttttagtgtaagaaaggtgtcgtggggggaccaactgatccatgacacatttcgtcagggttagatacctctactgtataaaatatcagtttcaatatcagtttcaacggttattcacc

SEQ ID NO: 8687 - DNA, 1234 bp, Zea mays
  misc_feature (1217)..(1217): n is a, c, g, or t
  misc_feature (1226)..(1226): n is a, c, g, or t
aataaaagcgcacacgcgttcgtgcacctgcgcggactctgcccctttcctgtgccttccaccttcccccggccggccacacctccgccatcgaccgacgctgactcccacaccggccgccgcgcgagccccggcaccatctccgcacgagcagaaatgggggatgcgtgtttctcaacacagctaattgatggagatggggtcttcaacgtctctggattggagaacttcatgaaggatgtcagattgggtgaatgcgggctctcctatgctgttgtatcaataatgggcccgcaaagtagtgggaaaagtacacttttgaatcatctttttggcaccaattttagggagatggacgccttcagaggaaggtcacagactaccaaaggtatatggttagcgaaggcccagaatattgaaccgtgcacccttgtaatggatttggaaggaactgatggaagggagaggggagaggatgacacagcatttgagaagcaaagtgcattgtttgctttggccgtttcagacattgtgttgattaatatgtggtgtcatgacattggtagagaacaggctgcaaacaagcctcttttgaagactgttttccaggtcatgatgaggttgttcagtcctcgtaaaacaacattgttgtttgtcattcgtgacaaatcaaggacacccctagaaaatcttgaaccaattttaagggaagacattcagaagatatgggatgctgttccaaaaccccatgcccataaagaaactccacttagcgaatttttcgatgtacaagttgtggcactgtccagttatgaagaaaaagaagagttgttcaaacagcaggtttctgatttaagagataggtttcagtattctatcgctcctggtggacttgctggggatcgtcgtggtgtcgtcccagcttcaggattctcgtttagttcccagcaattttggaaagtcattaaggagaacaaagaccttgatctgcctgctcataaagttatggtggctactgtacgttgtgaggaaattggtaatgagaaagtcggcagttttacatctgatgaggaatggcaacaattagaggaggctgttcaacatgactttgttcctgggtttgggaagaagctcagcagccttctggatagatgtttatcagagtatgacatggaggctatttattttgatgaaggtgtcagaagctcgaaaagacnacaacttgngtctaaac

SEQ ID NO: 8688 - DNA, 1755 bp, Zea mays
ttacttcactttttacacctgtagcattaaaaacgccatacaaaccgagttatggatcgagcacatatgcgttgccttgcctgccgtgccgccccatcactaccacctaacaagcaagtggtgtctatcgagtacagatgctcatgcgctcagcctctttctcattctcaccacgacgcctataaagcaagccaatccccgagcccggcgaacacaaagcagagagctgcaacttgggaaaaaaaaaaacaaagctcctactgcgagcatggattcgcttgtgaagcgcagcaatggctatggtgcttacggcagcagcaagccccagatgagctaccatcgccagagcaccgagtccgtgaccaccgtcgtcacggaaattaaccgcatgaccatcaacgacaagccctactacggcggcggcggcgtgcagaagcaggcctgcaaggtggaggcgttcgatgagcacgacaaagcatacaacggcaccctggccgtgaagaagcacgacgagtacgaggaggaggaggagtacggccaagtagtcgacgcggactacggtgcccactacggcaacgccggcgccgctgtgaagaagcaaggctacagctaccagcaggaggcgtacggggagactggagctgccgggtacggtggcgcggcaatgaagaagcaaggctacaactacacgaaggaggcgtgcggagagagcgacgccggctacggcgctcaccacggtggcgccggtgccgccgtgcagacgtacgcctacaaccagcaggcgctgtacggtggctccatcggtgccgccgtgcagcagccggcctacaagcagaagggcgccgctagtaagactaacggctcccggcagaaggtatacgggtacggggaaagccgtcaacacagcaggggcggggtacggtgctcaccacggcgtcgttggcgccggggccgggcagcagcacggctaccaccagaaagatgcgtacgggaccgggtacggcgctgtcgcggtcgttggcaaagagaagaacggataccagtaccaggaggcgtacggtggaactgacgcgggagggtatggcggcgctcactacggcggtggtggcgccgtgcagcagcatgggtatggcggcgtaaccgccggtggcaaagcgaagcagagcggcgaccagtaccaggaggcggcgtacggcggaaccgacgcgggaggacacggcgctcactacggtggtggcgccgccgccgccattcagaagcacggctacaggaaggacgtgtacgagagcgagactgagagcgaggacgacgagagcgactgcgaggaggcgttcccgccgcgcggcggccgaatgcagggcggcgtccaggtgcagcacggctacggagctgacaacctcggcggtgtgcgccgctacgagtcgtacgagagccgcgaggagcacggcgacggccgccgctatgagtcgtacaagagcaccgtccagtacaacggtggcgggcacgccacgtgctccccgatcaagaaccgccacctccttggctacggcgcgtaggcataatacgcgctggctgatccagtgcacctacgtactgtatattcgtatgctctgtcgtatatagacagacaggcctatatgccgctaccgctacggctacttggtcgatggatctgcttgtggttgctgatgcagctaaaccatcgaaatatctaaaaaaataagatgtaacataatgccaccttgggataataat

SEQ ID NO: 8689 - DNA, 1629 bp, Zea mays
ttgggaccctccgagccggccgggaaacacaaagcagagagctgcaacttgaaaaaaaaaaacaaaaaacaaagctcctactgcgagcatggattcgcttgtgaagcgcagcaatggctatggtgcttacggcagcagcaagccccagatgagctaccaccgccagagcaccgagtccgtgaccaccgtcgtcacggaaattaaccgcatgaccatcaacgacaagccctactacggcggcggcggcggcgtgcagaagcaggcctgcaaggtggaggcgttcgatgagcacgacaaagcgtacaacggcaccctggccgtgaagaagcacgacgagtacgaggaggacgaggaggagtacggccaagtagtcgacgcggagtacggtgcccactacggcgacaccgctgtgaagaagcaagcctacagctaccagcaggaggcgtacggggagactggagctgccgggtacggtggcgcggcaatgaagaagcaaggctacaactacacgaaggagacgtgcggagagagcgacgccgcctacggcgcgcaccacggtggcgccggtgccgccgtgcagacgtacgcctacaaccagcaggcgctgtacggtggctccatcggtgccgccgtgcagcagccggcctacaagcagaagggcgccgctagtaagactaacggctcccggcagaaggtgtacgggtacgcgggggaagccgtcaacacagcaggggcggggtacggtgctcaccacggcgtcgttggcgccggggccgggcagcagcacggctaccagaaagatgcgtacgggaccgggtacggcgctgtcgcggtcgttggcaaagagaagaagaacggctaccagtaccaggaggcgtatggcggaactgacgcgggagggtatggcggcgctcactacggcggtggtggcgccgtgcagcagcatgggtatggcggcgtaaccgccggtggcaaagtgaagcagagcggctaccagtaccaggaggcggcgtatggcggaaccgacgcaggaggatacggcgctcactacggtggtggcgccgccgccgccattcagaagcacggctacaggaaggacgtgtacgagagcgagactgagagcgaggacgacgagagcgactgcgaggaggcgttcccgccgcgcggcggccgaatgcagggcggcgtccaggtgcagcacggctacggagctgacaacctcggcggtgtgcgccgctacgagtcgtacgagagccgcgaggagcacggcgacggccgccgctatgagtcgtacaagagcaccgtccagtacaacggtggcgggcacgccacgtgctccccgatcaagaaccgccacctccttggctacggcgcgtaggcataatacgcgctggctgatccagtgcacctacgtactgtatattcgtatgctctgtcgtatatagacagacaggcctatatgccgctaccgctacggctacttggtcgatggatctgcttgtggttgctgatgcagctaaaccatcgaaatatctaaaaaaataagatgtaacataatgccaccttgggataataatgtatgatgctgggacactctggtacgcccaaatcaaaaaaaaaaaaaaaaat

SEQ ID NO: 8690 - DNA, 3176 bp, Zea mays
aacctccccgtgcaggggaggtgctgccgaaattttctgttgctaggcttctgttaggggatggaggaccgtgagtggatgtacacgggccgtagaggaaggaacgatgtcaccactgaatggattagaaagaccgatgatttcgtggaacgggcatatggcgaagctgctaaaggagcgagtctagtcccatgcccgtgcagcaaatgtgacaaccggaaaagaaaaccaaagaagaccatggtaaaacatatttggaagaatggatttacgttgggctatactcggtggatatttcatggtgaagcgcatcgtacgatagaggaggtgctgagacaacgtgtcgaggattatgacgcggatgcgggggtagcggatatgttgaacgactatcaggaggcacagtacacgggaggatgtatggatgacgagccagagccgactgcaaaggcgttctacgacatgttcgacgcggcacagaagccccttcacggccagacaaaggtttctcaactggatgccattgggcgtgtaatggcgttcaagtcgcagtacagcatgagtagagacgcattcgatggcttgttgacggttattgggagcctgcttccggatgatcacgttctgccaaagagcatgtacgaggcacagaaactccttcgtgcactcaagatgacgtatgagcagattcatgcttgtccgaagggctgcgtgctatttaggaaagaatacgcggaggcaaagtactgtcccaagtgtaattcgtctaggttcatggaggtagactctggtgatggacagaagaggcagctcgacatccccttgacaatcctacgacaccttccgttcataccgaggatccagcgtctgtacatgacagaggaatccgcgaaacagatgacatggcacaaaaatggaaaacgatacaatcctgacaagatggtgcacgcatccgatggtgaagcatggaaacactttgatgccattcaccgtgagaaagccgaagaggctcgtaatgtacgtgttgcgttggccacagatgggttcaatccctatggaatgagcgctgccccgtacacatgttggcccgtgtttgttatcccaatcaatctcccccctggtgtgtgctttcaaaggcagaatatattcgtgtcgttgataattcccggacacccggggaataaaatgggcgtgtacatggagcctttgatcgatgaattggtacgtgcctgggaggaaggggtatggacgtatgaccgagctacgaagacaaacttcagaatgcatgtttggtaccagtactccatgcatgacttaccggcgtatgggctattctgtgcctggtgtgttcacggtaagttcccatgcccagtttgcaaggaagctctcaggttcatttggttgaaaaagggtggcaaatattcgtccttcgataaacatcgacaatttctccctgctgaccatccattccgcctagacatcaagaactttacgaaaggtgtcgtagtgacagaccgcccacctgcaacgatgactggtgccgaaattcgtcaacagatagatgggctcgtggccaatacagaaggtggttttgtgggatatggtgagcagcatatgtggacacataagtctggcttgactcggctcccctattatgacgacctgctccttccacacaacattgacgtgatgcacactgaaaagaatgttgccgaggcactgtgggcaacaattatggacattcctgataagtcaaaggataacgtgaaggcaagagtggatctggcagcgttatgtgatagaccaaacctagagatgaagccgccaagtggcggaaagacatggagaaggcctaaggccgatttcgtcctaagcagggcccagaggaaggaagtacttcagtggatcaagatgttgatgttccctgatgggtatgcagctaacctgagtaggggggtgaacttatctactatgcgagtcttagggatgaagagtcatgacttccacatatggattgaacggattcttcctgcgatggttcgaggctatgtccctgagcatgtctggctagcgctttcagagttgagctatttcttccgtcagctttgtgcaaaagagttatctcggaccgtggttgcagacttggaaagattggcacccgtgttactgtgtaagcttgagaagatatttccacccggcttcttcaatccaatgcagcatttgattcttcatctcccctatgaggcacgaatggggggccccgtgcagggacgttggtgctatccaatcgagagatgtctaaagactattcgaaagaaatgtagaaataaatgcaaaatcgaggcttccattgcagaggcatacattctagaggaggtctcaaacttcacaacaacttattatggtgacaaactgccgagcgtgcataatccaccccctcgttacaatgatggcgacaatgaatcgaaccttagcatatttcgaggccaactcggaagcgcaagtggctcgaccaccaagaccctgacacatgaagagtggcggcatatcatgctatacgtattgaccaaccttgaagaggtgacgccatacatggaacaatttcttcatgaattctggcgtcgatcaagggaccccactccacaggaatatgacgctcttcttagaaagggtgcgagaaatgggttgcccgatttcatttcctggttcaaacgtaaggtacgtgcttagtttgtaaaagagatacgtctttgaactcaatttagcgtcttttaacttgcgaatacttgcagggccaaagagatccgtctatgagtgccgagttgagacaagtagccaacggctttgcttataggtcaagaaatattctgggtatgacgtcaatgggttttcgcacaacacactacgacaaaagtcggcccaatcggaaaacaacgtgttctggagtctttacgccgggccttgacaatgtcgattattttggacgaatcgaagaaatatatgagctcaatttttatggttccaaacctcttactccagtgatattcaaatgtcattggtttgaccctcaagtgacgagccggacacattctaatcttgggctagtcgaaattcgacaggattccaccttaccaggagacgatgtctatatcgtggcccaacaggccacacaagtg

SEQ ID NO: 8691 - DNA, 2605 bp, Zea mays
  misc_feature (2452)..(2452): n is a, c, g, or t
gacaatcctacaccaccttccgttcataccgaggatccagcgtctatacatgacagaggaatccgcgaaacagatgacatggcacaaaaaaggcaaacgatacaatcctgacaagatggttcacgcatccgatggtgaagcatggacccactttgatgtcattcaccatgagaaagccaaagaggctcgtaatgttcgtgttgcgctggccacagatgggttcaatccctatggaatgaccgctgccccatacacatgttggcccgtgttcgttatccccatcaatctcccccccccccggcgtatgctttcaaagacagaacatattcgtgtcgttgataattcctggacacccggggaataaaatgggcgtgtacatggagcctttgattgatgaattggtccgtgcttgggaggaaggggtatggacgtacgaccgagctacgaagacaaacttcaaaatgcatgtttggtaccagtactccatgcatgactttccggcgtatgggctattttgcgcctggtgtgttcacggtaagttcccatgcccagtttgcaaggaagctcttaggttcatttggttgaagaagggtggcaaatattcgtcattcgataaacatcgacaatttctccctcctgaccatgcattccgactagacatcaagaactttacgaaaggtgtcgtggtgacagaccgcccacctgcaatgatgactggtgccgaagttcgccaacagatagatggtctcgtggccaacccagaaggtggttttgtgggatatggtgagcaacatatgtggacacataagtcgggcttgactcggctcccctattatgatgacctgctccttccacacaacattgacgtgatgcacactgaaaagaatgtcgccgaggcactttgggcaacaattatggagattcctgataagtcaaaggataacgtaaaggcaagagtggatctggcagagttatgtgatagaccaaaccaagagatgaagccgcctagtggtggtaagacatggagaaggcctaaggccgatttcgtcctgagcagggcccagaggaaggaagtactacagtggatcaagatgttaatgttccctgatgggtatgcagctaaccttagtaggggggtgaacttatctactctgcgagtcttagggatgaagagtcatgacttccacatatggattgaacgaattcttccggcgatggttcgaggctatgtccctgagcatgtctggctagcgcttgcagagttgagctatttcttccgccagctttgtgcaaaagagttagctcggaccatgattgcagacttggaaaggatggcacccgtgttactgtgtaagctggagaagatctttccacccggcttcttcaatccgatgcagcatttgattcttcatctcccgtatgaggcacgaatgggggggcccgtgcagggacgttggtgctatccaatcgagagatgtctaaagactatccgaaagaaatgtagaaataaatgcaaaatcgaggcttccattgcagaggcatacatactggaggaggtgtcaaacttcacaacaacttactatggtgacaaactgccgagcgtgcataatccaccccctcgttacaatgatggcgacaatgaatcgaacctcagcatttttcgagggcaactcggaagcgcgagtggttcgaccaccaagaccctgagacatgaagagtggcgccatatcatgctatatgtattgaccaaccttgaagaggtgacgccatacatggagcaatttcttcatgaattctggcgtcgatcaagggacccaactccacaggaatatgatacccttcttggaaagggtgcgggaaatggattgcccgatttcatttcctggtttaaacgtaaggtacgtgcttagtttgtcatttgaagttgctcttacgtgcgaataatataacaatctagcgtgtttgaacttgcagggccaaagagagccgtctatgagtgccgagttgagacaagtagccaatggctttgcctatagggtcaggaaattttctgggtatgacgtcaatggataccgttttcgcacaacaagctacgaccaaagtcggcccaatcgaaaaaccacgtgttctggagtctttacgcccgggcttgacgaggtcgagtattatggaagaattgaagaaatatatgaactcaatttttatggttccaaacctcttactccagtgatattcaaatgtcattggtttgaccctgaagttacgagacggacacattctaatcttgggctagtcgaaattcgacaggattccaccttaccaggagacgatgtctatattgtggcccaacaggccacacaagtgtattatcttccatatgcgtgccaaacgaaacaacatcttaagggttgggatgttgtgtataaggtatcaccgcacgctaaattacctnttccaaacgatgaagattataacttagacccggacacatatgacggagagttcttccaagaagatgggctcgaagggcaatttgagatagacttaaccgaagcgatcggaatggaagtagatattgaaatggttgttgatgacgaggatgatg

SEQ ID NO: 8692 - DNA, 1254 bp, Zea mays
gcgtcgtaatttggacctctagacggcccgggggccgggggggggggctggagccatccggtggggcagcgccaagctgcagggcgctcgcgacgagatggaggatgaggtcttgctccgcccgggctccctcctcgatggcttctccttcgccgccgtcttggatggacacgccggcttctccgccgtccagttcctcagggatgagctgtacaaggagtgcgcagctgcgttggacggcggcgcggtgctcagcacgaagaatctcgacgctatcacggcctccatccagcgtgccttcgccgctgtcgacgccaagctctccacctggctcgagcaaacggacaaggacgactctggtgctacggccactgtcatgtttctcaggagcgatgtgcttgttgtctcgcacattggggactcttgcttggtgatatcacgtggtggaagatctgaagctttgactggctctcatcgaccgtatgggaacaacaaaacgtcccttgaagaggtcaagaggatcagagcagcaggtggatggattgttgatgggcgcatatgtggagacatatctgtatctcgtgctttgggggacataagatttaagacacaaaagaatgaaatgctggtgaaaggagttaaacaaggaaggtggactgataagttcatctcacggatacaatttaaagatgatatagtaatctcgtcacctgatgtatctctggtagagcttggaccagacgtggaatttgttctgttggcaactgatggtctttgggactacataaaaagctctgaagctgtagcttttgtcagagatcaactccgtcagcatggtgatgtccagttggcctgcgaggcacttggtcagaaagctctggatcaacggtcccaagacaatattagcatagtcatagctgacttggggaggacaaactggaaggcgttgcccgatgaaaggccgaacttgttcttggaactaagtcaagcagtcgcgactgtaggggttgtctcaataggaatttgggtctcgtcgttccttgggttacagtagaactagctactccgtccggatgtgtatattacctactgagtttacatctttctgctagcagtagcagctgcaaaatatatgtatattcgtatatagtgtgtgaattgatagggtaatctgtttgggtaatactgagtgaacgtgtgaagtactaaaaaaaaaaaaaaagaagagaaaaaaaagcaaaaaaaaaaaaaaaa

SEQ ID NO: 8693 - DNA, 3022 bp, Zea mays
  misc_feature (2927)..(2927): n is a, c, g, or t
gcctctaatccctcccaactccagcgccgctaggggtcaaatcgaaaaatggcgttgctgagcccgcgcgtgccgcggctgccgccctccaccttcacctccgttgccggtgcccggtgctttggccctgccgcgaggtgccaggcgacggcggcgggcggcgtggcggccgcggggcccccgtcgtcggagctggaggccatccggtggggcagcgccaagctgcagggcgctcgcgacgagatggaggatgaggtcttgctccgcccgggctccctcctcgatggcttctccttcgccgccgtcttggatggacacgccggcttctccgccgtccagttcctcagggatgagctgtacaaggagtgcgcagctgcgttggacggcggcgcggtgctcagcactaagaatctcgacgctatcacggcctccatccagcgtgccttcgccgctgtcgacgccaagctctccacctggctcgagcaaacggacaaggacgactctggtgctacggccactgtcatgtttctcaggagcgatgtgcttgttgtctcgcacattggggactcttgcttggtgatatcacgtggtggaagatctgaagctttgactggctctcatcgaccgtatgggaacaacaaaacgtcccttgaagaggtcaagaggatcagagcagcaggtggatggattgttgatgggcgcatatgtggagacatatctgtatctcgtgcttttggggacataagatttaagacacaaaagaatgaaatgctggtgaaaggagttaaacaaggaaggtggactgataagttcatctcacgaatacaatttaaagatgatatagtaatctcgtcacctgatgtatctctggtagagcttggaccagacgtggaatttgttctgttggcaactgatggtctttgggactacataaaaaggtctatccaagtacctttcatatttacgtgcagttttttttttctttcaaaacattgtactaaattcacttcaaagtttgaaagttagatgttctgacatgtaaaccgattggcttttgtagctctgaagctgtagcttttgtcagagatcaactccgtcagcatggtgatgtccaggtactcagtttatcttgccgagaaaagcaatagcaaattattttcctttctgcaactgattctgttatttttttttacttattaaacatttggtttgtgtagttggcctgcgaggcacttggtcagaaagctctggtattgatgcctgccatattcatcttctctgttcttcttcttttttatgtcccatgaaatctagtctaagtatagttttgagtccattacagaatactaaaaaagaacgctgttgtaatttcttccttttgttctcaacaggatcaacggtcccaagacaatattagcatagtcatagctgacttggggtacttattcaaaacttctattagttagtttaacggcctgtgtgcacgcttccagtgcagcatccactgcaaagtttgctgacagttcgtacaaatattggcaggaggacaaactggaaggcgttgcccgatgaaaggccgaacttgttcttggaactaagtcaagcagtcgcgactgtaggggttgtctcaataggaatttgggtctcgtcgttccttgggttacagtagaactagctactccgtccggatgtgtatattacctactgagtttacatctttctgctagcagtagcagctgcaaaatatatgtatattcgtatatagtgtgtgaattgatagggtaatctgtttgggtaatactgagtgaacgtgtgaagtactgatgaagatcgtgtagttgagctcctggtgagtcatgagtcatgacagctgagtggcttttgagtaatcctcatgtcaaaaaaaaccaagcaaaagaagaagaagaaaaagatcttctcatcagttgcttattgctacaaagccataaacaaatgaaggagtattgaataatggaatcgaataagtgcatggaacaatctgtagcttgctacctttatgctatgcgtctattcaagaataccgatgcggcttctcgcctgcgactatcctttggtcgatcctacggcacgccgacgctgcctgtttgccccgatacgcatatacaggatacacacaaacacaaccctacaattggtgaaacactttggatctgtgcatagccaggatacacacaactttacaagcttcacccatactagtaacactaaattcttaggctagattgtcactcacgtgcttgcctgggtaaaaaacttaatggtggccaccgtccatgccgattggtgacatgccgttgcaaccaaatcatatgatgttggctttcatacatacgatagtccttcagtgtatgaagtcaatgtatatctgagtatataaccgcgactatattttttttcaaaaaaaaaaaatcatgtcatttctacgtaatcatatagcgatcaacacgtagacacactatatggttaaggtaattcagaagctagccgcctaataaataacggactacacaacacgagcaaaacaactctcaaagatcaaatacttaactgcctcatttttatgacagaaattaacaacacggttcgctacccaccattaaaaaacagactttatcaaggatgaagatctagaaattaaagcctacggtcccaaaagcggccactccaaaagcaaataaataaaagcatgtcaagagatatttatgagaccaagaaaaaaaagattgatgattgaggaaaagtttgtgcaaaactctgcaagccaggaaccaaactactgaagattggtcagggggaaagaacacaaagaggcggcatgcatggagctaggataattttgtgcataagggataagctactcactaggttgatgcctgataacaacntactatagatatataaaaacagaacaggagattcttccccacagagactttcgacggtacatcatggataaatggtcactgtttctaaggtaacc

SEQ ID NO: 8694 - DNA, 1368 bp, Zea mays
atccctcccaactccagcgccgctaggggtcaaatcgaaaaatggcgttgctgagcccgcgcgtgccgcggctgccgccctccaccttcacctccgttgccggtgcccggtgctttggccctgccgcgaggtgccaggcgacggcggcgggcggcgtggcggccgcggggcccccgtcgtcggagctggaggccatccggtggggcagcgccaagctgcagggcgctcgcgacgagatggaggatgaggtcttgctccgccccggggctccctcctcgatggcttctccttcgccgccgtcttggatggacacgccggcttctccgccgtccagttcctcagggatgagctgtacaaggagtgcgcagctgcgttggacggcggcgcggtgctcagcactaagaatctcgacgctatcacggcctccatccagcgtgccttcgccgctgtcgacgccaagctctccacctggctcgagcaaacggacaaggacgactctggtgctacggccactgtcatgtttctcaggagcgatgtgcttgttgtctcgcacattggggactcttgcttggtgatatcacgtggtggaagatctgaagctttgactggctctcatcgaccgtatgggaacaacaaaacgtcccttgaagaggtcaagaggatcagagcagcaggtggatggattgttgatgggcgcatatgtggagacatatctgtatctcgtgcttttggggacataagatttaagacacaaaagaatgaaatgctggtgaaaggagttaaacaaggaaggtggactgataagttcatctcacgaatacaatttaaagatgatatagtaatctcgtcacctgatgtatctctggtagagcttggaccagacgtggaatttgttctgttggcaactgatggtctttgggattacataaaaagctctgaagctgtagcttttgtcagagatcaactccgtcagcatggtgatgtccagttggcctgcgaggcacttggtcagaaagctctggatcaacggtcccaagacaatattagcatagtcatagctgacttggggaggacaaactggaaggcgttgcccgatgaaaggccgaacttgttcttggaactaagtcaagcagtcgcgactgtaggggttgtctcaataggaatttgggtttcgtcgttccttgggttacagtagaactagctactccgtccggatgtgtatattacctactgagtttacatctttctgctagcagtagcagctgcaaaatatatgtatattcgtatatagtgtgtgaattgatagggtaatctgtttgggtaatactgagtgaacgtgtgaagtgcgctcgcgatctagaactaaaa

SEQ ID NO: 8695 - DNA, 4779 bp, Zea mays
atcaaactggattgtgtcagctatctcagctaaccaatattgatctctcgtataacttcttggttggagatgttcccgcatgcttacagcaaatccaaaggtacacctttgccgtttgtggcttaaaatgtttcacttgtcttcctgaacttacctgttttacagtatttgaacagatcaagcttggtagggaattgcttccagaacaacacatcaaaccgcccacttcaacaatgtatggcgatattttaaattttaactaatacaatttgttcatcttttttggttgtttgacacccttttcttccgttatttggcacgagcactgcatatgcatcactggttccaaaatactctatcggttctaaaatagtagtcgttttagctcttggtttttatggctatatttaaatgggcgaagatgaacctagacacatatacaaaacacatatttcaaatattttatgaatctagacacatatacaaaacaaatacatcaaggctaaaagatgaaattagggttcattcctggactagaggacatagtgcaatgttggaaaccgaactatagcctattgaactcatttgacacttaacagaagcaaagtaaccctagtcacattgcttattgcgttgtcaatctcggaccaccaaattactgttgatttcggacctaggatagtgtaaccatggctatggttgttaaaataaagacctgaacttacactttattttcttccttgttggatccgaccccccacattcttccttttgtccttgtgtgcttcgatctttaaggctccttttgttttggttcatgttaatagttccaccttgttttttaaggatgccaaaattgattatgtgcgctttcatatgcttgttacatataagcaatacaatatgactcgtaccggtctatatactgtcaatagaacgttcccaacaactttttcaaaagaaaaagaaaaggaacgttcccaatgttagcgtaattttaacataaaaaaattgttagcgtaatttgcttttctgaacagtgaacaagtgtactacataattacaggtgaaactaatcaggacagaggcaaagacaatgatgctgatgagaatgtgcagaaaggcctgccagagccactttggcttctcattctggaagtcatcgcagcagtttcattgctttgcttcttaacactttgtaccatgactggcctccgaaggtgcagagccagatcctctgggtctgagaccagtgttccatggacaagagctgtaagctggaaggagaacaccgtaatctcaatcggttagtgcctgcttcttttgcgagtagctgacaaaaactgaatttttttacactgtgtcgattacgggttgttgctcgtgtagatgatgacctcctggtaaatgtgccaaagataagccggcaggagctggcagaggcttgcgaggacttcagcaacataattggatcgtctcaggagacagttgtgtacaagggaactctgaaggatggccgggaaatcgctgttgtgtcgctgtctgttccggtgcattactggaatgactatgtcgaacttcactttcacaaggaggcgggtgttcaccaactgttcccacattaagatttttactactgcgtaatcatatctcataatattctcgaaatattcaggtgatagaaatgtccagaccgagtcacgaaaatgtcgcaaagatggtgggatactgcaaggagtctgatccattttcgagaatgctagtctttcagtacccaccaaatgggacactctacgagcatctgcacggtaagccaacaagctcttgccttgctccatgcctccatggatggtggcatgaacacggtgcgttgtctgtttgcagatggagatgggtggcagctatcttggcctagacggatgaaattagcactcgccatctcgagggctctcagatacttgcacactgagctgcaacctccgtttgcagttgctgcactgacgtctagttcagtctacctaactgaagacttctccccaaaggtctgagttacctgctgctggtagcatagcatcctgattcctgagcatgaggtcctagtcttagttcagttcagataacaactgcaactgattgcggttttgcagataatcgatttcgagaggtggagatatcttgcgaccaaaccaggatttggctcactaaatggcgggtcagtcaacagcgttacagattctcggcataagcgcttcatggacgtccaggccaacacttacgcgtttggcgtgatcctgctggagctggtcagtggcagagcctcggtttccaaagatacaggaggcttggtggattgggtaatgactcttcttgactcgagcggccaagcctgctcatgctacactgcctgaggctatctgcatgtgttatcactgacaaataccgggcgcgttgcacgcaggcaagaaagcacctggagcatcccgaggagttcggcaagctggtggacccgaggctgcagagcgtgaaccaggagagcctgggcatcgtctgcaacgtggtgaacctgtgcatcgacctggagccgtcgcggcggccctccatgagcatgatcgcggccatcctggaggaaggcatcgaagcgtcggcggccaccttgctcaggaattcgtctctggcctgggccgaagccgagctggccatctcctagaacctagataccctctttgcatgttttgctgcacttgctagactgtatgtttggacagtgacgatggtttaacccgttgttactccgtttggcattgttatttctctcccttttttggagagagaaatggctcacagatctgaattcaaaatgactcaagttttgatttcatcagcgcgaggagatgcatttttatcttttcaaatagagggagcattttctttttttaggtacagaaaatcagagggagggggctagacaaaagactgctacaatagatcgatgacacagagtataatacaatcataatatagagaggttcgaattgggtagtagcctatgttgttctttgtatggtagatgtttagatgcaaacatggacaaaacttacatatgtggaggcgcaggagagcatgcttctgtctccaacttagccgagctctttggcccatgttctccagtgaagcacgattcgtcatcgtcgatctttccttctctcacggcggcctgcacgactgtcgactccttagtgtgtcaggacactagagcaaacatcgtagtcttctttggcgagatgcccaaaaggagatctggcgttgtactggtcatcgcgggtcatctccagataatcttgtctttagcctcctgttatgactggacacaatatgtacgcggatcagaaaaaaaaggacaaattcttcaatttggcgttgtagtgatattccttctcagggtcttaattcaggtggcgcttgtgtgcgacgaccctcaagagaacaatactttggacctgaaaaggcagatcccaatttcctacagattctggaatctggctggcggctgctaccatagcaggtccttagtccttttgttccatcttgccctgtttttttccctctccagccacaactgccggcgaaatggcacaggcaccatttgctcgcaacaaagccacaggcaccaatcaagaaagcggacaaagatgagaggggagctatcctgtccccgctcctcatctcctcaatcctctcgccgccagaaagtaacacttctgcactctagagcagaggagaaacgcatcctggccaagtacgcctctatccgaagccaaaccacacgcacacgccgcgccagcctcacgctctcacccatgttttgtgcgcgcacgcgtcctgcttcttctcgccaacgacaagccgcacgcagcgtctcgccagctagctgatcatgagcaacggcgacacgctcgacaagctggtggtgttcctggcgaagcgcgacggcatcgacaagctggtcaagacgttccagtacgtgtccaagctggcgcactggggcgccgagtcttcgctcccggagctcgcgcagcgcgccaagagctgggagacggcgtccgggctgagccgcaaggcgttccggtcgggccgcttcctggccgggttcaacgcgctgcgccgcggcccggtcccggtcccgggggagctcggcgcgctggccgtgctggccaacgccggcgagatggtctacttcttcttcgaccacttcacgtggctgtcccgcgcgggcgtgctcgagccctggctggcgcgccgggccagcttcgtgtcggccttcggcgaggccgtcggctacgtgtttttcatcgccatggacttcatcatgatcaggcggggcctgcggcaggagagggagctgctgagggaaggcgccaaggacgccgcggagaaggaggtgcggaggatccgggtggacagggtgatgcggctcatggcgacggcggccaacgccgccgacctgatcatcgccgtcgcggaaaccgatcccaacccgttctgcaaccacgccgtcacgctggggattagcggcctcgtgtcagcgtgggctggctggtacagaaactggccctcgtgaactgggccgcttcggcctacatgtgcatatttttcattcacttatttaactgcggctgcgatgcatgatgatattgccagatttgaaccttttctatctccagcaataacctttaaggcctaatttgaaaacttaaaaaaaaaaaaaaaaaacccgcggcc

SEQ ID NO: 8696 - DNA, 2383 bp, Zea mays
  misc_feature (608)..(609): n is a, c, g, or t
cggccgggccgggatttccatgtaatgtaaagtgaagcaaagcaagcgaaacaagccgccgccgcctctgctttcctctcgatcacttccggcgcccgccaccaccgcgccgccgccgccgtcgtgatacttttgcccctccttttttttttcttgtggtctggtctggtgttgcgctttccggggcaggcggatggggaggagcggcacgtcgacggtgaggctgctgctgctggggagctccttcctctgcgtgcttctcgtcagtacctcagaacctgcctcggagtcggatgacgtatctgcgcttcttgcgttcaagagagccatctaccaggaccctctgtccaagctctcggactggaactccaaggacgaggatccctgcgcctggtccggtgtgaggtgctcagggctcaacaaccgcgttgttgcgctcgacctgtcaaattcatctctccaaggattcttggcaccagagatcggatccttgagatctttgcaaactctcgtgttggatcgcaacacattcatgggctcaataccaaaaggcatcggcatgctacacaacctgatcgagctgaacctcagctccaaccagctcgcgnngcctattcccagtgagatcggtgacatggccgggcgcgcgggcggagaccttcacgccaatcggctggacggcactatccctcctgagcttggcaagctgggaagcctccttgagctacggctgagcaacaactgccttacaggcattgttcctgcaagtaatgattccgacgtggaatccgccagcagctctgatcaaattggattgtgtcagctatctcagctaaccaatattgatctctcgtataacttcttggttggagatgtccccgcatgcttacagcaaatccaaagatcaagcttggtagggaattgcttccagaacaacacatcaaaccgcccacttcaacaatgtgaaactaatcaggacagaggcaaagacaatgatgctgatgagaatgtgcagaaaggcctgccagagccactttggcttctcattctggaagtcatcgcagcagtttcattgctttgcttcttaacactttgtaccatgactggcctccgaaggtgcagagccagatcctctgggtctgagaccagtgttccatggacaagagctgtaagctggaaggagaacaccgtaatctcaatcgatgatgacctcctggtaaatgtgccaaagataagccggcaggagctggcagaggcttgcgaggacttcagcaacataattggatcgtctcaggagacagttgtgtacaagggaactctgaaggatggccgggaaatcgctggtgtgtcgctgtctgttccggtgcattactggaatgactatgtcgaacttcactttcacaaggaggtgatagaaaggtccagactgagtcacgaaaatgtcgcaaagatggtgggatactgcaaggagtctgatccattttcgagaatgctagtctttcagtacccaccaaatgggacactctacgagcatctgcacgatggagatgggtggcagctatcttggcctagaccgatgaaattagcactcgccatctcgagggctctcagatacttgcacactgagctgcaacctccatttgcagttgctgcactgacgtctagttctggcgacctaactgaagacttctccccaaagataattgatttcgagaggtggagatatcttgcgaccaaaccaggatttggctcactaaatggcgggtcagtcaacagcgttacagattctcggcataagcgcttcatggacgtccaggccaacacttacgcgtttggcgtgatcctgctggagctggtcagtggcagagcctcggtttccaaagatacaggaggcttggtggattgggcacgaaagcacctggagcagcccgaggagttcggcaagctggtggacccgaggctgcagagcgtgaaccaggagagcctgggcatcgtctgcaacgtggcgaacctgtgcatcgacctggagccgtcgcggcggccgtccatgagcatgatcgcggccatcctggaggaaggcatcgaggcgtcggcggccaccttgctcaggaattcgtctctggcctgggccgaagccgagctggccatctcctagaacctagataccctctttgcatgttttgctgcactcgctacactgtatgtttggacagtgacgatggtttaacccgttgttactccgtttggcattgttatttctctctcttttttggagagagaaatggctcacagatctgaattcaaaatgactcaagttttgatttgatcagcgcgaggagatgcatttttatcttttccaaaaaaaaaaaaaaaaagggcgggc

SEQ ID NO: 8697 - DNA, 4317 bp, Zea mays
  misc_feature (3743)..(3743): n is a, c, g, or t
  misc_feature (3856)..(3856): n is a, c, g, or t
  misc_feature (3981)..(3981): n is a, c, g, or t
  misc_feature (4121)..(4121): n is a, c, g, or t
  misc_feature (4278)..(4279): n is a, c, g, or t
ctatcccattgggtacctcgaggccgggccgggactggcactgccattcccgtttcctcgctcgaacacacaccgaagagagagacagagcgagagaggatggcgtccctggcgcagcacgtcgcgggcctaccgtgcccccctctatccggcgcgtcgcgccgtcgccccgcggcgcagaggcggcctccgtcggcgcttgtgtgcggtacctatgcgctgaccaaggacgagcgggagcgggagcggatgcgccaggtgttcgacgacgcctccgagcgctgccgcaccgcgcccatggagggcgtcgccttctcccccgacgacctcgacaccgccgtcgagtccaccgacatagacacggagatcggctcgctcattaaaggaacagtatttatgactacctcaaatggtgcatatatcgacatccaatccaagtctactgcttttttgcccttagatgaggcatgccttcttgatatcgataatgttgaagaggctggcattcgtcctgggttagtagaagaattcatgataattgatgagaaccctggtgatgaaactttgattctaagtttgcaagcaattcagcaagaacttgcatgggaaaggtgccggcaacttcaggccgaagatgtcgttgtcacgggtaaagtaattggtggaaacaaaggaggtgttgtagctcttgtggatgggcttaagggtttcgttccattttcgcaagtgtcatcgaaaacaaccgccgaagagctgcttgagaaagaattgcctctgaagtttgtagaggtcgatgaggaacaaggcaggcttgtcctcagtaatcgcaaggcaatggcagatagtcaggcccagctaggtattggatcagttgtcttgggaactgtagagagcctaaaaccttatggcgccttcattgacatcggtggaatcaacggccttctccatgtgagccagattagtcatgaccgtgttgcagatatctcaacagttctgcaaccaggagataccctcaaggttatgatactgagccatgaccgtgaaagaggccgagtcagcctttctactaagaagcttgagccaacacctggtgacatgatccgcaatcccaagcttgtgtttgagaaggctgatgagatggctcagatattcaggcagagaatagctcaggcagaggctatggctcgtgctgacatgttgagattccagccagagagtggattgaccctcagttcagagggcatcttaggaccattgtcgtcggatgcaccttcggaggattctgaagaacccacagatgaatagaggcagttgacgaagtgcaccgggtttgagatatgtgatggcagttcatcatgctcattttccttggggtgggggaggcatgacgagagcatgttctgttcagatcgttttccccgttccacttattcttgtcttgtactaggaaatctgaaaatgtaacaaggttctgaagacaccgaaaagaaatgtaattaaatccctctgtgaagttatcccattctcgcaggaacctcaatgtgtagtctgatcgttgagtgtatattttgtaattttgaatgcattttgaatgcgtattccgcaaagggaacacgcgaagtgttctgaatcgcatcacgtttcactgaagaccgaggccaaagacttgtcaacagcaaatcagcgtacgagtgtaaaaaaaatgctgttgcactgtaatggagaggatggttgtgcgacacctggcacgtaaaaaagttagataggaaacttgtttgagttgcccacagccccttcaacacagtggcagtggtagtggcacaacagatgtccgtccatacaagtgcccaagctgtttcaccgaaagtgccgaaaagcaaaagagaagcaaagcaacttctgcagcctcgcaggttgacaatcgacaaactagtgtttgtttttacgaaatttagttgtgcctggagagctgctgctgctcctcatggccacgggccacccgatagacagacaacaagagaaccgggttttaaagcagtttgcttgtacaatacaactatgcccccacggccactgctcttttgttcaaacatctcaagctgccaaaccatactactagtttcactgatagcgccctccactacattcacatgccaaaccaaacatatatcaaatgttcatcccagtgcatgtcaactctgaacaattctcctcaggaaaaaaaggctttcacactgtgagaaaacacggattatatccatcgaatgaccgggggtcaattagctttgttgatcctcatcgatcacgcgtaggcgtctgctctgctgaaagacctgaacctgaacggctaccaaactaattaagaaggcagcaggctagtgttagtgtcagtccctttccagcagctcatactttcctgaaacccttgtacccactgcaagcaaatccgccatatccagtttcccagcgagtgcggattggaattcgcaggcgcgcggccggctggctggataagcctcccgtcgcctgcaacttgcattgcatgaattctactagttgctagcttggcatcatcaagcaagaaacaaaagcaacctccctctctctcctctctctgtctgctgaggcccgcctgaggtcgagctctgcactgcacggtaattaatgtagctgtcgatcggctgaagctagctgcacacgtacgtacgtccacggaccacggtccaccagcagcagcagaagctgagctctcatgtacgtaacgactcagcagtcagcacctacttgcatgcatgcatgaccctcttggcttctcttcacggctcactgtccctgcccaggctgcctactctggctcgccgctcacggtcgtcgctactcactagcttaataattcgtgttggattgagtgtacgttgaccggcaactcataaattaaagaggattaggtagcacggcataacatgacaacatgactttcatagcatattaagttgcatgtacccaccaatccaactctaaagtttaagctgatgagaagagatagataattcaattatattatattctaatagagtattcaaccactgtcttatttgcactgcaagtaggagaagtcaaatatactagtacgtagccgtctctgaaaacgtacttttgaaccgctaagctagcgcttcttttcctttgctgctccaccggtaccattcgagagactgggcacgcacgcatggtacaagcagcttaagctcgctcgaaaaaggcaacgccgcggtcagtctcgctcgttaccgaattccggagaggtaaattaatttaaaccggttatacgtacgtacgtacgtgtcgagtgagagaggccgagttgaacaacacgtatacgcgcgcgcggtataccaagtcctcacgctagctgcaagcctgcaagagaacgaaatgcgtgcatggcttctccttttgggacgcttttgtgatggatatatctcatctcgcctttggaaactcaaaatgcatgtcaaacagcatatatacacggctggcaggcagcgacggaaccgtcgccgtcgatggagttctgcctccactgaccgggtacagagatacacgcggatgggtggatggatacacggcgacatgcgccgcgccggccgcacgcgactggcctgctgccacattattgattgtttcgttcggccggatcggaggagagacgtgtacgtacgttgaacgtacgatcgatcgancagcacgatccatctggcgcgttgtttttatggatccgcgcgggcacaagccagagccacacactagcagatagcagatcacgatgttttgtactagtgtagactgcacaaantttgacatagaagattggagataagaccgatggggttgtggaggtagatgttacgtaccccgcactagtgcggagaatatggatcatgttttttttaagccacaacgagcacgaattaaaaacanaaatccaaatcacggttcaacacgtaatgatatagaccaagctagcacgatccgatgatggtcctagactagatctcaaattccggtctatcaggctcctagcacaatccacacgtatggactaggtttagaccggtctngcccaatcaatgaaacatgtattgtttaatttctttaatttagtaagctataaacttgtagtatttggattttagttaaatgatgctcacattgtttaatatctttaatttagtaagctatgtattttatgtggatgtaatatttagactttatctnnttcaaatatatggcccaggttggaccggtattggcccg

SEQ ID NO: 8698 - DNA, 2003 bp, Zea mays
cctctcgactgcccttcggacgcgggggcccctgggcaaattgcggtggccggggcccgccgccgcgacagcgccgtccgtcctcggttccgctcctccgtccgatccatacgtttccgttccctataaattctttaaattcccgcaaagtcccgtaccgctcagccaacccaacacgacggcgagtcggcggcgagtgggagggaacaccgcagcagcgatgcgtcggggctcgctgccgctgccgctgctgctgcttgcggcggtggcggcggtagcggccaccgcggttcccgccgagccggcgtcgacgctgtccgggccgtcgcggccggtgacggtggcgatcggagacaggggccacgcggtggacctgccggacacggacccgcgggtgcagcgccgcgtcacgggctgggcgcccgagcagatcgccgtcgcgctctccgcctcgcccacctccgcctgggtctcctggatcacaggggactaccagatgggcggcgccgtggagccgctggaccccggcgcggtgggcagcgtcgtgcggtacggcctcgccgccgacgccctcgaccacgaggccaccggggagtcgctcgtgtacagccagctgtacccgttcgagggcctccagaactacacctccggcatcatccaccacgtccgcctccagggcctggagcctgggaccaggtacttgtaccggtgcggcgacccggccatcccggacgccatgagcggcgtgcacgcgttccgcacgatgccggccgtcgggccggggagctacccggggcggatcgccgtggtcggggacctcgggctcacctacaacaccacctcgacggtggaccacttggtgcgcaaccgccccgacctggtgctcctcctcggcgacgtctgctacgccaacctgtacctgaccaacggcaccggggcggactgctactcctgcgccttcgccaagtccacgcccatccacgagacgtaccagccgcgctgggattactggggaaggtacatggagcccgtgacgtcgagcatcccgatgatggtggtggagggcaaccatgagatcgagcagcagatccacaacaggacgttcgcggcctacagctcccggttcgcgttcccgtcggaggagagcgggtcctcctcgccgttctactactcgttcgacgccggcggcatccacttcgtcatgcttgcgtcctacgccgactacagcagatcaggtgcgcagtacaagtggctggaggcggacctggagaaggtggacaggtcggtgacgccatggctgatcgcgggctggcacgcgccctggtacaccacctacaaggctcactacagggaagccgagtgcatgagggtggagatggaggagctcctctacgcctacggcgtcgacgtcgtcttcaccggccacgtgcacgcgtacgagcggtccaaccgggtgttcaactacacgctggacgcgtgcggccccgtgcacatctcggtgggcgacggcggcaaccgcgagaagatggcgacggcgcacgcggacgaggccggccactgcccggacccggcgtccacgccggaccccttcatggggggccgcctctgcgccgccaacttcacgtcgggccccgccgcgggccgcttctgctgggaccgccagccggagtacagcgcgtacagggagagcagcttcgggcacggcgtcctggaggtcaggaacgacacgcacgcgctctggcggtggcaccgcaaccaggacctccatgccgccaacgtcgccgccgacgaggtctacatcgtcagggagcccgacaagtgcctcgccaagacggccagattgttggcctattgattgatccatcactcctagctactcctactctagtcggtttcagaagagttctattctcatttaatgcagcaaatctgcagtgttaatttgcggcagtaccagattaagcttccatccagattggcagtgggcctcgagggggggccaa

SEQ ID NO: 8699 - DNA, 1340 bp, Zea mays
actcatcacaaatctctctctctctctacaagctccagctagactgtcctgctctgcttcggcgctactgtgcagtgtgcacagccagccagctctgcagcagagcagagtccggctgtgagccctgaccagagaggattcagtgccatggagagacctgcgcaggcgcccacgcagctgccgccggggttccggttccaccccaccgacgaggagctggtagtgctgtacctccgccggaaggccctggctcgcccgctgccggcagccgtcatccccgtcgtccacgacgtcgccgggctcgatccatgggacctccctggggcaagcgaaggggagggttacttctttagcctgcggcgagcgccggcgaccggccgtggcagccgcaggaggagagctgggagcgggtactggaaggccacgggcaaggaggagccggtgttcctacagtgcggcggcggcggcgtaggcggcaagaggcagctgctcgtgggcggcaagacggcgctcgccttccaccgcagtgagccgtcgccgccgtcgtcgtcgcggacaggctgggtcatgcacgagtaccggctcgccgccgcgtcccgcggcgtggccgagcagaggaagaagaatgcgagccacggttgttgcgatgctgagccgggagagtgggtcgtgtgccgggtctttctgaagaagggagcaagaagaagcaggccgggccgggatggtaaccacagcagagctctgagacaccgcgcatccgctgcgccgccgcagctccgggaaggtgtgggaggacggcagccgttgctgttcccggcgccacagtcgccgtcctcaagctgtgtcaccggcgttaccgacttgtcagacgaagaagacgaagtcagcagcggcagcataacaagagttgcacctcagagagaggcctgatggggattttaagtgttccctcccccctctctcatggtcccgtagcccaacctttttctggtaccatacaatgatgatgagttaagcacgagataatcaggtttaaggcatgtccagcgcaggagtgatcccgaaatatcatgtcaaatggatctggcaacctgagtttaaatcaaaaaaaaaaaaaaaaaaaaaaaaaaaaaaaaaaaaagtccactttgatttggaactagaaaatgggcgctgcaacggcccaatggtgtgtaaaacctaaaaatgggatggtagccaaggcattctttaagatgtaatgtccccatcccaaaatataattcgttttatattaaacacatttttattaagcaatatatgagtatgattctcatatatacctatattcattatcattt

SEQ ID NO: 8700 - DNA, 2799 bp, Zea mays
aaaaacgcatgcgagtatgcgacgaccctttcgtcgaattttgaaagggatcggtaggaaaattaaaatttggggaactatcaaacacatctcgttaccatctagctcgttggtcggtcgccgtcagcccagtacccaccatccccaccaacggccggccgccgcggcggagcggagcagagagcaaccatggcgtcgaagcagatggaggagatccagcggaagctatccctgctggagtacccgcgggcgaacgcccccgcgcaatccctcctcttcgccggcgtcgagcgctaccgcctcctcgagtggctcttcttccggctcctaggcgacagatcgcccttcacgcagcagaactggcaaggggatagcctggaccgcgacgaggagaacaacaggatccaacacctggcggagatagccaacttcttgggcatcacaccttcggcggacaccgaggcgattcagggtcgaggtagctatgaggagcgggtggaactgctccatcttattgttgacctagtggaagctagttgctacgctgacaatccagaatggagtgttgataagcaattggagaaggatgtgcaactagtagattcaattgctgagaaacaagcccaaattttttcagaggagtgcaagcttttccctgcggatgttcaaatacaatcaatttaccccttgcctgatattgctgaactagagttaaagctctcggagtataccaaaaagatgtctaatctgcagcaaatggttcaggagttagcatcgaagtatgattataatccaaatgaagactatgcggagacagagttgaagttgagggaatacttgcaatcatttttggaaacggttaaatccttcaacacaatatatactaaggaaatccatccttggacccacatgatggaagtgccacaattgcatggcttcggtccagctgctaatcgcctcttggaggcatataatacccttttaaagttcttgggaaatctgaggagcctccgagattcatacactgcaatggctgctggttcactgtcggcttctaatgagccttcatctgtgaccaagattatttcagactgcgaatctgcactcaccttcttgaatcacagcctttccatcctttcaacttccgtggcacgtgagcaggggggaacgctatgattttacagtatttggatagtaagatatagtcagtgaacttatgtatgtaagcttctattaattcaattgtttgcttcctataaaaaatcagttgtttgcattttaatttcagctagtgcatgtactccctttgatccaaattataaattgttttgatattttccaaattatgtctaaatacacaatccccgtgccataattgtttatgtagaaaaagtcgtggtggtctagattcacaataatctctactagaaaaagaccgtgtcacagactatagcgatgattaaggagtaaatccctagcaagcctgttgtatgttttggggagggggggaggttgacatgggacatttgtgccaccataattagtctcatttcctagtgtggtggacttgcgtactctagcccttgtatgcgctcatctcctttttaatataacaagcaatcctctttccggttttcaaaaaaaagtgtgaatgtcttcgtaactagtcatgctattgtttgttcgtgctatacaaatgaaggaaaaatataaatatatatgtaaagtaataatttgaaaataaaaatccaatcgtgtcaggatgggccggcattgtggatcaagaagacggtccaatcacggcacgattctctggggttggaccagcacgagtccactttgaatcatatcgaccttagatgtgtgccaccgcgtttaggtccacgcaaggtgcaccacaatatccattgcgttggtatggatgacattattgcatggttacctcggctttggtttggcttaatccgtagacgttccaattgcatgtgcatgtgttgatcttgtcctagtccctggttgtctctccttgacacgatctaggaatctatggatcggaattgtgtttgaataaatatctcatttaaacaaaatttgtctttacagtatatagaaaccatactgttgaggtttcggaaactaggggacaatagatttgtgttcgataggatgcaagcgcggactcactctaaatggtggatcacgtggatccgagcaaagaactgaaacacaggggttatactggttcaggctttcttactagtccagtgtagtgctgatcgtagtattacttagagacgtgttacaacaagtgtgcttgtgttcgaacagagtgagagatactcccttttatacttcaagggacagtccttacattagactatgagagagagagagggagggagagcgagttctgtagctaatgccttgcacggtagtgcgtggcgggtctattggtcagtctcggggcatgcttgcatatggcatgctccttctgacgggtcgtgtgttgttgcactcttggtatggtgttctgtcttgtccagccggcgtatgagtccctatagcttgctcaacgcctacattgtcgtacctgatgggtctcacagaacgtgctcatagtaaggttgaggttcgtgttcagtacagcttcatcttctatcaatgcccttgcatcaccctgtagcatgtgtgagtatgcattaggtgtgttgtcctgtcctttctagtgtgtaggtcgttactgtggaaactctgttgtcgtggtctcccttggtactgtacacaggtctcagacatagt

SEQ ID NO: 8701 - DNA, 2358 bp, Zea mays
cattgggtccctcggggccggcgcgggaccactcaccacagtctccagtctccactgcatctaaaaaaaaacgtaaaacccccaccacgccgtagcggagagaagagaagagaggagcgcgcgatcgatgtcgggctccggcgatcgtcgcggcggcgggcctccaggttcccatagtggctgggaaaccatggggaagaagtcgaagaaacccgggcaagccggggggagacagtgggcaccatggagttccacaaatgtgacacctaacacagcaagaccagcatggggtggcagtggttcctcgcacccttctggaaccagctgggctcaagctccagatcatggtgctgctaccagaggcaatcctagaccgccatcacaaacatcgcgccctgttctggctccacctctggcaaatggttggcagtggcaatccaggcctcgcccatctggatctgaagtcaagaaggatgatgctcctccatctggttctgtccctgaggtggagaatgttgatggcaacaatacatcagatgatgatgatgatgatgacgatgatttgagtgatgatatcagtgatgactatgattctgacgcaagtgagaaaagttttgagactcgaaaaacgaacaagtggttcaaagagttctttgaagtattgaatacattgagtttggaacaaattaatgaacaaactcggcaatggcattgcccggcatgcaaaaatggacctggggcgattgactggtacaaagggctgcagcctttagtgagtcatgctagaacaaagggttctacaagggttaaacttcacagggaattggctgcattgctggaagaggagctttctcgcaggggaacttcagtgttaccagcgggtgaacaatttgggaaatggaaaggactgcaagaaagcactgatcgtgagatagtgtggccaccaatggttattgttatgaataccttcttggaaaaagatgaagatgataagtggaagggcatgggaaaccaagagctccttgattattttggagaatatgaagcaagtaaagcacgtcatgcctatggtccctctgggcaccgtggtatgagcgtgttaatatttgaaagctcagctgtgggctacatggaagctgaacgtctgcataaacactttgttaatcaaggtacagacaggaattcatggcacctacgcaaggttcgatttgtgcctggtgggaaaaggcaactatatggtttcttagcaaacaaagaggatatggaggcatttaacaagcattgccatggtaaaagccgtctgaagtatgagatgaggtcttacaatgagatggtggtgattcaaatgaaacagatgagtgaagacaaccaacaactgaattacctgaagaacaagatggttaagacagagcagcgatctaaagcagtagaagaatcattgggtgttgttacccagaagctacgtgagactattgaagaaaatatatttgttaggagtaaagcaaaagagaagcacatggagtacgaggaagagatgaagtcccaggaggaaatttttcatggtctaattgaggatattcacaaggccacagaggataaagaaaagcagtttgagaagttgttgcaggaagagcgctcaaaggccagacgctttgatgttgattctggaactatgaaagatcgtcagctaaggaaggaatatgtgcagaagttcattgattgccaagtcaaggatgtggcagagtttgaagttgagcgagatgagctgatcaaagtccacgaggacaagaagttgaagctcaagaaagaatacatggatctggagctggagctggagaaggagtttgacgcagccctgacgggcctgatggagaagcataagccagataccttcgaggcctccagctcgtaagggggcttcagcggctaagcgctttccttaggccccagctaagcttggagcagtctcgtacatgctcctgcttgcttatccatgaaataatgcctggacagtctgtagatgttgcgaaaacatggtgccccctgtggttgccgcgtgtgtagtaagtatctctcagtcgtagtgtggttgaagcatctgaactcttgagcggtttgcctgtgatggcatatgggtcaaactacaactggagtgtgatatctagtttatatggtccagcgctcttgttgactgcgggtggtggtttgccccggataatttactgattatgtctgctccgatcgtcaaaaaaaaacattctgttttttttccaccaaaggttaaaaaaacaaaaaaaaaaaaaaagggcgagggcggcagacggatccagaggactcacgcacgcgtgcagtggggcg

SEQ ID NO: 8702 - DNA, 1053 bp, Zea mays
acgcggggaaaaggcaactatatggtttcttagcaaacaaagaggatatggagacatttaacaagcattgccatggtaaaagacgtccgctgcctgagatgaggtcttacaatgagatggtggtgattcaaatgaaacagatgagtgaagacaaccaacaactgaattacctgaagaacaagatggttaagacagagcagcgatctaaagcagtagaagaatcattgggtgttgttacccagaagctacgtgagactattgaagaaaatatatttgttaggagtaaagcaaaagagaagcacatggagtacgaggaagagatgaagtcccaggaggaaatttttcatggtctaattgaggatattcacaaggccccagaggataaagaaaagcagtttgagaagttgttgcaggaagagcgctcaaaggccagacgctttgatgttgattctggaactatgaaagatcgtcagctaaggaaggaatatgtgcagaagttcattgattgccaagtcaaggatgtggcagagtttgaagttgagcgagatgagctgatcaaagtccacgaggacaagaagttgaagctcaagaaagaatacatggatctggagctggagctggagaaggagtttgacgcagccctgacgggcctgatggagaagcataagccagataccttcgaggcctccagctcgtaagggggcttcagcggctaagcgctttccttaggccccagctaagcttggagcagtctcgtacatgctcctgcttgcttatccatgaaataatgcctggacagtctgtagatgttgcgaaaacatggtgcccctgtggttgccgcgtgtgtagtaagtatctctcagtcgtagtgtggttgaagcatctgaactcttgagcggtcaaactacaactggagtgtgatatctagtttatatggtccagcgctcttgttgactgcgggtggtggtttgccccggataatttactgattatgtctgctccgatcgtcaaaatgcctctttctgttttttaaaaaaaaaaaaaaaaaaaaaa

SEQ ID NO: 8703 - DNA, 1250 bp, Zea mays
gttttttttttttttttttggatcaacactagaatcacaaacaggataaatagattacacagcacccttcaccaggtatcaatgccgataagccaaacgcacacaaaattttcacacggagagatactacacactatctgcatttgactagatgcagaaacacaccaaagaatcgttggctaaaaacctgacaacctctagggcctcctgagtttaacatggagaggcatctccttgtaggtggtgactcgttccctggcctgccgcatcggccttccaagagatgatctgcgcaagaacgggtgcccaggcttctcgctgccggaagcactctctggatcgatcttgcagctgccgattgcgagctggacgtcctctatctcgaacaagtcctccgtgcggctgctcaactcgggtgttctcatggacttccgtctctgagaggcatccctatccttcgaaagcatcggtttcgaagatgccgtaggtcctagagatcgagatctcagcactcgtttcctgctggcgttcccggccctctggatgctcctcgcagacgatgcgtccgaagcgggctccgcatcgactacatctccatccctggtctgcacagctctgtcaggacccagatgctgcgtcctttgcacaggtgcgttgcgccgctgcatcgtcttcttcacatcctccagttcagacgcttttgctttaaggctggctcttgagcacgcaagctcatgttgcaacgctttcaacctttttcttccgaggttaacctccgccatcaactgggaatgggcccgcccaagttcccagttggcaaggcgcagcttctgaatctcagcccggctcagctctatgatctcgtctctcgccgcgaggagcctcacgagttccgctttctcctcgactagctgcgcaaacccctcaaggccgcccgcgtccgccggtgccggcgcctccgggcacgccggctcgcccggcacgtcgaccggctcgcgcttgctcaggttggtgatgtcgcagagcgtcttcctcctcgtgaccctggacttgggggtcgccgtcacgtctgatgcaagcgtcttcttggccagcgcggccgctgggggcgtgacggcctgttggggcgcgaggacgggcgcgtccacctccatgggctgttcgtcaatcacggcgatgggagggcgcgccaagcgatgagaaagtcggatagaggaagtgagatccagagagagtaggggaactttggt

SEQ ID NO: 8704 - DNA, 1036 bp, Zea mays
gagacaatttaatttggttggcccgatcctttttggattggtcatctctgtcaagcacggcctaagtcctaaacagacacgggccggacttagccgtcgacctcaggctggaccggcccccccccccccccccccactcagaacggaaaccagcaaacgacatctctccccggcggcccggtcccttcatctctcgccgctgtcgtcgccgccgcgccgtatctgcagcttcccgcaccgtatcctgcggaagaagtttctaacgggctacatcccaccaccgcacgatgtcggcagcggcgcgagtgctgccgaaggcggtgaccttcgtgacgggcaacgccaagaagctggaggaggtccgcgccatcctcgggtcttccgtcccattccagtcgctcaagctcgacctgcctgaactgcaaggggagccagagtacatatccaaagagaaagcacgaatcgctgcatctcaggtgaatgggcctgtactggtggaggacacctgcctatgttttaatgcgctcaaaggcctaccaggaccctacataaagtggtttcttgagaagattgggcatgaaggtttaaataatctgttaaaagcttatgaagataaatcagcgtttgctatgtgcatcttctctcttgctcttggacctggagaggaaccaatcacatttgttggcaaaactgcgggaaagatcgtgcctgctagaggccctaattattttgggtgggatcctgtgttccagccagatggttttgaacaaacatatgctgagatgcccaagtcagtgaagaacaacatatctcacagagggaaagctcttgctctggtgaaagaacacttcgcatctgctagctatacagttcagagcaacgactcaacttaaagtttgacttggattcctagacgaatgaactgtcattctggaatgtaaactgaactactacttttagtccggtgcctattatacttgcgagttgcgacataaaaaaaaaggatcaaaacgacaatcacaaacagggtaaaaaa

SEQ ID NO: 8705 - DNA, 1709 bp, Zea mays
caaacccacttgccttgtgtttcaggtcagattcgcctaacagaccccgacgacttccaaactccaatccagcgttgagctcgacagctcgtgccaaactaggccgcagctggaaataccctccgctccacttacctgctgctggtgagcaccgcaagcaccaactcgcgcccaccgctccgctacaccagccgacgccatcatgtctaccgtcgccgccgcccccaccgtcgtgaaatcggctccggagctcgtcgcgccagtggggccaacacccggcggcaccctcccactgtcctccatcgacaagaccgcggcggtgcgtgtgtcggtggatttcatccaggtttttcccccggccgtaggagcaggcggggacaaagacgccgccgtggccgcgatgcgcgacggcttcgcgaaggcactggtgccgtactacccggtggccggccgcatcgcggacgccagccccggggagcccgtggtggagtgcaccgggcagggcgtctggttcgtggaggccgctgcgagctgcgcgctcgccgacgtcaactacctcgagcgccctctgctcatccccaaggaggagctcctcccgcgacctccccccgaggagaagctcgaggacctcgtcctcatggcacaggtgaccaagttcgcctgcggcgggttcgcggtcgggatctgcttcagccacctggtgttcgacgggcagggcgcggcgcagttcctcaaggcggccggcgagatggcgcgggggctgccggcgccgtcggttgcgccggtctgggaccgcgacgcgatcccggacccgcctaagctgccgcgcggccccccgccgtcgttcacggcgttcagcttcgtgacccaggtggtcgagatctcgccggagagcatcgcgcgcatcaaggacgacttcaaggacgcgacggggcagacctgctccaccttcgacgctgtcacggcggtggtgttcaagtgccgcgcgctggcgatggcgctccccgacgacgccgaggtccggctcggcttcgccgccagcacgcggcacctcctccacggcgtgctgccgtcggtggacggctactacggcaattgcgtgtaccccgtgggcatcacccggaccagcaaggcgatccgtgaggcgtcgcttccggaggtggtcggcgtgatgcgggaggccaaggaggcgctcaccacgcggttcacggactggatgcgcggcggcgccaaggacgaccactacaacgtgccgctggactacggcacggtgacggtgtcggactggagccgcgtcgggttcaacgaggtggactacggcttcggcgaaccggggtacgtcttcacgctcaacgacgacgtcaacatcgtcgcgtcggtgatctacctcaaaccgcccgcgcccaagcgcggcatccggctcatgcttcgctgcgtcgaggaacctcatgctgcggcgttcgccgaggagctcgccaaattcgcgtagatggttgtttagtcttgctttatctatacttcattggtgtcggacactcggacctcatcttttacaatattatctatacttcattggtgtcagacgctcattaattgtcatcggcattgttggatgtgggagaatgaaaaagctattataagaacatttctggtatgcctaaaagtacacatattaaatcatgaccatttatctaaaaaaaaaaaaaaaa

SEQ ID NO: 8706 - DNA, 1534 bp, Zea mays
gacaggtggccagccgaaaccgggaggcaggagcgcgaggcagaggggcagcgtcatcacccgggcgcgcgccaacgacaacgaggccgaggccggaaataacacgccgggcgggcgggtcactgctgctgcctttgccgctgcgcgtccgcggaaggggacgcgtccccgtccgtcttcccacttttccccgataaaaccacgggcgcctcccgccggttccgcgctcgcccaccctccccgcggatcacagacagcctgtgcccgccttccagtccacaatctccctgcctctcctctcccaccctccctccgaaaagcaagctccggcccggaccgccccaccgcgcgcgcgcatacacagagagagagagagagaccgcacggtcgttcggggttcctttggccaggcgcacgacacgagcatggcgcagcgcgacaagaaggaggagcccacggagctgcgggcgccggagatcgcgctctgcgccaacaactgcggcttcccgggcaacccggccacgcagaacctgtgccagagctgcttctcggcgtcgaggtcgtcgtcgtcgtcttcgcagccgtcccctacctcctctccctcagcttccgcgccggccgccgcggtgccgcagccgaggccggcgctcctggacgcggcgctgcagctggcgcctccggccgcggccgcgggccagcctgtggaggcctcggccaggacttctgccaaccggtgctccagctgccggaagcgcgtggggctgacggggttccggtgccgctgcggcgacctgttctgcggcgcgcaccggtactcggaccgccacggctgccgctacgactacaggggcgccgcccgggacgccatcgcccgggagaacccggtggtgcgcgcggccaagatcgttaggttctgattcgaccggcgggcggaggaaggaattgcagagagggaaaacgaagattccaagggcggaaggggggaaaggcatgcgaaatcagagaggtcttcggtgttactactatgctgttcttggacgtgtttgatttttaatctccttttatatatatatatatatataattttcctacggaggtgggaggagaggaggtggacgaagaatagtgtaatgataatggtggtggtgcagcggcggtggttgagggcccaaaacgatgaacacatggggttgggttgggtgtatgtatctatctgtcacacgcagcttttgtgcaagactattatactacatcgctggtccctccaatttgctcgatcgttcaggctcctaatcatatctgccgaccccccgtatttcctccgcttaaactttttgctcgcggagaatgagaagcactgaagcaatcaagtcctctttttttttcccgtctggcccacatgccaatctccataatggaaccgtcgcattatcgcgccgcggtcggcacaatagtcatctcccgggccggctggccagcgtgccacggcgtcgccgaattttttttgcaaaaaaaaaaaaaaaaacccgcggcc

SEQ ID NO: 8707 - DNA, 1138 bp, Zea mays
  misc_feature (12)..(12): n is a, c, g, or t
  misc_feature (18)..(18): n is a, c, g, or t
  misc_feature (939)..(939): n is a, c, g, or t
  misc_feature (964)..(964): n is a, c, g, or t
gcgcgtccgcgnaagggnacgcgtccccgtccgtcttcccacttttccccgataaaaccacgggcgcctctcgtccattccccgcccgcccgcgccccgcccgcctccccgcggatcacagacagcctgtgcccgccttccagtccacaatctccctgcctctcctctcccaccctccgaaaagcaagctccggccggaccgccccaccgcgcgcgcgcatacacacacacagagagagagaccgcacggtcgttcggggttcctttggccaggcgcacgacacgagcatggcgcagcgcgacaagaaggaggagcccacggagctgcgggcgccggagatcgcgctctgcgccaacaactgcggcttcccgggcaacccggccacgcagaacctgtgccagagctgcttctcggcgtcgaggtcgtcgtcgtcgtcttcgcagccgtcccctacctcctctccctcagcttccgcgccggccgccgcggtgccgcagccgaggccggcgctcctggacgcggcgctgcagctggcgcctccggccgcggccgcgggccagcctgtggaggcctcggccaggacttctgccaaccggtgctccagctgccggaagcgcgtggggctgacggggttccggtgccgctgcggcgacctgttctgcggcgcgcaccggtactcggaccgccacggctgccgctacgactacaggggcgccgcccgggacgccatcgcccgggagaacccggtggtgcgcgcggccaagatcgttaggttctgattcgaccggcgggcggaggaaggaattgcagagagggaaaccgtaagattccaagggcggaaggggggaaaggcatgcgaaatcagagaggtcttcagtgttactactatgatgttcttggacgtgtttgatttttaatctccttttatatatatatantatatataattttcctacggaggtnggagggggagaaaagggtgaacaaaaaaatagtgtaacgatgataatgggtggggtgggttgagggccccgaaacgatgaacacatggggttgggttgggggggaatgatttctgtcacacgcagcttttgtgccagactattatactacatcgctggtccctccaatttgctc

SEQ ID NO: 8708 - DNA, 916 bp, Zea mays
agctcgcccaccctccccgcggatcacagacagcctgtgcccgccttccagtccacaatctccctgcctctcctctcccaccctccgaaaagcaagctccggccggaccgccccaccgcgcgcgcgcatacacacacacgagcatggcgcagcgcgacaagaaggaggagcccacggagctgcttctcggcgtcgaggtcgtcgtcgtcgtcttcgcagccgtcccctacctcctctccctcagcttccgcgccggccgccgcggtgccgcagccgaggccggcgctcctggacgcggcgctgcagctggcgcctccggccgcggccgcgggccagcctgtggaggcctcggccaggacttctgccaaccggtgctccagctgccggaagcgcgtggggctgacggggttccggtgccgctgcggcgacctgttctgcggcgcgcaccggtactcggaccgccacggctgccgctacgactacaggggcgccgcccgggacgccatcgcccgggagaacccggtggtgcgcgcggccaagatcgttaggttctgattcgaccggcgggcggaggaaggaattgcagagaggaaaccgaagattccaagggcggaaggggggaaaggcatgcgaaatcagagaggtcttcagtgttactactatgatgttcttggacgtgtttgatttttaatctccttttatatatatatatatatataattttcctacggaggtgggaggaggagaggtggacgaagaatagtgtaacgatgataatggtggtggttgagggcccgaaacgatgaacacatggggttgggttgggtgtatgtatctgtcacacgcagcttttgtgcaagactattatactacatcgctggtccctccaatttgctcaggggggaaaccggtaccc

SEQ ID NO: 8709 - DNA, 3283 bp, Zea mays
  misc_feature (1999)..(1999): n is a, c, g, or t
caaagttttttgcttgcacacagctacaatattctcttctcctaaaatattacgtctctaaacatgtgtcgggttggactaatgtaaaatataacattattatattaatgacattacattaaaccgtggtgttataaactatggttttaagaaacaaagtttctaaacaaggcgctaacagggtgtgcaaggaggaggaggtgcacccgtgtctccgcccttatcattattcactgattcagaaagatgagacttcagctggtgaagcagacgctacggaacggggcgattcgtccgagcaccagtgcatgtgcgtctccagtacgcttattggcacaccatacgtggttttgcatggattactgcatcttgtcagccgaaactcagtcttcttcggtgacgatcggagctctcgcgagttcttgcgcgcctgtccgccgccggttggccgccttgtcaacgtcgatccgatggaagaacgtaacgaagcccgcttgcttgttcgtatttttgcggtcaagagaatcggcacaggcgtggctgggaggtgtccgtcgtggcgtcatgcacggcagccaaaaaagaaaatggcgcgggccacgagttccccatgccgtgtcggtggcctgtttggttcactacttcagttgccacactttgcctaacttttctgcctaaggttagttattcaattcgaacgactaaccttaggcaaggtgtggcacatttagccacaaaccaaacaggcctttagtctggctctggcctggcctggcctgagaagagttcgttcactcgatttattagtattctccctacttatcatctttcaactacttggtgctatagcatcagtctgtctgtggggaaattcagaaaacagcattcatctcacgcacgattcagaaaacaacactgaaaaaatgggtattcacaaaatagcactggttttgccaagggaatttataaaatgacactatgtttaacactagttccttcttcacacacaattataccaaatttctgatgatgtttctacggcatcattttttcccaactgatgatgcagccctttctttctcagatagaacaaagaggcgtttgattgggtagtggcaatagatggtcctgtaacattacatactcttggtcttcctttaacaaaaaaatccttcttcggagaatacttcctaaaaaaatattatcagcgggtagtgtatttggcctggcaaacgaatgattttttttgaagagatgataaaggatgaggcatgcgtttttctgactgctctcgctgcctgcagtgctatttcgtgaatactcggattcgcagtgttgtttactgaatcacctcacagaccagtgctattttatgaattctcccgtctgtctgtcagggagtggtatgcagacaagcgagggttgaaaatttagggcgagggatggaaagaaagaaagaaagaaagaaagaaaaaaggaatggccatgctaatccagacagctcagcgtccgaaagcgacaccattcgcggcgagcgtggctttagtttttacggattggttgacggggaggaaggatcaagctgtgagcgttcgtgctgtagacgggtgacgtgggcgacggtttccaagcacaaacccctgcggccgggcatcctacgccaatcccggctggagtcggcgccggcgattggttttcagcggtttcgcgcgtcggcctcggtcagcccgggcggctacttgccccggtcggcaggtcccaatccaaacccaccccactgccgggacggaacaaccagcacaggaccccgtccgtgcgaccgcgtcctatagcgcaccagacggcgggaccatcctaccccctcggcatccagtctctggatccagctctcaccgctccgaacgcgcgtggcccgcagcgcgccatgttgttcacgttccttttcgccgtttccgcgagccgagcggcccaggccgcgacaggtgtccggccgaaacanggaggcaggagcgcggggcggggggcagcgtcgtcaaactgggcgcgccaccgaggcccggggccggaaataacacgcgggcggggcgggtggggtcgctgttgcctttgccgccgcgcttgtgcactgcacgtccgcggaaggggacttgccatttcttccccgataaaaagcccgggcgcctcccgtccattcctcgcccgctcgctccgcgctccctccccccctcccgcgcggatcacagacaggctcacggtcacggccggcctcccaattcgcaacctcgcctccgcctctcctcctacccctccgaaaaagcaagctccggccgggccgccaccaccaccaccgcgcgcgcgtgcacgcgctcccacacacagacagacagacagacagacagagtgagagacgcacggtggttcggggtctcccttctgccaggcgcacgaggagccatggcgcagcgcgacaagaaggaggagcccacggagctccgggcgccggagatcacgctgtgcgccaacaactgcgggttcccgggtaacccggccacgcagaacctgtgccagagctgcttctcggcgtcgaggtcgccgtcgtcccctacctcctcctcctcttccctggcgtccgcggcgtcgcagccgaggccagcagcgctcgtcgtagacgcggcagcggtggaggcgctggccgctccggctgccgcggctgcgggccaggctacggaagccgcggcgagggcgtccgcgagccggtgctccagctgccggaagcgcgtggggctgacggggttccggtgccgctgcggcgagctcttctgcggcgcgcaccggtactcggaccggcacggctgcagctacgactacaggggcgccgcccgggacgccatcgcccgggagaacccggtggtgcgcgcggccaaggtcgttaggttctgatgacgggaaggaaggaaggacacagcacaaaggctcgcagggcggagaaggggaggaggaaggcgtgcggacaaggtcttcggtgttattattattacgctgttcctttgattttaatctcctttttttttaaaaaaatatttgtcctatgggaatgggattgggagaagaggtggacgaagaatagtggagtaataataatggtggtggtgcagtggcggtggttgagggcccgaaacgatgaacagatgggttggattgggttgggtgtatgtatgtgtcacacgcaactttggacagaactattatactagtactaaaaaaaaaaaaaaaaaaaccttag

SEQ ID NO: 8710 - DNA, 1759 bp, Zea mays
  misc_feature (1662)..(1662): n is a, c, g, or t
ataaacagtagttaggtaaccaaaggcttctcggaagattaaaatgcaatttttcaaacaagtggatttaggaaaggagcaaatcatggatgaagtcctttggccactgaatttcaacacaccaaaaacaggactttggacttgtatgctgatggcaactcaatatacaagcatgtgactttgcacaactgaacagtctccattttcctcatttgtttgaagactcatacaagcctttaaattaccttatctgataatttggcttttattagcattgacagtgctgccaaattatatttgtagctatattgccagtggatgcttgagtaaaaaaaaatctcaatcaattttaggatcattgagattgaattgcaagcaggtaggttgtaagcaagcaaaacacatggctagatcatgacctgagctatcatgtgcacgacaggaaggtgaattggtcaggattctcagtcctcgttggtgccattgagcttctgttgtacaagggctaccagcctagaatgcactgcaggaaaacaagaaaacatatatgaacctaaaggaaaaatgtgaataaagatttattacaatgccaaaggacagaaacagaacataagttcaaataagcaccatgtttgtagttcggttatggaccttactcctgacgaacaaggttgtaaaaagcatctgacactaggagcttagagatcatgaccaaacacctatgtcatgcatagatactatgctaaatttctcatggtgccgactggcttacatattgaagttcatataatacaagcggccacaacagaaaatattcatacactatagtggttatggtattagtggcttagtgcggcagaaaagtaaattaaagatttatttgttcaacggcccacagggatacacagaaaagtatgcatacatcagcaatagcatgaaccagatcacacctcacactagtagctgcagtcctagaacctcaagcagagagccaatggcttccatattcttgtcctcgagaagggaacaaggaatgaccgtgagcatcacgccacggcaagtattggaagaagagcagcacagacaagaggaaggaggacaagcctgaggtggactttctcttcccccagcaaagtacagcaataaattcatcgcatggacataagattgcgcctttgggtggccctcctggaggcctgggcagccctcgatgttcgcttcaggtttttcctcaccaacttctctaccttctctattgaaccggaaagtttcttgtcagcaagggcaggatccattggtttggatggagtattcaatgagccttctgctgccaaagaagacacattcaaattgtcatcagccaaaacagtagcagggtttgctacagcttctctttcagttgagccggagccagatgcaacagcatgggaggcttcagcaatgtgagcatcctgctctgcttgtgctggagtagtcacgttcacagattgtgaagactgctcgatcctttggcttcgctgctgagctgcagcaatccttgaacgacttctctgaatagcctgcatggaagccagtcagaatagggtggaagctagcaagggaacaaatatacactgagggctagtttgggaggcggttttgtggctgccaaactagccctgnatgtgtagttcagcttttgtagaactactgaaagagagcaggcaagccattcagactagggtggaagctagcaagggaacaaatatacactgaatgt

SEQ ID NO: 8711 - DNA, 1412 bp, Zea mays
gcggcagaaaagtaaattaaagattttatttgttcaacggcccacagggatacacagaaaagtatgcatacatcagcaatagcatgaaccagatcacacctcacactagtagctgcagtcctagaacctcaagcagagagccaatggcttccatattcttgtcctcgagaagggaacaaggaatggccgtgagcatcacgccacggcaagtattggaagaagagcagcacagacaagaggaaggaggacaagcctgaagtggactttctcttcccccagcaaagtacagcaataaattcatcgcatggacataagattgcgcctttgggtggccctcctggaggcctgggcagccctcgatgttcgcttcaggtttttcctcaccaacttctctaccttctctattgaaccggaaagtttcttgtcagcaagggcaggatccattggtttggatggagtattcaatgagccttctgctggcaaagaagacacattcaaattgtcatcagccaaaacagtagcagggtttgctacagcttctctttcagttgagccggagccagatgcaacagcatgggaggcttcagcaatgtgagcatcctgctctgcttgtgctggagtagtcacgttcacagattgtgaagactgctcgatcctttggcttcgctgctgagctgcagcaatccttgaacgacttctctgaatagcctttgcaatggccgtaatatcacggagcggcgtcctggggtaccatccaggaagcgggctcctctttgtcggtgtgaccctcaacgcccaaaccggcagcaggttctccttgttcctcgagggtgaaatataacgccgcgccaacggcttcctgacacccctcaccgctagggctcccggcgaggccaccctcctgataaagaaccctccaccaccaacaccaccagaaaggtcagctaggtcctcactcctgccgtccctggactcaggcatctcggggctcagattgggaggggagcagccactagagtggagcagggcgccgcaggtagaaaaggatagcagctgtaggaatcgagcaaggccggggcgccaccggatcgggatggtagccgccgccgccgcagtcgaacagggcgccgctggatcggagaggggagcagcttctggtgtcaggcaagcctgggtttgcaacggtagttggacggagcccagggcggcgcgaatgcggcgacggcgacgtcactttctatgctgcagttgcaggagcgaatcgtagccgcgcaaatggttcccggaggatttggaatggagggaggagcagaggattttgaggggagagggaggcgattttgggaggaggcgggtgacttgaacgttttcacttcccgcccctcctgcaatccaaactttcggagttttgg

SEQ ID NO: 8712 - DNA, 1132 bp, Zea mays
ctgttctctctgctccaaggaacaggacgtgcaacagaactgctccagctgtggggcctgcatgggcaagtacttctgtaaagtatgcaagttcttcgatgatgatgtaagcgtactcgaatcccagacgatgaacaaagaaactgaactcgatgcgttgtttactgcgtttcttttttcccccttcttcttcacgtacatactgtactgctcttggtccaggtctcaaagggccagtaccactgtgacggatgtggaatatgtagaaccggcggcgtggagaactttttccactgtgataaatgtgggtgttgctacagcaatgtcttgaaggattcccaccactgcgtcgaaagagcaatgcatcacaactgccccgtctgctttgagtatctgttcgactccacgaaggacatcagcgtgctgcaatgtgggcataccatccatttggagtgcatgaacgagatgagagcacaccatcacttctcatgcccagtgtgctcgaggtccgcctgcgacatgtcggccacatggcggaagctcgacgaggaggtcgcggccacgccgatgcctgacatctaccagaagcacatggtgtggatcctgtgcaacgactgcagcgcgacctcgagcgtgcggttccacgtgctggggcacaagtgccccgcgtgcagctcgtacaacacccgggagacgagggctgcgtgccccaggatctgaggcgaaccagaggccatgtcacaaaatgccagggagatgccgtccaacgatcatctgtctgcaggacgttgctgcgcttaaggttaaaggctagcgcgagaccaggcctggtagtccagtcttgagtttggtgctggagcatttgtaatgttccggtaaaatgtaatgcgtccatgagtgctgtccaggcagtaagcacacctgtggatcggggccggcgcaaggtccctaggcaagctgcaggattagtggggctattcatgtttagggcgcgaatgcaacgaaattacccgtgggccgtgggctcggtatgtaacagaaccgattatttctattacaataataacatgcagttctattgggccgagcctaatcaggcaccaaaaaaaaaaaaaaaaaaaaacccgcggcc

SEQ ID NO: 8713 - DNA, 1022 bp, Zea mays
  misc_feature (30)..(30): n is a, c, g, or t
  misc_feature (76)..(76): n is a, c, g, or t
cccggttcgacccagcgttctttcgctggnagtcgacccgcgcgaccggcacgaggagcgcccgccacgaaaaaanaagtgatctgttctctctgctccaaggaacaggacgtgcaacagaactgctccagctgtggggcctgcatgggcaagtacttctgtaaagtatgcaagttcttcgatgatgatgtctcaaagggccagtaccactgtgacggatgtggaatatgtagaaccggcggcgtggagaactttttccactgtgataaatgtgggtgttgctacagcaatgtcttgaaggattcccaccactgcgtcgaaagagcaatgcatcacaactgccccgtctgcttcgagtatctgttcgactccacaaaggacatcagtgtgctgcaatgtgggcataccatccatttggagtgcatgaacgagatgagagcacaccatcacttctcatgcccagtgtgctcgaggtccgcctgcgacatgtcggccacgtggcggaaactcgacgaggaggtcgcggccacgccgatgcctgacatctaccagaagcacatggtgtggatcctgtgcaacgactgcagcgcgacctcgagcgtgcggttccacgtgctggggcacaagtgccccgcgtgcagttcgtacaacacccgggagacgagggttgcgtgccccaggatctgaggcgaacgagaggccatgtcacaaaatgccagggagatgccgtccaacgactggtggagatcatctgtctgcaggacgttgctgcgcttaaggttaaaggctagcgcgagaccaagcctggtagtccagtcttgagtctggtgctgtccaggcacacctgtggatcggggccggctcaggattagtggggctgttcatgtttagggcgcgaatgcaacgatatttcacgtgggccgtgggctcggtatgtaactgaaccgattatttctattgcaataataacatgcagttctattgggccgagcctaatcagccaaaaaaaaaaaaaaaaaaaa

SEQ ID NO: 8714 - DNA, 1458 bp, Zea mays
  misc_feature (1388)..(1388): n is a, c, g, or t
  misc_feature (1411)..(1414): n is a, c, g, or t
  misc_feature (1417)..(1417): n is a, c, g, or t
  misc_feature (1420)..(1422): n is a, c, g, or t
  misc_feature (1425)..(1426): n is a, c, g, or t
  misc_feature (1428)..(1430): n is a, c, g, or t
  misc_feature (1436)..(1436): n is a, c, g, or t
  misc_feature (1438)..(1439): n is a, c, g, or t
  misc_feature (1444)..(1444): n is a, c, g, or t
gggtacctcgaggccgaggaagccaatcgccagccagccaggaagcgctcctgcacctgtcctgcatacgcccaacggcctaatatttgcgtagccgctacaacctacatgattctcgatccgtcacccatccgttccggatcttgattcttgccaaggcgtgcaagattcctgcttcgccgaggttaaattttagccgccggccgagcttctgcggagaaccggcaggtttgcttggtgcccccgatttgcctgctactcgtggcgcgccgctcctaggcgaagggaaggatccgactcaacatggccgccgccgcttctaccatgtccctgctcccgatctcccagcccaggaagcagcagcagcaaggcgcgggcgccgtggtcgtgttccagcggcggccctgggacgcgcggcggaggcgatacgtcgtcccgacggcgaggctgttcgggccagcgatcttcgaggcgtccaagctgaaggtgctgttcctgggcgtggacgaggggagcagcaagcatctgcatgcgcaccacccggcgccggcgccggcgctgctgccgcggacgtacacgctgacgcacagcgacgtgacggccagcctgacgctcgccgtctcccacaccatcaaccgcgcgcagctgcagggctggtacaaccgcctgcagcgcgacgaggtggtggccgagtggaagaaggtgcgcggccggatgtcgctgcacgtgcactgccacatctccggcggacacttgctcctggacctcatcgccggcctccgctactacatcttccgcaaggagctccccgtggtgctcgaggcgttcgtgcacggcgacggcgacctgttcagccgtcacccggagctggaggaagccacggtgtgggtctacttccactccaacctggcccgcttcaaccgcgtcgagtgctggggtccgctccgcgacgccgccgcccccccgcccgccgaggacgactccaccgcgccggccgccgcctccatcgccatggagggccagatgcccgtgggcgagtggccgcaccggtgtccccagcagtgcgactgctgcttcccgccgcacagcctcataccctggccgaacgagcaagacatggccgccgccgccggccaggtccgacagcagtagtgaagctgcacggaggaggggcctttgcctcataccctggccaaacgtcctagatacactactagcgcgttgtttggtttgctattgctattgctagatgcaagcgtgtgcgtgcagtgcaggtgtggagtggcgtcaacaccttgcatgcacgggctattctttaattggtagcttagctcagctcagttcagttccacttgtacaccttcgtatttggaagcagcttggttgangttgggggatgaaaaaaaaaaannnnaantannnaannannnaaaggngnnatttnaaaaaaaaaaaaaa

SEQ ID NO: 8715 - DNA, 3923 bp, Zea mays
gagttggttagataactctagtagcacttctcaggtcctgtgttcgactcctagtggaagcgaattttaggttgtggttagaaaaggtaactcgctggttcccctagttgtgtgcacacgagacagactgatctatagactatagggggtggatcctcgtgtagggcctaggaggctcaaaccacgggtacagatctgatctatagggggcggaccctcatgctgcactgggggtggggggggggttgtgacctttcttggccggttcgagcttcttcttaatacaatattgtgggggcagtctttccccaccaaccgcatttttgaggatggaatatatccaaacacttgaatgggagtgcgtggaaacagctatccatgacttgtggtttctgttgggtctcaactcgagcctactccgacttacttgggactaaaaggttttgttgttgttgtatgattttttctatcctgttttgacatacaagacatctaatcctgcaccccctcgtttaaacttgctctatctacgacctccgcgagttaattttacatttccttttattaacttgtctagtaatgtatttcatctccattcctagacaaatatgccttatgaacagaaatggagggagcacttactgaaaaattaaaaaaaaacatgccaaaatttgggagtttgtgaaacctcgttattttaaaaacgctgctcaactggatcagcagaaacccaaaacacgccaaaagctaaatgcatttcctctcataggtcaacagttgtccaaaaaatatcagcattggatttgccaagcgtcatctgaaatgtgactgatcaatgtgtcatactagcagtgatatgtgtccctaggcttcacatggaatcctaatgtttgatgatattctttttaatttatgcctcttgggtactatggtagttttttcttctattattattgggcctccctagtgttattttgtaaagctgcttgtttttcctaagccacatctttgggccaatcaatcgaaatcagtagcatctgtgcatctatctcagatagactgaaagccaagaaaagcgcattatttacctgttcggcacttcggctgcactaaaatggctgccggcagcagctgcacctgctgttcggctagcttattgctagaagcattagctgcagcatagccactgaaacaagcaggcgaactactcaatatgtttaaaaaagtaaatgtaacttacatcaagaaaaatctgtttaatttagtttattgaggcttagccttttgttattagatacctatcatatttaattgcctcaagtcgacagactgaccaattcatattatatacagctatgatttgaacagctctgaagaggacaggaatactatcaagataaagaaaaggtatcactttcttaactccattctttgtccatcagcttttgctttcttgatttagttgaatgtacagtttatattggtgatgatttatcctattctagaacccagagaacaagagtaaataaattgatataacagctgtgtgcaccttttctatcaaacatgttgttctttcctgttatctgaagaaaatgccacaataacactggtattgttcacaatgatactttgtttattggtagaatgaattgcctcaacttctggtgcaggaaagaatatgaaaaattgaggcgacagtgccaccgcatcctgcattgtaatagagaaaatggtctgaatgttataaatgagttcatgaacgaggacttttctgatggggctgaaggttcagagtcaccatattcaaatggtgttagtaagagggtttgtgtgatgcccaaagaattgaaatctttaggcagtaaggcagaagaatcagagagttctaactgggatgctgtgaaatgcatagatgaagacataacctctgttgatccatgtttggtagaatcagaatcttctgaatctgagtcttcctatgaagaggaccctgatagaacacctgtctctaccaatatggaagagaactgtggtcccaaaccaaaatttgcccggaccgcttcatctaagtcggagattattatttcagacagaactcctgaggattttgccacatggcagcgcattatacgtgtagatgctattcgagcaaatacagaatgggttctgtttgcccgtaaccaggctgaagtctctaaagagaaagcgctgcagtctgcaatatctgtcgggttgaaagattttgaccatttagagccttacatgatctatcatgctgcacgattagttgcactgcttgaggcatatgcactttatgatccagagatcgggtactgtcaaggaatgagtgatctcttgtcaccaataattgcagtcatggaggaagatcatgaagcgttctggtgctttgtgggtttcatgaggaaagccagacacaacttcaggcttgacgaggttgggataaaaagacagctgaaaaccgtctcgcagatcatcaagcgcaaggattcacacctctacaggcacctgcagaaacttcaggcggaagactgcttctttctgtaccgaatggtggtggttctcttcaggagggagctcacttttgagcagactatgtgtctgtgggaggtcatgtgggctgaccaggccgcgatacgagctgggattggaaggtccacttgggcaaggataaggcttcatgccccgccaaccgacgacttgctgctctacgccatcgcagcctgcgtcttgcagaagaggaagctgataatcgagaagtacagcagcatggatgagatactgcgggagtgtaatagcatggccgggcagctagatgtctggaagctcctagatgatgcccaccacttggttgttgaccttcatgacaaaatctgatgcgactgccttcctcagctatgtttttgggtagagtatgcagacatgaacacattttccgaggtgtatttagtaagctgttgtgtactgttcatcacccggaataaaaaaaaactttcatgggagtacatgtagagaaccttgtagcttcaagtgaggacgaagttgtcttccactttggttaagctgataaaccattggatagcgcaatggtttattcaagccatccatagttaaaacttcatggaaaattttgttcttgcttctaatgtctgtccttggcagaaacaacattttccatgaagttttttacaggaaagttaagttcccagattttgggtgtaatgtgtagtaataatgaaatcacagcagtttctttcatcatgtgtagtaatgtactccctctgttttattttagttgtagctggatagtgcaaaattgaactatcaagcgacaactaaaaagaaacggagggagtacatacccgtgtgtggttgtgtgtgtagtgtgtacacacggcgacgctattcatcatacaggtgtctgaaccagctccatctaattaaatcctaccgaaccatcccttaagccattctaagatggatgttcatcacctaaagtttctgctatattctgcagaatttgtttgagcatggtaagggtatatgcttgcagaaattatgcgaagcacaaaagcatggtaacatgctacaatctacaatcgtgcgaagcataagagcatatgcttgctgaaattatatatttctggacaacatggctctgtcacatgcgagccggctgaatcatgctatagctgcactactatttgatatatccatcccgagaatgttgcaattctaactctattattagtcaaatattttgaggtttaagtaatattatagaagatactattaatactattaggtgtgcgatgaacgtatacttattttggtggcttggtggctatgaaaacatctaattttgttgtgagtttgaggatggcaggacggacgtttcaaag

SEQ ID NO: 8716 - DNA, 2443 bp, Zea mays
cattgggtacctcgaggccggccgggacaactcttttaacccccttcctctccccggccggcccggagaatcccccgtcgacgcgcacgcgcagagctccgcatccgcaccggccgccggcggcgtggatggggaagctctccgccctgaagcgggaagcggtcggagtggactaggcgctcggtgacttcctagtttagaagcggtaggtggaggcgatgcggggcggggcgatgaaggccctgcggcgatccagcacctcctcggcgccatcgccaagggtgccgtcttccccgcggtcttattcgtggatccaccgccggtcgcttctcgttacctcgccggcctcgccggcgacgtcctctgtgtctgaatcggcgaatttgcccgcggagggttcggattcagcgccagcgtcagtggtggcagcttcctcgtcgccctcgctggctgcttcgtctccgaacatggaatgtacatttcattctaggggtggaattaaatctccgtggtctcgaagaaaaaggaaacgggcgcttacttgtcaacactggaatcgtctattttcagcaaatgggaagcttcgtgatgggggaaggaagtttctaaagaaggttcgcagtggggggattgaaccgggcataagggctgaagtttggccatttctgcttggagtctatgatttgaacagctctgaagaggacaggaatactatcaggataaagaaaaggaaagaatatgaaaaattgaggcgacagtgccaccacatcctgcattgtaatagagaaaatggtctgaatgttataaatgagttcatgaacgaggacttttctgatggggctgaaggttcagagtcaccatattcaaatggtgttagtaagagggtttgtgtgatgcccaaagaattgaaatctttaggcagtaaggcagaagaatcagagagttctaactgggatgctgtgaaatgcatagatgaagacataacctctgttgatccatgtttggtagaatcagaatcttctgaatctgagtcttcctatgaagaggaccctgatagaacacctggctctaccaatatggaagagaactgtggtcccaaaccaaaatttgcccggaccgcttcatctaagtcggagattattatttcagacagaactcctgaggattttgccacatggcagcgcattatacgtgtagatgctattcgagcaaatacagaatgggttctgtttgcccgtaaccaggctgaagtctctaaagagaaagcgctgcagtctgcaatatctgtcgggttgaaagattttgaccatttagagccttacatgatctatcatgctgcacgattagttgcactgcttgaggcatatgcactttatgatccagagatcgggtactgtcaaggaatgagtgatctcttgtcaccaataattgcagtcatggaggaagatcatgaagcgttctggtgctttgtgggtttcatgaggaaagccagacacaacttcaggcttgacgaggttgggataaaaagacagctgaaaaccgtctcgcagatcatcaagcgcaaggattcacacctctacaggcacctgcagaaacttcaggcggaagactgcttctttctgtaccgaatggtggtggttctcttcaggagggagctcacttttgagcagactatgtgtctgtgggaggtcatgtgggctgaccaggccgcgatacgagctgggattggaaggtccacttgggcaaggataaggcttcatgccccgccaaccgacgacttgctgctctacgccatcgcagcctgcgtcttgcagaagaggaagctgataatcgagaagtacagcagcatggatgagatactgcgggagtgtaatagcatggccgggcagctagatgtctggaagctcctagatgatgcccaccacttggttgttgaccttcatgacaaaatctgatgcgactgccttcctcagctatgtttttgggtagagtatgcagacatgaacacattttccgaggtgtatttagtaagctgttgtgtactgttcatcacccggaataaaaaaaaactttcatgggagtacatgtagagaaccttgtagcttcaagtgaggacgaagttgtcttccactttggttaagctgataaaccattggatagcgcaatggtttattcaagccatccatagttaaaacttgatggaaaattttgttcttgctcctaatgtctgtccttggcaggaacaacattttccatgaagtcttttacaggaaagttaagttcccaaattttgggtgtaatgtgtagtaataatgaaatcacagcagtttctttcatcatgtgtagtaatataaatacgtgtgtggttgtgtgtgtagtgtgtacacacggcgacgctattcatcatacaggtgtctgcaggtcgactaagaggatacggggt

SEQ ID NO: 8717 - DNA, 859 bp, Zea mays
cattggggacctcgagccggccgggagatcccccgtcgacgcgcacgcgccgtcgcgcagagctccgcgtccgcatcggccaccgcccacccgcgccggccgccggcggcgtggatggggaagctcgccgccctgaagcgggaagcggtcggggtggactaggtgctcggcgaattcctagtttagactttagaagcagtaggtggaggtgatgcggggcggagcgatgaaggctctgcggcgatccagcacctcctcgccgccgtcttccccgcattttcattcgtggatccaccgccggtacctcctcgttacctcgtcggcgacgtcctctttgtctgcatcggcgaattcggccgcggagggttcggattcagcgtcagtggtggcagcttcctcgtcgccctcgttggatccttcgtctccgaacatggaccggggtgtaattaaatctccatggtctcgaagaaaaaggaaacgagcgctcacttgtcaacactggattcgtctattttcagcgaacgggaagtttcgtgatgggggaagaaagtttctaaagaaggttcgcagtgggggaattgagccaggcataagggctgaagtttggccatttctgcttggagtctatgatttgaacagctctgaggaggacaggaataccatcaagataaagaaaaggaaagaatatgaaaaattgaggcgacagtgccaccatgttctgcattgcaatagaggaaatggtctgaatgttataaatgagttcctggatgaggacttctctgatggggctgaaggttcagagtcaccatattccaatggtgctagtaagagggcttgtgtgatgcccagagaattgaaa

SEQ ID NO: 8718 - DNA, 1019 bp, Zea mays
  misc_feature (1005)..(1006): n is a, c, g, or t
  misc_feature (1013)..(1014): n is a, c, g, or t
gccggccgggccgggacccgataataagtagcaggggcaggccggccgggctccccgacgacgtacgccacccgtaagtgagccgagagccctcgagataccatcagctagctagataaccagccagcgccgccgccgtcacgcccatcgactacttccaccgcacctacgggcccacctactacatctgccgcttccaggagcctggtgtcgcagagaaggagttctcgccggccaacgccgggtacctgatgaagcggatcctgtgcaaccgcttcacctcctcggcggccggcgacgacaagcgaccgccggcggacgccgccgaggaggagccgctgccgccgtggctgacggaggaggacgcgcgccacttcgcgtcggagttcgagcggacgggcttcacggggcccatcaactactaccgcaacatggaccgcaactgggagctggcgccggcgtgggcggacgccaaggtgcgggtgcccaccaggttcatcgtcggcgacggcgacctcacctaccactacccgggcatccaggactacatccacaagggcgggttcgaggccgacgtcccggggctcgagagcgtcgtcgtcatccccggcgccggccacttcgtccagcaggagaaggccgacgaggtcagccagcacatctacgacttcatctccaagttctgatacatgtgcatggatcgaccattatcagcttgcttgcttacctgctaaagcctgtaatctcaacctcgatatccgtgctgccaacttgttttgtttttcgaactaagagtaataagtgttcgcatatatgtctggtttaatttgtgacttggacatggtatgttcgatgtgaaatggataaaccatgcgtttcgtaaaaaaaaaaaaaaaaaaaaaaaaaaaaaaaaaaaaaccagggggggggcgcggcccccccggggccctcttataagttctttatacaaagaagtccgggagagaaggaggagggcgggacggnncgagtgnnatggg

SEQ ID NO: 8719 - DNA, 1671 bp, Zea mays
ctcaaaaagcttacagattttttatgggccagacgcagattcaccctatctacagacttttatggaaaagcaaatgtcagcctaaacatagagtcttcttttggctgtggctcaagaataggctaaacaccagagatatgctgagaaggagaaacatggaactggattcctattcttgtgaaaactgtctatggcaaagagaggagactctctatcacctgtttctcagatgcaatttcgcgaaagcctgctggagctcaattggcataactccgcccagaatctccaaccctgaggtggcagctgcgaaccttaaccaccagcttaacgtccccttctctatggagattattattctcatgacttggagcatctggaaaagccgaaacgagtggttgttttcaagcaaagatccttcggtgcaccgttgtacgcaggaattcagcaaagagctgcgattgatcatgcagagagcacagaggaaatttgacacctctatcccgaattggctgagcctgtggcaggcataggagtagtgttcccttttcatttcttcttaacgtttgtaaaaagaccttgtcctaacgttttcgtttcgcttacctaataaatttctcagcaggggcatcccctactgattcttcaaaaaagtaataaagcgatcgagatctttactgcttattataactactaaagtgcctgcctgcaggagcctggtgtcgcagagaaggagttctcgccggccaacgccgggtacctgatgaagcggatcctgtgcaaccgcttcacctcctcggcggccggcgacgacaagcgaccgccggcggacgccgccgaggaggagccgctgccgccgtggctgacggaggaggacgtgggccacttcgcgtcggagttcgagcggacgggcttcacggggcccatcaactactaccgcaacatggaccgcaactgggagctggcggcgccgtgggcggacgccaaggtgcgggtgcccaccaggttcatcgtcggcgacggcgacctcacctaccactacccgggcatccaggactacatccacaagggcgggttcgaggccgacgtcccggggctcgagagcgtcgtcgtcatccccggcgccggccacttcgtccagcaggagaaggccgacgaggtcagccagcacatctacgacttcatctccaagttctgatacatgtgcatggatcgaccatcagcttgcttgcttacctgctaaagcctgtaatctcaacctcgatatccgtgctgccaacttgttttgtttttcgaactaagagtaataagtgttcgcatatatgtctggtttaatttgtgacttggacatggtatgttcgatgtgaaatggataaaccatgcgtttcgtaatttaaatgtacaatgcttgtaccggtgaccgtgtactgttgtcggacgatcaacagtggcatactggcatctatgttggaaactataccacctccagccccggccagaagcctaggcccgacgtgcctttcggttgagccagatcacgtacgagcgtctataaaaacaccctagacccctaggaattaaggtttcgaggcctcatagcggctgcaactgcgtgaggtgctagaggaggcgagcggcgaccggacgtcgatgacgacttcctgcaggcatgca

SEQ ID NO: 8720 - DNA, 1703 bp, Zea mays
gttttctgtaacctgcggaaaacgaccggtagacaaaattcgtaggaaaatggtagcaaaagtgtcatttgctcctgcaatgctgcttatacaagccaaaacgcaaataatggcgaatgccactgcatgtgctaattgctaaacaagtccagcttcaccgtatcatcgcgaatgacgaacccgagccgcgttcccgtccaggtacaccacagcatgggcgagcacacaggagcatcatcacctccagcccaatcatacccacctcgcctgtcgtgtcgaacatctcccgcacggaatgaccaaactggaccccgtcggtcagatactagtaccattctgctttcctcaccacggaagagtaaaacagtcatttcagagctggtaccagtggcgtgctattttaacgactggttccccgctcgtccgtcggcgagcgccacccacacgccacgcccgagagcgcccgcgaaaatgacgccgccggcgagcacatcaggcaaacgcgccgtcgcgatagacgagccgctgctgccggagtcctcggcgggtgggcggcacggcggcggggcgtcggtctcgggcgccgtgttcaacgtgtcgacgagcatcgtcggcgccggcatcatgtcgatcccggcagcgatgcgggtgctcggggtggtccccgcggcgctcctcatcgccgccgtcgccgcgctcgccgacgtctccgtggagttcatgctgcggtacacggggcgggggtggggcggcggcggcaaggacgaggcggccacgtcgtacgcggggaccatgggcgacgccttcggccgcgccggcgccgcattgctcaacgtcttcgtcgccctcaccaccacgggcacgctcgtcgtctacctcatcatcatcggtgagctagcggcttcgtcgatcgagaacgaattcaggtcgaatcgagattgtgataacgtgtgcacgtggtgcatgcgcgcgcgtgccgcaggggacgtgatgtctgggagcgtcggcggaggcgacgagcacgccggggtgctgcaggagctgttcggcgcgcggtggtggacggggagggagttcgtgctgctcgtcaccgccgtcttcgttctgctgccgctcgtgctccgccgccgtgtcggtaagttgttcacatctctcagttgcggcgtgcattggttgatttttttttagaaagatttcaagagcaatagtttcgttgagattacatatgatcacttgattgagattgtgtgaccgcgattggcgaatcgtccaatctgatttaatattacaaaaatgaccttagcggacgggtgatataataaagcggtagtataacgcatgtgggcatgtcggtttggatctggccccaagttttaaatgaaatagacagtttggtaggcggggcatggtgatgaagagatgatgatgatcactccatttctgtggagttccgacgtgcagcctgtggccacaatcttattattgtttgtgtttgacattttcatgggaagatgggtttaacgtttaagtagttggcatcctgccttttcccttgtccttgagcagaaccaaaacgctccatttctgtggtatactatagtagaagtccaatattaggctgtctttagcaacgtcctctatatctatattagaaggtcaataatgagttccagtagtattgatgctagggatggcaacgggtc

SEQ ID NO: 8721 - DNA, 2286 bp, Zea mays
gaccctcgaggctggccgggagctcttatccaacgccatccccattccccacccatcgttttctcgcccactcgccacgcctacacgctctcgagctgccgaatcccagatatacgcacgcgcaccaaacagtcccagcactccaaacacgccgctgttctcagcgatgcccagcgccggcagggacaacgcgacagcggcggagggggccgcgcaggcgctgctgctcccggagcacgccggggacgacgacgccccgtgcgcgggcggctccgcttcggtgctgggcgcggtgtgcaacgtgtcgacgagcgtggtgggcgccgggatcatgtcgatcccggcggccatgcgcgtgctgggcgtggcgccggcggtggcgctgatcgccggcgtcgcggtcctggccagggtcgccgtcgacttcatgctccggtacacccgcggcgcgccgtcgtacgcggcgctcatgggcgacgcgttcggctccgccggggccgcgctgctcaacgtcttcgtcgccctcaacggcttcgggacactcaccgtctacctcatcatcatcggtaacgccgcgagacccacaccggccattccagcgcgctagctaactgctagcgaacgaacgtgccatccggttccgccccggccgtgcgagtgactagacacgccatatgcatgctgtcgccgcgcgtgcaggggacgtggtgtcgggcacggcgagcggcggggtggcgcacccgggggtgctgcaggagtggttcgggcgccaatggtggaccagccgggaggtggtgctggtggcagccgcggcgattcggtccctcaaggccggccgtgtgctccgccagctgtgtcgattcgctgagattcacgtcggccatttccatcctactggcggtagtgttcatgctcatcagctcggggatcgcgctatacgctctcttcaagggcaccgcgaccatgccgcggatgtttcctgacttctccagactctcctcgccgttcgagctcttcaccgccgtccccgtcatcgtagtcgccttcaccttccacttcaacgtgcacccgatccgcgcggagctgagcaagacgtcggacatgaaggtggcagtgcgcgtctcgctcgtgctctgcgcggccatctacgccgccgtgggcttcttcggcttcctcctcttcggggacgccaccatggccgacgtcctcgccaacttcgaccgcagctctggggccggtgtcccgcaggcgctcaacgacgcggcgcgcctcagctacgcgctgcacctcgtgctcgtgttcccgctcctcctcttctcgctccgggtcaacgtcgacgagctcctcttcccgggccgccggccgctcgccgcggacacgcgccggttcgtgtccctcacagccgtgctcatggcggtgctctacgtcctggccatcgcaatccccagcatctggacgctcttcgagtactccgggtccacgttcgcggtcaccatctcgttgatcttccctggcgccatagttctcagggatgttcatggaatagcgaagcgcaaggacaaggcattggcggcaacgatgatcgttctggcagtggtcacgagcagcatcgccattgcctcgaacatcatgagctccatcagtgacgaagacagaggaggtcatgtagctggtagacgataatggctcagatcgaatcaaattaaaatgtggtttccaggccaaccgcgcgtgaagattgctgctcgtgtcatgcgttcctcctgggtattctttctttgcagcgagattgcttcggcccctgagatgcaagtttagtctgtgccccctcatggtgtagatgtttgtggttgagaggagatacgttggtacatggtaaggaaattaccagttggccaatgctgtatacttgtttcggtgatacattacagtgtaaaatagaaaacggtcatattttctttttcaggggtttataaaccgtagcaaataattgcaggccacttgttagccatctcccattacaacagaaagatagtccaccttagccttacccttaccattctaaatgccagacgtaagagccattgatgaaattgctttaaaggttttactcagtttaagcacacatttgctgtaaagcataacttgatctcttgtactatagttgtttatttagaatacttaacaaatttaggattatgagctctagtaatatagtatgcaaaagcatcagactcaccaatccaaagagatagatgctctctagctatcaatcggcacgactca

SEQ ID NO: 8722 - DNA, 850 bp, Zea mays
  misc_feature (4)..(4): n is a, c, g, or t
gggnatgtgattcacttaacccacaacccttggtggcggttgcttctggtaagaaattgtactgccttcatgtcaataacactgatgctgaggtcggcggcggagtgcgtcaaagggttagttcatccgaggtggaaggaaacgatggtgttttcagcacacaggaaagcgtgaatgtatttgatttccgtgtacccgctggcatcgggcttaaaatagcgagacatggcggcacagcgaactcaatcttctcacgcggagactcggtatttatcggtagcacagaaggaaggctgcaaataaaaggagggtcgaggtcacgagtccagcattactcgctgagaaaggggaaacttgtcgccacctatgagctaccagaattcagcgctcatatccatcactccgcgataacccaggtatggggcgactcaaaccttgtgttggcagcatgtggtatggggctgtttgccttcgacacattcaaggaagacacgcagccaaccaacaacaacctacagcttcgaccgaggaaacaccgttggagtgagagaagcgattggccctgacgatttgtactgccctacatttgattactcgtcgtcaagggttctgctcgtctcaagagatcgcccggcacattggaggtacttgtaggctgtatagctagctatgtaacgttttttttgtatgtgagagtgtgtgcaacgtgtgtcatcatgtaatatatgtacttcgtttatgcttcacatgtgatgccatctgccgtgtcaagcatcttgctttcactgtagtacttgctagcagatgttatctagttcttacccctggaatgataaattagttaacgacc

SEQ ID NO: 8723 - DNA, 1745 bp, Zea mays
ccgcatctgatcctggcgatgatgagaacagtatagccatggagtttctggcttctttagatggggaagaaaatgatttcttcaaggatcgtcgagctaagaaattggaaaagaataaaatatgtgaagtagcagatgctaccagcaagacatcaagtcaaggtagcacaaagaatccagttgctcccaatcataaggatgaagttgaattgcttgctacagaggagctagaagaatttgatgatcaggaaaacaagtcatccatgatgttacaggaagaaactgaggagtcatgcaatagtcagttatcgggtataggaaacaagtcttcaactggtggatggtttgtttcagagggggaagctgtgcttcttgctcatggagatggcacatgctcctattatgacattgcaaaccatgagttcaaatctgagtacaagcctcccagcttggtatcaaataatacgtggggcgattgctggttgattcgtgccccaggcgtagatggatgttctggtagatttgttgttgctgcatcggctgggaatgcattggagcctgggttttgcagctgggattactataccagagaagtaaaatcatttcatgtcgaggaggaagcttctcaaacttttgctccaacatcgagggctattcttggtgctctctctaatgtaggctcatcaagatccagctctgcgctgtcaaatacagagaggcagcaatggtggtataaaccatgcggacctctcctgctttctactgctagcaagcaaaagatggtcacagcttatgatatacgtgacggtgatgttgtgatgaaatgggaagttagcaatctagtaatgggaatggaatactccagcccactacaatggcgtagcagggggaaagtagtaattgctgggagtgaatcaatagggctgtgggatgtgaattcacttaacccacaacccttgttgtctgttgcttctggtaagaaagtgtacctgccttcacgtgaataacactgatgctgaggtgggcggcggagtgcgtcaaagggttagttcatctgaggtggaaggaaatgatggtgttttcagcacacaggaaagtgtcaatgtatttgattttcgtgtacctgctggcattgggcttaaaatagcaagacatggcggcacagcaaactcaatcttttcacgtggggactcggtatttattggtagcacagaaggaaggctgcaaataaaaggagggtcaagatcacgagttcagcaatactcgttgagaaaggggaaacttgtcgccacctatgagttacccgaattcaacgctcatatccatcactctgcgataacccaagtatggggcgactcaaaccttgtcttggctgcatgtggtatggggctgttcgcctttgacacgtttaaggaagacacgcagccaacctacagctttgaccgtggaaacaccattgcagcgagagaagctattggccctgatgatctgtactgtcctacatttgactactcatcatcaagggttcttctcgtctcaagagaccgcccggcacattggaggtacttgtaggctgtagctagctatttcttgtttattttgtgtgcaacatgccatgtaatatatgcactttgtttatgcttcacatgtggtgtcatctgccgtgtcaaccatctcgcgctttcactgtaatattatctagtttttacccctgcaattataaattattttcagtcttctgtact

SEQ ID NO: 8724 - DNA, 3175 bp, Zea mays
tgattattgataggaagaggaactaacgcttcgaaagctcgaaaccagaagcgctcattagatgatgcagttttgggaataacgcacatcattgtggatgaaatccatgaaagggataggttttctgatttcatgctgactattctaagagacttgttgcctttgtatcctcatcttcgtatggtactcatgagtgcaacaattgatgctgagcgtttttcgcaatatttcaatggatgttcggtcatacaagtccctggttttacctatcctgtcaaatctttctatttggaggacgtgctttctattctgcagtctgcagagcagaacacagaagtctacaattaccagcattcagagactggtataactcctttaatggtttttgctatgaagggtcagcttggggacgtctgtatgcttttatcttttggtgtggattgttcagcacaggatcatgatggaaaatccgcattagattgggcacaacatgagaatcaacaagaggtctgtgaagtaataaagaaacatatggagtgtagttcagaaaaatcaactgaagataacgagctgcttaacaagtacttggcatctattaatccagagcacattgatactctgctaattgaacggctgcttcgaaaaatttgtgtggattccaatgaaggagccatcttggtattccttcctggctgggaagatatcagtcaaacacgtgaaagattatttgcttctccattctttcaggattcatcaagatttcttgtgttgtctcttcattctatgatcccgtcctcagagcagaaaaaggttttcaaacgtccaccagtgggggttcgtaaaattattctctcaactaatattgcagagactgctgtgacaattgatgatgttgtgtttgtcatagatagtgggagaatgaaagagaaaagttatgatccatacaataatgtgtccacacttcatgcttcttgggtttcaaaagccagtgcaagacaacgcgaagggcgtgctggccgatgtcagccaggaacttgctatcatctttactcaaggtttagagcttcatccttgccagactaccaaattcctgaaataaaaagaatgcccattgaggaactttgtttgcaggtcaaactgcttgattcaaactgcagaatagcagactttctgaagaaaaccttggaccctccaattccagaaactgtaagaaatgctattgctgtgcttcaggatcttggtgctttaacacaagacgaacaactaacagaattaggagaaaagctgggttccctgccagtccatccatccaccaccaagatgctcctgtttgctatattaatgaactgcctggatccagcattgacattggcatgtgcagctgattacagagatccatttgtccttccagtagcgcctgatgagaggaaaagggcagctgcagcgaaagttgagcttgcttcgttgtatggtgggttcagcgaccaacttgctgttgtcgcggcatttgactgctggaggcatgccaaagatagaggccaagattctcaattttgtgcgaagtactttgtctcttcaaacatcatgaatatgctatcaagcatgaggaaacaacttcagaatgaactgtctcaaagagggtttgtccctgcagatgcatctgcctgcagcttaaactctaaagatccaggtatcatgcgtgctgttcttatggctggtgcttacccaatggtagggaaaatgctccctcctcgcaaaaatgctagaaaatcagttctggaaacagcgagtggtgccaaagttcgtctgcacccacactcctgcaactttaacctatctttcagtaaatcttctgggaatccactgctgatatacgatgagatcactcgaggtgatggtggaatgtatataaaaaattcttcagttgttgggtcatatcctttgcttctaatagctgcagaaatggttgttgctccacctgatgatgatagtgatgaagatgaggaagattctagtgaggatgaagctgaggaaagcacattggtacagcacaaagaagagattatgtcttcacctgacagcattgtttcagttgttgttgatcggtggctccggtttgacgctacggctctggatgttgctcaaatatactgcttaagagaacgtctagcatctgctattcttttcaaagtgaaacatccacaagatgttctacctcctgcgcttggagcgtcaatgtatgccatcacatgcatcctttcattcgatggtttgccttctatggttccacctaatgacctttcagcaaaccgaggttcaggccaggatttagcagaagctagcaagttctctcagggaagaagagcgggttatattccacctagtggttttctgatgtccttgttagctgataggacccataatgcaccttctttccagaactcatctaaccatccaggaggtggttcagcgcatactcggccatccagggctcctgttggtaggtttgatcgatctcggcgacctttccgcaattctggacctgggagttcagcaccacgttctttcaaaaggcagcgcgacgctccacggtgagcagggcataaaggcagccttttgcatgccagccatttcggatgtgctttgtcaacggtgcctagtctaagaaaaggacgtgctatagaatcacaagctttgctgtgttccgttgtagaaatgaaggaaaagaattatagcactgcatcggattcctttgtcgaagagttttttgtaggtatgcccctgagtgttttgtgtactttgctcagccgagctcatttgcaccgtagacctcagaggtgcctgtaatcttttggatggagttcggatgttaaaaagaagtgggatagaaaagcgaagacctgttatctgctcaaatgatgagccccataattgacggtatcactggaccatagatgaactttgtgctgtagtgccataggcaatatggtgtgacgggcgagtggaatttgccctgcatcgcaagcgttaaattttgtccttgtatgtacgtacttagtaaacttagtaataaccctttctctggtttaaaatttatagtgagtccaacatgatatgggcgcatttttgttcttgtttggggaaaaaatgcagcgaagtacgatgcacccaccga

SEQ ID NO: 8725 - DNA, 1447 bp, Zea mays
cctaagatcgggagcagtccacatacgaataggaataatgaggtgtctagtgatctccctttagtagggaagcataataaagggtgccattgcaagaagtcaggatgcctcaagaagtactgtgagtgcttccaagctaatatactatgctctgaaaactgcaagtgtatggattgcaagaattttgaaggaagtgaagagagaagaaatcttttccaaggggatcataaaaatgcaattaacattcagcaggcgacaaatgcagctgtaaatggtgctattggaaccacaggattcccttctccctccacgtcaaggaagaggaaacatattgatccttcacttgaccattcaaacaaggaacatgcagcgcacaggaattgtcacatacctcagaaaaatgcagtgcctgatggttcaattccaggaagccagtctgcacatcctccaactctgggcccctttaaagttacctacaggccccttttagcagacattgtccaagcagaggacgtaaaggagctatgcaagcttttagtggtggtatcaggagaagccgccaaaacatatgctgaccggaaagcgaaggaagagagggttggcaagaaggaagatgaaagggcagaacaaaaggaagatgagagggcaggttccctagcattgacaaaccatgacagagaaggaaataatcaagatccagataaaaaagcatcaatcgatgaccattcaagcagaggaactcatatgggcaaagctaatcaagaagaatccagacctaactgcgctgatgatcagaagtccaatagacctatgtctcctggaacactagcactgatgtgtgacgaacaagcgttcgagaaaatgtgcgacgaacaagatacagtgtttacggcttctcaaaatgctgttcctcagcagacagttactgtcaaccaaaaccaatctgcactgtacgtagaacaagaaagaattgtgctgacagaattccgtgattgcctccgcaaacttgtgacatacggaagaatgaaagaggaaaggtacgccatggaaatcaaatctgaaacatctggccatcctggacaggtaaatggtgtttctcaagtaccatattcaaaagtagaggtgcctgttgtaaaaacagacccacagagttccagcagccatcctgttgctgggaaacctgttactggccttttggacaaaaactgaagcctgggcgttccaggtttgtattcggggtgttgcaatgatcaagggaatcagtgttttcaccctcctaatttgttgatcagatacatgtatcagtcttgatagataatctagattttagggaattccaatttattctcattggtcagagtaagtgtgatgctggaatgtggatagttagtttagtcataaatgccaaccttgtcgtattttctacattgtagtttctcccttttct

SEQ ID NO: 8726 - DNA, 2650 bp, Zea mays
aaaataaatctcctgctgcagggtaatttccaccttcccgaaagccaaagaggaaaaaggaattgcgcctcccgctacgctattaccgccggcggccgctgccatggacgttggcgcgaaggaggaggagatgggtcaagtgtggtggggccaccgcgcgtggtccctcctctccgctgttcgtgcacgggcgccgctagtgcagtgcatcaccaacctcgtctcaatggacatcgccgccaacgtgctcctcgccgcgggcgcctccccggctatggtccactccctccgcgaggtgcccgactttaccccgcgctgcgacgccgtgtatgtcaacgtcggcacgctctcggaggactggctcccctccatgcgcgccgccgcctccgccggccgcccctgggtgctcgaccccgtcgccgccgccgcctccgggttccggatgaaagcctgcctcgagcttctgtcgctctgcccagcagtcgtcagggggaacgcctctgaaattctcgcgctcgcttcccgctcaaccgccgcctcttccaatttcaagggtgtggacagttcacattgctctgttgatgctattgaagctgcaaaagcgttggcactgtccagcagtgctgttgtcgcggtatctggagctgttgatttcgtcactgatgggaagcaggttatcagcgtgagcaacggtgtgcccatgatgcagaagatcaccgcaacagggtgcgctgtgactgctcttattgctgcatttgttgccatggaaccttctgatgccatagttgcagcggcatgcgctcttgccatctttggtctggtgggagagattgggatggagtcagccaaggggcctgcctctcttaggatgcacctcatcgacgctctctactgcctcaatgaagaaacagtcacttctcgggttaggatttccttgcgaccatgatgcgcggacgcatgccatggctactgttttttcaggtaaatatggagtttcgaataataggaaggctgagttcattttctgaaatgtcttgataaccatgaaaatcatagacactcctttaaccttcacgactgtacgaaatacctagatgtgatgcccaagttgtgcctgaattgtcagctgtacatatttaatacagtaaaatggggaaccttgtttctgtacaaaaaaaaaaaaagaagacatggaggcacgatggaataatgcacgtagctggatttgtgttatatgattataatcatatggtgccatggaaacatagaggcacgttgagatgctaaagccatgcagacactggacacaactgacaccttatgatgataaatagcagtagtaaatagaacaaatgtgattcacttgacgcccaacatttgttctttatctgtccaagttggagacatggagtctccttgtcacgataaagagtggtagccaatagaggaaatacgatttaactgtcactatcaattgcaagttttgtaatgaggtcctgagcctcagaatcataggtgtatgaatcagaaatctcagtaatccactttggattgcatgatgataaagcagagtccagaacgagcgacaatgttgggcataggaacaacctaatctagtgttaattgttccattttgaataggaacaacctaatctagtgttaattgactgcacccaacaatttccagaaaagcagagcccagaacgagcgacaatgttgggcatagttccgacagtgctagggagtgatagtgccacgagtcgaagcaaaaaaatgtttagaccgactttaaattttgtaggcagcaaacgctgcaggagaagaagtggttcgcgaagtaggagcatgaaaatatcagatcttccaaaacagatcagatacttagttgtgaatgggattttgttggggttttgagatttcgaccaaaactgcaagaaacatgcccacgaaagtgatcacctcaaaccagagatttgcagtaaccacaagagtacaagactgtttccatcacagagaatgtccccaacacttctaaacacatgaaaccaaagatcaactcacaatcaactagaggggttgagaagagaagaaacgaaacaaaaactcaactccatcagatttgacacaagaagtaaaaccacgagggctaagtgtggttatgaccatacttcctcaaaaatccacagtcttaaatgccacagttcaaaagtacttgaggatctccaacctagagcgattacaagactaaaatagaaatcaatgtaacagtaatctaatgctaaagagagaaaactgaaacaaccatctctctcctatttatagagggttattctatttccctaaactaaccataaatacatagagcctatccactcggccaagggcaaaatggatcaactcctaaaattttgttctgacggccacacactcttcatgaagttgatttgccttgatgccatggtttctaaagcggtaaggcgaggcaaggcattagaccaccgtctcgatgcctaggtgaggtaggtggacaaggtgtctaagcgttggacctccgcctagacgcttaggcgacaccttaagaatagtgcttgatgcacccttcgtgatgatgccatgtgccgcatctaattctcgctgaaaccgtaccatc

SEQ ID NO: 8727 - DNA, 3447 bp, Zea mays
ctaagtccttacttcagaaacaaaataacttatgaggtcaattgtttctgaagttttcgctggtgcttttggtttgtcaagccccaccaaaaggcagggggcatgtgttgagcaccaaaagtgacggacgatccggccctagggcccggacggtccgcgcccccgcagtcagattaacttgggtaattatctttatcttgtgtgtggttatctatctaatcacgtggagtttgttagctattgtataggaataggtccagacctcccctatatatatgaaggggtacgaccgattgagaactcccgaacgcatttcaatcgaacatatctactttatttacctttcctgtcctaggagtagatgtaacgtagttctagttgtagccttccacatatccacctccacccctattcgactctatgtcgtctagatccgtattgtgtggcctgtcgacctcaagacgaccttacgatcttacccctctcacggggcaagatctagttgtccactcaagatcttttcctcgaattgatttcttaattcctaggcgactccacgtcgtctggagacgtctcgggtgacctgtcgacccggagcgtcctaagatctcttccccaggtggcgaggtcgatgttccagcaaggaggaagacgacctggcgccatcacaaaccatctgatctagagcgcggaccgtctggtgcagtgcagggaaggcgccgctgctgcgcctaggtcacggaccgtccaaggccagagccacggaccatccgcccaaagtgattggcgctgccaagatcggcaccaaaaatgttcttcctgtgggactccttaattcattaggctgatcaacaatgtgggactccttaattcattaggctgatcaacaacgttccttctgaatggacgacgtgctggattattgtggcagtagcagtacaagcgatcaaacccaaatctctctttaatttatattttgatgtcattcgttcaattggatgctaatagcctttccattagatctcagaaattagcacatctccagtcttgctgagctgtggatgcaaaaacttctcttcaagaggatattgaattcctgaacaatttcacaaagctctacgatgatggggttagttttagctcaaagattatttccgcattcggttcagaattaattgatagagattggaagagattaaatcaattgctagttaaattaaatagagatttaatcctcctcaatcgctttcggatcacataaaaccaaacttgggcccttgcttttcgattttcgagctttttttttacgcaagggtccggtcaaccaccttgccatttcaatctcacgagctacagttgtcaaatcagagtaaaaatgattactgttaaccggacttctaattcatataccaccaaactgtcaaacatctggactaaatacatgcaacaccagtatttacaaacaagactcgcttctcctaagcgattgacctacactgaagctacttcgccaaaaactcagtattctgttcagtgaaaaaaccttcgtcggcaccgtgctgatcccatctcctcgtactcagacttcgttatgcacattgattcgaaatcaggacttgatgctagaatagatccgcctctccagacaccaaaaattgggttctcttgacgagttatcttaaccttgtagtcgtcagggacaagaggccgaagttccctctccaatctttcggtgaatctggggaacagtgtgcttccacctgtcaagatgatgctctcaaaaagcacaggttgaagatatggatggcaagcttgtacagcacgaactatacactcagcaagcccagcttgatttatgccaagatcaatgggatgaaaaagcatctctgggacaaggaacctctcgtttgtcaagacaaattcattttgacttaattctgcctttttccgatcctcggacttatttgtatccataccatggtctttgctatctgattcttgaggcagggtgcgatatctaagtgcttcatccatatccttgataaactctttcttgtatgttataccatcagggagaatataagaacatctaaaagggttatccttaaatgataacctggcaaggtgtagatcaccagggacatcaagcgagacaaaacatagcttttcctttgcatcatcaatgaggagagtttcatccataacattaagggaacggtatgagacgagctccttgagatagtttgtaagggccttgccgccaaggtccatacgccgaacaccataattaagagtaaagttctgaagtacaggggatgcatgggtgaaagagaagccacagtcaacaacaaggctgcattgggcacgaaacatcattggttgtcggctagcctcataaaggtggacaagggaaggaccatctgcaacataaagcgagttgaagccaaactcctcgaacactagctcatcagttgcatgctgtatcgctggagggttaaacatgggttccaccagtaacaaggacgagttagtaggatcaacctggagaagattgcgcaaaacccgttcccacacatccctctgcacctcggtattgataagatagccacggtcaataggacgcttcaaagtcatgccagtcacatcgacatcttctgcctgcagctggtcagccacaagccatttcttcgagctggcattgccaccagggggtttggccatacagttggggacaacagcaattggatcattgtcccccccaaagccagccttgagaagaccacccccattgtctatcaccaccacacccgatccacccgtcattgaatatccctatcttagttcaacctcttctgagtgccaggagtacccgacagcaatcgattaagcgacgattgatcgccgtttaagcgtttaatgcccccccaggccacacagttgcgcgcgtcgttcccctgtcccagccgatcgtgcggagaactcacctctctcgtccgtacctgtctctgccgctacaggatccgcctgtccgccacactccaagccctgcgcgtccgccactccttggctggaagtgatcgaccagtggctggcggcgttggtttgcccagcagacgaaagagaacaaaggaaaggggaacgggagatggcggcggtatagggcgcttggaacgggggttcatgccttcagggagtaggacgggaggtggatgggatgcccggcggcggcacttggcgcaggggacttgcggcgagcatggcgtggcggccgcgtcagggtttcgaggaagacggaagaccagccagggctgccgcacgatgtgggccagcaaaaccccggccccccccccgccgacaggaatgaagaagaagaactagggcactttcgtgggccagcaggcgcttgtggcctccgcggctccgccggatgaagaacaggaacgccag

SEQ ID NO: 8728 - DNA, 807 bp, Zea mays
tgcatgggccaagaatattaaggtttctgatccgcttgaagagggttgcagacttgggccagttgttagtgaagggcagtatgagaagattaaaaagttcatattgaatgccaaaagcgaaggtgctactattctgactggaggtgttagacctgcgcatcttgagaaggggttctttattgaaccaacaatcattactgatatcaccacatcaatggaaatttggagggaggaagtcttcggtccagtcctgtgtgttaaagaatttagcactgaagatgaagccattgaactggccaatgatacacagtatggtttagctggtgctgtaatttctggtgatcgtgagcgctgccagagattatctgaggagattgatgctggaattatctgggtaaactgctcacagccctgcttctgccaggctccctggggcggtaacaagcgtagtggatttggacgtgagcttggagaagggggcattgataactacctgagcgtcaagcaagtcacggagtacatctctgatgagccgtggggatggtatcgatccccctccaagctgtaaactggcatgaaattttgtttgttccattagaataaatatatctcgatgctatacagaacgaacccgtgtatcaaatggagtatgacattgtgaaaaaggcacatcagcggaacaaatgtcagagttgacaattccctctaatgcaaatagttaactcgcccttgagtaccaaaaaaaaaaaaaaaaaaaaaaaaaaaaaaaaaaaggggggggcccgcgtaaagtgatctggtaccccg

SEQ ID NO: 8729 - DNA, 1553 bp, Zea mays
ggccgcgattgggcgcgcgcgccgggggccattcgggccagggacctccgcgccattgtcgccaagggaattgagaggaaacaagagctagctaagctagaggcacttgattgcgggaagcgcttatgatgaagctgcatgggacatggatgatgttgctgggtgctttgagtacttcgcagatcaggcagaagccttggataaaaggcaaaattccccagtttctcttccaatggaaacttttaaatgtcatctccgaagagagcctattggggtagttgggctgataactccttggaactatcctctactgatggctacatggaaggtagcccctgcattggctgctggttgtacagctgtgctaaagccatctgaactggcttctgtgacttgcttagagcttgctgatatctgtaaagaagtcggtctcccttctggtgtcttgaacattgtgacaggattaggtcctgatgctggcgctcctttgtcagcacacccagatgttgacaaggtcgcttttactgggagttttgaaactggcaagaaaattatggcatcggcagctcctatggtcaagcctgttacactggaacttggtggaaaaagtcctatagtagtatttgatgatgttgacattgacaaagctgttgagtggactctgtttgggtgcttttggaccaatggtcagatttgcagcgcaacatctcgtcttcttgtccatacaaaaattgctaaagaatttaatgacgcgggggttgcatgggccaagaatattaaggtttctgatccgcttgaagagggttgcagacttgggccagttgttagtgaagggcagtatgagaagattaaaaagttcatattgaatgccaaaagcgaaggtgctactattctgactggaggtgttagacctgcgcatcttgagaaggggttctttattgaaccaacaatcattactgatatcaccacatcaatggaaatttggagggaggaagtcttcggtccagtcctgtgtgttaaagaatttagcactgaagatgaagccattgaactggccaatgatacacagtatggtttagctggtgctgtaatttctggtgatcgtgagcgctgccagagattatctgaggagattgatgctggaattatctgggtaaactgctcacagccctgcttctgccaggctccctggggcggtaacaagcgtagtggatttggacgtgagcttggagaagggggcattgataactacctgagcgtcaagcaagtcacggagtacatctctgatgagccgtggggatggtatcgatccccctccaagctgtaaactggcatgaaattttgtttgttccattagaataaatatatctcgatgctatacagaacgaacccgtgtatcaaatggagtatgacattgtgaaaaaggcacatccagcggagcaaggcgcggggtgggctgaaaccaaaaattttggaactgtgccattataagaggtggattttgtcaaaaaaaaaaaaaaaaaaaaaaaaaaaaaaaaaaaaaaaaaaaaaaa

SEQ ID NO: 8730 - DNA, 2038 bp, Zea mays
agaaaaaggtacgcatctgaaacggacgtgccagcaaaaaccgccacgtgctgaaccgcctgccgcaccgcactagcgtccgcaacagcaggagacgtcctcgctttccacctgcacagagcgccagggccgtagcgtgccgatcgctcgatcccaccaactgaggccactgtctagttgccgactctcctcgcaggccgcaatctcgcagacacgcaccgtcgcggtatccgtatcgccagagtcctcacggatggcctcgccagcgatggtcccgctgcggcagctcttcgtcgacggcgagtggcgcccgcccgcgcagggccgccgcctccccgtcgtcaaccccaccaccgaggctcacatcggcgagatccctgcgggcacagcggaggacgtggacgccgcggtggcggcggcgcgggcggcgctcaagaggaaccgtggccgcgactgggcgcgcgccccgggggccgtccgggccaagtacctccgcgctatcgccgccaaggtgattgagaggaaacctgagctggctaagctagaggcacttgattgtgggaagccttatgatgaagcagcatgggacatggatgatgttgctgggtgctttgagtacttcgcggatcaggcagaagctttggacaaaagacaaaattccccagtttctcttccgatggaaacttttaaatgccatctccgaagagagcctattggggtagttgggctgataactccttggaactatcctctcctgatggctacatggaaggtagctcctgctctggctgctggttgtgcagctgtgctaaagccatctgaattggcttctgtgacttgcttagagcttgctgatatctgtaaagaagtcggtcttcctcccggtgtcttaaacattgtgacaggattaggtcctgatgctggtgctcctttgtcagcacacccagatgttgacaaggtcgcttttactgggagttttgaaactggtaagaagattatggcggctgcagctcctatggttaagcctgttacactggaacttggtggaaaaagtcctatagtagtatttgatgatgttgacattgacaaagctgttgagtggactctgtttgggtgcttttggaccaatggtcagatttgcagcgcaacatctcgtcttcttatccatacaaaaattgctaaaaaatttaatgagaggatggttgcatgggccaaaaatattaaggtttcggatccacttgaagagggttgcaggcttgggccagttgttagtgaaggacagtatgagaagattaagaagttcatatcgaatgccaaaagccaaggtgctactattctgactggaggtgttagacctgcgcatcttgagaaggggttctttattgaaccaactattattactgatatcaccacatcaatggaaatctggagggaggaagtctttggtccagtcctgtgcgttaaagaatttagcactgaagatgaagccatcgaacttgccaacgatacacagtatggtttggctggtgctgtaatttctggtgatcgggagcgctgccagaggttatctgaggagattgacgctggatgcatctgggtaaactgctcgcaaccctgcttctgccaagctccctggggcgggaacaagcgcagtggatttggacgtgagcttggagaagggggcattgataactacctgagcgtcaagcaagtcacggagtacatctctgatgagccgtggggatggtaccaatccccctccaagctgtaaactggcaagacgaaaatttgtctgtttcggtagaataaatatatctcgatgctatacagaacgaacccgtgtatcacattgaatgacatggtgaaaaaggcacatctgcaggataaaggcgagagttgagttgaaaccaaaaattttggaactgtgccattataagaggtggattttgtccatgggccttgtctagacttcgttatcagcaaagacagatttgcccctaaaaaaaaaaaaaaaaaactagagggggggcccggtacc

SEQ ID NO: 8731 - DNA, 2251 bp, Zea mays
  misc_feature (296)..(296): n is a, c, g, or t
gcgagcttgtgcattttgtgtttggtgagagcaagcacaacagctctgtggagaggggtcgtttgaagctccaacctggagattcggaggcccttcggcttttcttcactcggatgcaggccaaaaatgccaacttttttactgtcattgacctggacgatgaaggctgtaccaggaatgttttctgggcagatgcacggtctagagccatgtgtgagtactatagtgatgtcatcacacttgatacatcatatgtggctagtaaatatgatatgcctctcgcgcctttattgggngtgaatcatcatggacaatctgtcttgatggggtgtgccctgctttctgatgaaacagcagaaacctattcatggctacttaagtcttggatagcatgtatgtacggcaatcttccaaaggctattgtcactgactattgtaggggcatccaaagtgctgtagctgagattattccgggagtccgtcatagaatgtgtttgtttcagataatgaggaaggccgcagaacgtttaggtgggctgtcagagtacagagctatcaacaaggcgatgcataaggctgtgtatgattctttaaccattgatgagtttgaagaagaatggaatactttaattacatatagtgggcttcagagcaatgactggttaagatcactttatgaatgtcgatcttcatgggttcccgtttttattaaagatacattttgggcaggaatgtctactacacaaagaaatgaaacaatcactcctttttttgatggatatgttgatttgaaaactaccttgaaacaatttcttgtcaagtatgagatggctttgcagagtaaatatgagaaggaggcccaagcagattttgagacgtttcataagcaacgcccaccggtatcaaaattctatatggaagagcagctctcaaaagtatacacacataatatgttcaagaagttccaagatgagattgaagccataatgtactgccatgtatctttaattagtgttgatgggcctgtctctacattcaatgtcaaggagtgcattttctttgaagatggtaaaaggactatgagtaaaatttttgcagtgacatacaaagcggacgaaaagaatattagttgtatatgtggaggtttccaattcagtggcatactgtgtaggcatagtctctcaatgctcaagtttcaactggttcgtgaaatcccacaacattatattcttgataggtggaagaaggattttcgacagttgcatgtgatgagacgccctccaagcgatcttgttcctaacaatcgcatggatcgatatgactatttatcaataagatgtttgcaacttgttgactctgcagtcctatcagataagtatcgccttgctttgaggttggtaagggagacagagaaatttctgctaaatagcaacacacatgatgatacacaaccaaggatcaagtctcgtgttcctaaagtaaataaaccaaatattgtgactggccaaaccatggtgggtgcagctactggaaatggaaatgatggtctcaaaggaccagaggctacagcagtcacgcaagtaccacaatcccaaaagggaggagcagaaaaaggaatagttcctactggctacattggagtaccagctaatctccaacaatttgtaggcaatcaaacagcatttcggccaagcattgtgtacatggtaccgagtggtgttgatccacatgcttttggaaatgttatgatgccagtgatgtaccagcagatgttccaggtgcctccgaagccaaatgagaccgtgcaggatacttcagccaatggaaaaagtaagcgacctcgcggtcagaagctcacagagacatcccaacaggcaaatggaaccccagcatctgcatctggctagggtggactactaacattttgaacaggatttctgtacatacgttgacttcgttgacttcatgccgtgagaaattttacatatggacgctggcactaacaattacctcaatgttgtccaaggtatctggcccaggactggaaattgtctctcgcacactttctttttgtgtgtggctgatttctgcaagacaggttccacctaatgtacaagtccccctgtcctttttatgatatgtaaatgaatgttcttggaccagctctatcatggctcttgagtacggtggccagtgccttccaaattccctgaaaaaaaaaaaaaaaaaacggccctcgagttccaggttt

SEQ ID NO: 8732 - DNA, 751 bp, Zea mays
  misc_feature (739)..(739): n is a, c, g, or t
gtttccctcctaatttggatgagtataacaagtggaaagcttcatttcagaagagaaaagattatttagatgctgtggcttcagatggttgtttgactcagagttcacaggggttggctgcaggggagatgatttacagtttgagagattacttgaaagattctgtcagcaatagcatctcaaaccttaactggagtgcatctaaaaggcggtctgggagacggtttagacaaggagacactgggacttcaactccaacctttagcggaagcccaggcaaagggggttttggccactctactgacacctcagagaagaaaggcactgaagaaactcacaggctttctttatcaagtccagtaaaaatcacgcaaaggccactccgaaactgcagcatagactcaaagtcaaaagaatcaaaaacaagggataccactttgcatccactgattttcaaggaggatggccttgcagataatactttgttgacttacaagttaaagaatggagaggctctaaagcaagggtataaacggggaacatgcatcatctgtaactgttgcaatcaagagttttctccttcccactttgaagaacatgctggcatggggagaagacggcaaccgtatcacaacatttttccttagaagggtttcccacttcataagctagctctgcaactgcaagatcatttgaatccaaatggattcgacaatgctagtgtttccagcgtcagtgnctaccataacgt

SEQ ID NO: 8733 - DNA, 844 bp, Zea mays
cccggtttaaaagttgggtacctcgaggccggccgggacttctagagtttagctatagcctcactgctagagcgccgccatggctcaggtaaggggcagtgctcgtggcactggcagtggcagcagcgccgccgcgctggcgctggtcctcctgtgcgcgctcctccgcggcgagttcgccgagtcggcggtgtacacggtcggcgaccgcggcgggtggagcttcaacaccgccagctggcccaacggcaagcgtttccgcgccggcgacgtcctcgtgttcaggtacgacgccagggcgcacaacgtggtgcccgtgagcgcggcggggtacagctcgtgcagcgcgcccgagggcgccagggcgctcgccaccgggaacgaccgcgtcacgctgaggcgcggcgccaactacttcatctgcagcttcccaggccactgccaggccggcatgaaggtcgccgtcaccgccgcctaggcactgcagggcggccaatcagccggcggagagcgccgcgctcacggagtagtaaagcacgtagctaattagacggtgctgcccttgttgttcaataatatcgtctgtcgtcccgtacttcataacctgcgcggcgtgttagtagttgtttggtggtgtttggcgactggcactataaagaagggtcagatcgagtgatgtacttgctaccaataaaggtatacgggtttgtgtgttcaaaaaaaaaaaaaaaaaagcggccctattccaaacctatagagagctaatggctaattaaagtgtaagcggccgttgagaaagtatattaaataattagctagcctaaaaaaaaaaaaaaaagcgggc

SEQ ID NO: 8734 - DNA, 762 bp, Zea mays
cattgggtacctcgaggccggccgggacttctagagtttagctatagcctcactgctagagcgccgccatggctcaggtaaggggcagtgctcgtggcactggcagtggcagcagcgccgccgcgctggcgctggtcctcctgtgcgcgctcctccgcggcgagttcgccgagtcggcggtgtacacggtcggcgaccgcggcgggtggagcttcaacaccgctagctggcccaacggcaagcgtttccgcgccggcgacgtcctcgtgttcaggtacgacgccagggcgcacaacgtggtgcccgtgagcgcggcggggtacagctcgtgcagcgcgcccgagggcgccagggcgctcgccaccgggaacgaccgcgtcacgctgaggcgcggcgccaactacttcatctgcagcttcccaggccactgccaggccggcatgaaggtcgccgtcaccgccgcctaggcactgcagggcggccaatcagccggcggagagcgccgcgctcacggagtaaagcacgtagctaattagacggtgctgccttgctgttcaataatatcgtctgtcgtcgcgtacttcataacctgcgcggcgtgttagtagttgtttggtggtgtttggcgactggcactacagagaagtgtcagatcgagtgatgtacttgctaccaacaataaaggtatacacggttttgtgtgttcactaaaaaaaaaaaaaaagcggcccgcccttcccccatccgcgtggcctcgccgca

SEQ ID NO: 8735 - DNA, 883 bp, Zea mays
cattgggtacctcgccgcccgcccgcacagctctgctcactctcatcacttcgctccaagcccccttgtgtacgtgagagacggcatcgtaccgtagagcagcatccatggcggctcagggaagtggcagtgctcgtggtcgtggcagcggcgccgccgccgcgcttgcgctggtccttctctgcgtgctcctccacggcgagttggccgagtcggcggtgtacacggtcggcgaccgcggcgggtggagcttcaacaccgccaactggcccaagggcaagcggttccgcgccggcgacgtgctcgcgttcaggtacaacgccaaggcgcacaacgtggtgcccgtgagcgcggcggggtacaagtcgtgcagcgcgcccaagggcgtgagggcgctcaccaccgggaacgaccgcgtcacgctgaagcgcggcaccaactacttcatctgcagcttcccaggccactgccaggccggcatgaagatcgctgtcaccgccgcgtgaggcccccggccgatcagccgcgccggcgacgacgaccgccggacacacgggctcgatcggtggccagctttttattatttttatttccctctccaaagtaaaagcgtcgcgtccttaacctgcgtgctggtaggcggtgttaggtgtgtggagaccggccggcactatagagaactaaatcgaatgatggtgtactcgatcactacgtactgacgtgtatgagtttgtgtacgcgtttgtatatcctgtactcagttcatgtgcgatataaaggcatgtgtactgagtttggccctaacctcgttacgaggggaaagctgtaactctcttccattatctaaaaaaaatgcctgcttgagctaaaaaaaaaaaaaaaa

SEQ ID NO: 8736 - DNA, 782 bp, Zea mays
  misc_feature (767)..(767): n is a, c, g, or t
ccggccgggatctcaattctcaactcacactcatcacccggccgccttctcgctcgagcacttccctttctgagctcatcgtgctgctgagacttgagagcggcatatatatggcggctcaggcaagaatgggcggcgctcgtggcagcagcggcgccgtcgtgcttgcgctggtcctcctctgcgtgctccttcatggcgagttcgccgaatcggcggtgtacacggtcggcgaccgcggcgggtggagcttcaacaccgccaactggcccaagggcaagcgcttccgcgccggcgacgtgctcgtgttcaagtacgaccccaaggcacacaacgtggtgcccgtgagcgcggcggggtacagctcgtgcagcgcgccgaggggcgtcagggcgctcaccaccgggaacgaccgcgtcacgctcaagcgcggcgtcaactacttcatctgcagcttccccggccactgccaggccggcatgaaggtcgccgtcaccgccgcgtgaggccgtaccggaccgtgccgagccgatcggccggacgggctatatatctggggctgctgcttctattattttcttctccaaagtaaagcgcatcgttgttcaattatagtcgtcgcgtacgtacgtgtgtgtgccgtagtcgttagcggattggcactatatacggagagagagaaggacagatcaagcaatgtattggcgtgtgtgttgatctatgcaacagaataaagcctcgttcgattggtgaggcgacttttttanaatttagcccttttt

SEQ ID NO: 8737 - DNA, 1136 bp, Zea mays
ccggccggcactatagagaactaaatcgaatgatggtgtactcgatcactacgtactgacgtgtatgagtttgtgttgatgtggagaacaataaaggcatgtgtacgcgtttgtatatcctgtactcagttcatgtgcgatatatatatatgctagctaaaaaaaaaaaaaaaaaaaaaaaaaaatgggaccctccccggcccgcgccggacagctctgctcactctcatcacttcgctccaagccagtgctagcccggccccttgtgtacgtgagagacggcatcgtaccgtagagcagcatccatggcggctcagggaagtggcagtgctcgtggcagcggcgccgccgccgcgcttgcgctggtcctcctctgcgtgctcctccacggcgagttggccgagtcggcggtgtacacggtcggcgaccgcggcgggtggagcttcaacaccgccaactggcccaagggcaagcggttccgcgccggcgacgtgctcgcgttcaggtacaacgccaaggcgcacaacgtggtgcccgtgagcgcggcggggtacaagtcctgcagcgcgcccaagggcgtgagggcgctcaccaccgggaacgaccgcgtcacgctgaagcgcggcgccaactacttcatctgcagcttcccaggccactgccaggccggcatgaagatcgctgtcaccgccgcgtgaggcccccggccgatcagccgcgccggcgacgacgaccgccggacacacgggctcgatcggtggccagctttttattatttttatttccctctccaaagtaaaagcgtcgcgtccttaacctgcgtgctggtaggcggtgttaggtgtgtggagaccggccggcactatagagaactaaatcgaatgatggtgtactcgatcactacgtactgacgtgtatgagtttgtgttgatgtggagaacaataaaggcatgtgtacgcgtttgtatatcctgtactcagttcatgtgcgatatatatatatgctagctatgcctgcttgagccacaataaaagaataaggggaaagcatcaactctcttccattatctaaaaaaaaaaaaaaaaaaaaaaataaaaaaaacctaaaaaaaaaaaaaaaaaccccgcggccctga

SEQ ID NO: 8738 - DNA, 2122 bp, Zea mays
aaacaaatttcatttttttctcggtcgtcctcctctgcttcgactctcttctccaactccgcctcggcgtcgtcgtgcgcttcgatctttcccatttccaaccggaggggaggcgtcggcgcaataataggaggcgcctttgtttcgcccatcgccggcatggggaactagcttcgtggctgggccccacgccatgcaaaccagtgagaccaccgggaccgcatcgccgccggctgttgagccggaggccgaggacaaggtggaagagggggcgcgggcgaatgaggaggcggcggcgaaggtgggcggcgacgacgaggatgactgggaatcggagcatgaggggaggagaggcaggcggcagcggtgccggcgaggcggtgcggcgggggacagcgccgtggccatggtgaagcgggagctgctcacgcgctgcttgacgtgcccgctctgcgaccacctgctccggcaggccaccaccatctccgagtgcctccatacattttgtagaaagtgtatctataaaaagctcaatgatgaggatctggaccactgtccagtatgtaaaattgatctgggctgcactccagtcgagaagcttagagctgatcataatatacaagatgtgaggtcaaaattttttccattcaaaagaaagaaggttaatgctgaagaagccgaatctcctattatgctgcctgttaaagttaaagagaggtctatctcatcgttggtggtcaatacacctagagtaaccccagcagctttgacagggaggcgaacaagagcggttaccaggaaggctgccgcattgcgtggccttggtcctatcattgtggatcctttaaaaaaggacaacgataacccaaataagcaaactgataattcaagcttgctagatagcttgaacaaaatacctcaaacaagaagacagttattgtcgaatggggacacaacaagtcatctctctgttaaagataaagcaggtgataataaggacctggataagtccgagttctggaaacctttgaattgtcttgtagaagctgcaagcaaaacaaagcccctgacaagtgcaccaaggccagctttgaagggagataagcccagaaaatctccgagtagtgatagcgaacattctagcagaacaaagactagggagcctcttcagaagtccaaagctgaagttgacaaaagcgatcccgggccaatagtgatgcttagaaagagagggcggcctggccggaagaggaaaaatcccctacctgaaacaaatgcagattccactgctacagctatccaggccaggaaggcattgagcccaatatggttttcattgattgcctcgtttgaccagaaaggtgtccctcctttgcctcagatacctgcacactatttgagaataaaggatgggagcatacccgcgtcatctattcaaaagtacattgtgcagaagctcagtcttctaagcgaatccgaggtcgaaataagctgctgcgggcagaccgtgaaccctgggcaacctgtgcgcaacttggtggagcggtggctgagggttggcccggcgcgcccgctgcacacggtgatcggctcctccgggggagattatgtgatggtgataagctatgggcggcccaagtccgcgtcctgttaaaaccatatcaccatcgacggcctggcgaggtcgattcctagttcgaacaagggttggtgccgccgccgctgccgccgccggggaagaggccgtcgacagataaactcaagcagcggtagcgggctgctctgccgcagcagctcgtcctctcaccggcgtgttctttaaggatctgttcgttcgttcgttgttgtcatacatgcacatgtgatggaagtcgctataatttggtagtacttggtaggctgtgagtgagaactgacgtttaggttggaggcgagatcgttaacctgagcttaagtgttgggggcgatgagtccgccgtgtatgggagaggcgctgctggttcagttctttttcctccgttttttttttcacttcttgaagggaaaaacacacacaaatacataatgtacctccgtttatttgtcctgaactaatatccagccgtgactgattcggatcgtt

SEQ ID NO: 8739 - DNA, 669 bp, Zea mays
gtccctcggtcgcgccagccgggccgaacaccaacgcaaccacgttacgcaccatagaacatacccgtgagaagctaagacccggccgttgctcaccacagcatcatcgccgcgccgtgctagctcaaggatggagaacaacaggcagcagcagcaggcgccgccgccgccaggctacccgacggcggctgcaggcttggagcaggagcagggaggcaggaagggacgacgccgggagaagacgacctcgcgcggggataaaggcttcatcgaaggatgcatcgcggcgctctgctgctgctggatctgcgagatgtgctgcgactaggcacgcagctagcggtcagctagctctccgtctccggcggctatacatacgaaatacgatgagagagctagcctgccacagcttctgcttctgcttctgcaagagagatctgcttaaattattctatcgtccagagctgcagcaacacctgatatgtttgtttggggtgttattagtagggagagctagctcagctttattattgttaataataattctgtgctgtacgtagctatagcaagcatacgtatgtatacacgtatatgtatgtgttttaccgtgacttgaatgtttggaaatggtgatttcattgcctcctttaaaaaaaaaaaaaaaaacta

SEQ ID NO: 8740 - DNA, 7587 bp, Zea mays
agtctcattttaagatattgtgttatgatttctaattatatgtatgcactgatattgatatattgctttaatactttgcgagatatcattgatcttttagaaatttgtgaatatttatataataataatttttatgtggatgtacgacttgagtgaatttttgaagttattgaaggtatatgttacattttttaccgatcgtatgttagatttcgaccttaaccagtgtattttccgtaccgaagtttcgttttttatgtttctgaattatcaatgttgttttagtttccggtgttatcgttttcgattttatttccaaagaaaaatataaaaacgaaaatggtttcagtgtttaccgaccatttccacccttccccttgcacacaacaaacaggtctctagccaacagaaaatggtttcggtgaaagttggcgttgataaacgaaaaagaaaaagaaaaaacagatgcaggccgagcccatcaaccatcctttggagtccgctactgagcccagatcctctgcgagccgcagtccaccctcatcgtctctcctcctgcagcacatacatacccaaccaggcaaccacacaattgtctgaatagagggcgacagagttcatgatttcagccaattttcaccgaaattcgtttctactaattcacgagaaccaataaaaggccaaacgagcctatatggtctatgtatctatgcacacgtaaaaaaaactggtggttcaagcctaagcgaaagaaattttatttttctctgctcctcatcccctgccgccaccgccacatcttaaacatgtttgggacgtctttttcctaaaaagtttttaaaattgaattcttggataatctagctactatgagaaactgaatattatgagacatgcgtgtagggatggtaacagattagattcagatcgaatattccaaatatctgctcgcaaccacatctgcggttgcaaccaatatccacccacgatcatacccgcggtagcaatttatatccacactcgtacccatcagatttcggatattcgtcagatatgacacacaccatcatttttcaaaaaattaatagtgtaattaatcaaacttcttcctaattcaccatcacacacaattaaaaacttagcaaaagaattattataggcatgcgagctatggcgaggggctttgaagcttagaaggggcagccactgactatgttgtgtggcccatgggacttggaagagggtatagatgtccaaatgggccacccggcacggacccggtccgaacccgttttggcccggtacgaatagggccgggtcagacatggcccgttaatgcttcgagccgggtcgtgctagcccacgtgcctaggaacatgctcaaacccgacacgcacagggataaatcgtgtcgggccggcccgttcgcccggtgggactcaacgtaccggaccggccactgctccggaccaacagtacagcatatataaatacatacatttaacagaattaatcatataaacagtatactaaagtgatcatataaacagtatactaaagtgagttcagatgttgtaaactaaatctaaaaaacataacagacaacaactaaattaaacagctaacaactaaattaaacagacaacaactaaattaaacaaacgcagttcctgcgccctgcggccagagctttggagtttggaagcagcttggaagcagacaacaactaaattaaacaaacagctaacaactaaattacgcgagcgacagagaggagcgttggagtttggaagcagttcctgcgtggccggagccccggggcatattcctcgcccggagatcccgtacccgaccctcccctgataaacagacgcaagcgtcagggagggagggagggacagagagaggtagagagggccggggcgaagggggcaaagatgcgttcttgaggagcctgtgcaggggaggtccaatccagaggccgccattccttttcttttccccccaacctctgcaggctcttcagatccagcaatccggcttgtttcttttgctggttgatttatactctatagtggttctctacttagcatcaagtcttggcatggcaatggcctcgtagctcgcggctctctaataggaataattttactcaaaatgaagctatagcgtcatgctatcttaggttgtttggacagttccttaggatactgaaactgtcttagataatggagatgatgttcactcaaacatttctcccgatagatatacaattgtaattacaccagaactgtacttacaattaagaacaacatcagctgtaacattagtagtaagaaacagttcagatagtgtgtgggtgctcatctgccgccctgcttgtgcagatactgtgtgtgttcctgaaacttcatggagacttccatatctccaccaggcacatcaaagcagtcagctgtccgcaaaccttctcctggaagctctcttaaggatctgtgccttgtttccaaacaagggtcaatagctgaagtagaatctgctttggccttgttgaaaaaaagtggtgggaacattgatggtagaaatgcatttggtcttagtgccctccaccttgcaacatggagaaatcatctacccattgtgaggcgactcctagatgctggcgctgatccagatgcaagggatggagaatctggctggagtagcctgcatagagcacttcattttggtcacctatgtattgctggtgttcttttacagtttggtgcttccctcgctttggaggacactaagggccgtacacctgttgaccttatctcctgtccagtatcacaggccaatggagattttccagatgcagttgcaacggaagtcttcagttggggaagtgggacaaattatcagctgggaactggcaacgcccacatacaaaaactaccatgcaaagtagaagctttgcatggatcatatatcaaaacagttgctgcatcaaagtttcacagtgtagcagttagttctaatggtgaactatacacatggggatttggtcgaggtggtcgtcttggtcatccagatattcacagtggacagacaactgctgtgattacccctcgccaggtgacagtaggattaggccgtaaacgagttaatgctgtggctgcagccaaacatcatactgtgattgctacagagctgggggaattgtttacctggggatcaaatagagagggtcagcttgggtacccttctgttgatacccaaccaacaccaaggcgtgttagttcgctcaagcaaaggataatttcagtagctgctgcaaacaagcactccgctgcagttgctgatactggcgaagtattcacctggggttgcaataaggagggccaactaggatatggcacttcaaactcagcatcaaactgtatcccaagaatggtggagtacttgaaaggaaaagtacttagaggtgtttctgcagcaaagtatcatacaatagtgttaggagctgatggagaggtgttcacttggggccatcgccttgtcaccccacggcgtgtcggagtagctcgatgccttaagaagggtggaaatacaaatctgaagtttcatcgtatggaacgacttcaagtgatttcagtggctgctggaacaacgcacagtactgctttaacagctgatggtgctcttttctactgggtttcatcagatcctgatctaaaatgccagcagatattttcaatgtgtggaaggaatatcgtgaacatctcggctggaaagtactggaccgctgtggctacatcaactggtgatgttttcatgtgggatgcaaagaaacgtaaggacgaaacgccaattttcactcgggtgcatggtgttaagcgagcaacatttgtttgtgttggtgaaacgcacatgcttgtgctctcaagtatataccatcctgagtatccacccaaacctaaaagccaaggcttaaaatccatgttagaatggaacggtggaacagaagagctgggtgaagatatcctgtttgatgatgttcagcccaacagtggtttatcaggaagcagtggtgaaatgagcaaaggtgtgcctagcttgaaaagcctctgtgagaaggttgcagttgagtatttattggagccaaaaaacgcaatacagcttcttgaaattgctgattccttggaagctaaggagctcaagaagcattgtgaggatttagctattcgcaacctcgattacattttcacagtgggagcttcttcaattatgaatgcttcttctgaaattcttgtgaacttagagaaattgctagatgagaaatcctcagagccttggagtcagcgccgtcttcccacaatgacagctacctatcctgctgtcattgacagtgatgtagaggaagatgaagcaagagaattccccaagacccgtaaatgtgggaaatctgcatcaaggccatctgcgatgtctagtgatgacagcttccttcagaaagactgcaccgctgaacaagccgtctctaagcagatcagagcacttcgcaagaagctgcaacagattgagattctcgaggctaaacaacttgcaggtcatcagcttgacagtcagcaggtagcgaagctcgagtctagggctgcccttgaaggtgaacttgctgaacttggcattccctcagagatatactcaacttcctctgcttgtccagcagaaggtaggacaaacagaaaacctgaggtttctaagaaacagaagagaaagaacaagcagtcaacacagaccccgtcagtgaaaaatgagcctgggcaacaaatccccattacggaacttcaagttctacaagtcaatgtctctgctgaaaaggaggcgtatgccgctgatccaattaaacctatggaggctgccgcgttcagcaacacaaaggacaccgcttctccaccggagaagaaaccttcccaaccaactccatcaaagaagaagaacagaaaaggcggcctgtcgctgttcctgagcggcgctctcgacgacaccccaaaaccaagcctccctgcccccgctgtgcctgccacaccgaagcccgaaggacccgcctggggcggcgtgaagataaccaagggacccgcttcgcttcgagacatccagaccgagcagagcagaacaaacgagcccgcgtcggccaaggcgaaggaccgccacgagaactcgccggacagcgccggccgcgcgacaagactctcctcgttcattcccgacgcgcgttccagcccagtagccgtcgtggcgcctgctcgcgcagcggcggcgccttcttccgaaggtgacaggagcacgccgccgtggtcgtcctctgccacctcgcccaacgtgtcgcagccttcgctcagggacatacaacagatgcagcagaagaggcaccatggcggcgtctcccacagcccgaaaacccagacatcgggcttctctataccgccccacggcggagcgccagaggccgctggcggtggcggcgtgaaggacaacgtgcccaaccggtggttcaggccggagaccgacgccccgtcctccatccgctccatccagatcgaggagcaggctatgaaggacttcaggcgcttctacagcagcgtgaggatcgtcaagccgcaggtctagtagcactggcggcggcggcggtggcggccttggcggagagtgactgatggcacaacaaccccctttaggctcaccctcccatttgacactggctcgttgtacattcgagtgtacagttggttctgttcgccataggttccttgagctgaacaataaacaaacaccctttgctgctgttgctgctgctttcgcagtgagtggtctcgtttagttgtaacagaagattgtacaggccatgtgagatcaccaccccccggctttggcttaacagtttaacttgagccaatgcttcttttttttttttttggcgccaaaatgtctttggttgttccaagcagaggtcataaaaactgtgtggtgcgtctgcacccaggtacccaacatttttagcttcgatcggacatgatctcactttggggctgtagcctagtgcttctatatgctctcgatctgcttgactggtcggtgtgagaatttggtagatagcggcatacttgtgctgttgtgcaatagtagcactatgcatggtcatctgctaagatcgatggcagctcgtaattaatggagctagtctgcctggttcagtagcttgtcgcctatggctatcggtaataaggccggttgcaatatttttttgtttggtgagcactagctagccatgaggcgatcaaatgtcatgtgctcccatgaaccctgatgacatgtatcttcacacctttgcgtgtgtgtatatatataaaaaaagagcaagctttcttttttcctctttctatccatggaatcctgctgggtcccacagctgcaccgccggaaagaggaggagagagccaggaggatggcgggaagtcctctctctctctccaacttttgcggctctttctcgcggcgctttctgccatgcacgcggcatttctaaccagtcttcagtctcagccatccgccggcgttctatacgtagtagagccttatgcccttatcgttcgtaatcgtttcactttgattgacagttacacacatgcatgccaaagggaagggaggacatggggatcctgatcgactctcagctgtccttcgtcttcgtcctcatgcatgtccagaaaggaaggaataggcagaaaaacagcctggcaggcagtgactctccagcaatggacagtggttgtggttcaccgcgcaagtcatcggagcttataaagactggttcgaccgccggccagtcatgtgctgggcacgtacgtgaggagcaagtgcccaccacctgatccatggggcgggcggccggcgatggtggaatcgccggtccacttttttgcccgcggctttctgactagatttctgccgtttctagctactatagtgactagatttttgcaccgcgtttctagcactagagtctctctagagcctcattcgtcgtttcacacatatgcccatatatatggccaagggacatgggattcctggtggagtgagctgtctgttcgtcttcgtcgtctccgtcactaaactcactttatagggaggagagacatggtgcatgcatggcccgaaaggtggcaaagtatatcttgcttattgatacaaaggcagatgctgtctgtgtggggccggttaatttcttctagccatgaggaacctttgcttcttgtaatactcaaatttatatacaaaggatatattatatctcctcattttatgtgcctcatttgcatcataagaaaagagcacacacacaatttagagattaagtcaaacaaatgataaaaaaatgcatcatgctggagtttatatgtttgtgcattaaataaaataataatgttaatgataataatataataatgactagaagttgaattaaaacctaaaattaaaattagggttttgaaaatgagaagaagagaaaggatataaaaatataaataatataattatata

SEQ ID NO: 8741 - DNA, 1012 bp, Zea mays
ttgggtacctcgaggccggccgggataaaacctgcccctcgaggccggccggcgggcgcatcccccggtgaggtgagcagaccactcctccactagtcccctgtccggctgtcccctccttcgtgtcggagcctgcgcctcggcttgtccccaccaacccgcagctcgctcccaccaaacccacacccgaacaatggcgtcggcgtccaaggaggaggtgatcgggaagctcaacatccgcgtggtgcggggcaacaacctggccatcgccgacccgctcacccacaccagcgacccctacgtcgtcctccagtacggcgctcagaaggtgaagactagtgtccagaagaagaaccccaatccagtgtggaacgaagtactgcagctctcagtaacacatcctacgaagccagtgcaccttgaagtttttgatgaagacaagttcacagcagacgacagcatgggtgttgctgagatcaacattactgacatctacgatgctgcgaagctggacctgaagcacgcctctgatgggacaaggatcaagacgatctaccctgtcggagtaaactaccttggcggcgagagccatgttcagtggaaggatggcaaggtggtccaggacttgattctgaagctgaggaaggtcgagagtggcctgattgtggtgcagctggagtgggttcatgttcctggcgtgaagctgtgaaggccctgtctgaatgagggctgatggagctgcagttgctgtgtccctggtttgattgtttggttgtaaacgatatcctgaacgtggtgatatgcggtgtatgagtgaggtttgagtgtgatgctttgtttggggtacttcctggtgacatgatgtgggtatgactgccaaaggttgtggcgcaccaataagaaacgccctgtcagcatgacagcatgttgtgagatgtaaactaagactttagaacctaaatatacaggtgattgggcgttaattgccaaaaaaaaaaaaaaaaaagcggcc

SEQ ID NO: 8742 - DNA, 2789 bp, Zea mays
cattgggtgcctcccgcccggccgggccggcggcctcgctgcgccggcctcccaatcgatcgaggcggcgcagagcagaggaaaaccccgagccgcaaccctcctcaccgcacagcaactcgagtcctcgttctcttccccatcctcctcctcgtcaactccagtcgtcttcagcccttcaccacaatcaggcccacctcccaccaccacatttcttctcatccaaccgccccgtaggatcacagagaagggggatggcgagcggcggggcggtgagggatgtgggctcgcctgcggagctggaggcggcggtggccggggcgcgggcggcggccgtgcacttctgggcgtcctggtgcgaggcgtccaagcagatggacgaggtcttcgcgcacctcgccgtcgacttcccccacgcggccttcctgcgggttgaagctgaagaacaacctgaaatatcagaggcatatggagttacagcggttccatattttgttttctgcaaggaaggaaaaattgttgatactttggagggagcaaacccagccagcctggccaataaggttgcaaaagtagctgggcctgctagtgttgctgagtctgctgtacctgctagccttggagtcgctgctgggcctgctgtacttgaaaacatccaaaagatggcacagcaaaatggatcctctgctgctgaaagcacaaactctggcagtactcaagatgcattgaataagcgattggagcagcttgtcaattcccatcctgtgtttttatttatgaagggaaccccagaacaaccaaggtgtggtttcagccgtaaagtggtgaacattttgaagcaagaaggggtcaaatttgggagctttgacatccttacagataatgatgttcgtgaaggtatgaagaagttctccaactggcccacttttcctcaactgtactgcaaaggcgagctgcttggtggatgtgatattgttattgctatgcatgacagtggtgaattgaaggatgtttttgaggagcacaatattccccttaaaccacagggtagcaaaaatgaagaagcaggtcagcccgagtctgcaactgagaagggtgctgcagctgctgaaccaatcgggcttactgatgctcagaaagctcgtttggaaagccttactaattccagcccagtgatggtattcatcaaaggtacaccagaggaaccaaagtgtgggttcagtgggaagttggtccacatacttaagcaagagaatattcctttctcaagttttgacatcctttcagatgatgaggttagacaggggctgaaggtgctctcaaactggcccagttaccctcaactgtacataaaaggtgagctggttggcggctcagacatagtgatggagatgcacaagagtggtgagctgaagaaggttctgtctgagaaaggggttattccaaaggaaagcctggaggacagattgaagtccctggtttcctctgcaccggtgatgcttttcatgaagggcactccagatgctcctcgttgcggcttcagttcgaaggttgtgaacgccttgaagaaggaaggggtcagctttgggtccttcgacatcttatctgacgaggaagttaggcaaggtttgaagacgtactccaactggcctaccttcccccagctctactacaaatcggagctgattgggggatgtgatatcgttcttgagatggagaagagcggagagctgaagtcgaccctgtcagagtagacacctagcattcttgcttcgctggcgtttttaccatattgcctgcattggatcactctactctggtattcatgccattgtattcatagatccacgttggtacttgtctgcagtgccacattgctagaattgtgacacatctgcagaaggaataacttacgcttgttcggtactgattgcattgttcttatatcaccagttctatttagcgggtggaagcttttttgttcgggtattgtcacgatttatagacggataaagtaaaatatttatagagtatatgtgtacgtgtaattgtgtatttaagtcatgccattgttcttgggaagtcacatgtggaaaattgactttcacaatgaacaagcttataaatctaattagaagtggttcgtacaacatttattcacaggaacggagataaggctggctcaaggctccagcaagggcagctaatagaactatgtgaagaaatttaattaaaaaaactaaatttaatagttatagcaaataattttataattgtgccaaaatggtacgtgtaggtctatatagtgtagcaacatatcataaaagtttggttaggaaaagaaaaaataaaaaaagtttggttgagaaaagaaaaaaaataaaaatatactttgccgagtgtcaaaggatgacattcgacaaatcattctctgccgggtgtcttatgtctaacacttgacaaagaagcttctttgtcgagagccaaaacctggattttggtaaagataacggtcgtcagttataaacggctgctaatggctctttgctgagcaccgcccttcgccgagtgtttggtactcgacaaagatttctttgtcgagagtcctgctttcggtaaacgcggtcattaccgagagcaggactttaccgaacgggtcactcggcaaagagccaggtttcaatagtgactcatcggggcctcatccctagcttctgccagtttcaatccgagatggcctgaagataaacttatggacgagagctgctggtcagataaagacttctgca

SEQ ID NO: 8743 - DNA, 2130 bp, Zea mays
cattgggtacctcgaggccggccgggctgctgctccgcccctccgaccgatcgaggtggcgcaaagcagaggaaaaccccaggccgcaaccctcgcaaacactcaagtcctcgtcccttccgcactctcctcttcaactccagccgctttcaccgccaatcagaggtccaccaccaccaccaccacatctcttcgcatccaaccgccccgtaggatcacaggaaacggggatggcgagcggcggggcggtgagggaggtgggctcggccgccgagctgcaggcggcggtggccggggcgcgggcggcggcggtgcacttctgggcgtcctggtgcgaggcgtccaagcagatggacgaggtcttcgcgcacctcgccgtcgacttcccccacgcggccttcctccgggttgaagctgaagaacaacctgaaatatcagaggcgtatggagttacagcggtgccatattttgttttctgcaaggaaggcaaaactgtcgatactttggagggagcaaacccagccagcttagccaataaggttgcaaaagtagctgggcctgctagtgttgctgagtctgctgtacctgctagccttggagttgctgctggacctgctgtacttgaaaacatccaaaagatggcacagcgaaatggatcttctgctgttgaaagcataagctctggtagcacagaagatgcattgaataagcgattggagcagcttgtcaattcccatcccgtgtttttatttatgaagggaaccccagagcaaccaaggtgtggtttcagccgtaaagtgattgacattttgaagcaggaaggggtgaaatttgggagctttgacattcttacagacaatgatgttcgcgaaggcatgaagaaattctccaactggcccactttccctcaactctactgcaaaggtgagctgcttggtggatgtgatattgttgttgctatgcacgaaagtggtgaattgaaggatgtttttgaggagcacaacattacccttaaaccacagggaagcaaaaatgaagaagcaggtgaacctgagtctgcaactgagaagggcagtgcagtttctgaatcaatcaagcttactgatgctcagaaaactcgtttggaaagccttattaactccagcccggtgatggtattcatcaaaggtacacctgaggaaccaaagtgtgggttcagtgggaagctggttcacatacttaagcaagagaacattcctttctccagttttgacatcctttcagatgatgaagttagacaggggctgaaggtcttctcaaactggcctagttaccctcaactgtacataaaaggtgaactggttggcggctcagacatagtgatggagatgcataagagtggtgagctgaagaagatactatctgagaaaggggttcgtcaaaaaggaaatctggaggacagattgaagtccctgatttcctctgccccggtgatgcttttcatgaagggcaccccagatgctccacgttgcggcttcagttcgaaagttgtgaacgccttgaagaaggaaggggtcagctttgggtcctttgacatcttatctgacgaggaagttcgacagggtttgaagacatactccaactggcctaccttcccccaactctactacaagtcggagctgattggtggctgtgacatcattcttgagatggagaagagcggagagctgaagtcgaccctgtcaatgtagacacctaacctagcattcttgcctcgctggcgttcctatcatattgcctgcattggatcattctactatgacgtttgtgccaatgtattcatagatccacgtttggtgcctgcagtgccacattgctagaatcgtgacatctgcagatggaataacttgagagcttgttcggtactgattgctcttttatcaccagtctatttagcggatgagagttttttttgttcgggtattgtcacgatatattgcagagtatgagtaattgtgtgtatttaaaggtatgtttggttgctgcacagaaaaaaaaaaaaaaaaaaaaaaagaagaacaaaaaaaaaagaaacaaaataaaatacaaaagcatgaaaaaaaaataaatcatatataaagagggctgact

SEQ ID NO: 8744 - DNA, 4637 bp, Zea mays
  misc_feature (475)..(475): n is a, c, g, or t
  misc_feature (662)..(662): n is a, c, g, or t
  misc_feature (845)..(845): n is a, c, g, or t
  misc_feature (879)..(879): n is a, c, g, or t
  misc_feature (1175)..(1175): n is a, c, g, or t
  misc_feature (3591)..(3591): n is a, c, g, or t
cgcctttgctgatgtctcccagccttacacagttaatcaatgtcaatgatccgggagatgcggttcatatcccaagccggtggtgagctctgatggcattgcggctggaccttatttgcataaataggagagttgccacccggtggtgagcatgccaggcccatgtctgaatgatttgcccgctcaaggtggcattcctccacctctaccaatgagcagaatcccatctcctgatctccttgcacctcgggagcagccttggtatcagcagagaactattcttgatcacctaggagtcgatgactacttctttgcccgggaacaccaaatgagtctgcagagggagtatgaaatgaagaggcaagtcattccattggaacatcgccacacggacagggagtctgttgagaagctagagtggctgcacaggatgatcgcattgtatggtaggaagtgaaggatctttgggaggtgncagtatgaaggagctgggcctaccagttccaggcttctataggactacaggtaaaggtcattttgtatggcatgcactgaccacgggcaatgcgatgagttgctaacttgctattttgttgttaatactgtctgtacgttgtactcctaggcagttaagcatgcctgcttttgaagtggagctgttngaagagagttcctgattagttgctcattctgcaatagagtatggcttacattttcgtggggtgcaacattggtcacacaaagatcatgcatggtagagaaatgaagctgcgttatatgcttagccaattagcttatatactccatacgttacaaattatggtttactttagttttgccctaanttacactttcctaattttgatcaaatttacaganaaataattagctaatagctaactatttacaatattaaattaggcgatgtttggattcactagcgataatagttagctagctaagtagctaatagctaacaactactaactattagctagctaattattagtaaggtttgcttcgatccatctactaatataggtacttgaatagttggttacatgtttatatttactactagcactcatcaccaagtaattaacatcttcacttgctaatagttagtagattgtttggatcaccactcagctaattcagctgttaactattagtgncaatggatccaaacatatccttagggcttaattatataatctagattataatatgtcgagattataatttgtatatagctgtttggatgaacagattatatgaatgaagattattgatttttcagacataaaggcaaagacaacaataccctacatgcatatgatttgggaaaagaaaaaaatgacatacattgtaattttataaacgtaaccatggatagtggatcttttactaaaaataatctcaaataagctattcttgaagagattatgagattaccatagtatgtactttagattatataatctagacctataatctaggtgtttgtttatctgctaaattatttacgctggattatataatctggacagattataatctgaaacaaacatgcctttgatctcattaaactctgcaaaatatattttcatagcgtatacatatttttatagagtatttacttgaatttgtagatgtggctagaaatgtccaaacgggtcgcttggtattatacattgtagcacgggcacaattagttccgaactgtacgacagactcatctttgtgaacgagtcagacatgggatagactcgataggttcatagttttctctactaactgaaaaacgaattttggcccgattttaaatggatttggattcaaaatataaaaatacaaaagtcaaattttggtcaacaaaatgaaatttggatcattccaaacaaaattgtggaccctcgttccatggtgatgaattgatggtattgcattttttgagtaatatgtagaccatggagctggaaatttaatctcatatatcttctaattttctattgctgtgacttaaatatgttgtctattttttttgactatgcagatggcaaggacacagaagaacaaagccactgctcaccatcttggtcttctgaaggtaacttgaaatatactctaatctttatcttagaactcttacctatggtaatttctgtcattcactttaatgagtttaagattcccactccatatgaggccattaggacatctgcatatcatttcaagtttaagagcatgatataataacacaaaaacatcttctcatagccgtaaaggggtcaacattttgaagcaagaaggggtcaaatttgggagctttgacatccttacagataatgatgttcgtgaaggtatgaagaagttctccaactggcccacttttcctcaactgtactgcaaaggcgagctgcttggtggatgtgatattgttattgctatgcatgacagtggtgaattgaaggatgtttttgaggagcacaatattcccctcaaaccacagggtagcaaaaatgaagaagcaggtcagcccgagtctgcaactgagaagggtgctgcagttgctgaaccaatggggcttactgatgctcagaaagctcgtttggaaagccttattaattccagcccagtgatggtattcatcaaaggtacaccagaggaaccaaagtgtgggttcagtgggaagttggtccacatacttaagcaagagaatattcctttctcaagttttgacatcctttcagatgatgaggttagacaggggctgaaggtgctctcaaactggcccagttaccctcaactgtacataaaaggtgagctggttggcggctcagacatagtgatggagatgcacaagagtggtgagctgaagaaggttctgtctgagaaaggggttattccaaaggaaagcctggaggacagattgaagtccctggtttcctctgcaccggtgatgcttttcatgaagggcactccagatgctcctcgttgcggcttcagttcgaaggttgtgaacgccttgaagaaggaaggggtcagctttgggtccttcgacatcttatctgacgaggaagttaggcaaggtttgaagacgtactccaactggcctaccttcccccagctctactacaaatcggagctgattgggggatgtgatatcgttcttgagatggagaagagcggagagctgaagtcgaccctgtcagagtagacacctagcagcattcttgcttcgctggcgtttttaccatattgcctgcattggatcactctactctggtattcatgccattgtattcatagatccacgttggtacttgtctgcagtgccacattgctagaattgtgacacatctgcagaaggaataactcacgcttgttcacgcttgttcggtactgattgcattgttcttatatcaccagttctatttagcgggtggaagcttttttgttcgggtattgtcacgatttatagacggataaagtaaaatatttatagagtatgtgtgttcgtgtaattgtgtatttaagtcatgccattgttcttgggaaggcacatgtgaaaaaattgactttcaaaangaacaagcttatataaatctaatttcaaaatggttcgtacaacatttattcacgggaacggagataaggagctgtaagtattctcagacattattctaattccacttctaattccacgtgaatgggagtggattagggtggactttgacttctatagatttaaatcgactcaatactatccagtatagaactaatttacaccataaatcatcttaatctatgtggattgagacgaataagagccttaatctatacagttccgttgcaacgtacggacactcacctagtgtatatatatatatatatatatatatatatatatatatatatatatatatatatatatatatatatatgatagaaggcccaaagagtttctttgccgattttttttaccgagggttttttatttgacactcggcaaaaaccttctttaccgagtgtccgaaaaaacactaggcaaatcatttgacatttggtaatgtgtcgttttccggtggtgttgctagtgttacaacttattacaaagtcacatatatttattaggatggtaaaccttacatatactccggtgatggaacgcccaaaacgtatgctacaggctacgtctacatgcatatatagcagtatatacctcatcttccaccagaaacaacagatgttgtaccaatgcttgctgtggatcccgtgacgacgtagtcatcgaatccttcattctgcattatcgccatcatgtgaaggctcatatccgttggcgccatctccggtagcggcacctcaccgtcaaggtactgcatgacctgccgtgcggtaggcctcgacttggagaaggggtgagagcatagcagccctagttttagtgccaaacaagcctccgcagcgttgtagtcccctccaagcctggcatccacagtttccagcagtgctccactgcttgcccaacgctcaaggacccaatccaccagcatgcactggctttcctcctgtgagctttcgtcgtcaccgacgacgacgacgacgacaggcctcctgccacatgtaatctc

SEQ ID NO: 8745 - DNA, 2512 bp, Zea mays
gcagagagaaaagggaggagagaggcggccgcacgaccatcttggcgtccgggccgcgtgtgagctgaagtttgggtcggtgatcgtcgcgtgttcgcggtggagctttccgctggtgagccaagtggagtcggtcgggaaagcggcccgaattgctcaccaccgtcgttgacccgcagacttccgccgtgcgccgtgggcgagcctcctggtgacctaatccccgaccccaaaaaaaatcgcccggcacagtgggccacaagcatgcatcacagggcggttgacgcgcgcagcctagcaagaaaccggcccagcttgccacgccgataccgcggcccacctagcctcggtccggcggcccgtcgctttcccacgtgccccccgcggccggccgaagtcgccgtcgcggcgccgcgcgggagcccccagaaaagccgaggaggaggcagcgtacaccttctgcctcgctgcgccggcctcccaatcgatcgaggcggcgcagagcagaggaaaaccccgagccgcaaccctcctcaccgcacagcaactcgagtactcgttctcttccgcatcctcctcctcgtcaactccagtcgtcttcagcccttcaccacaatcaggcccacctcccaccaccacatttcttctcatccaaccgccccgtaggatcacagagaagggggatggcgagcggcggggcggtgagggatgtgggctcgcctgcggagctggaggcggcggtggccggggcgcgggcggtggccgtgcacttctgggcgtcctggtgcgaggcgtccaagcagatggacgaggtcttcgcgcacctcgccgtcgacttcccccacgcagccttcctgcgggttgaagctgaagaacaacctgaaatatcagaggcatatggagttacagcggttccatattttgttttctgcaaggaaggaaaaattgttgatactttggagggagtaaacccagccagcctggccaataaggttgcaaaagtagctgggcctgctagtgttgctgagtctgctgtacctgctagccttggagtcgctgctgggcctgctgtacttgaaaacatccaaaagatggcacagcgaaatggatcttctgctgttgaaagcataagctctggtagcacagaagatgcattgaataagcgattggagcagcttgtcaattcccatcccgtgtttttatttatgaagggaaccccagaacaaccaaggtgtggtttcagccgtaaagtggtcgacattttgaagcaggaaggggtcgaatttgggagctttgacatccttacagataatgatgttcgtgaaggtatgaagaagttctccaactggcccacttttcctcaactgtactgcaaaggcgagctgcttggtggatgtgatattgttattgctatgcatgacagtggtgaattgaaggatgtttttgaggagcacaatattcccctcaaaccacagggtagcaaaaatgaagaagcaggtcagcccgagtctgcaactgagaagggtgctgcagttgctgaaccaatggggcttactgatgctcagaaatctcgtttggaaagccttattaattccagcccagtgatggtattcatcaaaggtacaccagaggaaccaaagtgtgggttcagtgggaagttggtccacatacttaagcaagagaatattcctttctcaagttttgacatcctttcagatgatgaggttagacaggggctgaaggtgctctcaaactggcccagttaccctcaactgtacataaaaggtgagctggttggcggctcagacatagtgatggagatgcacaagagtggtgagctgaagaaggttctgtctgagaaaggggttattccaaaggaaagcctggaggacagattgaagtccctggtttcctctgcaccggtgatgcttttcatgaagggcactcccgatgctcctcgctgcggcttcagttcgaaggttgtgaacgccttgaagaaggaaggggtcagctttgggtccttcgacatcttatctgacgaggaagttaggcaaggtttgaagacgtactccaactggcctaccttcccccagctctactacaaatcggagctgattgggggatgtgatatcgttcttgagatggagaagagcggagagctgaagtcgaccctgtcagagtagacacctagcattcttgcttcgctggcgtttttaccatattgcctgcattggatcactctactctggtattcatgccattgtattcatagatccacgttggtacttgtctgcagtgccacattgctagaattgtgacacatctgcagaaggaataacttacgcttgttcggtactgattgcattgttcttatatcaccagttctatttagcgggtggaagcttttttgttcgggtattgtcacgatttatagacggatgaagtaaaatatttatagagtatatgtgtacgtgtaaaaaaaaaaaaaaaaaaaaaaaaaaaaaaaaaaaaa

SEQ ID NO: 8746 - DNA, 2057 bp, Zea mays
aattcggcacggagggactccaagaaaagccgaggaggcagcctcgctgtgctcctgctgctgctccgcccttccgaccgatcgaggtggcgcaaagcagaggaaaaccccaggccgcaaccctcgcaaacactcaagtcctcgtcccttccgcaccctcctcttcaactccagccgctttcaccgccaatcagaggtccaccaccacatctcttcgcatccaaccgccccgtaggatcacagaaaacggggatggcgagcggcggggcggtgagggaggtgggctcggcggccgagctgcaggcggcggtggccggggcgcgggcggcggcggtgcacttctgggcgtcctggtgcgaggcgtccaagcagatggacgaggtcttcgcgcacctcgccgtcgacttcccccacgcggccttcctccgggttgaagctgaagaacaacctgaaatatcagaggcgtatggagttacagcggtgccatattttgttttctgcaaggaaggcaaaactgtcgatactttggagggagcaaacccagccagcttagccaataaggttgcaaaagtagctgggcctgctagtgttgctgagtctgctgtacctgctagccttggagttgctgctggacctgctgtacttgaaaacatccaaaagatggcacagcgaaatggatcttctgctgttgaaagcataagctctggtagcacagaagatgcattgaataagcgattggagcagcttgtcaattcccatcccgtgtttttatttatgaagggaaccccagagcaaccaaggtgtggtttcagccgtaaagtgattgacattttgaagcaggaaggggtgaaatttgggagctttgacattcttacagacaatgatgttcgcgaaggcatgaagaaattctccaactggcccactttccctcaactctactgcaaaggtgagctgcttggtggatgtgatattgttgttgctatgcacgaaagtggtgaattgaaggatgtttttgaggagcacaacattacccttaaaccacagggaagcaaaaatgaagaagcaggtgaacctgagtctgcaactgagaagggcagtgcagtttctgaatcaatcaagcttactgatgctcagaaaactcgtttggaaagccttattaactccagcccggtgatggtattcatcaaaggtacacctgaggaaccaaagtgtgggttcagtgggaagctggttcacatacttaagcaagagaacattcctttctctagttttgacatcctttcagatgatgaagttagacaggggctgaaggtcttctcaaactggcctagttaccctcaactgtacataaaaggtgaactggttggcggttcagacatagtgatggagatgcataagagtggtgagctgaagaagatactatctgagaaaggggttcgtcaaaaaggaaatctggaggacagattgaagtccctgatttcctctgccccggtgatgcttttcatgaagggcaccccagatgctccacgttgcggcttcagttcgaaagttgtgaacgccttgaagaaggaaggggtcagctttgggtcctttgacatcttatctgacgaggaagttcgacagggtttgaagacatactccaactggcctaccttcccccaactctactacaagtcggagctgattggtggctgtgacatcattcttgagatggagaagagcggagagctgaagtcgaccctgtcaatgtagacacctaacctagcattcttgcctcgctggcgttcctatcatattgcctgcattggatcattctactatgacgtttgtgccaatgtattcatagatccacgtttggtgcctgcagtgccacattgctagaatcgtgacatctgcagatggaataacttgagagcttgttcggtactgattgctcttttatcaccagtctatttagcggatgagagttttttttgttcaaagattgtcacgatatattgcagagtatgagtaattgtgtgtatttaaaggtgaaaaaaaaaaaaaaaaaagcggcc

SEQ ID NO: 8747 - DNA, 861 bp, Zea mays
tcgggatctttctcctctctctttcagtttctagatcggaccgacttcatctctatcgtgcacacgctggcagctccggccgcggtcgctcgcctacctggccatggccgcggcggcgcccgctcgctcacaaggttttggtgctggcgcggcggcgtccgctcgcacgcccgcctggccgtggtcccggtgccggcgtggcggcggttgcgcctgctcgtgtatagtggatgtgcagcctccctgccttggtgcttgcacgcaacttcttcttctctctcttctattactgatcgaagcagcgtccgcgcagggcttgaaggtggctgtgctcgcacgcgcttgttcgacggcgacgcccaccctcacatgctgggctgcggtggtgcttgcccgtgcgcgatgtggtcgcggtggcgcacgtccgcgcgctctcagccgtgtggcagcggctggtgctgcacgctcgctcgcccacggagtggtggcagcggcgtccgacatgcgcgcttgcctgcgaggcggcgacagggtccatgctctcctgtgatgaggcaacagcggcggggacaaggcccacacattcgctcgtacatgctcgcagcgacgacctacgttccatcgagcggtggctactagcacgcgcaacacatggtgacttgtgcgaggttctcacaagctcatgagcttggctggtcttaccgccatgtaaggatgacaacatgtccctattcctttctatctaaaaacaattcctttggaaaaaaaaaaaaaaagttttatttcttgattctgtttgttttgcatctcattcggcttcaagccagcgattaaatctgctaaagagatgttttttttctc

SEQ ID NO: 8748 - DNA, 2696 bp, Zea mays
ggttagggaagttgccctttctgtatttagtggcattaactcaagtattcggcacgagggacaaacgagtagtggaaagacttataccatgaatggagtaacagaatatacagtagcagacatatatgattacattaataagcatgaagagagagcatttgttctgaaattctcagcaattgaaatatacaatgaagctgtaagggatcttctgagtgcagaaaacactcctcttagactctgggacgatgcagagaagggcacctatgtggagaaccttacagaggttgtgttaagggactggaaccacctcaaggggcttatttctgtatgtgaagctcaaagaaggacaggggagaccttcttgaatgaagaaagctccagacctcgccggcgactgaggctgacaattgaaagttctgcacgggagttcctagggaaggacaagtcaactacacttgtcgctagtgctaactttgttgatctagcaggaagtgagcgtgcatctcaggcgttgtctgctggcacgaggctaaaagaaggctgccatattaacagaagtttacttgcccttggcactgtcattaggaaactaagcatggggagtaatgcacacataccatacagagattcaaagctcacacgcatattacaaccttctttaggaggtaatgcaagaacggctattatctgtacactgagcccgcgacagcaacgtattgagcattcaagaaatactttgttatttggaagttgtgcaaaggaagtagttacaaatgctcaggtaaatgtggtcatgtctgataaagcactagtaaagcatttgcaaaaggaagttgctaggttggagagtgagttgcggcaaccagcttcaaattccagtcttgaagcattagtaaaggaaaaggataaccaaattagaaagatggagaaagaaattaaagaactcaagtcacagcgtgatttggctcagtctagattgcagaatttgctggagactgttggggaccaagtgaagcactcgggctcagggaagcgttcagcccgcagtcctccgtcaattggaatatccccaggcatcagcagggatgatagttctcagatctctcacgatgattcagatcttttcaaggacgtgcgatgcattgggaccagtgggacaggaggaaatgaacagttggacctgtcagctggtgaaagcagtagccttcaaggtttaaacatgaattctagtttgcatggaagcggttcaaatgcatcagtgaattctaggcgctcaaggctccttagtgaatctcctatcacattggagcagcatttggagaatatcaaaaggccttttgttagtcttggcagagatctaggatcgtcgacacataactcatcaggctccagaatacttggtagaagcaggagctgtagatcacttatgggttctaccatgtttgatggcatggagatggatgatggcacccctctgcatagaagtttggttggtttccctggaaggcctgaagggaatcatagaaggggatcaacaccgaaccatgacgcagaaagtgaaactctttcaagagcaggatccgtagtttcaaccaagacaaatgctgcatgcgatgcagagtttactggtataggtgaatttgttgctgaactgaaagagatggctcaggttcattaccagaaacagttaggcaatcagattacaaatggagaatttgtagacataaagaacattggtttggacccgattgctgatgcttcacaatcaccttctcgctggccattagaattcgagaagaaacagcaagagatcatcgggctttggcacgcgtgctgtatttccttagtccacaggacctactttttcttgctattcaagggagaacaagctgattcaatctacatggaagtggagctccggaggctatcattcctcagagatacctactctcggggaaacacccctagcaatgcggtggtaggcagcttgaactcttcccccgctgcgagcgccaagaagctgcagcgtgaacgggagatgcttgcgaggcagatgcagaagcggctcacggcagaggaaagggagcgcctgtacaccaaatggggcatttcgctggactccaagaagaggaagctccaggtcgctcgccggctctggaccgaggccgaggacctagaacatgtcagggagagcgcctcccttgtcgccaagctgatcgggctccaggagccagggcaagtcctcagggagatgttcgggctcagctttgcgccgcagcagcagccgccccctcgccggcgatcctccaatggctggagatacgggatcccttcgttcggctgatcggatcggatgaacggtgcgagcgactgaccaaagagatgtaactaccctccccccacttttttttttaatcttggtgtggtgtacggtaccttctgatttctgtagttttttagtaggatacctaccggggccatcatttgtttgtgcggctggcttcgtgcatgcttttctgcctagccgccgccgatcaggcctcaattgctgacgacatcgtcctatcctacgaccgtaattgtaattcctaactcttctgtgttatcgtgttgacgtgcgctgcaacagcgcaatagtaacgtgatgttccattccatcaggaaaaaaatcactgggactggtccctatagct

SEQ ID NO: 8749 - DNA, 2973 bp, Zea mays
  misc_feature (1509)..(1509): n is a, c, g, or t
cacctaagattagacaggtttgatcgagttagagatgtgtttagtttgtagccatagttatgaaaaaaaattctcctgttgtgtaggtcccacttataatgactctttaggcatactaaaatgtggcgtataatttgagctcctaaccttaggcaagtgtgacagaaaatgtgtggtaatttttggcaccttacatatataactaaacatggaggactgttttgttcgctgcctcacttgccacagtttacgacgcctaaagataggcatgtttgaccgtgttaagcgtgcatttggtttgtagccacaattgtggcaagatttttttctactgcgtaggttctactcgtcaatgacttgttaaagtatggcgagattaccttaggcatgacaaagtgcgacacacaaaatttgaacgcttaaccttagacaagtatgacagaaaatgtacaagtatgacagaaaatgtatgacaatttttggcaccttaggcatgcaaccaaacatgccttagccttcaagtttttcttttgatgggatgctatttatcctcttaacttgtttgcatatagttttatcctcaagtgggaaatatgaaataactgcagagtgttttctcactgtgatttgctagagtcctacattaattgtgtaccttatgcgagttatgttcttccactaattgattgtgtatcttgtgtgtcagatatcaatatcggatcctttcagtaaccctatcgcgaaaaaactatatgacgaatggctggggcaacctggttcagagaatgcaaagaagtatttgcacacagaatatcacccagtggtgaagagtgtggcctcacagttacagaactggtgatagaggtttcttgttgcactgggaattcctatgttcctcaagagccaagaggaacctgcaaaccgagcaaacatggcgacctgtccatgctaagcaaatatggatcacacaagaattaaacttactcaagtttttttggcattatggcgaagaagttttgttaacatataggttttcagctgctttctagttaaatgttgtgccagggaaacaacagctaaatcgcaatgtgtaaaatgaacgaagtaatgtgtaaaataaacaacagctaaacatggcgaccttttcattgtctggtacacgccctttgccacatttttttttttggtaaggaaggatagctcgttggttgcccgtatatgttttttagatgctcgggcatagtagagaagggaacgaaaaacatactcagtcccggtatattttagggattttaagacagataaaaaggacaacacaagagatgcacgtgcttttacttttttccagccagatatttcgttacatgattaatggtgaccggttgataattggtaaatatttaatgcaaaaactgttttctgttcctagaagattttacattcgtggttcaattttaagacaaattaaaaggaacaaaaaaaggtgcacgcgctttactctatttttantctgatgtatgttacatgattaatgacgttcagttaataaatgataagtatttaatataaaactattttctgtcccctagaatttttacatttgatgtatgggttcccctccgaggtcgcggccgggggaaaaaaacatataacgataggctaattaatggcatggcagcataaacaagccctaaagttatatagaagatttcatgtagcatacccagaacacacacacatggttgaaatgaagccatattccaatgtacattccagcaacattcgctaaatttatcttctatattcatcctttacggtcttctttaaaagaatctattctctatatttcctccttcaataatattttctatatctcattctttatacataaatatctatattagagacatattttacttttaatttttatacgtacgtatttgtcgtactcttaaatgtatgatacatattttagtttttctaaatctattgttttaaatattaaaatagatagaggagaggagagtgaaactatatatagaggatccagtcatattctctatatttagaggatgatttagatgacaccgttgaagatataaatgagataaatcttctctaaaatttagagtacaagacgctttaaagtaactgctggagagtcttaactctttcgatctccacagataataaagcaatttattatggattctgggaacaagaaaaggcatgaaggcacatcaactcggatgcaccgtcgacctctgacacaagttgcaacaaactagttttgtgttacttgataggccacaacgatctgataaatgcttcatcattaagtaatatgatatacaatgatacgctaacgctgacactgttgatctaagttaaagtctttaacttgacacagatgctcgtattttgctaattttatttcagaccgatcaaacttaggccttgtttggttttttttagtctaggactaaagtttaattagatgattaaagtttagtctctactctatttgattttagggactaaaagtattcagttaaacgaatcataagagtatcaaaatatcacttagcattcttctgcaattagtgtaactaaaataaagtaagtataagaagtgaaattaatatagtttagtccattttagtcatccattgagatactagagacaaacaatttagtctattttagtcctactattgaaaatttagagactaaatgagactaaaatagatggactaattttagtccctcaaaccaaaggcgtcattattctttcagatgtgcttacagaggtaatgtgtgcatatcagcatatgtgtgatgtgtatgtttatataggtgagtgtgcgtttgtatacgtcaaaaaaaaaaaagtcctaccaagcactcaagcaaaccttgcacaatgcctagaaagtagacctgatatcaaacaccatgtattatcacatctgc

SEQ ID NO: 8750 - DNA, 1288 bp, Zea mays
ctatctcttattgaagcatgcaatgaatttgtttcacgttatcagaaaaaccattcatgtagtggccaagaagctggagccaatcttccaatgatttcatctgcatgcccgggttggatatgctatgctgaaaagactcttggttcatacatcctaccttacatctcatctgtgaggagcccgcaacaggcaattggtgcagccattaagcaccatgtggctgagagacttggtctaaagccgtatcatgtatatcatgtcactgtgatgccctgctacgacaagaagctagaggccgtccgggatgatttcactttctcagtagatggtaaagaagttacagaggtggattcagtactgacaactggtgaagtgttagacttgatacagtccaaatcgatcgatttcaagacagtagaggaatcttcattggacagattgttaacaaatgttgatgaggaaggccatctatatggggtttctggaggttctgggggctatgcagaaacaatctttcgctatgtagcacatgtaatttacaagagagaaatagagggtcctcttgacttcagaatcctccgaaattcagattttcgtgaaattacactggaggtggagggcaaacctgttttgaagtttgcactttgttatggattcaggaacctgcagaatgttgttaggaagattaagatgggaaaatgtgaataccacttcattgaagttatggcgtgcccttcaggttgtttgaacgggggaggtcaattaaagcctgttgaaggccaatctgccaaggaacttatccagcaattggagagtgtgtacacacaagatatattaatatctgatcctttccgtaaccctatcgcgaaaaaactatatgacgaatggctggggcaacctggttcagagaatgcaaagaagtatttgcacacagaatatcacccagtggtgaagagtgtggcctcccagttacagaactggtgagaggtttcttgttgccctgggagttcctatgttcttcaagagccaggaggggcttgcccacagaacaaacatggcgacctgtccatgctaagcaaatattggtcatacaggaattgaaacttgtcccttttttgcattatagcgaagaagtttttgttagccctataggttttcagctgctttctagttaatgttgtacgctgccaacgggaaacaacctttaaactgcaatgtgtaaaatgaacggagtaggtcttgacgaccttttcattgtttgatactcgtcctttggcgtttttttttt

SEQ ID NO: 8751 - DNA, 1994 bp, Zea mays
tgcacgaggctcccatcctccgtcctcgatctgagcgttgtctgcttccctgcctccctccctccccttgcccagatggccgccttccgtgtcttctaaatcttccgccgcatcaagcttccctcacctgtcggctgtcctgctgctcctgctgccaatggcgaccaagggaggcaacgcgaggggcgtcccggtgggggtgctgctggtggccgcgctcctcctttgctccttggctccggcttccgcgtcctcgtaccccgcaagggtggtgagcgggttcctctccaatgcggcttcggcggtggtgaagcggctgtggtcgctcaaatccaccaccaagatagcagcgagcgggggcaagtcgatggtgaagtacgagggcggctacaccgtggagacggtcttcgacggcagcaagctggggatcgagccctactccgtggaggtcacccagggtggcgagctactcgtaatggactccatgaacagcaacatctacaggatggcgctgccgctgtcccgatatagcaggccaaagcttgttgctggttctccagaaggatttcctggtcatgttgatgggaagctgcgagaggcgaggatgaaccatccaaagggatttacagtggacgacaggggtaacatctatgtggctgatgccatgaacatggccattagaaagatcagtgatacaggggttacaactattgctggggggaaatcaggcagaggagggcatgttgacggaccaagtgatgaggcaaaattttctactgattttgaagtccgttacattggcagtagctgctcccttctggtgattgacagaggaaaccaagcaattagagagattcagctccactttgatgactgtgtgtaccagtatgaagctggttttcctctaggagtcgcactgcttctcgctgccgctttctttggctacatgcttgcactgctccaacgccgagttttagggatgtattcaaatggagatgaacaggaccacgagagcccagtaaaagcaaaattaaccagcattccacctccataccagaagccactgaagccttatgttcaccccctgctaattccaaatgacgacgaacctgtgaaacaagaggaggaagaagggctcttcacgtcaattggcaagcttgtgggtggagcaaaatcatcaattgcagagatcattggcgccgcattctccagaaagaagcgagtgaacgttcatcatcatcagctgggtaggccaacctcctggccagcacaagaaagctatgccatcccgcgggacgagaccccaccgccgctggacacaagggcgcccacccctcgcaaaaactacgccttcatgtccaaggagccggagaagatccaccacatccggcacggccggcctcagttacatggctggaccggagaggcagcacctcagccgccgcagccgcagcaggtgcgtcaccaacagtacgtgcaacaccacaggcagtactcggccgggccgcagaccttctacgagccgagctgcgatgcaacgaaggagatcgtcttcggagccgtgcaggagggggacaccagccgccgtcccgtggagatcaaggccgtgaaccatggggacgcggcgccgtacgagcagaacgggctgcgattccgcagcagttatagcgtgcgctacaatggcaactagtcgagtcgaggagcacttctgtagctgtaatgtaactgtaaggagaggagcgatagagagagcagtcgaggggagtatcaatctcctcattgacaagtgcaacagaaaagctggaattttggtagaagagcttggtgataatggtcattggactctttactggcggtgacatatataaatatagcgtgtatttttcttgttcttcttgggtctaattctatttttaataaatcaccttgcgtatagtcctatctttaataaacaaagtgtgtatttcttatcctatcaactgtttttcgttttg

SEQ ID NO: 8752 - DNA, 878 bp, Zea mays
ctcgaggccggccgggccgggacacacactctctctctgatcagtcatcgccaccggaccaccgtcacgcggagctctctcctactctcctcttcccctcgagacccccacctcctcgcggcagggaggagcggacgccagcccccaccaccacttgttcaatctctctcctctcccgtctcgcctcccggagcgcaagaaaagctcggattcctggtggtttctaccatcctccgtcctcgatctgagcgttgcctgcttccctgcccccccgctcagatgtccgccttccgtgtcctgtaaaatctttcgccgcgcagcaatcttcccccacttgtcggctgtcctgctgctgctgctgccaatggcgaccaagggagggaacgcaaggggcgttccggtgggggcgctgctggtggccgcgctcctccttagctccttggttcccacctccgcgtcctcgtaccccgcaagggtcgtgagcgggttcctctccaatgcggcgtcggcggtggtgaagcggctgtggtcgctcaaatccaccaccaagacagcagcgagcgggggaaagtctatggtgaagtacgagggcgggtacactgtggagacggtcttcgacggcagcaagctggggatcgagccctactccgtggaggtcacccagagcggcgaactactcgtcatggactccatgaacagcaacatctacaggatggcgctgccgctgtcccgatatagcaggccaaagcttgttgccggttctcccgaaggatttcctggtcatgttgatgggaagctgcgagaggcgaggatgaaccatccgaagggatttacagtggatgacaagggtaacatctatgtggctgatgccatgaaca

SEQ ID NO: 8753 - DNA, 2922 bp, Zea mays
  misc_feature (135)..(135): n is a, c, g, or t
gtgatgtgtattggtgacggtgctttatgtgaaacgtagacggtccactgctgagggtcggacggtccttgacctggcgtaggggctagggtttatgctgacgagtcaaacggtccgcgcctgatggctagatgntccgcgcgggcgcagaggcgacgggtccaccaacaacacctagatctcgctcttgggagggaccccgtcgaggagagattctagggtttgtcttagggtcagcaggccacctaagacacctctaaacgacgtggagtctaagagagacggagattagagagggaaaactatgttactatctactcctagagcaaaaatgtaaagaacggaaagtatattgattgtttgatcgattgttggtgattgcaatcggtcgtaccccttaatatatataagggagaaagtttggactcgttactaggcgtctcccaacaacaaccgtggatttagaggataaactcgcacagaaaacgattatttgcgtctgattcgatttattcgcggactgtccacgcctatagatgggccgtccgtgggccacagcatccggtcctcaagaccggaccgtccggccgtgaccagtgccacaaatgcttctcaacatgatgtgcatcatggttacccggatgtgtgtgtttagttttctccataacttgagctagtcatattggctctagccttgacaaggcaactcgtgaggtaaggtcagcaacaaaacaaacacgcccctcgcgtggtcaactgatcatgaccttatattgatggcagttcaataaaatagggatttgctaaatcacatgcgtctaatttttgctttattttcgggagatagtatctaatctgaatccaacaataaaaagtatcctaaactttatatttttaggaccaaacatctctgttgctgttaaaggggcgtttggtgtcctgactttagtaagtgtcaaaataaatgtttaaatatcaattacgagtattaaaaataagtttagttatgcttaataattcgtctcgctgtttagcttttatctatataattaattttataaatatttaatacttgtaattccctttcaaaatctaaagtaaactactgcgaccaaacataccggtcagcactcagccgtacaataggaaatgtgaaatacagtaggtgagcgcaaaagcttgagtacaatggcaatactctaccgatatcaaaccaatgtgacgtcaattcaagtctaaggagtactgatatattgaataaaatagtacttattatcactgaggctagctacccgctgcgttgacgtccagctcctgctcgttggtcgctggtgggcaccagcacaaaactgggtctcctcggttccgccccgcgcgtcccgcgggccccgcccggcggctacctcagccgccttccatggcgcccctctcctgccgcgaccttcccgcccggctaccgactcttccccaccatgctagcactcacccacacctctccttcctatcgggcggcccagcccctcgccgatggcgatcactcaccacctcaaacactctgcggcttcgcttggcggccactaaggacgacgcggtcgcctccctcgtcggaaggctcgagcacgacgtggcgaacgcccagtaccgcgacgacgttctggaagaagaagacgaagagcagcgggaggaggaagaagaggagcagcagttccttgacgacgacaacgctcggcgccgcggcgcggggaagcatcgggacgagctgcgcagtcggtggcgcgagatccacgggtgcgacgactgggcggggctcctggaccccatggacccgctgctgcggtcggagctgatccggtacggcgagctggcgcaggcctgctacgacgccttcgactacgacccgtcgtcccgctactgcggcagctgcaagtactcgcggcgcgacttgttcgagcggctgggcatggcggacgcggcgcgcggcctacgtggtgtcccggtacctgttcgcgacgtccaacatccggttccccaacttgttcccgcagtcccgggcgggcgccaggatctggagccagagcgcgagctggatcgggtacgtggccgtgtccacggacgaggagagcgcgcggctggggcggcgcgacatcgccatcgcgtggcgcggcacggtgacgcggctggaatgggtgtcggacctcatggacttcctccggcccgtggcggaggagggcatcccgtgcccggaccgggaggtgaaggtgctggccgggttcgtggacctgtacacggaccgggaccccagctgccggttctgcaagtactcggcgcgcgagcaggtcctgacggaggtccgccggctggtgggccgctacacggcggcgggggaggacgtgagcgtgacggtgaccgggcacagcctcggcagcgcgctggccatgctgagcgcctacgacatcgcggagaccggcgcgaacatggaggccgcgcccgtgtgcgtgttctcgttcgggggcccgcgggtgggcaacacggcgttcaagcggcgcttcgaggaggagctcggggtgagggcgctgcgggtggtgaacgtgcacgacaacgtgacgcggatgccggggatcctgctgaacgagggggcgcccgaggtggtgcggcgcgtggcggaaggcctgctgcgtgtgccctggtgctacgcccacgtcggcgtggagctgccgctcgaccacaagcgctcgccgttccctcaggacacgctgggaccccgcgtgctaccacgaccctggagcgcacctcccactcatcgacgggtaagcagccacctaaccttaacagtaacagacagcgtcgccgtcgtcgcttcattgcttgacatcttgaggacagctatcaccaggcaaagcggttgccgctgcggctgtgtcc

SEQ ID NO: 8754 - DNA, 1716 bp, Zea mays
acagttgttgaaccttgactactagctagagagacaaatatccaggccgaaggcgagagaggtctgagcggggagacgacgcccgcgccatggcaggcgccagcgccaccaacggcggaggcaacggcggaggcgggaaggtggtcagcatgccgctgcagtacttctgcgtgctggcggcggtggtggtggccgtgatggtgctgtcgctgtcgttcatgtcgccggcggccatggtggccgtccgccagaacctcagctctgtggcggccgcccccggtggcagcagcaacagcaccgccggaggcgccggagcgggaggcgccgccggcctggccgaggcgtcaccgccggcgggctggaaggagaaggagcaggcgcggcggccgcccgtggtgctgttcaacttcggcgactccaactccgacaccggaggcgtggcggcggccggcgggatacggatcatgccgccggagggccgcacctacttccaccaccccacgggccggctctccgacggccgcgtcatcatcgactttatctgtgagagtctgggcacgcgtgaactgaacccatacctcaggggaattggttcggactacagcaacggcgtcaacttcgccatggcaggctcgacggtgacccacggcgtctctccctactccttgaacgtccaggtcgaccagttcgtctacttcaggcacagatcccttgagatgttcgaacgaggactggaaggcccggtgagcaaggaggggtttgagagcgctctgtacatgatggacatcggccacaacgacatggttggtgtggcgcacacaccgtccgatcagtgggacaagaagatcacagagatcgtcggcgaggtcagacaagccatctcgatcctgtacgacaacggagcgaggaagttctggatccacggcacgggcgccctggggtgcctgccggcgctggtggtgcaggagacgaagggcgagcaggacaagcacggctgcctcgccggcgtcaacagggccgccaaggcgttcaacaggaagctcagccagctctgcgacgacctccgcttccacctcaagggcgccaccgtcgtctacaccgacatgttcgccatcaagtacgacttcgtcgccaaccacaccaaatacgggatcgagtggccgttcatggtgtgctgtggcaacggcgggccgccgtacaacatgaagcagggaagacccggctgtggcgacctgtgcccaccggaggcgaaggtggtcagctgggatggcgtgcacttcacggatttcggcagcggccttgctgccaagcttgcgatgagcggggagtactccaagcccagggtgaagctggcaagcttgatccatggcggatccaagaaaacgtcagactcttgatgcggaccattgaccgagtcgtgacctttggatccacatctatggaatggaagatgggtagcggtgaagaattggagggatatcttgcaccaggctgtttcttgacgaagattgactccttgtacacactacacagaactactacagaaggcaaagtagcactgggaatgctcagttacaagcttaagttaatttgctgtctttttattttgggattttgtgctgcagagtacagagattttgtaccttgatgtacgtgtaactatttatgatagttcttacaagctccaaaaggaaaaaaaaaaaaaaaaaaaaaaga

SEQ ID NO: 8755 - DNA, 2547 bp, Zea mays
atgcttggccaaggcggtggaaggggcgggacctgggcccggtgccatcgggatgtttgggaagctcggtcctaggatttgcaagttgctcggtgggcagggcgtgcaagccaaggcgggattactaggcatcatgggaagtttggcgcaggtgggagcaatcagttcccagaatatgcagcagactctgcaaagtatccgcgactgccttgagaacagcgattgggctactagaaaagcagctgctgatacattatgtgtctttgctacccattctgttcacttgataggtgacggaacagctccaaccattgctgctctcgaagcttgccgttttgataaggtaaggcctgtcagagatagcatgattgatgcagtacagttgtggaaaaagttgactggagaagatgcaaatgatggtagaaataaggatcttgctgatggtgaagggaaactggactcaagaaggtcaatacaaagaggtggaaaatcagaatcctttgatgattcctctccagattcacctagtaacaacgtgaagggcagtagcatagctgaaaaggcagcttttcttttgaagaaaagaccaacattaactgacagggaattgaaccctgagtttttccaaaagcttgagacaagaaaaacagatgacttggcagttgaggttgtagtcccccacaagactctacaatctcacttgcgaggtgaagatgaaacagaagaagatgatgatcctgttggtccagctgacagcaatggatcagctgaagatgaagcaaatctaactcaaatgcgtgctagctttaattttcagaatatccgggataaatgggctggccaaaggggaaatagaaacaaaattacaaaagctaggacaactgatgttgaagataggggtgaacccagtacaaaagattccactgctgcagcaatgaacatttctggagaaggccctctcataaataataaaacaaattggttagcaatacagaggcaattgtcacacttggagaggcagcaaactagtctcatgaacatgttgcaggatttcatgggagggtctcatgacagcatggttacattggagaacagagtacgtggtcttgagagagttgttgaggaaatggctagagaaatatcactctcctcaggcaggagaggtggtggtccagcgttgggctttgattcatctcctggcagatcatctaaacacaatggtttccatgaatattctaattcgaaatatggaaggagtggtgatggacgaatgggatttgcagaaaggtatttctctgcagatgctatggcttctggtacgaaaaaccaatcttggagaccagattctgaaccatgggattcatatgcttattctggatcaagaagcggtatgaatgtgaggagaggattagattctgtttcatcagacaatagaatggcaagaaatgaacggagtaatgatcaagtgggtccccggagaggttgggacaaaggtcagggaccctttaggttcggtgagggtccttctgcccgaagtgcatggcgggcctcaaaagatgaagcaacactggaagctattagagtagctggtgaagataatggaaattcaagggccgctgcaagagttgctattcctgaactggatggagaagctttgaatgatgacaaccaaggggatgaaagaggcccactttgggaggcctggactcgtgcgatggatgctgttcatcttgaggatatggactctgcttatgctgaacttctttcgactggtgatgctgaattacttgtaaagttgatggagcaaactggaccggttgttgatcaactttcaaatgaggttgcaaatgaagtcctacatgcagtggggcagtttctcatggaagaaagcttatatgacgtagcattaaactggcttcagcagttgactgatctggtaatggaaaatggctctgattatctcggaatacctctagacgcaaagcaggacgtcttactgggacttcatgaggcgacagcgattgacctgcctgatgactgggagggagcgacaccgttgcagataatgaagcagctagcttcatcctggcacatcgacctacagcaacttatcaattagggtaacattgattaccgacatatgggttaatttcatttgttcgttgcctcttggtcttgtctggcctgttgctattaggattaggaatattatattggttggagtggaagtggcactgtgttgaaatggattggttgtattggggaaatatgatgtggatattgtctcaccttcatctaaaggctttcataattcatagtttgattctccagttatactgtaaaaccttctcacttcatggtggtggtctcttgtatgattatggtgcattggttattacatggaactcaaaatgagtagcaatgcattgtttatttgccaaaaataaattgtctccagcaacacttgtatgcagaaggcagatgctacgcatttggatatattgcccatatgatgttaggcatcccagagcatcaactctttctgca

SEQ ID NO: 8756 - DNA, 1692 bp, Zea mays
gtatgatgcttatgctatgcaaaatgatgtgatgatgttatgttatgcatgtgacatttgttccgaagatacacataaaatatattcgtaagctctgcattcccttaggaacgtctttggagcttcttcgtcttttacttagacggcatcagcgttgacttttcgctgtaagcctcccttaggagcttcttcgtcttttacttagacggtatcagcgttgacttttcgctgtaagcctcccttaggagcttcttcgtcttttacttagacggtatcagcgttgacttttcgctgtaggctctgcattcctttaggaacgacttctgagcagaaaacttacgctgcgctccctttggaacgactttttgtgactttataaacttactctgcgttccttagaacgactttttgttactccgaaggatttttagtccgaaggtccttcttggtaacggaagaaattttaggcttcggcaacttaggcctgtgaatcaaataaatttttctcgtggaaacaacgaaattattacatggaaactatcaatgttttttgcttcacagaaaataaaactgaatagaaaagactgctatcaaaggtaggatatgtcaataaatgtgcttcgactctggcacagtgctgttgactgtgcgagcttcggactgttctctgaagtccctctgctgtggagcgtattgactcccttctggctgttgaccttgctgcaatggaggtggaggcggaagctgctgccaggaagcttgaggttgacttgccgaagctacagaagccgcagggtggttgtctatgtattgtgggacataaggcggatgaaacgaagcagtatgcataacctgcttcgactgagcttgttgagatgcagcttcggctagttccttttgcttctggattgtaacatggcacgtcctagtggtgtggcccttgccctctccacagaataggcaaaacagtctccttggctgatctccgaatcttccgccgaagcccctggcgcctctgcctcttggagctggtggccgaaaggaagtttgttgttgccccgaagcctgtgaggagcactgcggcctgttttgctgactccccttatcatcattctgagtgctgtgaatggaacggacatgcctcgggtagtatcttcctccgaagcccctggtcatctcagaaaatctgaaggcctcctcccttctttggcgaaagtcattgtcggcacgaatgtactcatccatcttttggagcaatttctccaaggtctgaggaggcttccgagcaaagtattgagctgcaggtccaggacgaagccccttgatcatggcttcgacaacgatttcattgggcaccgttggtgcctgcgccctcaatcgtaagaaccttcggacatacgcctgaaggtattcttcgtgatcctgaatacactggaagagggctgggcctgtaaccggcttcgtttgaaatccttgaaagctggtcagtaacatatccttcagcttctgccatgaagtgattgttcctggccgaagggaggaataccaggtctgagcaacattcctgacggccatgacgaaagacttcgccatgactgcagcgttgcccccgtacgaagacactgttgcttcgtagctcatcaagaattgcttcgggtcggagtggccgtcaaacatggggagctggggtgg

SEQ ID NO: 8757 - DNA, 2056 bp, Zea mays
gacgactttttgttgcttcgaagaattttcgatagtccgaaggtcctttttattatcacaagccggtgaagaaaacatattttccttgtaggaaccaacgaaactaattacatgaaacctaaacaatgtcctttattatagaaaataaaactgaatgaaaaagattactattaaggtaggatatttgtcaatagatgtgctttgattctggcacagtgctgttgaccgtgcgagcttcggactgttctctgaagtccctttgatgcggagcatattggctcccttctggctgctggccttgctgcaacggaggtagaggcggaggctgttgccaggaagcttgaggctgacttgccgaagcaacagagactgcaggatggttgcccacatattctgggatgtagggcgaatgatacgaagctgtatgcatgacctgcttcggctgagcttgttgtgctgctgcttcagctatttccttttgcttctgaatagtgacatggcacatcctggtagtatggcctttgttctcaccgcagaataagcaaaagattcttctcggttgatcgccaaatcttcctccgaagcccctggctcctctgcctcttggagctggaggtcggaaggaactttgttgttgccctgaagcctgtgaggagtattgtggcctttgttgctgactccccttatcatcattctgagtggaattgtgaattgacctgacatgcctcgggtaaaaccttcctccgaagcccctggtcatttcagaaaacctgaaagcctcctcccttctttgacgaaaatcattgtcagctcgaatgtattcgtccatcttctggagcagcttttccagcgtttgtggtggcttcctggcaaaatactgtgctgacggccctggccgaagccccttgatcatagcctcaatgacaatctcattgggcactgttggcgcctgtgccctcaatcgtagaaaccttcggacatatgcctgaaggtactcttcatggtcctgagtgcattggaagagagcctgagcagtgaccggcttcgtctgaaacccttgaaagctagttaacagcaagtccttcagcttctgccatgaggtgatcgttcctggtcgaagggaggaataccaggtttgagcaacgcttctgacagccataacgaaagatttggccatgactgaagcattgccaccatacgaagacactgttgcttcgtagctcatcaaaaactgcttcgggtctgagtggccatcaaacacggggagctgaggcggcttgtaggacgggggccaaggtgtagcctgcagctcagcggacaggggagaagcatcatcaaaaacaaaattcccatgatggaaattgtcataccaatcatcttcgttgggaaaaccctcctgatgaaggtcttgatgctgaggccttcggtgttgctcgtcctgagcaagatgacgaacttcttcagaggcttcgtctatctgcctctgcagttcagctaccctggccatcttttccttcttgcgttgaacctgctgctgaaggatttccagattttgaatctcctgatctagatcatcctccggaggtgttggactggtagccttcctcttctggcttcgtgcctctctaagagaaaggacgtcttgattggggtccagcggctgcagcgtgccagcccctggtgctgaagccttcttcggcggcatgacgaaggtgatgcttgccgaagatgttgaaaagctcaagaaatggaagtgagttcaccggaggtgggcgccaatgttggggacttgttctcaagcacttcaagagttaagaacaaggcaacatagaaaatgttaatcgttaatgtccttcgtcctccgaagcattatctcccttaggatgtaatgacttgcggacgaaggttatgaaggacataccttcataaactcatcagacaatgacgaaggtgataaatataaataatattaaagaaaacatggacaatcatttattattgagcataaataaaaatatattgaaatcacagtgtacctttcatcggaaggaaaata

SEQ ID NO: 8758 - DNA, 2297 bp, Zea mays
tttcgctgtaagcctcccttaggagcttcttcgccttttactttcagcggtattcgcgttgacttttcgcgcttcgccttttacttaggcggtatcagcgttgacttttcgctgtatgctctgcattccctttggaacgactttggagcagaaaacttacactgcgctcgctttggaacggctttttgtgacttcggcaaacttactctgcgttccttagaacgactttttgttgcttcgaaggattttcgataattcgaaggtcctcttcgttatcacagatctttaaacttttaataacttgagcctgtgaagaaaatatattttccttgtggcgaatcaacgaaactatttacatgaaacctaaacaatgtcctttattacacagaaaataaaactgaatgaaaaagactgctattaaggtaggatatttgtcaatagatgtgctttgactctggcacagtgctgttgactgtgcgagcttcggactgttctctgaagtccctttggtgtggagcatattggctcccttctggctgctggccttgttgcagcggtggtggaggcggaggctgttgccaggaagcttgaggttgactcgccgaagcaacagaaactgcagggtgattgcctacatactctgggatgtaaggcgaatgatacgaagcagtgtgcatgacctgcttcggctgagcctgttgtgctgccgcttcggctatttccttttgcttctggatggtaacatggcacatcctggtggtatgacctttgttctcaccacagaacaagcaaaagattcttcttggttgatcgccaaatcttccgccgaagcccctggcgcctctgcctcttggagctggtggtcggaaggagccttgctgttgccccgaagcctgtgaggaacactgtggcctttgctgttggctccctctatcatcattttgggtagagttatgaattgatctaacgtgcctcggatagaacctccctccgaagcccctggtcatttcagaaaacctgaaagcctcctcccttctttggcgaaaatcattatcggcccgaatgtactcgtccatcttctggagcagcttctccaaagtttgaggaggcttcctagcgaagtactgagctgaaggtcctggccgaagccccttgatcatggcctcaatgacaatttcattgggcactgttggtgcctgtgccctcaaacgcaagaacctccggacgtacgcctgaaggtattcttcgtgatcctgggtgcactggaatagagcttgagcagtgaccggcttcgtctgaaacccttggaagctggttaacaacaagtccttcagcttttgccatgaagtgatcgttcctggtcgaagggaggaataccaggtttgagcaacactcctgacagccataacaaaagatttggccatgactgcagcattgccaccatacgaagatactgttgcttcgtagctcatcaaaaactgcttcgggtctgagtggccatcgaatatgggaagctgaggcggcttgtaggacggaggccaaggtgtagcctgcagctcagcggacagaggagaagcatcatcaaaaacaaaattcccatgatggaaattgtcataccagtcatcttcgttgaggaaaccctcctgatgaaggtcttggtgctgaggccttcggtgttgctcatcctgagtaagatgacgaacttcttcagaggcttcgtctatctgcctttgcagttcagctagcctggccatcttttccttcttcctctgcacctgttgatgaagcatctccatgtctctgatttcttggtctatctcatcctctggtggtgtcgggctgacagccttccttttctggcttcgggcctcccgaagagagacagtctcctgattgtggtccagcggttgcagagctgcagccccagttgctgaagctttcttcggcgccatagcgaaggtttatgatcgccgaaggtgttcaaaaactcaaagagtggaagtgagttcaccggaggtgggcgccaatgttggggacttgttctcaaatgctatgagttaagaacaaggcaacacagaaaatgttaatcggtaaagtccttcgtccttcgaagcattatttcccttaggatataatgattttcggacgaaggttatgaaggacgtaccttcataaatcacagcatacgataatgaagaatgaatcataagaaatatgaaggataacatagacaattatatattattatcaacttatttttgcattattattatgaagaaacagaaatgacatcaact

SEQ ID NO: 8759 - DNA, 2381 bp, Zea mays
gagcttcttcgccttttactttcagcagtattcgcgttgacttttcgcgcttcgccttttacttaggcggtatcagcgttgacttttcgctgtatgctctgcattccctttggaacgactttggagcagaaaacttacactgcgctccctttggaacgacttttttgtgacttcggcaaacttactctgcgttccttagaacgactttttgttgcttcgaagaattttcgatagttcgaaggtcctctttgttatcacaagtctttgaactttaatcaatataagcctgtgaagaaaatatattttccttgtaggaatcaacgaaactaattacatgaaacctaaacaatgtcctttattacagaaaataaaactgaatgaaaaagattgctattaaggtaggatatttgtcaatagatgtgctttgactctggcacagtgctattgactgtacgagcttcggactgctctctgaagtccctctggtgtggagcatactggctcccttctggctgctggccttgttgcaacggaggtggaggcggaggctgttgccaagaagcttgaggctgactcgccgaagcaacagaaactgcaggatgattgcccacatattctggaatgtagggcgaatgatacgaagctgtatgcatgacctgcttcggctgagcttgttgtgctgctgcttcagctatttccttttgcttctgaatagtaacatggcacatcctggtagtatggcctttgttctcaccgcagaataagcaaaagattcttctcggttgatcgccaaatcttcctccaaagcccctggcgcctctgcctcttggagctggtggtcggaaggagctttgctgttgccccgaagcctgtgaggagcattgtggcctttgctgttggcttcctctatcatcattttgtgtagagttatgaattgatctcacgtgcctcgggtagaacctccctccgaagcccctggtcatttcagaaaacctgaaagcctcctcccttctttggcgaaaatcattatcggcccgaatgtactcgtccatcttctggagcagcttctccaaagtttgaggaggcttcctggcgaagtactgagctgacggtcctggccgaagccccttgatcatggcctcaatgacaatttcattgggcaccgttggtgcctgtgccctcaaacgcaagaaccttcggacatacgcctgaaggtattcttcgtgatcctgggtgcactggaacagagcctgagcagtgaccggcttcgtctgaaatccttgaaagctagttaacaacaagtccttcagcttctgccatgaagtgatcgttcctggtcgaagggaggaataccaggtttgagcaacacttctgacagccataacgaaagatttggccatgactgaagcattgccaccatacgaagatactgttgcttcgtagctcatcaaaaactgcttcgggtctgagtggccatcgaatacgggaagctgaggcggcttgtaggacggaggccaaggtgtagcctgcagctcagcggacagaggagaagcatcatcaaaaacaaaattcccatgatggaaattgtcataccagtcatcttcgttgggaaaaccctcctgatgaaggtcttggtgctgaggccttcggtgttgctcatcctgagcaagatgacgaacttcttcagaggcttcgtctatctgcctctgcagttcagctagcctggccatcttttctttcttcctctgtacttgttgatgaagcatctccatatctctgatttcttgatctatctcgtcctctggtggtgtcggactgacagccttccttttctggcttcgggcctcccgcagggagactgtctcctgattgtggtccagtggttgcagagctgcagccccagtcgctgaagctttcttcggcgccataacgaaggtttatgatcgccgaaggtgttcaaaaaacttagagtggaagtgagttcaccggaggtgggcgccaatgttggggacttgttctcaagtgctatgagttaagaacaaggcaacatagaaaatgttaatcgttaaagtccttcgtcctccgaagcattatttcccttaggatgtaatggcttacggacgaaggttatgaaggacgtaccttcataaattcattaaacaatgacgaaggatgaaatataaagaatataaaagacaacatgaacaatcatatattattatcgggcataaacagaaatatcattgaattacaagtgtaccttcaatcgggaggagttgacagtacaagcgtgacgcaaaaagcgaatgccaagtcagcgtgtcaagtacgggggtactgttcacctatttataggcgcgggacacaacccacacaaaatt

SEQ ID NO: 8760 - DNA, 2288 bp, Zea mays
  misc_feature (1862)..(1862): n is a, c, g, or t
  misc_feature (1877)..(1877): n is a, c, g, or t
cccttaggaacggctttttgttgcttcgaataaattgtactttgttccttagaacaagtttttgacaactttgaaaatcctccttgccaacataaattctcatgcttcagcagcttaggcctatggagaagatatatttttattacagaaaaaagcgaaactattacaaaaagttgaaaggcgataaaagacattaaaactacccttaattgttccttattaaaaagaaagtaatagtgaatatgaaaatgcgaaagagctgctgctgaggtaggatatttgtcagtaaatgtgcttcgactctggcacagtgctattgactgtgcgagcttcggactcctctctgaagtcccgctgaaggttgacgcgctgactcccttctggctgctgacctctttgtgttggtggtggcggtggaggctgctgccaagatgcttggggtcggcttgccgaagcaacagaagctgcagggtggttgcctacatattctggaatataaggcgaatgatacgaagcagtatgcatgacctgcttcggctgactttgttgcgctgctgcttctgctatctccttctgcttctggatggtaacgtggcacatcctggtggtatggcccttgtcttcaccacagaataggcagtaaatttttcttggctgatctccaaaccttcccccgaagcccctggcgcctctgccccttggcgctgacggccgaaaagaactttgctgctggcccgaagcttgtgaagagtattgtggcctttgctgctggctccctcgatcatcagtttgagtagagttatgaattgacctaacgtgcctcgggtgaaatcttcctccgaagcccctggtcatttcagagaacctgaatgcttcctcccttctttggcggaagtcattgtcagctcgaatgtactcgtccatcttctggagcagcttctccaacgtttgtggtggcttcctggcaaagtattgcgctgaaggtcccggccgaagccccttaatcatggcctcaatgacaatttcattgggcactgttggcgcctgtgccctcagacgcagaaaccttcggacatacgcctgaaggtattcttcgtggtcctgggtacactggaatagagcctgagcggtgactggctttgtctgaaatccttggaagctggttatcaacatatccttcagcttttgccatgaggtgattgtccctggccgaagagaagagtaccaagtctgagcgacactcttgacggccatgacaaaagactttgccatgactgctgtattgccaccatacgaagatatggttgcctcatagctcatcaagaattgcttcgggtctgaatgaccgtcatacatggggagctgaggtggcttgtaggactggggccatggtgtagcctgtaattctgttgacaaaggggaagcatcatcaaaagcaaaatttccatgatggaaatcttcataccagtcttcctcattgtagaaaccctcctgatggagctctctacgttgaggccttcggttctggtcatcttgaacaagacgacgaacctcttccgacgcttcatctatctacctctgaaggtcagctagacgagccatcttctccttcttccgttgaacctgttgctgaagcatttccaagttttggatttcttggtccaagtcgtcctccagaggcgttggactagtagccttcctcttttgacttcgggcctccctaggagaaaggacgtcctgaatgggatccagcgactgtagagtacaagcccctatcgctgaagcttttttcggcggcatgacgaaggtgatgcttgccgaaggtgtttaaggctcaaaaaatggaagtgagttcaccggangtgggcgccaatgtnggggacttgttctcaaatgatatgaatcaagaacaaggcaacataaaatgttaaatatcaaagcccttcgtccttcggatcattatttcccttcggatataatgaatctaggacgaaggtcatgaaggacatgccttcatgatcatgataaaagatgaagaacattcatacaaagtacagaaagtaacataatttttgtaaacattattattaatctatttccatttatattacttgtgtaaacaatagtaaattacaaatgtaccttcagcttgaaggaatgagaatacaggtgtgacgcaaaagcgaatgccaagtcagcgtgaacagtacgggaatactgttcacctatttataggcacgggtcgcagcccatgcaaaattacattaatgccctttacatttatcaat

SEQ ID NO: 8761 - DNA, 2169 bp, Zea mays
ggtattcgcgttgacttttcgcgcttcgccttttacttaggcggtatcagcgtttatttttcgctgtaagctctgcattccctttggaacgactttggagcagaaaccttacactgcgctccctttggaacggctttttgtaacttcagcaaacttactctgcgttccttagaacgactttttgttgcttcgaagaattttttgataattcgaaggtcctccttgttatcgcaaatctttaagcttcaacaacttaagcctgtggagaaaatatattttccttgtggcaaacaacgaaactattacatgagatttaaaaagtgtcctttattacacagaaaataaaactgaatggaaaagactactatcaaggtaggatatttgtcaataaatgtgcttcgactctggcacagtgctattgactgtgcgagcttcggactgttctctgaagtccctttggtgttgagcatattggcccccttctggctgctggccttgttgcagcggtggtggaggcggaggctgttgccaggaagcttgaggttgactcgccgaagcaacagaaactgcagggtggttgcctacatattctgggatgtaaggcgaatgatacgaagcagtgtgcatgatctgcttcggctgagcctgttgtgctgcagcttcggctatctccttttgcttctggatggtaacatggcacatcctggtggtatggcccttgttttcaccacagaacaagcaaaatattctccttggttgatctccaaatcttccgccgaagcccctggcgcctctgcctcttggagctggcggccggaaggagctttgctgttgccccgaagcctgtgaggagcactgtggcctttgctgctgacttcccttatcatcattttgagtagagttgtgaattgacctaacatgcctcggataaaatcttcctccgaagcccctggtcatttcggaaaacctgaaagcctcctcccttctttgacgaaaatcattgtcggcacgaatatactcgtccatcttctggagcagcttctccaaagtttgaggaggcttcctagcaaagtactgagctgaaggtcctggccgaagtcccttgatcatggcctcaatgacaatttcattgggcactgttggtgcctgtgccctcaaacgcaagaacctccggacatacgcctgaaggtattcttcgtgatcctgggtgcactggaatagagcttgagcagtgaccggcttcgtctgaaacccttggaagctggttaacaacatgtccttcagcttttgccatgaagtgatcgttcctggccgaagggaggaataccaggtttgagcaacactcctgacagccataacaaaagattttgccatgactgcagtattgccaccatacgaagatactgttgcttcgtagctcatcagaaactgcttcgggtctgaatggccgtcgaatatgggaagctgaggcggcttgtaggacggaggccaaggtgtagcctgcagctcagcggacagaggagaagcatcatcaaaagcaaaatttccatggtgaaaattctcataccagtcatcttcgttgaggaaaccctcctgatgaaggtctttattctgaggccttcggttctgctcatcctgagtaagatgacgaacttcttcagaggcttcgtctatctgcctttgcagttcagctagcctggccatcttttccttcttcctctgcacctgttgatgaagcatctccatgtctctgatttcttggtctagctcatcctctggcggtgtcgggctgacagccttcctcttctggcttcgggcctcccgaagggagagagtctcctgattggggtctagcggttgcagagctgcagccccagttgctgaagctttcttcggcgccatagcgaaggtttatgatcgccgaaggtgttcaaaactcaaagagtggaagtgagttcaccggaggtgggcgccaatgttggggacttgttctcaaatgctatgaattaagaacaaggcaacacaagaaatgttaaacgttaaagcccttcgtccttcgaggcattatttcccttaggacataatgattttcggacgaaggttatggagcacggcccttcgtagatgcaacctataataatgaagaaggaatcatatgagacacaaaag

SEQ ID NO: 8762 - DNA, 1509 bp, Zea mays
cgccttttactttcggcggaatcagcgctgacttttcgctgtaggcttagaaaacttacactgcgctcccttaggaacgactttttactgcttcgaataaattgcactgtgtcccttagaacaaatttttgataatacaaaggtccttcatgccaccataaattcgtatgcttcggcgactcaagcctatggagaagatatattttcattatggcgaaaggcgaaactgttacaagaaattgaaaaacgataaaagaacacttagacttcccataattgttccttattaacaaaaaagtaatactgaatgtgaaaatgcgaaaaaactgctgtcgaggtaggatatttgtcagtaaatgtgcttcgactctggcacagtgctattgactatgcgagcttcggactcctctctgagatccctctgaaggtgagtgtgctgactcccttctggctgctgtcctcgctgcattggtggtggcgtggagactgttgccaagatgcttggggttgacttgccgaagcaacagaagctgcagagtgattgcctacatattctgggatgtaaggcgaatggtacgaagcagtgtgcatgacctgcttcggctgactctgttgtgctgcagcttctgctatctccttttgcttctggatggtgacgtggcacatcctggtggtatggcccttgtcttcaccacagaatagacagtaaattcttcttggctgatccccaaatcttcccccgaagcccctggcgcctctgccccttggcgctggcggccgaacagagctttgttgttgtcccgaagcttgcgaagagtattgtggcctttgctgttggctccctctatcatcactttgagtggagttatgaattgacctgacatgcctcgtatgaaatcttcctccgaagcccctggtcatttcagagaacctaaatgcctcctcccttctttggcggaagtcattatcggcccggatgtactcgtccatcttctggagcagcttctccaaagtttgtggtggcttcctggcaaagtattgcgctgaaggtcccggccgaagtcccttaatcatggcctcaatgacaatttcattgggcactgttggcgcttgtgccctcagacccagaaaccttcggacatacgcctggaggtattcttcgtggtcctgggtgcactggaataaagcttgagcagtaactggcttcgtctgaaacccttggaagctggttatcagcatatccttcagcttctgccatgaggtgattgtccctggccggagagaggagtaccaggtctgagcgacactcttgacggccatgacaaaagactttgccatgactgcagtattgccaccatacgaagatatggttgcttcatagctcatcaagaattgcttcgggtctgtatgaccgtcgtacatggggagatggggtggcttgtaagactggggccatggtgtagcctgcaattctgttgatagaggagaagcatcatcaaaagcaaaatt

SEQ ID NO: 8763 - DNA, 2752 bp, Zea mays
cgtaaaaaaaaattctcgaagctatacttcgaagatgaagattgtgtctccttgtgaccacgattttcactctttcagatcatacttccgaagatcaatattgtgtccccttcttgtgaccacgattttcactctttcaaatcatacttccgaagatcaatattgtgtccccttcttgtgccatatgcaacatgatgtatgatgcttatgctatgcaaaatgatgtgatgatgttatgctacgtagatgacatttgttccgaaagatacacacatatccccacacaatatttttgtatcagcactgattctttgctgtaagctctgcattcccttaggaacgtctttggagcttcttcgccttttacttaggcggaataagctctgcattcccttaggaacgtctttggagcttcttcgccttttactcaggcggtataagctctgcattcccttaggaacgtctttggagcttcttcgccttttacttaggcggtatcagcgttgacttttcgctgtatgctctgcattccttttggaacgactttggagcagaaaacttacactgcgctcccttcggaacgactttttgtgacttcgtcaggcttactctgcgttccttagaacgactttttgttgcttcgaaggattttcggtagtccgaaggtcctttttattatcacaaacctgtgaagaaaacatatttttcttgtaggaatcaacgaaactaattacatgaaaacctgaatcaatgtcctttattgcagaaaataaaactgaatgaaaaagattgctattaaggtaggatatttgtcaatagatgtgctttgattctggcacggtgctgttgaccgtgcgagcttcggactgttctctgaagtccctttgatgtggagcatattggctcccttctggctgctggccttgttgcaacggaggtggaggcggaggctgttgccaggaagcttgaaggctgactcgccgaagcagcagagactgcaggatggttgcccacatattctgggatgtagggcgaatgatacgaagctgtatgcatgacctgcttcggctgggcttgttgtgctgctgcttcagctatttccttttgcttctgtatagtaacatggcacatcctggtagtatggcctttgttctcaccgcagaataagcaaaagattcttctcggttgatcgccaaatcttcctccgaagcccctggcgcctctgcctcttggagctggtggccggaaggagctttgctgttgtccagaagcctgtgaggagcattgtggcctttgctgttggcttcctctgtcatcattttgtgtagaattgtgaattgatctcacatgcctcgggtaaaacctccctccgaagcccctggtcatttcagaaaacctgaaagcctcctcccttctttggcgaaaatcattgtcggcccgaatgtattcatccattttctggagaagcttctccaaagtttgaggaggcttcctggcgaagtactgagctgacggacctggccgaagccccttgatcatggcctcgatgacaatttcattgggcaccgttggtgcctgtgccctcaaacgcaagaaccttcggacatatgcctgaaggtattcttcgtggtcctgagtgcactggaacagagcctgagcagtgaccggcttcgtctgaaatccttgaaagctggttaacaacaaatccttcagcttctgccatgaagtgatcgttcctggtcgaagggaggaataccaggtttgagcaacacttctgacagccataacgaaagatttggccatgactgaagcattgccaccgtacgaagacactgttgcttcgtagctcatcaaaaactgcttcgggtctgagtggccatcaaatacggggagctgaggcggcttgtaggacgggggccaaggtgtagcctgcagctcagcggacaggggagaagcatcatcaaaaacaaaattcccatgatggaaattgtcataccagtcatcttcgttgggaaaaccctcctgatgaaggtcttgatgctgaggccttcggtgttgctcatcctgagcaagatgacgaacttcttcagaggcttcgtctatctgcctctgcagttcagctagcctggccatcttctccttcttgcgttgaacctgctgctgaaggatttccagattttgaatctcctgatctagatcatcctccggaggtgttggactggtagccttcctcttctggcttcgtgcctctctaagagaaaggacgtcttgattggggtccagcggctgcagcgtgccagcccctggtgctgaagccttcttcggcggcatgacgaaggtgatgcttgccgaaggtgttgaaaagctcaagaaatggaagtgagttcaccggaggtgggcgccaatgttggggacttgttctcaagtgctaagagttaagaacaaggcaacacagaaaatgttaatcgttaacgtccttcgtcctccgaagcattatttcccttaggatataatggcctccggacgaaggctatgaaagacatatcttcataaattcatcaaacaatgacgaaggataaaatataaagaatgtaaaagaacacatgaacaatcatttatcatttattattattgaacataaacaaaaatattattaaactataagtgtaccttcaatcggaaggaaacgatagtacaagcgtgacgcaaaaagcgaatgccaagtcagcggaacagtacggggatactgttc

SEQ ID NO: 8764 - DNA, 2155 bp, Zea mays
ggcaacttaagcctatagagaagatatattttcattatcgtaaaaagcgaaactgttacaagagattaaaaacgacaaaaaacacttaagcctcccataattgttccttattaaaaagaaaataatactgaatgcctgaaaatgcgaaaagctgatgtcggggtaggatatttgtcagtaaatgtgcttcgactctggcacagtgctattgactgtgcgagcttcggactcttctctgaagtcccgttgaaggtgagtgtgctgactcccttctggctgctggcctcgttgcgttggtggtggaggtggaggctgttgccaagatgcttggggttggcttgccgaagcaacagaagctgcagggtggttgcctacatattctggaatgtaaggcgaatggtacgaagcagtatgcatgacttgcttcggctgactctgttgtgctgcagcttctgctatctccttttgcttctggatggtaacatggcacatcctggtggtatggcccttgtcctcaccacagaatagacaataaattttccttggctgatccccaaatcttcctccgaagcccctggcgcctctgccccttggagctggcggccggaaagagctttgctgctgccccgaagcttgcgaggagtactgtggcctttgctgttgactccctctatcatcactctgagtagagttgtgaattgacctgacgtgcctcggatggaatcttcctccgaagcccctggtcatttcagagaacctgtatgcttcctcccttctttggcggaagtcattgtcagctcgaatatactcgtccatcttctggagcagcttctccaaagtttgaggaggcttcctggcaaagtattgagctgaaggtcccggccgaagccccttaatcatggcctcaatgacaatttcattgggcactgttggtgcctgtgccctcagacgcaggaaccttcggacatacgcctgaaggtattcttcgtggtcctgggtgcactggaataaagcttgagcagtgaccggcttcgtttgaaacccttggaagctggttatcagcatgtccttcagcttttgccatgaggtgattgttcctggccgaagagaggagtaccaggtttgtgcaacactcttgacagccatgacgaaagactttgccatgactgcagtattgccaccatacgaagatatggttgcttcataactcatcaagaattgcttcgggtctgaatgaccgtcgtacatggggagctggggtggcttgtaagactggggccaaggtgtagcctgcagttctgttgacagaggagaagtatcatcaaaagcaaaatttccatgatggaaatcttcataccagtcgtcctcgttgtagaagccctcctgatgaagctctctgtgcggaggccttcggttctggtcatcttgagcaagatgacgaacttcttcagaggcttcgtctatctgcctttgcaggtcagctagacgagccatcttttccttcttccgttggacctgttgatggagcatctccaagttttggatttcttgatccaagtcgtcctccggaggcgttggactggtggccttcctcttctggcttcgggcctccctaagagaaaggacatcctgattgggatccagcggctgcagagcggcagcccctgtggctgaagctttcttcggtggcatggtgaaggtgatgcttgccgaaggtgttcaaaactcaaaaaatggacgtgagttcaccggaggtgggcgccaatgttggggacttgttctcaaatgcttcggcttaagaacaaggcaacataaaatatgttaaatattaaagtccttcgtccttcaagacattatatcccttcggatataatgaatttcggacgaaggttatgaaggaaagaaccttcgtaagcacgatagatgataagtaagagttttcatatcaaatatgaagaacaatataaataacattctcaatttatttttatttgcattatcatatccagaataacaaattataaatgtaccttcggcttgacggaaaataaaggtacaaggcgtgatgcaaaaagcgaatgccaagtcagcgtgaacagtacaagagtactgttcatctatttataggcaagggacgcagcccgtgtaaaattac

SEQ ID NO: 8765 - DNA, 1880 bp, Zea mays
ggcacgagggccaaccacagggcacagggtagcattctctctcttcgtcctcaagaaatccagcggaagctcatcttcttcaccctctcttctctccacatctcccctcggactactactgcatccaaggagcaaagaattgtgggggtagcaaaggaattggagttcttgcatggatgcagcccactggcagcagggcctagggctggtgaagcccatggaggagatgctgatggcggccaacgcgggcgccgcaaatccgagccaaagctcgaatccgaacccgccggcgccggcgccgtcgttggcacctggggggctcctgggcggtggcgcgccggcgcccctggcgggcgcgggtagtaccgagcggcgcgcgcggccgcagaaggagaaggcgctcaactgcccgcggtgcaactccaccaacaccaaattctgctactacaacaactacagcctccagcagccacgctacttctgcaagacgtgccgccgctactggacggagggcggatccctccgcaacgtccccgtgggcggcggctcccgcaagaacaagcgctcctcatcgtcggcgtcggcgtctgcctccacctccggctcggtcacgagctcgtccatggccagcacggcgggggccgggtccaagaacccgaagctggcgcacgagggcgcccacgacctcaacctggcgttcccgcaccacggtggcctgcacgcccccgagttcgcggcgttcccgagtctggagagcagcaacgtgtgcaacccgggcggcgggatgacgagcaacggtcggggcggcggcgcggggcccgcggtcggcgcgctctcggcaatggagctgttgcggagctccggctgctacatgccgctgcagatgccgatgccgatggcgatgccaggagattacacggcggcagggttcgcgctcggagagtaccgcacgccgccgcctccaccgtcacagagcgtgctcgggttctctctcgacgcgcacgggccggggtccggtgctaccgcggcggggtacggttccagcgcggggttgcagggcgtgccggagaacgcgggcaggttattgttccccttcgaagacttgaagccgccggttggctctgaaggtgggggtggtgcaaccggtggcgccagcgatggaaatagcagccatactcagtttgaccacaacaacaaggagcaaggcggcggcggcacgggtgccgggcacgacacgccggggttctggagcggcatgatcggcggcagtggcgcttcttggtaatggagaaacatgcacggccggggggcggcgccatgcatggctcatgcaaaggctccctgcgagcgtgcatgggcatgcagtagagacaagggttcaataagaggttggcattggtggtggttgccctgacatgggagtgtttgatctctttcctagtactgggtcctggtggtgttcttcgtctgttctcgccgtcgtcgtcgcgagttcatgtgtgttttgctgaccatcgactttaattggggctctaacacaccagaggtcatgttacataagcttgaccgacatctctcggtcgtcttttcccatttctgatctctcactatatctgccattgttgtagctgcttcactggggcttgggcagcttgtttttgggctgggcttcaagttaggatggtacatcagtgtgttcaggccacacattggcacaaggtttagtgaatcagtgtgtttggctggtaacaacaacggctgcagtatgtgaactctgaagctactggtgtagagttagatgttaattacaaggggacttgcaagtttgtgtatccatctatccaaatgattagagagattcattttgtttttgacttgtt

SEQ ID NO: 8766 - DNA, 1264 bp, Zea mays
cagctcgaatatattcatccatcttctggagcagcttctccagcgtttgaggaggcttcctggcgaagtactgagctgacggacctggccgaagccccttgatcatggcctcaatgacaatttcattgggcaccgttggtgcctgtgccctcaaacgcaaaaaccttcggacatatgcctgaaggtattcttcggggtcctgagtgcactggaacagagcctgagcagtgaccggcttcgtctgaaatccttgaaagctggttaacaacaagtccttcagcttctgccatgaagtgatcgttcctggtcgaagggaggaataccaggtttgagcaacacttctgacagccataacgaaagatttggccatgactgaagcattgccaccgtacgaagacactgttgcttcgtagctcatcaagaactgcttcgggtctgaatggccatcaaatacggggagctgaggcggcttgtaggacggaggccaaggcgtagcctgcaactcagcggacaggggagaagcatcatcaaaaacaaaattcccacgatggaaattgtcataccagtcgtcttcgttgtgaaagccctcctgatgaaggtcttgatgctgaggccttcggtgttgctcatcctgagcaagatgacgaacttcttcagaggcttcatctatctgcctctgcagttcagctagcctggccatcttctccttcctgcgttgaacctgctgctgaaggatttccagattctgaatctcctgatctagatcatcctccggatgtgttggactggtagccttcctcttctggcttcgtgcctctctgagagaaaggacgtcttgattggggtccagcggctgcagcgtgccagcccctggtgctggagccttcttcggcggcatgacgaagctgatgcttgccgaaggtgccgaaaagctcaggaagtggaagtgagttcaccggaggtgggcgccaatgttggggacttgttctcaaatgctaagagttaagaacaaggcaacatgaaaagtgttaagtgttaaagtccttcgtccttcgaagcattatgtcccttcgggaaataatgagtttcggacgaaggtcataagagacataccttcgtaaatataataggtaataacgaaagactcatataaagcatgagatataatataagcatcatcatggaatcatttctattttattaacatgggaaaatagaaatgatttcaaattacaaatgtaccttcggtcctgagagaaggacg

SEQ ID NO: 8767 - DNA, 2343 bp, Zea mays
attaaaccgtgcttttttatttttgattatcgacggcctagcctgacgaacagtagaactcagactcgagcgctccaaagcgagccaccgccgatctgctcctccctcttgaccctcctccgtgcgctgcgcaggcatgaggcgcctcctcggcggcgccctcgtcctttgtatcgccgcggtggtggagtccaagccgcctctcgactctctgggcataccaccgcaagatgaggcgtactacataggcggcgtgatcaaatgcagggacggatcgggcaggttttccagggaccagctcaacgacgacttctgcgactgccccgacggcaccgacgagcccgggacatctgcatgccctgaggcgaaattctactgcaagaatgcaggccacactccagtcacgatcttctcgtcacgagtgaatgacggcatttgtgattgctgtgatgggagtgatgaatatgacagcaatgtcacctgtaagaacacttgctgggaggctggaaaggtggcaagggagaaattgaagaagaaaattgctacatacgaaaatggtgttgttattcggaaacaggaagttgaaagggcaaaagaggcttttgctaaagatgaagcagatttagcaaaattgaagggcgaagagaaaatgctccaaggacttgttgataaactcaaagagcaaaagaaattaatagagaatgcagaggaagaagagcgtttaagaaaagagaaggaagaaaagagaacaaaagaagaagatgaaaagcaagctgctgttgaaaagggagcgcttgatgcctctcgggatgtagattctaaggaaattcatgatcatctgcaagaaggtgaaaacaagcatgatggacatgcaacaggccatgataatcatgtaacagaaagcagggcatctattgagcagcatggttctgtaagcaaagatggtattagcgttgaaggtggaactgtagatgaattgccgcaggagtctgcagcacctaccatagagaaggattctagccctgacaatcctgagggtttatctagggaagagttaggtcgtatggtggcttctcgttggactggggaaagtgtaactgaggttagtaaagatgataagaaggggcatgaagatcagcaagaaataccagaacctgcagaggaagcacttgaagatgagttagaaattccagaacctgccgaagaaaattatggtggttatcattcagaagttgaggatgataggcgtaaatatgaagatgaagagttttatcatgagtcagaagatgaatatgttgacgaccatgatgagcatgttgagtcctacaaatctgatgatgaccaaaaagatttaactgagccaggacatgcatcgtggttggacaaagttcagcagactgtacaaaatgttttccaaaaattcaacttttttaagacccctgtagatttgtcagaggcttctcatgttcgtaaggagtatgatgatgctagctcaaagctttcaaaaattcagtctaagatatccagtctagctgagaagctaaaacatgattttggtaatgacaaggagttctattccttttatgatcagtgttttgagaccaaggaagggaagtatacttacaaggtctgtgcatataagaaagcatcacaggctgaagggcacagttctaccaacctggggcggtgggacaaatttgaagattcgtacagagtgatgcacttttcaagtggagacaaatgctggaatggtcctgaccgaagcctaaaggttaggcttagatgtgggctgagcaatgagcttaatgatgtagatgagcctagcagatgcgagtatgtggctgtattgtcgacccctgcagtttgcgtagaggagaagctgaaggagctgcaaaacaaactggacgccatgtctttgaagcagcccgggcatgacgaactttaaaaactttagaatattccagcgtgaacataaagaagatgtcaccaggaggcatagctctgacagttacatccataacatgataggcatggaagtcaatgaggtatatggacagaaacgggccaagcgcgagaaatgagaatgtagagtttaggtcgcctaccaggctatattagctcgcatagaacattttttttagctgaaatttgatgttgcaattttccagactcatctgatggaatatatagtaagaaacagtacaccttgaatcagcatatactttacccagggtttttacatgaaaccatgttcagaacggtcatttggaactgaaggaattccccctggaacaaaaaaaaaaaaaaaaaaaaaaaaaaaaaaaaaaaaaactcgcgaggggg

SEQ ID NO: 8768 - DNA, 2457 bp, Zea mays
  misc_feature (2440)..(2440): n is a, c, g, or t
  misc_feature (2443)..(2443): n is a, c, g, or t
  misc_feature (2451)..(2451): n is a, c, g, or t
tcgaggccggccgggccgggtagtacacactcgacttgcgcgtgcacccgcggcctagcctgaagaacggaagaactcggagtcgtgcaccccgaagcgagccaccgccgatctgctcctcctgagtcctgaccctcctccgtgcgctgcgcaggcatgaggctcctcctcgtcggcgccctcctcctatgtgccaccgcggcggtggagtccaagccgcccctcgacaccctgggcatacccccgcaagatgaggcgtactacagaggcggcgtgattaaatgcagggacggatcaggcaggttctcccgggagcagctcaacgacgacttctgcgactgccccgacggcaccgacgagcccgggacatctgcgtgccctgaggcgaagttctactgcaagaatgcaggccacactccagtcacgatcttctcatcacgagtgaatgacggcatttgtgattgctgtgatgggagtgatgaatatgacagcaatatcacctgtaagaacacttgctgggaggctggcaaagcggcaagggagaaattgaagaagaaagtcgctacatacaaaagtggtgtagttattcggaatcaggaagttgagagggcaaaagaggcttatgctaaagacgaagcagagttagcaaaattgaagggcgaagagaaaatactccaaggacttgttgacaaactcaaagagcaaaagagacttatagagaaggcagaggaagaagaacgtttaagaaaagagaaggaagagaagagaataaaagaagctgaaaagcaagctgctgatgaaaagggaacacctgatgcctctccggatgtagattctaaggaaactcatgaccatgtgcaagaagatgaaaacaaggtagccgaagagcatgatgtacatgcaacggaccatgataatcatgcaacagaccatgataatcatgcagcagaaagcggagcatctgttgagcagggttctgtaaacaaagatgatattagcgttgaagctggaactttagatgaattgctgcacaaggagtctgcagtacctacattagagaaggatcatagctctgacaatcctgagggtttatcaagggaagagttaggtcgcatggtagcttcacgttggactggagaaagtgtaagtgaggttagtaaagatgataagaagggacatgaagatgagcaagaaataccagaacctgcaaaagaagcacttgaagacgaattagaaattccagaacctgctgaagaaaattatgatggatatcattcagaagttgaggatgacaggcataaatatgaagatgaagagtttgatcataagtcagaagatgaatatgttgatgaccatgatgagcatgttgagtcctatagatctgatgatgaccagaaagatttaactgagccaggacatgcatcgtggttggacaaaattcagcagactgtacagaatgtttttcaaaaattcaacttttttaggacccctgtagatttgtcagaggcttctcgcgttcgtaaggagtatgacgatgccaactcaaagctttcaaaaattcagtctaagatatccaatttagctgagaagctaaaacatgattttggcaaagacaaggagttctattccttttatgatcagtgctttgagaccaaggaaggaaagtatacttacaaggtctgtgcatataagaaagcatcacaggctgaagggcacagttccaccaacctggggagatgggacaaatttgaagaatcgtacagagtaatgcacttttcaggtggagacaaatgctggaatggtcctgaccgaagcctaaaggttaggcttagatgtgggctgagcaatgagcttaatgacgttgatgagcctagcagatgcgagtatgttgctgtattgtcgacgcccgcactctgcgtcgaggagaagctgaaggagctgcaaaacaaactggatgccatgtcttcgaagcagcccgggcatgatgaactttaaacggttccggcgtggacaaagaaaatgtcaccaggaagcatagattgacagttacactcataaccttaagggtggaagtcaatgggggcatatggacaggaaagggccaagctgaagaaatgggaatgtagggttcaggtcgcctacctggcaatgttagctggcatagagctgtttttttagctgaatttgattggatgttgcaatttttccaggctcatcccgagttgtttggtggaggcgactgcaaccgtgcttttctttgtggtttaacattgctctatttaattagggagagacgctaggcttttgcgtctccagcttcattgccagccattacacatttgatggaatatatagtaagaaacagtacactctgaaccatcataatttgaagatgccagttaaccccgggttgtcacatgataaaaaaaaaaaaaaaagnaanaaaaaaanaaaaag

SEQ ID NO: 8769 - DNA, 829 bp, Zea mays
ctataacatcgggtacctcgaggccggccgggaactcccaaaaccagaattaattatctgacggtgcatgtcatgcccatgacacccctcgagtgcgacatggcccctgcagcttctcgcaacaaacacctctcgcggtcgtggcctctccctcgctgcggcctgctggtcttggtccttgcactggcggcgaccgccgcggtgggcagcgcgcagctgtcgtcggaggactactacgacgcgtcctgccccgccgcccttctcaccatcaggaccgccgtctcgacggccgtgctgctggagccccgcatgggggcctcccttctccgcctccacttccacgactgtttcgtgcagggttgcgacgcgtcggtgctgctagacgacacggcgagcttcaccggcgagaagggggcggggccgaacgcggggtcgctccggggcttcgacgtgatcgacaacatcaagatgctgctggagctgctgtgcccgcagaccgtctcctgcgccgacatcctcgccatcgccgcccgcgactccgttgcacaactgggaggaccatcgtgggcggttccgctgggcaggagggacgcgaccacggcgagcgcgtccctggccaacagtgacctccctgggcctaccagcagcctcaacggcctgctcaacgctttctccaacaagggtttgagcagcaccgacatggttgccctctcaggtgcccacaccgtcggccgggcgcagtgcaagaactgccgggcccggatctacaacgacaccgacatcgacgcctccttcgcggcgtcgctgcgggccagctgccccgcgcagg

SEQ ID NO: 8770 - DNA, 1395 bp, Zea mays
ccgggattgcggggccagcctttgggggaagtcatatccgtgaaggagaaacgcgttttaggaatcgggcccattgggcccctcggcgccgggcccaaaaccagaattaattatctgacggtgcatgccatgcccatgacacccctcgagtgcgacatggcccctgcagcttctcgccagtcgtggcctcttcctcgctgcggcctgctggtcttggcccttgcactggcgacgaccgccgcggtgggcagcgcgcagctgtcgtcggagagctactacgacgcgtcctgccccgccgcccttctcaccatcaggaccgccgtctcgacggccgtgctgctggagccccgcatgggggcctcccttctccgcctccacttccacgactgtttcgtgcagggttgcgacgcgtcggtgctgctagacgacacggcgagcttcaccggcgagaagggggcggggccgaacgcggggtcgctccggggcttcgacgtgatcgacaacatcaagatgctgctggagctgctgtgcccgcagaccgtctcctgcgccgacatcctcgccgtcgccgcccgcgactcggttgcacaactgggaggaccatcgtgggcggttccgctgggcaggagggacgcgaccacggcgagcgcgtccctggccaacagtgacctccctgggcctaccagcagcctcaacggcctgctcaacgctttctccaacaagggtttgagcagcaccgacatggttgccctctcaggtgcccacaccgtcggccgggcgcagtgcaagaactgccgggcccggatctacaacgacaccgacatcgacgcctccttcgcggcgtcgctgcgggccagctgtcccgcgcaggccggcgccggcgacggcgcgctcgagccgctcgacggctccacgccggacgccttcgacaacgcctacttcggcaacctgctctcccagcgcggcctgctccactccgaccaggcgctcttcggcggcggcggcggcggcgcgactgacggcctggtcagcgcctacgcgtccaacgccggccagtggggggccgacttcgcggcggccatggtcaagatgggcagcatcagcccgctcaccggcacggacggcgagatcagggtcaactgccggagagtgaattaattatttattacagccacgttgattgcatttgctcttggggtagtggactagcgtgcatattttgcaaagaggcagagaagaattgaaatggagcctaagctcatatgtatacaaatgttgtttattattccatattatttcttgcatatataatatatatagcatacatgtaccaaaaaaaaaaaaaaatagcggccagtcattttagaccttaaaaaaaaaaaaaaaaaagccagt

SEQ ID NO: 8771 - DNA, 5322 bp, Zea mays
aaaaaaaaataaaaaaattgggtgtttacaacgaattttaggtcttggccccttgggctcttggtccaagcgattttttttctgtgggccgttgggtccgtggaacatatccgttgcagaagactacagattgcagaagcgctcgctcgctgttgttgctgctgccaactgaagggatgcgagccacggccaccgcaggaggccgtgcggtgttccacctccaacacctctgcccgcgcccgccatggcgagctcttcctcctgctgccaccacgcacctctcccgctccgcgccagcgaggcgagccgaccaccgttgcctccccaaaggtttcttatcaactctagaaccgaggatttcaggagtctctttgtgtcggcgtgctcatgcaacatgtagctattctttggatgacaagttacagggagagctagatgatacacagggagaacagagaaagctagaaacagttggtgcgtttcagaaaataccaatggtgatgcctgcaactgatatactaatgtcagcacaaaggaaatctagaaacgtgccaccaacaaagggtatagcaaatattgctaagcgtgaaaggaacaaaggtgcgaaacagcttgatgccttaatgaaagaactttctgtaccgctgagaacatacacagaaaacttcccaaagaggagagatttgcatccttatgagaggtctctcattgagttgacttttggcgagggttattatgagcaggttctaggacgtgtagatactctcaggaaaaggattacttctgttggaaagcaacatgcttcagtctgtgctaagtcaacaacaaaacgtgaagcagaggaacgcctcactgagggcagaaagaaactcgaagaggctttccagcatgggaagcacgccattgatgatttagtaaatgtagcaaaggctttgcgttctatgcctgttgttgatctacatattccaacactatgtctagttggatcacccaatgtggggaagtcatctttagtccggatattatcatctggaaaacctgaggtctgcagctacccattcacaacaagagggattctaatgggtcacattgtatctaatcaggaacgttttcaggttacggacactccaggactcctgacaaggcatgatgatgacagaaataacatagagcgattgacactagctgtcctttcttatctacctatcgctgtcctgtatgtgcatgatctatccgaagactgtgggacctcagtggccgatcagtacatcacgtacaagcatattaaggacagattcggtgaccgcctatggcttgatgttatttccaaatgcgatcttttgggaaagaaagagcccataagttttcacgatgctgatgaagatgtagcacggtacagaagattggggccagaaggcgccctccaagtatctgtgcagaccgaaatcggcgtcaaacaggttagctattctcgtgctagcctgatactgagcagcgactgcttgttgagtctacttattgcttatcatagcgacttacaggcccttaagaatctaggctaatatgcttctgtctctccagcttaaggaaagagtgcatgagctgctgacctctcagatggctcggatcaaatctagcaaggcggagcatgaaacacatgaagtagggactagtgttgtttactgaagtttgacaataataaggattcgaatatcatgctgggtgtccgcgtaaacattcaatgtcgatgatggtaacacattccatcagttgtccttttgtccatttggaaagggtggtcaaaattgcccattatgcgttctttagtagggtaccaccacctgtccgaaaaaaaaaagattatcgttcgtcttctccatggtagaaagattgtcgatagagctcgggaaaagattattgaaacaaaaaatcatttaaatgatcaagatgtctaataggagattgaaatgagcttttctatttttctttgcgtaaactaaatcctaattgctagcccagtttcacccgagtacctaacctaatatgacaatgttttgcaccctagttctcaaccatatattaaaaaaagtaaattgttcaaatgtaaatgtgtacaataaagatattttgatgttttgtagagatcttggagagactttttactaatcctcgttggggcatctatatatatgtgttgctcattcttgacctatgcaagaactaagtgctctttattggatgattctttatcgtcttggtataatgagtcacttataaccttgtatcacatataaaatctctgggtgatcattgttgtctcgatcgtcaccgaactgtctaggtgataatgatcatcaaaagtaacaagcacaaattctcacttaactttaccaagctttatgagatttatgggtgcacactaattactcttttatgcattactgaggtcacaaatcaatccaatactagcttttaagtcgctcactaggcaaaggcactttcttacaatttaaatgggttgcttcacctattaaattaaacaagagcacttatatgggtaggttggtgggatatttatagacccaaccagccgtcattatagtaactttgaaaaaattatgattgttggatcacctcaccctcaatgtcgtttgaattattgttgtgagcatatagaccgacactcaccatcggaccagtttaatacccgcaaaactctattttatcacttaacataggttgccggacccaaactcattggtctgacactgccactgttcatatcatatggtgtgattagggctagaaaataagcttgagactcgtgagcctcgaacgagccaagttgagcccatttttcgagctcgtttttccagtgagtcgactcgactcgttctagctcgcgagccacgccaaattaatcaatttatagaataataattaatattagataattttatggataatagctcgtttcttaatctttgatggtgaatatattacaatttataatttaaattactcataatgttgaatgatgattccatattttaaatttatataatgttaatttactaaataatgcaaaaataagtatcaggaaatggctcatgagccaatgtcgagccgagcctctttctccagctcgccaagtggacgaaccgaaccgagctcgttcagtcaccgagttgtaccaagccgagctcagcttggctcgcttccatccctaggtgtgatgatcatgtagaaagaaccctaaacttaatagttgcgtcacaggtcctatgctcaccgtcaaactagtttgacacatcttggaactctctgctttctttacatagaccatcggacccataaccattggtatgatgcttaactattcgcatggctcgacgatcatgctctcttgggttgtatacgtggagacatcggaccgttaacattggttcgatgaccctgaaactttagggttcaatgcctcaaaaaccattcttacagttttagctttgaaagcaatgtaaatggattttgatccaaacttattttaggcctcatttgaactacttagagctaaagacaattatgtgcaccatactaaactcattagactttcctaggtcaagctactagttaacacccctttatagtacggttaaaggaaaaaaacaatgtcctaaactattctaagtgtctcttaactccaagtgatacttagaacttgtccatccttaaccgtatcatccattccttgaaaatcaaaacaaaatcaataatcaagggcatggataaccattgattgcccaaataatctttgtcattatgacataactttaattacctttacaaaaacatatgttatacacaataatattttgttgtcataaatcatcaaaaccatagagggcccaatgctttcaacctccctccctttggtgattgatgaaagcgtcatatcaagtatgtaaaagaaatgatttttttaatggaaccttgtttataatagatataaagtgaataggcataaacaatcgtatgtgataggttatagaatgtgaagtaaaaacaagacaataatgacatctttcacaaaaaagaaaataatgacatcacaaccatatcctacatatgcaataacataaagtgtatcatataatgcatgagaatgtaaaattaagtgcacataaaagttccacacatagagaaaatagcaaataattccaaagtgtatctcttacaccccctctcccccgatcccccaatcttacaaactcttgacctccccccttgtcatcaaggatgaaaggaacaatgatgcttaagacgatggtgattagacactctagtttctctctaaactatgatctctacttttcttttagccaaaacttatgcaataaataaactgtcttatgtgtaactatggtttttactaagtgttgctatctccaccgcaaagagtaatacaaccttacaaacctaccactaactgatagctaagctagaaaggtaaagcatgcaaccaatataacacaatataaaatgtgaaagtttaaatacgttagatacaaaatacccatcaatgactctattatttttattgaggtataaagaagcatgcaagcttccttgtaatcctcgttggagctccacgcaaagaaatcccatgtgagggctaaacttccggtcgggtaactccatagatagcattcaagtggtgctccagttgtgttatgtcttatattctccatccatcgtctccactatgagtttctggacatattgttgacaattatggccacaccacaaacacagtttgtgtggtctcgcaagactacaagcccctcctagtacaactcaataccaatgtgtgcaagaaccaaggggtagaagtgtttaatcctaacttctaacactaggactagtcctagagcaagcactaatagaagtagtctaactaacctaagcacttcataaagtacatatgctaatcaccaagtgatctttaagcacttggttatctagagctactagacatgagacccaacaatcttgtgatgtttcttagctctcacacatctcaaatatctagtttatagtcctatttatagccccaatgagtactacaataggcgccattacacaccatcggaccatccgccgatggtagcattgttggaccattgagcatggtctgatgcatcacaatgactactgtgttagtactatttcatcactagccattactgactgttgggtatgctcatgcggtctaacaccttttatcgaaccaatctgataccctatttccctatctagaacctc

SEQ ID NO: 8772 - DNA, 5240 bp, Zea mays
taatgagttgaaggtgcatatgaactattaacacctattagcaaccccaaaccagctaatggaactagtagttagcaggcccctagctaataattagcaggtctatttggatccacaaatactaattttagctgctaatttttagtgttaatgtcaaaacaggccctaacttgtagtggtttatggactaaaatccccttttttttgacaaacggggacctagatttgaatttggcacagggatcataaaaagttcgggacagcccttaacctggttatggggtatggaacaccaatctaaaatatctttgtaacgtccactagatctttaattttttaagccaatataatatctcatcctaattgttaggacgagggccgagctggacctcaatcgctctcgatattcatcaactgctaaccacaagttagcacccgaagacataggagagggtgccctcggcataggggacctcgaaggtagcacccggagacagtgcgaacaccggaggacaacgggggttgcaccagcataagacgaaggccgctggccccgacggcgagggcccaaagacttcgctgttgatagagacatccgatctgagcagacccccaaggaggcgcaaagcccaacaaacccccttcgctgctaggcccggacacgtcccaggccaccatccaatacctcaccgcaatgggagcgggggcccaacgacgaatacccccagaacggaggtgaccaggactcaaaatgggggccgagcacgagggggctaaggcaagctgggtccccatccccggctgggccagatgggcccgcttgtcagtctcctacatgggtgcaaagcacggtgtcattgggaaggtgtcactattctgtaattaccccgttgtacaatgtattctgggaatgtagtaggtaaccggacacaacaccaatgaattgcatccatactgtttctatcaataggctaaattcagtgaaattgcaccatgtcaatgtccaaaaatgcatgcctataatacgctatgctgcaacaaatttcaattgctttgtttcaatgaaataaaatcggaggaaacagtacaattctgatgtttcagacttctaatagcctaagcagccacctaagggtgaactcttaaatttcacctaagttcctaatgaaacacgacattgatacatcattgcagcattgttcataactggaaaagttaacaactatcgagatcaacaattagcaacatatggctccactgatgtgtcagaatgaagagaagcatggcctgcaggaatcttaccctaccaaaattatcaggtttcgcctatgatgctgcttccgatgccgtcttggtgctcctgaagtctcgcttgagctcggtgatcctcttcatgcacacggcctttgtcttcccgggtacagaggccgccaccttctcccacctcattgcagtgtccttcgggaactccttaagagcgttcagcaaggcccggtcatccccggcgctccaagcggcgtccgcactctcggcgcctcccgcatcgtccgcagtgtcagcagcctcggccctcggatcgagcggcttccgcttgcgtaggaactgctcgaacgagcttcctcccgccgcgggagcgcccgactttgccgcccggatgacattctccggcgtgcggcggccgccaaacaccgcggcgatcttctcccagcgctggggctcacccgccgggtgcttcaccatctgccgccggagcagctccagctcttggtcagtccactcgccggcgtcctcctccctctcgccgccgtccaccacggctccatccgcagttgtcgccttctgcaacggatgcagtgatgcggccgattggacggggggagtgcccggatctgagggttttgtgggcgtcgggactgggttctggcgacggccgcggcggggggcgggcgtgggttccggcgtgggttctggggccggttctggagccggaacgacgcggcctcggccgacggagatgtcgccgccagtggccgacaagggcgcgaagggagcgaggagcagggacgaagcgatccatatgaggagggaggagaggatctggtaggtcgggaggaggtagaacgcggcggcgagaagtgcgacggccgcggcggcgcaagatgcggcgtggcggagggagaggggtgctttggcggtggaggaggagaacgaagtggagttggcgccggaatggacgacgcgagcgcgggactgggagtcccaggggtcgatgaactccatggtcaccggcgcgcgggattggggctcgtcggagtcgcaaggtgacacgaaatacagggtcagtggtaaatggtcctcccttgcatttttgcaatcggcaaatgttgtcggtttattattatgtcacatgtgtctatgattctttgatttgtgagattgtctgtatctataatttataggttcaatcataaagtagcaaagcacattgtatactatacgctactatgattttatttataagtatagagtataaaacataggtatatgtgtttagttggttggatgagtagaatgtaagtttagagcaagcattggtaatttggatctcttttatacataatttttagattaaatttagctattttgcgtatataatagagattgacaaatataaaagttcagtcattttttagtttaaagcctattttcttattgaacttgtcatacatcagtggctaaaagaaaaatcgtgtgctcgattggcatttagatgccatgtgttagcgttctttggccaatcacctaatgcatcatgatttagctcatggggaactagaactcgagtactcttcatacgagcgtggactgtccgctctaggcgtttggatcgttcacgacttacatgggggatgtcgctcttctctgcagggcggcagaccgtccgctcagaacggccaaaccattcacgcgtgcgcagaggctacgataatctccttcataatctggatctcgttctcgaaagagacccgtcaagaagaaaagatcctaaggttgtcttgagatttgcaagccgcttaaaaacgaatataaacaatgtcaactcgagaatgggtgaagattggagatggagaagactaatctaagctaagttatcgttactcctagagcaagaatgcaaaggtattgataataaattgatttgatcaatgcttcagtcggtcgtacttctcgtatatagggtagaggtctaaatccatttctagatgtaatagattcacgtacgattagttggataagcacacaaaataaaaaatatatcctaaattaatctaatcacagaccttctaaactataacttcgaggttatgacctcgaaccgtcctaagcgcagacagtccgaaacatatagccggatagccttgtctgaccgttcgatcatactaagatgacaaatcagctgctcaacatcatgtctgtaatggtgggcgtgagaaactgactgatgcggtactatacaaattcatccataaaattcttgtgcaatttttgtgcggaaaaaacaaaataaaaaaattgggtgtttacaacgaattttaggtcttggcctcttggcctcttggtccaagcgattattttccgtgggccgttgggtccgtggaacatatccgttgcagaagactacagattacagaagcgctcgctcgctgttgttgctgctgccaactgaagggatgcgagccacggccaccgcaggaggccgtgcggtgttccacctccaacacctccgcccgcgcccgccatggcgagctcttcctcctgctgccaccacgcacctctcccgctccgcgccagcgaggcgagccgaccaccgttgcctccccaaaggtatgccttaccaacttcgccgccacccccgccccttcgcacggagggtgttcgacggaacgcccgccgccgacgccttagatacatttagtcacgggcacgctctttgggttcttctatgcgcgatagatttgacttagcttagtttctattgaggcctgcgttctgttcacgcgggactgtctgcctactgcgtaggattatttatttacctactagttcccgtatcgtatttgccttacccaagcaatgaaagtggttggctataactgcaaggtgtttgatgaaatgcctatttccagtcacgcttctcagctctatttttattgcagggaaccaaaactctgctgcacccacaagcattattattggggttttcattgtctcttcaattttgatacactgtttttaacattttccaccggggatgccttcaactcaggtttcttatcaactctagaaccgaggatttcaggagtctctttgtgtcggcgtgctcatgcaacatgtagctattctttggatgacaagttacagggagagctagatgatacacaggtaaattcttttatgaacattttattagcaagtccatttcacatgttcaacaggccaacagggcctgacgttgaaacccatgttctggtttactaaaagatgggaatcattgtaaaactgatgacttacttgaaaaaaaggaaaaggggagttctcacccttagcagttaactaattttcacgcctcaagcactgaccttatgatgcacttgtaagttgtttaatttaatcatctcacaaatactgtattttcttggaaaaaatctagatctattagcatattacttcattatcatgcttacctattctgctactgctttacctaattccagggagaacagagaaagctagaaacagttggtgcgtttcagaaaataccaatggtgatgcctgcaactgatatactaatgtcagcacaaaggaaatctagaaacgtgccaccaacaaagggtatgattcatctgaccatttattattcacactctgctaaatgagggaatattgttctcttaacattttgttttagcatgaccaaacgtttgctttatgattcatatctaatgtaggtatagcaaatattgctaagcgtgaaaggaacaaaggtgcgaaacagcttgatgccttaatgaaagtaagtggatcatgttgtctttctactgagtaggttcatttatttgatattgagaactgttttgtttctcaggaactttctgtaccgctgagaacatacacagaaaacttcccaaagaggagagatttgcatccttatgagaggtctctcattgagttgactttgg

SEQ ID NO: 8773 - DNA, 1738 bp, Zea mays
gcacgagaccattacctagaacatcctaatcgaaaaaaaaataaaaaaattgggtgtttacaacgaattttaggtcttggccccttgggctcttggtccaagcgattttttttctgtgggccgttgggtccgtggaacatatccgttgcagaagactacagattgcagaagcgctcgctcgctgttgttgctgctgccaactgaagggatgcgagccacggccaccgcaggaggccgtgcggtgttccacctccaacacctctgcccgcgcccgccatggcgagctcttcctcctgctgccaccacgcacctctcccgctccgcgccagcgaggcgagccgaccaccgttgcctccccaaaggtttcttatcaactctagaaccggggatttcaggagtctccttgtgtcggcgtgctcatgcaacatgtagctattctttggatgacaagttacagggagagctagatgatatacagggagaacagagaaagctagaaacagttggtgcgtttcagaaaataccaatggtgatgcctgcaactgatatactaatgtcagcacaaaggaaatctagaaatgtgccaccaacaaagggtatagcaaatattgctaagcgtgaaaggaacaaaggtgcgaaacagcttgatgccttaatgaaagaactttctgtaccgctgagaacatacacagaaaacttcccaaagaggagagatttgcatccttatgagaggtctctcattgagttgacttttggggagggttattatgagcaggttctaggacgtgtagatactctcaggaaaaggattacttctgttggaaagcaacatgcttcagtctgtgctaagtcaacaacaaaacgtgaagcagaggaacgcctcactgagggcagaaagaaactcgaagaggctttccagcatgggaagcacgccattgatgatttagtaaatgtagcaaaggctttgcgttctatgcctgttgttgatctacatattccaacactatgtctagttggatcacccaatgtggggaagtcatctttagtccggatattatcatctggaaaacctgaggtctgcagctacccattcacaacaagagggattctaatgggtcacattgtatctaatcaggaacgttttcaggttacggacactccaggactcctgacaaggcatgatgatgacagaaataacatagagcgattgacactcgctgtcctttcttatctacctatcgctgtcctgtatgtgcatgatctatccgaagactgtgggacctcagtggccgatcagtacatcacgtacaagcatattaaggacagattcggtgaccgcctatggcttgatgttatttccaaatgcgatcttttgggaaagaaagagcccataagttttcacgatgctgatgaagatgtagcacggtacagaagattggggccagaaggcgccctccaagtatctgtgcagaccgaaatcggcgtcaaacagcttaaggaaagagtgcatgagctgctgacctctcagatggctcggatcaaatctagcaaggcggagcatgaaacacatgaagtagggactagtgttgtttactgaagtttgacaataataaggattcgaatatcatgctgggtgtccgcgtaaacattcaatgtcgatgatggtaacacattccatctgttgtccttttgtccatttggaaagggtggtcagaattgcccaaaaaaaaaaaaaaaa

SEQ ID NO: 8774 - DNA, 2219 bp, Zea mays
gtacccatccatgcaaggccttcagcccagcaaaggtggccgagccatttttttctcaacaaaactagtgatgtttggtcctttataaggttttgactaaagtttagcctgtgtttacatccaatattcgaatgccaatgacaagggtttaatatagtctaatcacaaactaattacgtggataaaaactgaacggcgagacaattagtaaatgtttattgtagtatcacactatgtattaataggtccgtcttgccgtttacttcgtgtctatagaattagactatatttaatactcataattagttttcgaacaactttagttgatgaaaaaaacaaagctcttaaaaagatacgtttttatagagagccgagaaggagctcagggcccacgatccgaggccgatgttcacccagtacaaatgtacaccccttgtcctcctccttggcccatcgtcaatcttcaccaaagccgccccacgcgtccgctcgtctggatctctctcactcctttcgcgcacaaggttttcaatggcattgaccggtagaacacgtgcccggacgccaattatctcgccctttcagatttgagaacaacaaggaggaaaagtaaacgcaagttcaggaaaggggagcctcaaaaggagagggagagtgagagggaggggaagtgcgctgcagtgctgcgcagctgcgctggggagaagagaagaaggtgccaaccacttcccaaggagaccgccagctctgctgctgcacgaccgaccagcccgtccactcgcctcgccttcctccgaaccccggcgaggaagaggaacccgccgccgccgccggacgcacttccgatggcgacgccacggaagccgatcaagctcacgctgccgtcccacgagaccaccatcggcaagttcctgacgcacagcgggacgttcacggacggggatctgcgcgtgaacaaggacggcctccgcatcgtctcgcggagggagggaggcgaggctcctcctatagagccgctggatagtcaactgagcttagatgatctagacgttataaaagtgatcgggaaaggtagcagcggaaatgtgcaattggtccgccacaaatttactggccagttttttgctctgaaggttattcaactaaatattgatgagagtatacgcaaacagattgccaaggagttgaagataaacttatcaacacagtgccaatatgttgttgtgttctatcagtgtttctatttcaatggcgccatttctattgttttggaatacatggatggtggctcccttgcagatttcctgaagactgttaaaaccattccagaggcctacctcgctgctatctgtacgcagatgctaaaaggactgatctacttgcataacgagaagcgcgttatacaccgagatctgaaaccatcaaatatattgataaatcataggggtgaagtaaaaatatcagattttggtgtgagtgccattatatctagttcctcttcgcaacgagatacatttattggcacacgcaactacatggcgccagaaagaatcgatggaaagaaacatggttctatgagtgatatctggagtttgggactagtgatactggaatgtgcaaccggcatctttccatttcctccttgtgaaagcttctacgaacttctcgtggctgttgttgatcaaccgccaccttctgcgccgccggatcagttttcaccagaattctgtgggttcatttctgcatgtctccagaaggatgctaatgacaggtcatcagcccaagccttattggaccatccgttcctgagcatgtatgatgacctgcatgtagatcttgcttcgtacttcacgacagcaggatctcctctcgccaccttcaattccaggcaactctaatttttttgtcctccttattacgcgaacggtgtggcgacaaatttctctttttggacaaggcttggattgtgtactgagctgtaatgatcttgtgtgtgtcaggtcggtgattggctccatcactttacatatatgacatacatgtacagccttttaggataaaaatgagcactgaagttttgcctatctgtatatcggcagcaaacgtttggtcatgtttgtttcaccttgtaatgtattgactcagatatgggattggtcattgtctcatttggtgtatgagtcaagtccagattttcttgtaaaaaaaaaaaaaaacat

SEQ ID NO: 8775 - DNA, 3618 bp, Zea mays
  misc_feature (2398)..(2398): n is a, c, g, or t
  misc_feature (2473)..(2473): n is a, c, g, or t
gctcccccgaggactactcctcgccgtctcatcctctccttcggcggccaccacgccagggcgcccaagcaggagctgctcgacgccgccgccgccgcgctgccgtcgttccagcaggcgcgcccggcgcccaagcgctcctacgacgacatgatggccgaggccgccagggcgcctgccgccgccgccgccgccgcacgcccggcctcacagaaccaggaccacatcttggccgagcggaagcgccgcgagaagctcagccagcgcttcatcgcgctctccaagatcgtcccgggcctcaagaagatggacaaggcatccgtgctcggcgacgcgatcaagtacgtgaagcagctgcaggaccaggtgaaggggctggaggatgacgcccggaggcgcccggtggaggcggcggtgctggtcaagaagtcgcagctgtccgccgacgacgacgagggctcctcctgcgacgacaactccgtgggcgccgaggcctccgccacgcttctgccggagatcgaggcccggctgtcgggccgcacggtgctggtgagggtccactgcgacaaccgcaagggggtgctcatcgccgccctctccgaggtggagcgcctcggcctctccgtcatgaacaccaatgtgctccccttcaccgcctcctccctcgacatcaccatcatggccatggctggtgacgacttctgcttgtctgcaaaggatattgtcaagaagctaaatcaagcattcaaatcacccttctgatgggattagcttaatctatgtcaacttttttcccattagccttaaggatttgaggcttagcggctcgtgatcaggtccttccttgcctttgcttccgaagagagttgcttgcagtccccaagagtccccccacacaaagatagccatttccactggttttttgctacatgggtgcagagattgatcacctagctagttacctacttaccatcccattttatctgtctctccagttttttacatgggttgatgttgtcactccatgtttttgggagagagcagattgtaaaaaaaaaacagcctttttttctagggctttgctatataggcctggggagtttgacttttacaaacctaatttttctttctccccttcgcccgtatgttgccctttaattcaccttgttttttccatgagaggatggtgtttttcaaacaccagcacctaccttcgccgtcctctcaaccttgatcacactgctcccagaaaaagcttcagttgtggagaaaatggcgccgtctttttttttaatcagctctgagggggactttgcaagccttgatttggaagtactgtagggatgcctcacttctattgtttctgttttttttgagggtcctacaagttggccgccacttgaaacttgatggagcctttgcctatagttttcacatgtgagttttgttgtcacaggacaggatgaaggtgtagttgttgtcatctcttgtttactctcatagaagcataaataaataaatgtgctcgtttggtacctcgcctccctttcttggtcacatgtcatttcagcttacgcgtgatctttcttttcttaatggtgagaaaattcgcagattgctcatggaccgcgattgtgattgttccttacatacacgtccgccggattcgagttatcctactattcatagtcactccacagactactattcatatttctgtaattagtttcaagtgcacctaaaatgaccgtgttacatactatctttttaaaacttataaacccttaatttctaaaagactgtagacatttattttttggaattatgaacacataacacatcccctagttctctttttttagaacatcccctagttggctagttctctatgctgtatcaattttggaacttgaagcctggcatcttcagcatgacaacaacatggtgtcctaattcccgtgtgaactccctcaccgttgcagctatgaggaaacaatactaatagtgcaatcgtagtttcttgtgtcacagcacaccacaccataccaaagtgccttgacaactaagttgcattagtcaaccaaagcctaccttgctgtggtgtcacaacaaagacttgtttgttggccaaagcatctgatctcctcccactccgtggctttttattttattttattttattttatttctaaacgcacaaacaattgcaaccacgaccatcaaactaaggctctctaatccctgcacacaagtttttgtctgcttgtgagattttggatacatgattgaggtggcaggatccgaatattgtcagcccaatgggtttgaaacgatctgagactgatagcttgccatggcgtctcttaaggaattaggttactactccctccgtctcagnatataaggcgtaaccactttttattcttgtcccacgatataaggcgtgctctctctatatatacgtatatcgatncaatggtatagacacagttaaatacatttcttggtctttgaaccggaggtggttgtgccttatatagtgggacggagggagtattgactacctgcaaacagtccccctcaaaccacatcactgattgcgatgttgtcccctctaggaactggctgctcaaccaatcgcaactaagtctctaattatgtggccggtggcagcatatatagttttgctctgcactgaatgtacaacactatttaatacatcgtctcttgagggttttctaggggataaaatgtaaaaaatacacacgactctttatatataatgtcttttgatagcatttatgatgtaactgattcttgcgtccctgcagatgcagttttttatgtatcttttgtgtatagaaaaccgaggctgtagattgtgagaagttgtgaacgattccacctgtgaaaactggaacggttcatacggtagtctgctgtcaaaacccaaaaagaaatagcgcaaccatgctagctctctctggtcagagaacgattgcgtgggaggagactggatgggcgaaaagggtatagtactgtaaggccttgtttggatgcacgagtatacaccttaatccatgtgaattagagctgtttggtgtagaatttagtttggaatctacaccaaactgcttcaactcatacggattggagtggacacatgcgcatctaaggtgattgcgcgtggcgtaaccgggcgttggcaacgtcgttcgttggggcgctggcgaaagcaattagaacgctccaagaacggcgacaggctgttttcagactgcaggtttagttttcagtacaagacatggtcaaggtgacttcgttgtataatatcttttgatctgcggcagcaaagtatttggtggagagtggtattggtatgttataaaaaggtgacctaacaggcttacatgcatgatctgatcagtttgtacaggcatacgttttataagttcataatccacatgatttgtagcctgcaccatcttgtcttgtcttgaaccaccacatgtgtttctttgcttaaacgcttggttgcttgaatacaagaagcgtggactgcatggacaggtgcaaaacaactcatttaggcctgttcgtttacgtcggattgcaccc

SEQ ID NO: 8776 - DNA, 1872 bp, Zea mays
ctagcaataatcaaacgcacatgatttggtcgtcgttttcggctcgccctcgccgtctgatccccacctccacccttccctctcctcaaaggctcaaacaacagcggcacagcgctcgattcggcttcgcctcgactcgcgggctcccatcgcaaagctctaaacccctctgagaacctagtcgggccaccacaaccgccacccatggacggcggcgacgctccggcgtcgggaggagggaaggtggcgtgcgcggcgtggatccggcgccgggaggacaagtcggcggcggcgccggcgcgggtgttcgcggcgtacggccgggcgggggcggccggctccccggccgctctcgaggtgcttggcttcgacgccaaggagtgctccctctctccctctcccctggcgagggccgtgatcggggacggcggcgcgggtgacgcgccgcgcggcatcgcggtgcaccccgccggtgacgagctcgtctgcgccacggcgaagggctgcaggttattcaaactgatatttgatgagttcacagtacgcattattccaagagatgctcctctactagaatctgttggaccacaaaagtgtcttgctttcagcacagatggtgcaaaatttgcaattggtggagaggatggacatctcagaatattccattggccaagcataaaagtgcttttggatgagcccaaagctcataaatccttccgagacatggatatcagcttagactcagagttcttagtttcaacatccattgatggatctgcaagaatatggaagatagatgagggcgcaccactggtcaatttgactcgatcctcggatgagaagatcgagtgctgccgcttttctagggatggcatgaaaccgttcctgttttgcactgttgcaaaaggtcccaaagttgttactgttgtctggaacataagcgattgggagagaattgggtacaaaagacttctggggaagcctatctccacactctcagttagcttggatgggaagtatctggcattaggaagccacgatggtgacttctgtgctgttgatgtgaagaaaatggaagtttctcactggagcaagaaggtccatcttggctccccagtcacctccattgaattttgtcctactgaaagggttgtaatctccacatcacatcagtggggagcagagctcacgaaactgaacgtgcctgccgactggaaagaatggcaggtctggctcgtactcctggcgctcttcctagcctccgccgtcctgttctacgtgttcttcgagcgatcagacacgttctggaactttcccatggggcggcaccagccggcgaagccatggaacgtgctcaaggagtctcctccggtccccgaggaccagactccatggtgatggtattgcttccatcgcgtcatctgtgaagagaagagcgatactgtcccagacccaacaaagccaccgcgtgctgtttatcttgttacaattataaatcgtccatgcttgttctaccactctcagccagtgaccacgcaagtttgtaaccctggactgccataaaccaggtgatagtaattgaacattctgtcttcgtgcgagtgtctgagtgtgtatccaggtattaccatgccgaccactgtcctgcttcctgatgacgaggtggctgatttcctcgtctttatttatacgttttgggatcaagagaaataaaggagctaaaacctctttgctattcaattttgaatagcaagatgattttgtcaaaaaaaaaaaaaaaaagcccggtttggaaaccctaatcgagattggagggcatggaattgaattgagttcaataccaaatcaaccactggtatttaaatgcgatgt

SEQ ID NO: 8777 - DNA, 4191 bp, Zea mays
  misc_feature (1794)..(1794): n is a, c, g, or t
  misc_feature (1911)..(1911): n is a, c, g, or t
cgggtattctatcaatcctattcaaccttaaactacgatgtcatataaatggagaccgggacgacacgacatgactgagagtgcgtggcgaacacgtggaggcaacacgtcgagatcgagagtggtgacagcaagagatacgagaagagggagacacgcacacccaaaagagttggtgttagataaagtacttactttttgttattcgtagaggaaactggtaaaactttaatattcaaatatttaatgtgtcataagctaaattttggttaggacgtggttatgacgtggtcgatggaaattgatcattttttgggcagctttaaacacacttgaaatttatttttggcctataattttttttttcatattttcttattgtgttgcacgaatttatttattggtaaatatatacagatatacatcagtgtgacggtgtactcgacatgaagtacaaactcggatataaaggcagccagcctgcatgtagtggtacccagtattttctgatctgcgaggcttcgcatttgcgccttgtatattcaagtggcaacatctatgtatttggtaggtgagacgcccaatgacgctaaaaaaaaatgaactctttctgtgtgtaacatgtgccgccgctgacaggatgatgaacggctacctcagctttgaggtctcggatttttctgtttaaaacaaattgataatgtgatcctctgagctttaaaacgggtatagggctataggctaaaataaggaggcgaataaacgaatcaaggaaaaagatgggaaaattaaagatggcgagagaagggaagaaggaaaggaactaaaatggttcactgtgaggaggaaggagagatcgaggagcagtggtgtagcatgactgatttctgtccttttaaaaagcccaccaccctacacgagacccattttttttaggttttttgaaattgtgagacctttttttttaatattactggtcctgcgatggccgttgaggaggatgagaggtgttgctggactggacgggcatcttggccagctaggatggcgagggacggaagctttctctgaaagggaaagcagcgaggagagagagagagggcagaggagagaggaggtggggtgcagtgcagtcaaagctggcatcgcatttatctctctctatccctgactccgaattgtattccccccatttctttcccactcgattcaagcccagaaaaagcttatgaaaatagagtaccccgggagagaggcgatagatttgggagctagtaatggccccatatatataacctcctccctcttcacgccatctcttgccttcgattgcccttccggcgttcctacctcctccccctccccatctcctcccaatccgtgtcctcccctcggttggggatcgacacaggctacgcgtgggttgcgtcgattgatgcgagggaggcaatggcggtttcttctgctccggagaagaagaggaagtggctactcagctacaggaaggtcagtgctggttcccgtcctcctctgctgactccattcttgagctgggttccctttctcttccattccacctgaatgtttcttggtgttcaagaactgcacgaaagcccaaggtagtgtctttttgacttctggtgcagttgacgtccaaatgccaggagggcgtgaaaccgtttggatctctgaagctcgctgtgcgtgccttgtgtttgtttcgttcagcaacagcttggttccagcgcattctgtccggtggcttgtcctgttttggtttcctttgttttgttngttcccctcccccctccccaaaaagaagagaatgatctcatctcagagtggtcaatcctgccctgttaagagggaagactactgttcttgctgcggaaaaaatctgatgtttccgtncctttcgcgtcccgtgatcgacaagtacctgcgggaggcgaggaggattcttgcggcggcgccagagggtggcggaggcggcgatgcggcggcggcactcggcctggtcgacgcggcgctggagctgtcgccgcggatggaggccgccctggagctgcgggcgcgcgcgctcctcgcgctgcgacgctacagggaggtggcggagatgctccgggattacatccccagctgcggcaagtcgtgctctggggaggacacctcgtcgtcctcttcggcgtccctcctgtccaccggctccggtgacctcggcacgatttcccgtgccaagctcctctcgcccgaccgccaccgctctgacgacgcggaacctgacgctcgccctgtccgcttcttccgctgcttcgacgtctccgagctcaagcgccgcgtccttgccggcctctccaagaacccgaacacggacacccagtggaggtacgaaaccttgagaacattgcacgaactggcgtcttgacttggcgaacccgaccgatttcctgatggttgatgccccaccatgtacaggtacttggtcctcggccaagcttgcttccacctcgggctcatcgaggacgctatggtgctgctccagaccgggcgccgcctcgcttcggcggctttccgccgcgagagcgtgtgctggtcggacgacagcttctcgtcgtcgtccgccaccgctgccgcggctccctccgtcccgtccggcaaaacatccaagtcgagttcggcgtttttcataatcccggcgacggagtcggaggccgtgtcccagctcctggcgcacgtgaagctcctgctccggcgccgcgcggctgccatggcggcgctggacgccggcctgcctgccgaggccgtgcgccatttcaccaagatcctggaggcgcgccgcggcgtgctgccgcacccgttcgccgccgcctgcctcgtgggccgcgccgccgcgttccaggccggtggccgtccggccgacgccatcgcggactgcaaccgctcgctggctctggaccctgcctacatcccggcgctccgtgcccgcgccgacctcctccagtccgtgggcgcggtcgccgactgcctccgtgacctcgaccacctgaagctcctgtacgacgccgcgctgcgggacggcaagctcccggggccccggtggcggccgcagggcggcgtgcggtaccgcgagatcgccggcgcgcaccgcaagctgacggcccgcatccaggggctgcgcggccgcgtcgccgccggcgaggcgtgcaacatcgactactacctgctgctgggcgtgcggcgcgggtgcccgcgctccgagctggagcgcgcgcacctgctgctctccctgaagctcaagcccgaccgcgccgtggtgttcggggagcgcctggagctcgtggacgagcaccgcgacctcgaggcggtgcgcgaccaggcgcgcatgtccgcgctgctgctgtacaggatgctgcagaagggttactcgttcgtcatgtcagccgttctggacgaggaggccgccgagaggcagagggcaaaggacgccgccgccgcggcggccgcgctggcggccaagcaggaagccgcgacgcaggagccaccacagccggtgcccgggaaatccaagaacaccgagagcggcagcggccgtccaagaagcccgccaggccgcgcgcagacggcgaaaccgaaacccaagtccaaggccaaggccaagtccgcgaccgcggcgacaatgccgaaggcaccggcagccgtgaattccacagcccccgtctaccagggggtgttctgccgcgacatggcggtggtgggaaccctgctgtcccgcggcggcgcgttcgaccgcgctctccctgtgaagtgcgaggctatgagctgctgacggggaatcctgttcccccccgtcctacacaacaccacatgacatgtgcgacgtggtgtgcaccgagacggagacaggcgcgacgtgagagtgatccagcgaggtggcgggaaagcggacatgtgtttgaaattggtttttttttggtcgtctagctcgctgttgtacagttgggggaagtggtattcgattcgtattgggtggggagtgggacagacagacgggaggaggggagaaagaaacctggggtgcaggcaggatgaggggggagccagtggactgtaattttggctgcgtcttggagaacggctcgttaattacagtgcttttcagttgtgccattgtacttgtgcctagccgttgtt

SEQ ID NO: 8778 - DNA, 2995 bp, Zea mays
ccattgacgcggagatgcaattcccggtcatcaccgggtttcccgctgatggcaagaaatgcatccggcagaaggccacaaaaaaacgtaggctttgaccagtttatcttcctgatatagtttccatgcagtaagccgtacctcccggaccaatgaatcgatgcgcgcgagtaggaaacggagaagaggaatgtccactcgtagctaggtcgtatcctctatataagacctatgtccccctcttgaaaagaccaaacacgtacacggtgcagtgcaatccactcacctgctatggcgacatcaaggccccttgccttggcgctcctcttgtgcgccttgtcggcctgcagccacgccgccatttcctacccaccgtcggccatgtccacggcggcacctgccaacaatggcttcctctcgtgcctcatcaagagcgttcccccgcggctcctccacggcaagagctcgcgtgcgtacggctccatctgggagtccaccgtcaggaacgtcaagttcgtgtcggacaagacggtgaagccggtgtacattatcacccccaccgaggccgcgcacatccaggccaccgtggcgtgcgggcgcaagcacgggctgcgggtccgcgtgcggagcggcgggcacgactacgagggcctgtcgtaccggtccgccaagccggagacgttcgccgtggtggacctgtccatgatgcggcaggtgcgcatcgatggcaaggccgccacggcgtgggtggactccggcgcgcagctcggcgagctctactacgccgtggcgaagatgacccccagcctcgggttcccggcgggcgtgtgcgccacgatcggcgtcgggggccacttcagcgggggcggcttcggcatgctgctgcgcaagtacggcaccgccggggacaacgtcatcgacgccaaggtggtggacgccaacggcaccctgctggacaggaagtccatgggcgaggactacttctgggcgatcaggggtggcgggggcgagagcttcggcatcatggtgtcgtggcaggtgcagctcgtgccggtcccgcccaaggtgaccgtgttccagatccacaggggggtcaaggacggcgccatcgacctcatcaacaaatggcagcaggtggcgccgtccctccccgatgacctcatgatccggatcatggccatggagcaggatgccatgttcgaggccctgtacctgggcacgtgcaaggacctcctcccgctgatggccagccgcttcccggagctgggcgtcaaacaggaggactgcaacgagatgccgtggatccagtccgtggccttcatccccatgggcaagtcggccaccgtgatggacctcctcaaccggacgtccaacatcaaggccttcggcaagtacaagtctgactacgtgaaggaccccatcccgagggacgtgtgggagaagatctacacctggctcgccaagcccggggccggggtcatgatcatggacccctacggcgccaggatcagctccatcccgcaggatgcgacgccgtttccgcaccggcagggcgtgctgttcaacatccagtacgtcagctactggttcggcgagggcgacggggcggcgccgacgcagtggagcagggacatgtacgcgttcatggagccgtacgtcagcaagaaccctaggcaggcgtacgccaactacagggacctcgaccttggcgtcaacgaggtggtcggcgacgtctccacctacgacagcggcagggtctggggcgagaagtactacaatggcaacttcgagaggctcgccaggaccaaggccaaggtggacccctgcgactacttcaggaacgagcagagcatcccgccattgctcaagtgatcgatgatacccggtcccatccagatcctttcgaccgcgccaagcaaaaggacgacgagtcgtacatgattctgctgattatattaattagattgatcctgctttgcatgcgttgagccaggtgctttgcatggcgagttagctacgtagttggcatcagccacatgcatgacattaaaacacaagctgacagccggctacccaagtaaataaggatacgcgacatacactgtcgtgccaattagtatggctgcttcttcttttttaatattattagtcaacattttatttcattttccttgtactgatgctactccatgcatcttaattatattcatatatatatacacgtcgccatatgacatttttcttgcgattattgacgcatctctgtgacgcgtttggcaatatttgggagttacttgtgttgaaacttgaaacattacgaaactacattggttgatatatattaccctcccagagctcttaattataggttgttttagtttttttgatacacaacttttattattatatagaaaaactaattctaaacatgacgggtccatgttctacaaattaaattaattaaagggcgtgaacaagcaatcaaatttcaaaaatacagaaggactttgcctcctaaatgtaagattcatttttttgcacaggttatagccaagagagttaataagtggcaaaaaaaagtcatacacccgtatgtgttatagttattcattaaatgatgcatacactaccagaaacaagttccttattgagtacttagagtttgccgagtgcaaaatcttgggcatttgacaaagaatactttgtcgagtctcactatcgacgaaaaacaacactcaacaatgaccatctttaccgagtgcacaacactcgacatacaatgactctcgacaaaggcatatttactgagtgctaaacactcggtatactaagactctcggcaaatggtcgtcaacagccgtctgtacatgacggtagttaactatgtcgagtgctcacggaggacactcgacaaagtcatgtctttaccgagtgccaccttgagacactcgacaaagaattcctttatcgagtgtctttctcttggtactcgata

SEQ ID NO: 8779 - DNA, 2979 bp, Zea mays
acgcacgtgggcatgcacaggcgcacagcacagcgcgtgtcccgcacagctcagctgcctgcttaagactctggtgcgcgtacaccagacaccggatgccttccttgcactggcccgcgtcgggacctacgtgctagcgccataccataggcggaggccacccccgcgtaggcgtagccgcgtaggcatacgattcctgcgtcatctcgcctcccgtggtcgacgagctcgcgtccacgtttaaatggctccactcacacttggcctcgttctgctgcagctcgtcccttttgccccaatcttcttctccaaaccacatcctctggcctctgacaggtgacgagtcccatgggtgccgcggcgaggaagcccgccgccgctctgctgccaatctggctctgtctcgtctgcgtgtcaagtgagtagtagcaatctcttttttgtctcctattctttttccttttcgcggagcagcgatctcgatagcgagtctctctagaactagtgcacggaaagttggcggatggggaaggaaggaaaccccaggctttacccgctgccgaaaagttcttctggaactgggatgggtttcatctcttttctgggcggttgattgagtggggttgatcgagttggggtgggggagtgttatcctatattcatcggctgccagctttacgcgattggtgatgcgggagccgtacattgcgcgcgtgcaggagcgcagccgtacatcggcgtgaactacggcgaggtagcggacaacctgccgtcgccggacaagacggcgaggctgctcaagtcgacgtccatctccaaggtgcggctgtacggcgtggacgcggggctgatccgcgcgctggcggggtccggcatctccgtggtggtgggtgtggccaacggcgagatccccacgctggccgccgacccggccgcggcgtcgcggtggctggccgccaacgtgctgcccttcgtcccggcgaccaccatctccgccgtggccgtgggcaacgaggtgctggagtccggggacgccgcgctggccgccgcgctcctcccggccatgcagaacctccgcgccgcggcggcggccgcgggggacggcgccgcggggatccggttctccaccgtgaacaccatgggcgtgatggcgcagtcggagccgccgtccgcgggcgcgttccacccggacgtcgcgccgcagctgcagcagatcctgggattcctgagcaagaccggcgcgcccttcatggtcaacccctacccgtggttcgcgtaccagtcggacccgcggccggagacgctggccttctgcctgttccagcccaacgccgggcgcgtggacggcgggtccaaggtcaggtacgccaacatgttcgacgcgcagctggacgccgtgaagtcggcgctggtgcgcgccggatacgggggcgtggacatcgtggtggccgagacggggtggccgaccaggggcgacgccggggagcccggcgccacggtggagaacgccagggcctacgtgtccaacctggtggcgcacctgcggtccggcgccggcacgccgctgatgccggggaggtcggtggacacgtacctgttcgcgctgtacgacgaggacctcaagccggggccgacgtcggagcgctcgttcgggctgtaccacacggacctgaccatggcgtacgacgccgggctgacctccaactccaacgccgggggaggtacaggtactgcggcgccggcgcagcccaaggcgggcgggtggtgcgtggcgcgggacggcgcttcggacgcggagctgcaggcggacctggactacgcgtgctcgcaggtgggcgtcgactgcggcgccatccagcccggcggcgcgtgcttcgagcccaacacggtgcacgcccacgcagcgtacgccatgaaccagctgtaccaggcggccgggcggcaaccgtggaactgcgacttccgggcgtccgccacgctcacctccgagaacccaagtacgtgtgcccgcgtcgtccctgtctatctccgatttctcttgctctgctgttgcttcttgttgaatcggccacatgccatgcattggtatgcttcttgataacgtcagccgtcgctgctcgctagctaggcaggcctgaatttgttgggttttgtccatgcggagatctcgcagttccgcatgacaatggtgacatgacatgtgcataagtatctccgtgcttgctttgctagaaaacctaactctgcctacgatccctgcaggctacggcgcatgcgtgtacaccgggggaggccaataatacaccgcgtggcagcgcacgattagttttgcgtgtaccatgcatgatgccgagcgagggaagttgggcccacaggctacagcaaggaggtctggactaccatggatgccaatgcgatccacggaggcgaagcatcctcttgtttggcgcgtcctttccagatgccttgcctgccaggctgggatgtgtttgtaacttcgtgtaaaaagaactgttagatgtttgccagtgtcacgtgatctttgtgcatatagtacgcgtgtcttaatttacaagtggaatgagattgtatgtgtgattaatttttttaaataatgttttatatataaaaatgttagaatatagtataaatgaattgtctgtatcctcctattaacttaatcattttgcattgaattagttggtacatataacttatatggtattagcgtaattaaaataaaataattgttgctcgctcttatattccatgtctgagacccaagaggggctcaacatgagtgagagtgttagaatatattataagtgaattgtccacctcctctcattagtttaagcttttgggttgaactgattggtacatgcaacttaataaaaaaataatctttattcaggttcgagtgttcggtttccctcgaccatatatctagccaccgttgtcgctaacacaaacacatca

SEQ ID NO: 8780 - DNA, 3734 bp, Zea mays
acttcgtggatttttctctctctctcttgaaactaatggtgaatattgttctatgcagctgaataacgatattgtcaatgtactgaatatctctattggtgccatattggctgttctaacgcagcagctgctcgtcagttggagatcttaatttttccttttgacttaggtctgcatccactattcgaattttattcttgtagtagctgccatattttgcccatctgaaatgtaatcatagattcacatttgggcccatcctaactttctctaggttccggtctttgttatgcctactgtgaaaatgcaaaactgtctttccttcagttacattgaggagttctctaattatgctgttaacttaggcagatgttgattaggatctgtttgatagagctctcaaagtgttttttgggagctgaaaacaattttttttattaagaagtgggtgattttatgctaattacgtgaagtaattcctgaaaataaactaggagattaagagctgcaaaaggtactttctttaaaatcattccacacacagaattattttatgtatagcctagagattcatttttatccaaagaaccactttccagaacatactagtttttttctatttttttttctcttgcgtgcgattcttaagttatgataccaatcaatttctatttctagggaggttttcttggtaaaaaaatcgatcacaaattaaaactgatgagtgtcagatgccatgtaaaataaaataaaagtaaacttcagtatcatgtgtactttaatattacctccattgacggtggctagttcatttttgaactaaaaataggtattcatataagtgacaatgagttctgaattttacattataagatttaatggtacgatcggattctatttctattaatttttaaattaaaatttatttagagtcatgtgaagaagtcatgttaagaattatttggattgtggttcattaccagctctatctatttatcgttgagcaaagagccaagctggcactgtagcaggtggtgattgtccggtaatctcgtaacaataaacaggggcttcctttatttgaaggcgtttgatgggacatgtgcgtcgcgaggtgacgcggttgcaggcacctctccatccttctgccaagcatcacatggcgcgtgcttttgtagagaatccggcgctgatcggtcatctcagtggctcagtctgcagtgcaccacccaacactattgccttcggtaccagtaatgcctgagtcgaacagctttttttttgtcacgtcggctgggacgtgccgacgcacagcccacaccagggttgggatttgggcctttgaggtgttgggcaaagccagggctcgcgccgacgtgcgggtgcggggtcgttccactgccgcggcgtgtgacacctgaatcctttggagtcttttttcatcagtgttcggatttctgtcttgcactcttgttcaccgccatcctacttccacagttggcaacggagcacgggaggcaacggccccccccccttttacacttaaccatccagcgatctcagtgacagtgtgtaggagtacggctgcgtctcgatttataacattcgcgcttacctaaatctctctaagaataatgttcatgtctgcacttctaaattgatttattataaaaaaaataaaaattataatcaactttatgatatttatttttattataaagtattggtgttttatttataattgattgttcttaaaatagtaaagcataatattatgtgctaaaattgtattctcattcagggtgtagctagcgcacgaccagtcaaactacgtacactgtattactcgatcctgctactatacagcaagaacctcaagcgtgcggttccttgtgagtgacccctactggctactgctacagcggaggcaagatcctggatgcggacctccgtttgtgggattacggcgggcgacacgaacgcacggcgaggccttgcctggacgggcccccgtgcccggtgcccccccccctgttctgcttgtatctggcgcgctttctctcatgtcgcgtcaatcgagtcgctcacgcgagtcacctgttttctttactggaagtgcaaccccctgttttactgcaagtgcaagtgcaaaggcttcatggcgagcgactctccccagtccccaaagcccagaaccccagagacgcacgcgcgagcgcgaacaacatgctgccggcgctcattgccctgctgctgtccctgctccccgcggtcgccgacgcagcgtcaatggatccaacagagagggagacgctgttccgcgtcatggaggccgtgtcctccgaccgggactggcgcgtagagagccccgacccctgcggcgggccgtggccggggctggagtgcaagccggccgccgacgcgggcgcggcgcgcatgcacgtcacgcggctggacttcggcgtggagcccaacccgacgtgcaaggactcggcgtccttccctcccgaggtcttcaccctcccgcacgtccagtccctcttcttcgtcgactgcttcaccaacccggccgccaccacggcgctcgccctgccgccgcccgccaacctctcggccaccggcctgcagcagctcagcatccgggccaacccggcgctgtccggcgtgatgccgccggcgctggccagccttccggtcgctccaggtgctcaccatctcccagaacggcctggtccgcggcgagatcccgccgggcatcggggacctcacgtcgctgctgcgcctcgacctcagctacaactcgctctcggggccggtgccaagccagatcggccagctcaagagccttgtcggcctggacctcagctacaactcgctctccggcgccatcccgagccgcctcggcgagctgcgccagctgcagaagctggacctcagctccaacaacctcaccgccggcatcccggacgccgtcgccaacctcacgtcgctcaccttcctggcgctcagcaacaacggcctcaccggccgttttcctccgggcatctccgggctgcggagcctccagtacctcatcatggacagcaaccccatgggcgtcccgctgccttctgagctcggcagcctcgcccgcctgcaggagctccgcctggccggctccggctactcgggcccgataccggacgcgttcggccagctggcgagcctgacgacgctctcgctgcaggacaacaacctgacgggacccatccccgcggcgctcagccggctgggcaggatgtaccacctgaacctcagcaacaacgcgctcggcggggccgtgccgttcgaccgcgcgttcctgcgccggctcggcgggaacctcgacctgagcggcaactccgggctgtgcctggacgaccggagcgccctgcggggcatcggcgcctgccgaggcggcggcgacggtggcactccgatgtcgtcgtcggcgcgcactagctcggggagcagaggtgtgaggggttcgctggtcggcgctgcgtgcgtggccgtgtgctgccttcttgccttgaacgagcacgctctgtattgactggacaattgtgctcgtactaccattattgtaggtgtagttgtgcgctgaagtgaaatgaaccgctctatgctctcgagatgagcaacgagccggtgcagttacaatttttagctgctgcgtatgctagagcagagagcccgagccgtttgaaattgta

SEQ ID NO: 8781 - DNA, 3312 bp, Zea mays
gtttccttgcgcggcggttgctgctcgcccgatctgccgccgtcagccggcgcccgatctgctcctatactgtggcgcggaggcgcggagcagcagattgtaaagctaggaatacaaatacaagatgggcgcgtcaagacccccaagcacccctgcatcgaagggtgagcacacaccgatgtcgactcctggtggcagctcaagggccaaggaggagaagatttttgttacggtgagggtgaggccactaagcaagaaggagctggctgcgaaggatgacgtggcatgggaatgcgctgatacccagacaatcttgtacaagggccccgcgcaggaccgagctgcacccatgtcttacacttttgataaagtgtttgggccagcttgccaaacagacgtggtctatgaagagggagctaaggatgttgcaatgtctgcactgacaggcattaatgccaccatttttgcatatgggcaaaccagcagtggtaaaacattcacgatgagaggcgttacagagagtgctgttagtgatatttatagacacatagatagtactcctgagagggaatttgtgataaaaatatctgctatggaaatttacaatgagattgtcaaggatcttctgcggcctgactctgctccccttcggttgttagatgatcctgagaaaggaaccattgtggagaagttgccacgcgtccggaagaaattgcgaaggatagccaacatctgaggcatctaatcagcatttgtgaagaacaaagacaggttggggagacggcactaaatgacactagttcacgttcccaccaaatcattaggctgacacttgagagcaggctccgtgaagtttcaggatgtgttaaatctttcgttgctaacctgaattttgttgaccttgctggaagtgaacgagctgcacaaacacatgccataggtgcaaggttgaaagagggttgccatataaatcgcagtttattgactttgactactgtcatcagaaagctaagttcggggaaaagaagtggacacattccctaccgggactcaaagctgacacgcattctacagctttctttgggtggaaatgcaagaacagcaatcatctgtaccatgagcccagccctgacacatgtagaacaatctagaaatactctattcttcgcaacctgtgcaaaggaagtcacaaatactgcgaaagttaatatggttatatcagataagcaattggtgaagcaccttcagacagaacttgctagactagaatcagagctgaggacccctgaccgtggctcctcttctgatatcctcataatggaaaaggacaggaagattagacagatggaaattgaaatagaggaactcaggaaacagcgagataatgcacagtcagagctcgaagaactgaggaagaagaaggttgatcaccagccagggtggaatccctttgactcgccacaaaaggcgcgaaagtgccttacattttcaggatcgctagagccaagtaacaaaaataagatgatgatgagctcgattaggcaatcatctactgctccatttatgttaaagcatgaaatccgcaagctggagcagctacaacaacagcttgaggttgaagcaaaccgcgccattgaagtacttcacaaagaagttgaatgccacaagcatggcaaccaggatgctgcggaaaccatcgctaaacttcaggcagaaatcagggagatgcaaactgttaggtctgagaacagagacatggagatgattacagatgaaggaaatggatccgatttgaaagatgagatttctagacttcatatgcaagacaatgatattgccaaacttgaggcgaagctggaaaatgtgcaacggtctattgacagattggtgatgtcacttccaaacgttgccatgccgtgtaatgagactaccccaaagtcaaacagatcaaagaagaagaagaggctgcttcttcctctgggtgtgagcaacaacatcaacagagcaaatcttctcagagcaccctgttctccccattcttctagtaggccttcggaatcagaagttgagaacagggcgccagagggtgacactatgtctgttgagggttcagaaaaggctactcccaccaagagtgaagatggagatatgtcatctcgtgatgaaacgccacgctacaggcgctccagttcagtcaatatgaaaaagatgcagaggatgttccaaaatgctgcggaagaaaacgttaggagcatcagggcttacgtgactgaactgaaggagcgagttgcaaaacttcagtaccagaagcagctgctagtctgccaggtcctggagctggaatctaacgagggcaagccgaatggagaggataattctgggcctctacaggatggtcctgattcatgggacagattattcaaagagcagatgcagtgcatcattcatctgtgggatcagtgtcaagtatcgatcatacacaggacccagttctacctgttattcaggggggacaaggctgatcagatatacatcgaggtcgaagtaagaagactcgtatggttgcagcagcactttgccgaggtcggtgatgcaagccctggtgctgttgaagaccctgcagtttcacttgtctccagtatgaaggcgctgaggaacgagcgagagttcctcgcgagaaggatgggatcaaggctgacggacgaagagcgtgagcggctcttcatcaagtggcaggtgcccctggacgcgaagcagcggaagctgcagctggtgaacaagctgtggacggaccccaacgaccaggcgcacatcgacgagagcgcggggctggtggcccggctggtgggcttctgcgagggcggcaacatcagcaaggagatgttcgagctcaacttcgccgtccccacgagcaggaggccgtggctggtgggctggcaacccatctcgaacatgatcagggagaagacccagcagctctggtgagaactgaacgcatcatggcgcagcgccgtgttgtacagatggaatggaacaagagacagacagtgcatttcggtttcagctctggaaattgctgatcaattaattgtggggggaagcgtctctacttccttcccggttgatcaaggcggacaagcggtcgtcggtctggtatccccttcctgtgtccctctgtgtagatggcgaattcgtggagtccgaagaatctgaatgatctcgcattctttacgtaatcccttgccaattttatggcaagttttgtttgcaaaaaaaaaaaaaaaaaatgatgatctggatctgatgggcccc

SEQ ID NO: 8782 - DNA, 1134 bp, Zea mays
cattgggtacctcgaggccggccgggaaaataaccatcctccctagctttcccgttccagccgtcgcgttgagttgctgccgcctcccccggtccccccacctcccgccccggcgcccctctctctctctctcttctgccgcacagagcccaaatcgcggcggatccctcgctctccagggagccgctgcggcgccgggttttgtacaccgacttgtttgcctacctccagctcctcctcggcgacccatggctctcctcgcccccgccatctccggcgaggttggtctgcggctcttattggcaccgctaagctctaacatagtcatgcgtacagccagttgtgctgttgggattggtctacctgtatactccactttcagagctatagagaagaaggatgaacaagagaaagagcggatgcttttgtattgggcagcatatggatcttttagcattgctgaagtgtttgcagataagcttctttcaagtgttcctctctattatcatgtgaagtttgctatccttgtgtggctccagttcccttcaaacagtggatcaaagcatgtatacaaaagatacctgcgcccatttttcctgaaacatcaagcaaaaattgataggtttctgaatattctgtcaaaggaacttacgaagtttgtgagcagccatgaagatgaaattcgttttatagaaaatatggctatcagaggggctacaacagcaaaccacatcgtaaatggcctcgaccaacctgaagaaacacaagcggttaatacaattgaaggtccaaatacaactgtgacagaagaagctggtgtgtcgggaactgaaacttaagcaaaactttctatctctgctcatgatcccagacgctgcttcaaaattgttgttgaggtcacccagcttgtttggattgtgaatactactgttcctgaaaggctagatctagaggcaatgttttagctttaactagatattcatatagcaagtaaaatcggtgttggacaaatttattacagtgtaaaaatgacccggtgtggaatgcagttcccagcaatgttgtcatttttcacgtgggaataatttgaagtctgcgatgaagaatctttctaaagcaaaaaaaaaaaaaaaa
